United States Patent 8,758,764 (PROTEINS AND NUCLEIC ACIDS FROM MENINGITIS/SEPSIS-ASSOCIATED ESCHERICHIA COLI) - sequence listing, part 2

SEQ ID NO: 3535 - DNA, 3108 bp, Escherichia coli
atgttttcgcgcttttttgttcgccgcccggtctttgcctgggttatcgccattttgattatgttggcggggattctggctattcgcacattgcccgtcgcgcaatatcctgacgttgcaccgccgaccattaaaatttcagccacttatactggtgcttctgccgaaacgctggagaacagcgtgactcaggttatcgagcaacaactcactgggcttgataatttactctatttcagctcaaccagtagctctgatggttcggtcagtattaatgtgacctttgaacaaggtaccgatccagatactgcacaggttcaggtgcagaataaaattcagcaggcggagtcgcgcctacccagcgaagtgcagcaaacgggtgttacggtggagaaatcacaaagcaactttttgctgattgctgccgtgtatgacaccactgacaaagcctccagttcggatatcgccgactggctggtcagtaacgttcaggaccccctggcgcgtgttgaaggtgtggggagtctgcaagtctttggcgcggaatacgccatgcgcatctggctcgacccggccaaactggcgtcttactcgctgatgccttcagacgtgcaaagtgctattgaagcgcaaaacgtgcaggttactgccgggaaaataggggcattgccttcaccgaatactcagcaactgaccgcaacggtacgtgcgcagtctcgcttgcagacggtggatcagttcaaaaatattatcgtgaaaagccagtcagacggcgcagttgttcgtataaaagatgtggctcgcgttgagatgggcagtgaagattataccgctatcggcaaacttaacggtcacccgtctgccggggttgctgtaatgctttcgcccggtgcgaatgcgctgaatacggcgacgctggtcaaggataagattgccgaattccagcggaacatgccgcagggatacgacatcgcatacccgaaagacagcactgaatttattaaaatctccgtagaggacgtaattcagacgctgtttgaagccatcgtattggtggtttgcgtgatgtatttattcctgcaaaacctgcgtgccacactgattccggcgttagctgtccccgtcgttttgctgggcacattcggcgttcttgcgttgtttggctattcgattaataccctgacgttgtttgcaatggtgctggcgatcggcttgctggtggacgatgccattgtggtggtagagaacgtcgaacgcattatgcgtgacgaagggttacccgcgcgtgaagccacggaaaaatcaatgggcgagatttctggcgcactggttgccattgcgctggtgttgtcagccgtattcctgccgatggccttctttgggggatctacgggggtaatttatcgtcagttctccatcaccatcatctccgcaatgctgctttccgtggtggtggcattgaccttgactcccgccctgtgcggttccgtcctccagcatgttccgccacataaaaaaggctttttcggcgcatttaaccgcttttatcgccgtactgaagataaatatcagcgaggcgtaatttatgtcctgcgccgtgcagcccgaacgatggggctttatgtcgtgctgggtggtggaatggccctgatgatgtggaagctgccgggcagtttcttacccactgaagaccagggcgaaatcatggtgcagtacacgctgccggccggggcgaccgctgcccgtacagcagaagtgaatcgccagattgttgactggttcctgattaacgagaaagcaaataccgatgtcatctttaccgttgatggtttcagttttagcggcagcggacagaacaccgggatggcgtttgtttcgttgaaaaactggtctcaacgtaaaggggcagaaaacaccgcccaggctatcgccctacgggctaccaaagagctgggcacaattcgtgatgccacggtatttgcgatgacgccgccagccgttgatgggctggggcaaagcaatggttttacgtttgaattgttagctaacggtggagccgatcgtgaaacactgctgcaaatgcgtaatcagttgatagaaaaagcgaatcaaagtccggagttacattctgtacgcgccaatgatttgccacaaatgccgcaattgcaggtagatattgatagtaataaagcggtgtcattagggttgagtttgaatgatgtcaccgacaccctgtccagtgcgtggggcggtacttatgtgaatgactttattgaccgtggtcgtgtgaaaaaagtctacattcagggcgacagcgaatttcgttccgcgccgtcagacttaggtaaatggtttgtgcgcggtagcgataacgccatgacaccattctctgcttttgcgaccacccgctggctgtatggaccggaaagactggtgcgctacaacggctcggcagcctatgaaattcagggcgaaaacgcgactggctttagttccggcgatgcaatgacaaaaatggaggaactggcaaacagtcttcctgcgggaacaacctgggcctggagtggtttgtcattgcaggagaaactggccagcggtcaggcattaagtctgtatgcagtttctattctggtggttttcctctgccttgcagcactgtacgaaagctggtcagtcccgttctcggtcattctggtgatccctctggggcttcttggcgcggcgctggcggcctggatgcgtgatttaaacaacgacgtttacttccaggtagcgctattaactactatcggcttgtcgtcgaaaaacgccattctgattgtggaatttgctgaagcggcggttgcagagggctattccttgagtcgtgcggcattacgcgcggcgcagactcgtttacgcccaatcatcatgacctcgctggcgtttattgcgggggtaatgccgctggcgatagcaactggcgcaggggcgaacagccgcatcgccattggtacgggcattattggtggcacgctgaccgctacattactggccattttcttcgttcctctgttttttgtactggtgaaacgtttgtttgccggtaaaccgcgccgtcaggagtaa

SEQ ID NO: 3536 - protein, 1035 aa, Escherichia coli
MFSRFFVRRPVFAWVIAILIMLAGILAIRTLPVAQYPDVAPPTIKISATYTGASAETLENSVTQVIEQQLTGLDNLLYFSSTSSSDGSVSINVTFEQGTDPDTAQVQVQNKIQQAESRLPSEVQQTGVTVEKSQSNFLLIAAVYDTTDKASSSDIADWLVSNVQDPLARVEGVGSLQVFGAEYAMRIWLDPAKLASYSLMPSDVQSAIEAQNVQVTAGKIGALPSPNTQQLTATVRAQSRLQTVDQFKNIIVKSQSDGAVVRIKDVARVEMGSEDYTAIGKLNGHPSAGVAVMLSPGANALNTATLVKDKIAEFQRNMPQGYDIAYPKDSTEFIKISVEDVIQTLFEAIVLVVCVMYLFLQNLRATLIPALAVPVVLLGTFGVLALFGYSINTLTLFAMVLAIGLLVDDAIVVVENVERIMRDEGLPAREATEKSMGEISGALVAIALVLSAVFLPMAFFGGSTGVIYRQFSITIISAMLLSVVVALTLTPALCGSVLQHVPPHKKGFFGAFNRFYRRTEDKYQRGVIYVLRRAARTMGLYVVLGGGMALMMWKLPGSFLPTEDQGEIMVQYTLPAGATAARTAEVNRQIVDWFLINEKANTDVIFTVDGFSFSGSGQNTGMAFVSLKNWSQRKGAENTAQAIALRATKELGTIRDATVFAMTPPAVDGLGQSNGFTFELLANGGADRETLLQMRNQLIEKANQSPELHSVRANDLPQMPQLQVDIDSNKAVSLGLSLNDVTDTLSSAWGGTYVNDFIDRGRVKKVYIQGDSEFRSAPSDLGKWFVRGSDNAMTPFSAFATTRWLYGPERLVRYNGSAAYEIQGENATGFSSGDAMTKMEELANSLPAGTTWAWSGLSLQEKLASGQALSLYAVSILVVFLCLAALYESWSVPFSVILVIPLGLLGAALAAWMRDLNNDVYFQVALLTTIGLSSKNAILIVEFAEAAVAEGYSLSRAALRAAQTRLRPIIMTSLAFIAGVMPLAIATGAGANSRIAIGTGIIGGTLTATLLAIFFVPLFFVLVKRLFAGKPRRQE

SEQ ID NO: 3537 - DNA, 1122 bp, Escherichia coli
atgaagtatatagcaacatctgtagtggcaatgctgctcttatcgggttgtgataatacgcaaagtaacaattcatccccgtcagaaacagaagtcggcgttgttacgctcaaatctcaaccggtttcggtagtcagtgaattaaccggacgcaccagtgctgcgctcagtgctgaagtacgtccgcaggttgggggaattatccagaaacgcttatttaaggaaggtgatctggtcaaggctggacagcctctctaccagattgatgcggccagttatcaggctgcatggaatgaagcccgggcagcattacaacaagcacaggcactggtaaaagccgattgccagaaagcgcagcgttatacccgactggtgaaagagaacggtgtttcacaacaggatgctgatgatgctcagtctacctgtgcacaagataaagccagtgtagaggcgaaaaaagccgcactggaaactgcgcgcattaatcttgactggaccacggtaaccgcaccgatttcggggcgtattggcatttcgtcggtaacccctggcgcactggtgaccgcgtcgcaggatacagcgttaacgactattcgtggtctggatacaatgtatgtcgacctcactcgctccagtgtcgatttattacgtctgcgtaaacagtcactggcgaccaacagtgacaccatgagcgtctcacttattctggaagatggcacaacctacagcgaaaaagggcgtctggaactcaccgaagtcgcggtggatgagtctaccggttcggtgacattacgggcaattttccccaatccacaacagcagttattaccgggaatgtttgttcgcgctcgtgtcgatgaaggcgtgatggaagacgctattctcgcgcctcaacagggcgttacgcgcgatgctaaaggcaatgcaactgcgctggtggtgaataaagacaataaagtagagcagcgaacgctcgaaacgggagaaacgtatggtgataaatggctggtgctgaacggcctgcacaacggcgaccgactgattgttgaaggttctgccaaagtcacttcagggcagaccgtcaaggctgttgaagttcaggctaatggaggcaacgcctga

SEQ ID NO: 3538 - protein, 373 aa, Escherichia coli
MKYIATSVVAMLLLSGCDNTQSNNSSPSETEVGVVTLKSQPVSVVSELTGRTSAALSAEVRPQVGGIIQKRLFKEGDLVKAGQPLYQIDAASYQAAWNEARAALQQAQALVKADCQKAQRYTRLVKENGVSQQDADDAQSTCAQDKASVEAKKAALETARINLDWTTVTAPISGRIGISSVTPGALVTASQDTALTTIRGLDTMYVDLTRSSVDLLRLRKQSLATNSDTMSVSLILEDGTTYSEKGRLELTEVAVDESTGSVTLRAIFPNPQQQLLPGMFVRARVDEGVMEDAILAPQQGVTRDAKGNATALVVNKDNKVEQRTLETGETYGDKWLVLNGLHNGDRLIVEGSAKVTSGQTVKAVEVQANGGNA

SEQ ID NO: 3539 - DNA, 567 bp, Escherichia coli
atgaccagcaagctggagatacgccacaaacagcgtcaggatgaaatcattaacgccgcccgtcggtgttttcgtcgctgcggatttcatgccgccagtatgtcgcaaattgccagcgaagctcagcttagcgtgggtcagatatatcgttacttcgccaacaaagacgccattattgaagagatggttcgtcgtatcatcgactttcgtattgcccaaatggacattgacgcgcgtaccgatcacttcccggaagtccttgccttgcgtaaatccttaaatgaggacgacgacgcgctgatgctggaagtggctgcagaagccacacgcaacccgcgggttatggcaatgcttgaagaagctgacgccagaatgttcgctaacggttgtgcacatatgaaaagaatgcatccccatcttagcgacgagcacattcgttgctgcgttgaagtgtttgctaccatgatggaaggtacggtttatcgtcgtttaacaccgcaaaaaagcgatccacaacatctgcaggaaatatatcaggatattgttagtatgttgataaataaataa

SEQ ID NO: 3540 - protein, 188 aa, Escherichia coli
MTSKLEIRHKQRQDEIINAARRCFRRCGFHAASMSQIASEAQLSVGQIYRYFANKDAIIEEMVRRIIDFRIAQMDIDARTDHFPEVLALRKSLNEDDDALMLEVAAEATRNPRVMAMLEEADARMFANGCAHMKRMHPHLSDEHIRCCVEVFATMMEGTVYRRLTPQKSDPQHLQEIYQDIVSMLINK

SEQ ID NO: 3541 - DNA, 789 bp, Escherichia coli
atgggttttctttccggtaagcgcattctggtaaccggtgttgccagcaaactgtccatcgcctacggtatcgctcaggcgatgcaccgcgaaggagctgaactggcattcacctaccagaacgacaaactgaaaggccgcgtagaagaatttgccgctcaattgggttctgacatcgttctgcagtgcgatgttgccgaagatgccagcatcgacaccatgttcgctgaactggggaaagtttggccgaaatttgacggtttcgtacactctattggttttgcacctggcgatcagctggatggtgactatgttaacgccgttacccgtgaaggcttcaaaattgcccacgacatcagctcctacagcttcgttgcaatggcaaaagcttgccgctccatgctgaatccgggttctgccctgctgaccctttcctaccttggcgctgagcgcgctatcccgaactacaacgttatgggtctggcaaaagcgtctctggaagcgaacgtgcgctatatggcgaacgcgatgggtccggaaggtgtgcgtgttaacgccatctctgcgggtccgatccgtactctggcggcttccggtatcaaagacttccgcaaaatgctggctcattgcgaagccgttaccccgattcgccgtaccgttactattgaagatgtgggtaattccgcggcattcctgtgctccgatctctctgccggtatctccggtgaagtggtccacgttgacggcggtttcagcatcgctgcaatgaacgaactcgaactgaaataa

SEQ ID NO: 3542 - protein, 262 aa, Escherichia coli
MGFLSGKRILVTGVASKLSIAYGIAQAMHREGAELAFTYQNDKLKGRVEEFAAQLGSDIVLQCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGISGEVVHVDGGFSIAAMNELELK

SEQ ID NO: 3543 - DNA, 1128 bp, Escherichia coli
atggaacaacgccacatcaccggcaaaagccactggtatcatgaaacgcaatccagtactgcggagtatgacgttctgcctctggtcccggaagccgcaaaggtcagcgatccctttctgctcgacgtgatccttgatgaagaaacgctggcacccttcctttcatggctggtccctgcgcgcgttcttgcagtagagttgttccctgacccgcttaccgtgacccgttcacagaccttcaccgcttatgaacgcttgtcgacggccctgacggttgctcaggtttgcggcgtccaacggttatgtaactactattcggcgcgacttacgccgctccccgggcctgattcctccagggaaagtaatcatcggttggcacaaatcacgcaatatgcccgccaactggctagctcgccttctattatcgacaaccgatcgcgccagcatctgaatgacgttggtcttactgtctgtgactgtgtgatcattaaccaaatcattggttttattggctttcaggcgcggacaattgcgacatttcaggcttatctcgggcatccagtacgctggttacccgggctggagatacaaaactacgccgacgcgtcactgtttgctgatgaatcattacgctggcgaagcagctatgaggtggaaaaactccctgaagagcacacaaaaagttcaactgcagaactttgccaactggccaacacactctctctccaccctatttcactttcccttctcgaaaagttgttaaacagcacacgggtcaatacacagccgggtaacctgcttgcggcgttgttatgcgcgcggataaatggcagtcctgcttgttttgccgcctgtatgaattcatcaaatgaatataaaaaaatcagcccccttctgcgcaagggcgaaaatgaaattaaccgatgggctgaccgtcattctgttgagcgcgctaccgttcaggcgatacaatggctgacccgagcacccgatcgctttagcgccgcccagttcagcccattactcgaacacgaaaaatcatcaacgcagattattaatctgctggtatggagcgggctgtgtggctggataaatcgcttaaaaatcgcgttgggtgagacatattaa

SEQ ID NO: 3544 - protein, 375 aa, Escherichia coli
MEQRHITGKSHWYHETQSSTAEYDVLPLVPEAAKVSDPFLLDVILDEETLAPFLSWLVPARVLAVELFPDPLTVTRSQTFTAYERLSTALTVAQVCGVQRLCNYYSARLTPLPGPDSSRESNHRLAQITQYARQLASSPSIIDNRSRQHLNDVGLTVCDCVIINQIIGFIGFQARTIATFQAYLGHPVRWLPGLEIQNYADASLFADESLRWRSSYEVEKLPEEHTKSSTAELCQLANTLSLHPISLSLLEKLLNSTRVNTQPGNLLAALLCARINGSPACFAACMNSSNEYKKISPLLRKGENEINRWADRHSVERATVQAIQWLTRAPDRFSAAQFSPLLEHEKSSTQIINLLVWSGLCGWINRLKIALGETY

SEQ ID NO: 3545 - DNA, 1935 bp, Escherichia coli
atgtttcaggacaacccgctgctagcgcagcttaaacagcaactgcattcccagacgccacgcgctgaaggggtggtaaaagccacagaaaaaggctttggcttcctggaagtcgacgcgcaaaaaagttatttcattccgccgccgcagatgaaaaaagtcatgcatggcgaccgaattatcgcggtgatccacagtgaaaaagaacgtgaatccgcagagccagaagaactggttgaaccgttcctgactcgtttcgtgggtaaagttcagggcaaaaatgaccgtctggccatcgttcctgatcatccactcttaaaagacgccattccttgccgcgcagcccgtggcctgaaccacgagtttaaagaaggcgactgggcggttgccgaaatgcgccgtcatccgctgaaaggcgatcgttctttctatgctgaactgacacaatacatcacttttggtgacgatcactttgtaccgtggtgggttacccttgcgcgtcataatctggaaaaagaagcaccagacggcgtcgctaccgaaatgctcgatgaaggtctggttcgtgaagatctgactgcgctggattttgtcaccatcgacagtgccagcacagaagatatggatgacgcccttttcgccaaggcgttaccggatggcaaacttcagctgattgtggcgattgccgatccaaccgcgtggattgctgaaggcagcaagctggacaaagccgcgaaaattcgcgcattcaccaactatctgcctggcttcaacatccctatgctgcctcgcgagctttctgacgatctctgctcactgcgcgccaatgaagtccgcccggtactggcatgccgcatgacgttctccactgatggcaccattgaagataatatcgaattctttgccgccaccatcgaatccaaagcgaagctggtgtatgaccaggtttctgactggctggaaaataccggtgactggcagcctgaaagcgaagcaattgccgaacaagtccgtttgctagcgcaaatatgccaacgccgcggcgagtggcgtcataaccacgcactggtgtttaaagatcgcccggattaccgctttattctcggtgaaaaaggtgaagtgctggatatcgtcgccgagcctcgtcgcattgccaaccgtatcgtcgaagaagcgatgattgccgctaacatttgtgcggcccgcgtactgcgcgataagctcggttttggcatctataacgtgcatatgggctttgatccggcgaatgccgacgcgttggcagcgttgctgaaaacgcacggtctgcatgtcgatgctgaagaagtgctcacgctggacggtttctgcaaactgcgtcgtgaactggatgcgcaaccaactggtttcctcgacagccgcattcgtcgcttccagtcatttgctgaaattagcactgaacccggtcctcactttggcctcggtctggaagcatacgccacctggacttcgccgatccgtaaatatggcgacatgatcaaccaccgtctgctgaaagcggttatcaaaggcgaaactgcgacgcgtccacaggatgaaatcactgtccaaatggccgagcgtcgccgtctcaaccggatggcagaacgtgatgttggcgactggttatacgcacgcttcctgaaagacaaagccgggaccgacacccgtttcgcggcggaaattgtcgatatcagccgtggcggcatgcgtgttcgtttggttgataacggcgctatcgcctttattccagcacctttcttacacgctgtgcgcgatgaactggtttgcagccaggaaaacggcactgtacaaattaaaggtgaaacggcttacaaagtgactgacgttattgacgtcaccattgccgaagtccgcatggaaacccgcagcattattgcgcgcccggtcgcgtaa

SEQ ID NO: 3546 - protein, 644 aa, Escherichia coli
MFQDNPLLAQLKQQLHSQTPRAEGVVKATEKGFGFLEVDAQKSYFIPPPQMKKVMHGDRIIAVIHSEKERESAEPEELVEPFLTRFVGKVQGKNDRLAIVPDHPLLKDAIPCRAARGLNHEFKEGDWAVAEMRRHPLKGDRSFYAELTQYITFGDDHFVPWWVTLARHNLEKEAPDGVATEMLDEGLVREDLTALDFVTIDSASTEDMDDALFAKALPDGKLQLIVAIADPTAWIAEGSKLDKAAKIRAFTNYLPGFNIPMLPRELSDDLCSLRANEVRPVLACRMTFSTDGTIEDNIEFFAATIESKAKLVYDQVSDWLENTGDWQPESEAIAEQVRLLAQICQRRGEWRHNHALVFKDRPDYRFILGEKGEVLDIVAEPRRIANRIVEEAMIAANICAARVLRDKLGFGIYNVHMGFDPANADALAALLKTHGLHVDAEEVLTLDGFCKLRRELDAQPTGFLDSRIRRFQSFAEISTEPGPHFGLGLEAYATWTSPIRKYGDMINHRLLKAVIKGETATRPQDEITVQMAERRRLNRMAERDVGDWLYARFLKDKAGTDTRFAAEIVDISRGGMRVRLVDNGAIAFIPAPFLHAVRDELVCSQENGTVQIKGETAYKVTDVIDVTIAEVRMETRSIIARPVA

SEQ ID NO: 3547 - DNA, 1986 bp, Escherichia coli
atgaaaaccgttagggagtccacaacgttgtacaactttctcggatcgcacaatccatactggcggttgacggaaagcagcgatgttttgcgcttttctaccaccgaaatcacagaacccgatcgtattttgcaactatctgccgaacaggctgctcgcatcagggaaatgacggtcatcacctccagcctgatgatgagtctgaccgtcgatgaaagcgatctttctgtgcatctggtaggacgaaaaatcaataaacgagaatggggaggcaacgcgtctgcatggcatgacacaccggcggttgctcgtgatttatcacatgggctttcctttgctgagcaggtagtttctgaagcacattccgcaatagtgattctcgacagccgggggaatatccagcgctttaatcggttatgtgaagattacacaggcttgaaagaacacgacgtcattgggcaaagcgtgtttaaactgtttatgagtcgtcgtgaagctgcggcatccaggcgcaataaccgtgtattttttcgaagcggcaatgcatatgaagtcgaactatggataccaacacgtaaaggccagcggctgtttctgtttcgcaataaatttgtccacagcggcagtggcaaaaacgagatttttttaatctgttccggcaccgacattaccgaagagcgccgcgctcaggagcgactgcgtattctggcaaataccgacagtatcaccggactgccgaatcgtaacgcgatgcaggagttaatcgatcacgctattaatcaggcagataacaataaagttggggttgtgtatcttgatttggataattttaaaaaggtcaacgacgcctatgggcatttgtttggtgaccagttattacgcgacgtgtcattggctattttaagctgtctcgaacatgaccaggtgttggcgcgtccaggtggcgatgagtttctggtactggcatccaatacctcacaaagcgcgctggaagcattggcatcacgaattttgacccgcttacgactcccctttcgcattggtttaattgaagtttataccagctgttcagtaggtatttcactctctcccgaacatggttcggacagcgcggctattattcgtcacgccgacacagcaatgtacacagcgaaggaaggcggacgaggacaattttgcgtttttaccccagaaatgaatcagcgggtatttgaatatctctggctggataccaacttgcgtaaagcactggaaaacgatcagttggttattcactatcaaccgaaaatcacctggcgtggcgaagtgcgcagtctggaagcactagtacgttggcagtcacctgaacgtgggttgattccaccgttggacttcatttcctacgccgaagaatcagggctaattgtgcctttaggccgttgggtgattctcgatgtcgtacgccaggtagcgaagtggcgggataaaggcattaacctgcgagtggcggtaaatatttctgcacgtcagctcgccgatcaaaccattttcaccgccctgaaacaggttctccaggaactcaattttgaatactgccctataggtgttgaactgacggagagctgcctgattgagaatgatgaactggcactgtctgttattcaacaatttagccgattaggtgcgcaagttcatctggacgattttggtaccggctactcttcactttcgcaactggcgcgctttccgatcgatgccatcaaacttgaccaggtttttgttcgggatattcacaaacagcctgtctcgcaatcactggtccgggcgatcgtcgctgtggcccaggcattgaatcttcaggtgatcgccgaaggtgtagaaagtgcaaaggaagatgcttttttaaccaagaacgggatcaatgagcgacaaggatttttgtttgccaaaccgatgcccgccgttgccttcgaacgctggtataaacgctacctgaagcgcacataa

SEQ ID NO: 3548 - protein, 661 aa, Escherichia coli
MKTVRESTTLYNFLGSHNPYWRLTESSDVLRFSTTEITEPDRILQLSAEQAARIREMTVITSSLMMSLTVDESDLSVHLVGRKINKREWGGNASAWHDTPAVARDLSHGLSFAEQVVSEAHSAIVILDSRGNIQRFNRLCEDYTGLKEHDVIGQSVFKLFMSRREAAASRRNNRVFFRSGNAYEVELWIPTRKGQRLFLFRNKFVHSGSGKNEIFLICSGTDITEERRAQERLRILANTDSITGLPNRNAMQELIDHAINQADNNKVGVVYLDLDNFKKVNDAYGHLFGDQLLRDVSLAILSCLEHDQVLARPGGDEFLVLASNTSQSALEALASRILTRLRLPFRIGLIEVYTSCSVGISLSPEHGSDSAAIIRHADTAMYTAKEGGRGQFCVFTPEMNQRVFEYLWLDTNLRKALENDQLVIHYQPKITWRGEVRSLEALVRWQSPERGLIPPLDFISYAEESGLIVPLGRWVILDVVRQVAKWRDKGINLRVAVNISARQLADQTIFTALKQVLQELNFEYCPIGVELTESCLIENDELALSVIQQFSRLGAQVHLDDFGTGYSSLSQLARFPIDAIKLDQVFVRDIHKQPVSQSLVRAIVAVAQALNLQVIAEGVESAKEDAFLTKNGINERQGFLFAKPMPAVAFERWYKRYLKRT

SEQ ID NO: 3549 - DNA, 183 bp, Escherichia coli
atgtccttgatgtctgaatttgatgcccagcgcgttgccgaacgtattgatattgtgttagatatccttgtggcaggcgattaccactctgcgatccataatctcgagatacttaaagcagaactcttgcgccaggttgctgaatctacgccagacatcccgaaggcaccgtgggagatctaa

SEQ ID NO: 3550 - protein, 60 aa, Escherichia coli
MSLMSEFDAQRVAERIDIVLDILVAGDYHSAIHNLEILKAELLRQVAESTPDIPKAPWEI

SEQ ID NO: 3551 - DNA, 750 bp, Escherichia coli
atgaattcccgacaacaaactattctacagatggtcattgaccagggtcaggttagcgtaaccgatctggcaaaagccactggagtttctgaagttaccattcgccaggatctcaacaccctcgaaaaactgagttacctccgacgtgcacatggttttgcagtttcgcttgatagtgatgacgtcgaaacccgtatgatgagcaactatacgctgaagcgtgaactcgccgagtttgccgcgtcactggttcaaccgggcgaaaccatctttatcgaaaatggtagcagcaatgccctgctcgccaggactctgggcgagcagaagaaaaatgtcactatcatcacggtcagcagctacatcgcgcatttgctgaaagacgcgccttgtgaagtcattttgctcggtggcgtgtaccagaaaaaaagcgaaagtatggttggccctttgacacgccagtgcatccaacaggtgcatttcagcaaagcatttattggtattgatggctggcaacctgaaactgggtttaccggtcgcgatatgatgcgtaccgatgtggtcaatgccgtgctggaaaaagagtgcgaggcgatagtcctgactgacagctcgaaatttggtgctgtacattcatactccatcggccccgttgagcgattcaatcgtgtgattaccgattcgaaaatacgcgccagcgatctgatgcatcttgaacaaagtaaactcaccgttcacgtcgttgacatttaa

SEQ ID NO: 3552 - protein, 249 aa, Escherichia coli
MNSRQQTILQMVIDQGQVSVTDLAKATGVSEVTIRQDLNTLEKLSYLRRAHGFAVSLDSDDVETRMMSNYTLKRELAEFAASLVQPGETIFIENGSSNALLARTLGEQKKNVTIITVSSYIAHLLKDAPCEVILLGGVYQKKSESMVGPLTRQCIQQVHFSKAFIGIDGWQPETGFTGRDMMRTDVVNAVLEKECEAIVLTDSSKFGAVHSYSIGPVERFNRVITDSKIRASDLMHLEQSKLTVHVVDI

SEQ ID NO: 3553 - DNA, 219 bp, Escherichia coli
atgtttgtaacgagcaaaaaaatgaccgcggctgttctggcaattaccctggcaatgtctctgagtgcctgttctaactggtctaaacgggaccgcaacaccgcaatcggcgcaggtgcaggggcattaggcggtgcagtactgaccgatggcagtacgttgggtacattaggtggtgcagccgtcggtggtgttattggtcaccaggtcggtaaataa

SEQ ID NO: 3554 - protein, 72 aa, Escherichia coli
MFVTSKKMTAAVLAITLAMSLSACSNWSKRDRNTAIGAGAGALGGAVLTDGSTLGTLGGAAVGGVIGHQVGK

SEQ ID NO: 3555 - DNA, 327 bp, Escherichia coli
atgagtgattccaacagccgtctggtctactcaacggaaaccggacgtattgatgagccaaaagcggcccctgtacgccctaaaggcgacggtgtggtgcgtattcagcgtcagaccagtggacgtaaaggtaagggcgtttgcctgattaccggtgtcgctctcgatgatgccgaactgacgaaactggcagcggaactgaagaaaaaatgcggctgcggcggagcagttaaagatggaattattgaaatccagggcgataagcgtgatttattaaaatcactgcttgaagcgaaagggatgaaggtaaaactcgcaggcggctaa

SEQ ID NO: 3556 - protein, 108 aa, Escherichia coli
MSDSNSRLVYSTETGRIDEPKAAPVRPKGDGVVRIQRQTSGRKGKGVCLITGVALDDAELTKLAAELKKKCGCGGAVKDGIIEIQGDKRDLLKSLLEAKGMKVKLAGG

SEQ ID NO: 3557 - DNA, 798 bp, Escherichia coli
atgctcgccgtttacctgtttcgcgccacttccggtgcccatcatcaagaaggtctggtcatgacgttaactgcttcatcttcttcccgcgctgttacgaattctcctgtagttgttgcccttgattatcataatcgcgatgccgcgatggcctttgtcgacaagatcgacccacgcgattgtcgtctgaaggtcggcaaagagatgtttacattgtttgggccacagtttgtgcgcgaacttcaacagcgtggttttgatatctttcttgacctgaaattccacgatattcccaacactgcagcgcacgctgtcgctgctgcggctgacttaggcgtgtggatggtgaatgttcatgcctccggtggggcgcgtatgatgaccgcagcgcgtgaggcactggttccgtttggcaaagatgcaccgcttttgattgctgtgacagtgttgaccagcatggaagccagcgacctggccgatcttggcgtgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgatgctggtgaccagcgccgcattatgacgccagaacaggcgttggcggctggtgttgattatatggtgattggtcgcccggtaacgcaatcggtagatccagcgcagacgctgaaagcgatcaacgcctctttacagcggagtgcatga

SEQ ID NO: 3558 - protein, 265 aa, Escherichia coli
MLAVYLFRATSGAHHQEGLVMTLTASSSSRAVTNSPVVVALDYHNRDAAMAFVDKIDPRDCRLKVGKEMFTLFGPQFVRELQQRGFDIFLDLKFHDIPNTAAHAVAAAADLGVWMVNVHASGGARMMTAAREALVPFGKDAPLLIAVTVLTSMEASDLADLGVTLSPADYAERLAALTQKCGLDGVVCSAQEAVRFKQVFGQEFKLVTPGIRPQGSDAGDQRRIMTPEQALAAGVDYMVIGRPVTQSVDPAQTLKAINASLQRSA

SEQ ID NO: 3559 - DNA, 156 bp, Escherichia coli
ttgatgatgggcaccggaagtggcgcgaaacaggtaaacggcgagcattctacccgtggaaataaaaaattaacagttgcgatttctcctctggcaggcttttccgcgccgtcggtgccggagcacaatagaacatcaataattagtatgttgtaa

SEQ ID NO: 3560 - protein, 51 aa, Escherichia coli
MMMGTGSGAKQVNGEHSTRGNKKLTVAISPLAGFSAPSVPEHNRTSIISML

SEQ ID NO: 3561 - DNA, 1170 bp, Escherichia coli
atgctggagttgttgtttctgcttttgcctgtagccgctgcctatggctggtatatgggccgcagaagtgcgcaacaaaacaagcaagatgaagccaaccgcttgtcgcgtgattacgtagcgggggttaacttcctgcttagtaatcaacaggataaagcggtagacctgtttctcgatatgcttaaagaggatacaggtaccgttgaagcccaccttacgctcggaaacctgttccgttcgcgtggcgaagttgatcgcgctattcgcatccatcagaccctaatggaaagcgcctcgctgacctatgaacagcggcttttggcgattcaacaattggggcgtgattacatggctgccgggttatacgaccgcgcggaagacatgttcaatcagctgaccgatgaaactgacttccgcattggcgcgctgcaacaactgctacaaatttaccaggctaccagcgagtggcagaaagcaattgatgttgccgaacgcctggtgaagctgggtaaagataaacagcgcgtcgaaattgcccatttctactgtgagttagctctgcagcatatggccagcgacgatctcgatcgtgccatgactttgctaaaaaaaggtgcggcggcagataaaaacagcgcccgcgtatccatcatgatgggacgcgtgtttatggcgaaaggagaatacgccaaagccgtcgaaagtttgcaacgtgtcatatcccaggacagagaactggtcagcgaaacgctggaaatgctgcaaacatgctatcagcagttgggtaaaactgccgaatgggcagaattcctgcagcgcgcggtggaagagaacaccggtgccgatgctgaattgatgcttgcggatatcatcgaagcgcgcgacggtagtgaggccgcacaggtctatattactcgccagcttcagcgtcatccgaccatgcgtgtgttccataagttaatggattaccacttaaatgaagcagaagaagggcgtgccaaagagagtctgatggtgctgcgtgacatggttggcgagaaggtacgtagtaagccccgttatcgctgccagaaatgtggttttaccgcatacaccctctactggcattgtccgtcttgtcgggcctggtcaaccattaaaccaattcgcggtcttgatggcctgtaa

SEQ ID NO: 3562 - protein, 389 aa, Escherichia coli
MLELLFLLLPVAAAYGWYMGRRSAQQNKQDEANRLSRDYVAGVNFLLSNQQDKAVDLFLDMLKEDTGTVEAHLTLGNLFRSRGEVDRAIRIHQTLMESASLTYEQRLLAIQQLGRDYMAAGLYDRAEDMFNQLTDETDFRIGALQQLLQIYQATSEWQKAIDVAERLVKLGKDKQRVEIAHFYCELALQHMASDDLDRAMTLLKKGAAADKNSARVSIMMGRVFMAKGEYAKAVESLQRVISQDRELVSETLEMLQTCYQQLGKTAEWAEFLQRAVEENTGADAELMLADIIEARDGSEAAQVYITRQLQRHPTMRVFHKLMDYHLNEAEEGRAKESLMVLRDMVGEKVRSKPRYRCQKCGFTAYTLYWHCPSCRAWSTIKPIRGLDGL

SEQ ID NO: 3563 - DNA, 309 bp, Escherichia coli
gtgaaatatttactcattttcttactggtgttagcgatcttcgtgatttcggtcacgttgggtgcgcagaacgatcaacaggtgacgtttaattatctgttagcgcaaggggagtaccgtatttccacattgctggcggtattgtttgctgcggggtttgctatcggttggttgatttgtggcctgttctggctgcgagttcgtgtttccctggcgcgcgctgaacgtaaaataaagcgactggaaaaccagctttcacccgcgactgacgtggctgtagcgccgcactcgtctgcgtcgaaggaataa

SEQ ID NO: 3564 - protein, 102 aa, Escherichia coli
MKYLLIFLLVLAIFVISVTLGAQNDQQVTFNYLLAQGEYRISTLLAVLFAAGFAIGWLICGLFWLRVRVSLARAERKIKRLENQLSPATDVAVAPHSSASKE

SEQ ID NO: 3565 - DNA, 765 bp, Escherichia coli
atgcgttcgattgccagacgtaccgcagtgggagctgcactattgcttgtcatgccagtagccgtatggctttctggctggcgttggcaacctggagaacaaagttggttactaaaagcggctttttgggttactgaaactgtcacccagccttggggcgtcattacacatttgattttattcggctggtttctctggtgtctgcgttttcgcattaaggctgccattatgttatttgccattctggcggcggcaatccttatgggacaaggcgttaaatcctggatcaaagacaaagtccaggaaccacgaccttttgttatctggctggaaaaaacacatcatattccggttgatgagttctacactttaaagcgagcagaacgcggaaatctggtgaaagaacagttggctgaagagaaaaatatcccacaatatttgcgttcacactggcagaaagagacggggtttgcctttccttccggtcacacgatgtttgctgccagttgggcactgctggccgttggtttgctgtggccgcgtcggcgaacgttaaccattgctatcttgttggtctgggcaacgggagtcatgggaagccgcctgctgctcgggatgcattggccacgcgatctggttgtagctacgttgatttcgtgggcgctggtggcggcggcaacgtggcttgcgcaacgaatttgtgggccattaacaccacctgcggaagaaaatcgcgaaattgcacaacgagaacaagaaagttaa

SEQ ID NO: 3566 - protein, 254 aa, Escherichia coli
MRSIARRTAVGAALLLVMPVAVWLSGWRWQPGEQSWLLKAAFWVTETVTQPWGVITHLILFGWFLWCLRFRIKAAIMLFAILAAAILMGQGVKSWIKDKVQEPRPFVIWLEKTHHIPVDEFYTLKRAERGNLVKEQLAEEKNIPQYLRSHWQKETGFAFPSGHTMFAASWALLAVGLLWPRRRTLTIAILLVWATGVMGSRLLLGMHWPRDLVVATLISWALVAAATWLAQRICGPLTPPAEENREIAQREQES

SEQ ID NO: 3567 - DNA, 591 bp, Escherichia coli
atgcagcttaaacgtgtggcagaagccaaactgccaaccccatggggcgatttcctgatggtgggatttgaagaactggcaaccggacacgatcatgtcgcgctagtctatggcgatatttccgggcataccccggtacttgcgcgcgtccattccgaatgtctgaccggtgacgccctgttcagcttgcgctgcgattgtggcttccagctcgaagcggcattgacgcaaattgccgaggaaggccgtggtattttgctgtatcaccgtcaggaaggtcgtaacattggtctgctgaataaaatccgcgcttacgcactgcaggatcaaggttacgatactgtagaggctaaccaccagttaggcttcgccgctgatgagcgcgacttcactctttgcgctgatatgttcaaactccttggcgtcaatgaagtccgcttgttaaccaataacccgaaaaaagtcgaaattctgaccgaagcagggattaatattattgaacgcgtaccgttgattgtaggtcgtaaccccaataacgaacattatctcgataccaaagccgagaaaatgggtcatttgctgaacaaataa

SEQ ID NO: 3568 - protein, 196 aa, Escherichia coli
MQLKRVAEAKLPTPWGDFLMVGFEELATGHDHVALVYGDISGHTPVLARVHSECLTGDALFSLRCDCGFQLEAALTQIAEEGRGILLYHRQEGRNIGLLNKIRAYALQDQGYDTVEANHQLGFAADERDFTLCADMFKLLGVNEVRLLTNNPKKVEILTEAGINIIERVPLIVGRNPNNEHYLDTKAEKMGHLLNK

SEQ ID NO: 3569 - DNA, 2676 bp, Escherichia coli
atgtcgtcaaccctacgagaagccagtaaggacacgttgcaggccaaagataaaacttaccactactacagcctgccgcttgctgccaaatcactgggcgatatcacccgtctgcccaagtcactcaaagttttgctcgaaaacctgctgcgttggcaggatggtaaatcggttaccgaagaggatatccacgcgctggcgggatggctgaaaaatgcccatgctgaccgtgaaattgcctaccgcccggcaagagtgctgatgcaggactttaccggcgtacctgccgttgttgatctggcggcaatgcgcgaagcggttaaacgcctcggcggcgatactgcaaaggttaacccactctcaccggtcgacctggtcattgaccactcggtgaccgtcgatcgttttggtgatgatgaggcatttgaagaaaacgtacgcctggaaatggagcgcaaccacgaacgttatgtgttcctgaaatggggaaagcaggcgttcagtcggtttagcgtcgtgccgccaggcacaggcatttgccatcaggttaacctcgaatatctcggcaaagcagtgtggagcgaattgcaggacggtgaatggattgcttatccggatacactcgttggtactgactcgcacaccaccatgatcaacggccttggcgtgctggggtggggcgttggtggcatcgaagcagaagccgcaatgttaggccagccggtttccatgcttatcccggacgtagtgggctttaaacttaccggaaaattacgtgaaggtattaccgccacagacctggttctcactgttacccaaatgttgcgcaaacatggcgtggtggggaaattcgtcgaattttatggtgatgggctggattcactgccgctggcggatcgcgccaccattgccaatatgtcgccagaatatggtgccacctgtggcttcttcccaatcgatgctgtcaccctcgattacatgcgtttaagcgggcgcagtgaagatcaggtcgagttggtcgaaaaatatgccaaagcgcagggcatgtggcgtaatccgggcgatgaaccaatttttaccagtgtgttagaactggatatgaatgacgttgaagcgagcctggcagggccaaaacgcccgcaggatcgcgttgcattgcccgatgtaccaaaagcatttgctgccagtagagaactggaagtgaatgccacgcataaagatcgcctgccggtcgattatgttatgaacggacatcagtatcagttacctgatggcgctgttgtcattgctgcgataacgtcgtgcaccaacacctctaacccaagtgtgttgatggccgcaggcttgctggcgaaaaaagccgtaactctgggcctcaagcggcaaccgtgggtcaaagcgtcgctggcaccgggttcgaaagtcgtttctgattatctggcaaaagcgaaactgacaccgtatctcgatgaactgggatttaaccttgtgggatacggttgtaccacctgtattggtaactctggaccgttgcccgatcctatcgaaacggcaatcaaaaaaggcgatttaaccgtcggtgcagtgctgtccggcaaccgtaactttgaaggccgtatccatccgctggttaaaaccaactggctggcctcgccgccgctggtggttgcctatgcgctggcgggaaatatgaatatcaacctggcttctgagcctatcggccatgatcgcaaaggcgagccggtatatctgaaagatatctggccatcggcacaagaaattgcccgtgcggtagaccaagtctccacagaaatgttccgcaaagagtacgcagaagtttttgaaggcacagccgagtggaaggaaattaacgtcacacgatccgatacctacggttggcaggaggattcaacctatattcgcttatcgcctttctttgatgaaatgcaggcaacaccagcacctgtggaagatattcacggtgcgcggatcctcgcaatgctgggggattcagtcaccactgaccatatctctccggcgggcagtattaagcccgacagcccggcgggtcgatatctacaaggtcggggtgttgagcggaaagactttaactcctatggttcgcggcgtggtaaccatgaagtgatgatgcgcggcaccttcgccaatattcgcatccgtaatgaaatggtgcctggcgttgaaggggggatgacgtgccatttacctgacagcgatgtcgtctctatttatgatgccgcaatgcgctataagcaggagcaaacgccgctggcggtgattgccgggaaagagtatggatcaggctccagccgtgactgggcggcaaaaggtccgcgtctgcttggtattcgtgttgtgattgccgaatcgtttgaacgaattcaccgttcgaatttaattggcatgggcatcctgccgctggaatttccacaaggtgtgacgcgtaaaacgttagagcttaccggggaagagaagattgatattggtgatctgcaaaatctacaacccggcgcgacggttccggtgacgcttacgcgcgcggatggtagccaggaagtcgtaccctgccgttgtcgtatcgacaccgcgacggagttgacctactaccagaacgacggcattttgcattatgtcattcgtaatatgttgaagtaa

SEQ ID NO: 3570 - protein, 891 aa, Escherichia coli
MSSTLREASKDTLQAKDKTYHYYSLPLAAKSLGDITRLPKSLKVLLENLLRWQDGKSVTEEDIHALAGWLKNAHADREIAYRPARVLMQDFTGVPAVVDLAAMREAVKRLGGDTAKVNPLSPVDLVIDHSVTVDRFGDDEAFEENVRLEMERNHERYVFLKWGKQAFSRFSVVPPGTGICHQVNLEYLGKAVWSELQDGEWIAYPDTLVGTDSHTTMINGLGVLGWGVGGIEAEAAMLGQPVSMLIPDVVGFKLTGKLREGITATDLVLTVTQMLRKHGVVGKFVEFYGDGLDSLPLADRATIANMSPEYGATCGFFPIDAVTLDYMRLSGRSEDQVELVEKYAKAQGMWRNPGDEPIFTSVLELDMNDVEASLAGPKRPQDRVALPDVPKAFAASRELEVNATHKDRLPVDYVMNGHQYQLPDGAVVIAAITSCTNTSNPSVLMAAGLLAKKAVTLGLKRQPWVKASLAPGSKVVSDYLAKAKLTPYLDELGFNLVGYGCTTCIGNSGPLPDPIETAIKKGDLTVGAVLSGNRNFEGRIHPLVKTNWLASPPLVVAYALAGNMNINLASEPIGHDRKGEPVYLKDIWPSAQEIARAVDQVSTEMFRKEYAEVFEGTAEWKEINVTRSDTYGWQEDSTYIRLSPFFDEMQATPAPVEDIHGARILAMLGDSVTTDHISPAGSIKPDSPAGRYLQGRGVERKDFNSYGSRRGNHEVMMRGTFANIRIRNEMVPGVEGGMTCHLPDSDVVSIYDAAMRYKQEQTPLAVIAGKEYGSGSSRDWAAKGPRLLGIRVVIAESFERIHRSNLIGMGILPLEFPQGVTRKTLELTGEEKIDIGDLQNLQPGATVPVTLTRADGSQEVVPCRCRIDTATELTYYQNDGILHYVIRNMLK

SEQ ID NO: 3571 - DNA, 189 bp, Escherichia coli
ttggaaattgtggggataactatggtcggtcaggagcaactggagtcgtcaccattatgtcagcatagtgacaatgaaccagaagcaaaacgggaatgttccgtcgttattccagacgactggcaactaacatcgcagcaacaagcctttatagaactgtttgctgaagatgatcagccgaaacaataa

SEQ ID NO: 3572 - protein, 62 aa, Escherichia coli
MEIVGITMVGQEQLESSPLCQHSDNEPEAKRECSVVIPDDWQLTSQQQAFIELFAEDDQPKQ

SEQ ID NO: 3573 - DNA, 165 bp, Escherichia coli
ttgctgataagtgatggcgattatatgaggttagcaatgccttctggaaatcaggaaccccgccgcaatcctgaattaaaacgtaaagcctggctggcggtttttcttggttctgcacttttctgggtggttgtcgcactgcttatttggaaattgtggggataa

SEQ ID NO: 3574 - protein, 54 aa, Escherichia coli
MLISDGDYMRLAMPSGNQEPRRNPELKRKAWLAVFLGSALFWVVVALLIWKLWG

SEQ ID NO: 3575 - DNA, 975 bp, Escherichia coli
atgaaattacaacaacttcgctatattgttgaggtggtcaatcataacctgaatgtctcatcaacggcggaaggactttacacatcacaacccgggatcagtaaacaagtcagaatgctggaagacgagctgggcattcaaattttttcccgcagcggcaagcacctgacgcaggtaacgccagcaggacaagaaataattcgtatcgctcgtgaagttctgtcgaaagtcgatgccataaaatcggtcgccggagagcacacctggccggataaaggctcgctgtatatcgccaccacgcatactcaggcacgctatgcgttaccaaacgttatcaaaggctttattgagcgttatcctcgcgtttctttgcatatgcaccagggctcgccgacacaaattgctgatgccgtctctaaaggcaatgccgatttcgctatcgccacggaagcgctgcatctgtatgaagatttagtgatgctaccgtgctaccactggaatcgggctatagtagtcactccggatcacccgctggcaggtaaaaaagccattaccattgaagaactggcgcaatatccgttggtgacatataccttcggctttaccggacgttcagaactggatactgcctttaaccgcgcagggttaacgccgcgtatcgtcttcacggcaacggatgctgacgtcattaaaacttacgtccggttagggctgggggtaggggtcattgccagcatggcggtggatccggtcgccgatcccgaccttgtgcgtgttgatgctcacgacatcttcagccacagtacaaccaaaattggttttcgccgtagtacttttttgcgtagttatatgtatgatttcattcagcgttttgcaccgcatttaacgcgtgatgtcgttgatgcggctgtcgcattgcgctctaatgaagaaattgaggtcatgtttaaagatataaaactgccggaaaaataa

SEQ ID NO: 3576 - protein, 324 aa, Escherichia coli
MKLQQLRYIVEVVNHNLNVSSTAEGLYTSQPGISKQVRMLEDELGIQIFSRSGKHLTQVTPAGQEIIRIAREVLSKVDAIKSVAGEHTWPDKGSLYIATTHTQARYALPNVIKGFIERYPRVSLHMHQGSPTQIADAVSKGNADFAIATEALHLYEDLVMLPCYHWNRAIVVTPDHPLAGKKAITIEELAQYPLVTYTFGFTGRSELDTAFNRAGLTPRIVFTATDADVIKTYVRLGLGVGVIASMAVDPVADPDLVRVDAHDIFSHSTTKIGFRRSTFLRSYMYDFIQRFAPHLTRDVVDAAVALRSNEEIEVMFKDIKLPEK

SEQ ID NO: 3577 - DNA, 2640 bp, Escherichia coli
gtgcgacgcattcctggaagaatcaaattaggtaaggtgaatatgggtaaagctcttgtcatcgttgagtccccggcaaaagccaaaacgatcaacaagtatctgggtagtgactacgtggtgaaatccagcgttggtcacatccgcgatttgccgaccagtggctcaactgccaaaaagagtgccgactctacctccaccaagacggctaaaaagcctaaaaaggatgaacgtggcgctctcgtcaaccgtatgggggttgacccgtggcacaattgggaggcgcactatgaagtgttgcctggtaaagagaaggtcgtctctgaactgaaacaactggctgaaaaagccgaccacatctatctcgcaaccgaccttgaccgcgaaggggaagccattgcatggcacctgcgggaagtgattggtggtgatgatgcgcgctatagccgagtggtgtttaacgaaattactaaaaacgcgatccgccaggcatttaacaaaccgggtgagctgaatattgatcgtgttaatgcccagcaggcgcgtcgctttatggaccgcgtggtggggtatatggtttcgccgcttctatggaaaaagatcgctcgtggtctgtctgccggtcgtgtgcagtcggtggcggtccgcctggtggtcgagcgtgagcgtgaaattaaagcgttcgtaccggaagagttctgggaagtcgatgccagcacgaccacgccatctggtgaagcgttggcgttgcaggtgactcatcagaacgacaaaccgttccgtccggtcaacaaagaacaaactcaggctgcggtaagtctgctggaaaaagcgcgctacagcgtgctggaacgtgaagacaaaccgacaaccagtaaacctggcgctccttttattacctctacgctgcaacaagctgccagcacccgtcttggatttggcgtgaaaaaaaccatgatgatggctcagcgtttgtatgaagcaggctatatcacttacatgcgtaccgactccactaacctgagtcaggacgcggtaaatatggttcgcggttatatcagcgataattttggtaagaaatatctgccggaaagtccgaatcagtacgccagcaaagaaaactcacaggaagcgcacgaagcgattcgtccttctgacgtcaatgtgatggcggaatcgctgaaggatatggaagcagatgcgcagaaactgtaccagttaatctggcgtcagttcgttgcctgccagatgaccccagcgaaatatgactccacgacgctgaccgttggtgcgggcgatttccgcctgaaagcacgcggtcgtattttgcgctttgatggctggacgaaagtgatgcctgcactgcgtaaaggcgatgaagatcgtatcttaccggcagtcgataaaggcgatgctctgacgctcgttgaactgacacaagcccagcactttaccaagcctccagcccgtttcagtgaagcatcgctggtcaaagagctggaaaaacgcggtatcggtcgtccttctacctatgcgtcgatcatttcgactattcaggatcgtggctatgtgcgagtagaaaatcgtcgtttctatgcggaaaaaatgggcgaaatcgtcaccgatcgcctggaagagaatttccgcgagttaatgaactacgacttcaccgcgcagatggaaaacagcctcgaccaggtggcaaatcacgaagcagagtggaaagctgtactggatcacttcttctcggatttcacccagcagttagataaagctgaaaaagatccggaagagggtggtatgcgcccgaaccagatggttctgaccagcattgactgcccgacttgtggtcgcaaaatggggattcgcacagcgagcaccggggtattccttggctgttctggctatgcgctgccgccgaaagagcgttgcaaaaccaccattaacctggtgccggaaaacgaagtgctgaacgtgctggaaggcgaagacgctgaaaccaatgcgttgcgcgcaaaacgtcgttgcccgaaatgcggtacggcgatggacagctatctcatcgatccgaaacgtaagttgcatgtctgtggtaataaccctacctgcgacggttacgagatcgaagagggcgaattccgcattaaaggttatgacggcccgatcgttgagtgtgaaaaatgtggctctgaaatgcacctgaaaatggggcgtttcggtaaatacatggcctgcaccaacgaagagtgtaaaaacacacgtaagattttacgtaacggcgaagtggcaccaccgaaagaagatccggtgccattaccggagctgccgtgcgaaaaatcagatgcctatttcgtgttgcgtgacggtgctgccggtgtgttcctggcggccaataccttcccgaaatcgcgtgaaacgcgtgcgccgctggtggaggagctttatcgcttccgcgaccgtctgccggaaaaactgcgttatctggccgatgcgccacagcaggatccggaaggtaataagaccatggttcgctttagccgtaaaaccaaacagcaatatgtctcttcggaaaaagacggaaaggcgactggctggtcagcattttatgttgatggcaaatgggttgaagggaaaaaataa

SEQ ID NO: 3578 - protein, 879 aa, Escherichia coli
MRRIPGRIKLGKVNMGKALVIVESPAKAKTINKYLGSDYVVKSSVGHIRDLPTSGSTAKKSADSTSTKTAKKPKKDERGALVNRMGVDPWHNWEAHYEVLPGKEKVVSELKQLAEKADHIYLATDLDREGEAIAWHLREVIGGDDARYSRVVFNEITKNAIRQAFNKPGELNIDRVNAQQARRFMDRVVGYMVSPLLWKKIARGLSAGRVQSVAVRLVVEREREIKAFVPEEFWEVDASTTTPSGEALALQVTHQNDKPFRPVNKEQTQAAVSLLEKARYSVLEREDKPTTSKPGAPFITSTLQQAASTRLGFGVKKTMMMAQRLYEAGYITYMRTDSTNLSQDAVNMVRGYISDNFGKKYLPESPNQYASKENSQEAHEAIRPSDVNVMAESLKDMEADAQKLYQLIWRQFVACQMTPAKYDSTTLTVGAGDFRLKARGRILRFDGWTKVMPALRKGDEDRILPAVDKGDALTLVELTQAQHFTKPPARFSEASLVKELEKRGIGRPSTYASIISTIQDRGYVRVENRRFYAEKMGEIVTDRLEENFRELMNYDFTAQMENSLDQVANHEAEWKAVLDHFFSDFTQQLDKAEKDPEEGGMRPNQMVLTSIDCPTCGRKMGIRTASTGVFLGCSGYALPPKERCKTTINLVPENEVLNVLEGEDAETNALRAKRRCPKCGTAMDSYLIDPKRKLHVCGNNPTCDGYEIEEGEFRIKGYDGPIVECEKCGSEMHLKMGRFGKYMACTNEECKNTRKILRNGEVAPPKEDPVPLPELPCEKSDAYFVLRDGAAGVFLAANTFPKSRETRAPLVEELYRFRDRLPEKLRYLADAPQQDPEGNKTMVRFSRKTKQQYVSSEKDGKATGWSAFYVDGKWVEGKK

SEQ ID NO: 3579 - DNA, 93 bp, Escherichia coli
gtggcagcgtgggcaaaagccgttgatgtaaaagacaaacgcgaggataagacctcgcgttttgctttaatcaaccaggtgatatttttctga

SEQ ID NO: 3580 - protein, 30 aa, Escherichia coli
MAAWAKAVDVKDKREDKTSRFALINQVIFF

SEQ ID NO: 3581 - DNA, 252 bp, Escherichia coli
atgaacaaagagactcaacccatcgaccgcgaaacgctgttgaaagaggccaacaaaatcattcgtgagcatgaggatacgctcgcagggattgaagccaccggcgtcacgcagcgtaatggcgtgctggtatttaccggcgactactttttagatgaacaaggattaccaactgccaaaagcaccgcggtgtttaatatgttcaaacacctggcccatgtgctttcagaaaaatatcacctggttgattaa

SEQ ID NO: 3582 - protein, 83 aa, Escherichia coli
MNKETQPIDRETLLKEANKIIREHEDTLAGIEATGVTQRNGVLVFTGDYFLDEQGLPTAKSTAVFNMFKHLAHVLSEKYHLVD

SEQ ID NO: 3583 - DNA, 1050 bp, Escherichia coli
gtggaattgttgtctgaatatggtttgtttttggcgaaaatcgttaccgttgtgctagcgattgcggcgattgccgccattattgtcaatgttgctcaacgtaataaacgccagcgtggcgagttacgagtcaacaatctcagcgaacagtataaggagatgaaagaagaactggccgcggcgctgatggacactcatcagcaaaaacagtggcacaaagcgcagaagaaaaagcacaagcaagaagcgaaagccgcaaaagcgaaagctaaactgggcgaggtggtaactgacagtaaaccccgcgtctgggtgctggattttaaaggcagcatggacgcccatgaagtgaactcgctacgtgaagagataacggcggtactcgcagcattcaaaccgcaggatcaggttgtgctccgtctggaaagcccaggtggcatggtgcatggttacgggttggcggcttcgcagttgcagcgtctgcgtgataaaaacattcctttaactgttacggtagacaaagtcgctgccagcggcggttacatgatggcctgtgtggcggacaaaattgtttccgcaccgtttgctattgtgggttccattggggtggtggcgcaaatgcccaactttaaccgcttcctgaaaagcaaagatattgatatcgaactgcacaccgccgggcagtataagcgcacgctgacgttgctgggtgaaaataccgaagaagggcgggagaaattccgcgaagagttgaacgaaacgcatcagttatttaaagattttgtgaagcgtatgcgtccgtctctggatattgaacaggtggcaacgggtgaacactggtacggacaacaggcagtagagaaaggcctggttgatgaaatcaacaccagtgatgaagttattcttagcctgatggaaggccgggaagtggtcaatgtacgctatatgcagcgtaaacgactcattgaccgattcaccggcagcgcggcagagagcgccgatcgattgttgttacgctggtggcagcgtgggcaaaagccgttgatgtaa

SEQ ID NO: 3584 - protein, 349 aa, Escherichia coli
MELLSEYGLFLAKIVTVVLAIAAIAAIIVNVAQRNKRQRGELRVNNLSEQYKEMKEELAAALMDTHQQKQWHKAQKKKHKQEAKAAKAKAKLGEVVTDSKPRVWVLDFKGSMDAHEVNSLREEITAVLAAFKPQDQVVLRLESPGGMVHGYGLAASQLQRLRDKNIPLTVTVDKVAASGGYMMACVADKIVSAPFAIVGSIGVVAQMPNFNRFLKSKDIDIELHTAGQYKRTLTLLGENTEEGREKFREELNETHQLFKDFVKRMRPSLDIEQVATGEHWYGQQAVEKGLVDEINTSDEVILSLMEGREVVNVRYMQRKRLIDRFTGSAAESADRLLLRWWQRGQKPLM

SEQ ID NO: 3585 - DNA, 759 bp, Escherichia coli
atgcattaccagccaaaacaagatttactcaatgatcgcattatcctggtgacgggagccagcgatggaattggtcgtgaagcagcgatgacgtatgcacgctatggtgcgacagtgattcttttgggccgtaatgaagaaaaattacgtcaggtagccagccacataaacgaagaaattggacgtcagccacagtggtttattctcgatttgctaacctgcacgtccgaagattgccaacaactggcacagcgcattgccgttaattatccgcgtctggatggtgttttgcataatgccggattgctcggcgatgtttgcccaatgagcgaacaaaatccgcaggtctggcaggacgtcatgcaggtcaacgttaatgccacctttatgctcacccaggcactgcttcctttattactcaaatcggacgccggttcactggtctttacttcatcaagcgttggacgtcaggggcgtgcaaactggggcgcttatgcagcgtcgaaatttgccaccgaagggatgatgcaggtactggccgatgaatatcagcagcgcctgcgcgtcaactgcattaacccaggcggtacgcgcaccgcaatgcgtgccagcgccttcccgaccgaagatccacagaaacttaaaacccccgctgatatcatgccgctctacctctggctgatgggcgatgacagccgccgtaaaaccggcatgacctttgacgcccaaccgggccgtaaaccaggaatttcccaatga

SEQ ID NO: 3586 - protein, 252 aa, Escherichia coli
MHYQPKQDLLNDRIILVTGASDGIGREAAMTYARYGATVILLGRNEEKLRQVASHINEEIGRQPQWFILDLLTCTSEDCQQLAQRIAVNYPRLDGVLHNAGLLGDVCPMSEQNPQVWQDVMQVNVNATFMLTQALLPLLLKSDAGSLVFTSSSVGRQGRANWGAYAASKFATEGMMQVLADEYQQRLRVNCINPGGTRTAMRASAFPTEDPQKLKTPADIMPLYLWLMGDDSRRKTGMTFDAQPGRKPGISQ

SEQ ID NO: 3587 - DNA, 591 bp, Escherichia coli
atgagtgatgaacactaccaacagcgtcagcagcgagtgaaagaaaaagtcgatgctcgtgtggcccaggcccaggatgaacgcggtattatcatcgtctttaccggcaatggaaaaggcaaaaccaccgcggcatttggtacggcaacacgcgcagttggtcacggaaaaaaagtgggcgtcgtgcagtttattaaaggcacctggcctaatggcgaacgaaatctgctggagccacacggcgttgagtttcaggtaatggcaacgggctttacctgggatacacaaaaccgagagtctgataccgccgcctgccgcgaagtctggcaacatgcaaagcggatgctggctgattcctcactggatatggttttgctcgatgaactgacgtatatggtggcgtatgactatttgccactggaagaagtggtgcaggcgttaaatgaacgtccacatcaacagacggtgattatcacaggtcgtggttgtcatcgggatattcttgaactggcggatacggtaagtgaattacgccccgtcaaacatgcgtttgatgccggtgtaaaagcgcagatagggattgattactaa

SEQ ID NO: 3588 - protein, 196 aa, Escherichia coli
MSDEHYQQRQQRVKEKVDARVAQAQDERGIIIVFTGNGKGKTTAAFGTATRAVGHGKKVGVVQFIKGTWPNGERNLLEPHGVEFQVMATGFTWDTQNRESDTAACREVWQHAKRMLADSSLDMVLLDELTYMVAYDYLPLEEVVQALNERPHQQTVIITGRGCHRDILELADTVSELRPVKHAFDAGVKAQIGIDY

SEQ ID NO: 3589 - DNA, 876 bp, Escherichia coli
atgagcgaaaagctacagaaagtgctggcgcgtgccggccacggttctcgccgtgaaatcgaatctattattgaagccggtcgtgtgagtgttgatggcaaaattgctaaactcggcgatcgcgttgaaattacccctggactgaaaatccgtatcgatggtcacctgatttcggtacgtgagtccgctgaacaaatttgtcgcgttctggcctattacaaacctgaaggtgagttgtgtacccgtaacgatccggaagggcgtccaacggtgtttgaccgtctgccaaagctgcgtggcgcacgctggattgccgtaggtcgtctggacgttaacacctgtggtctgttgttgttcaccaccgacggtgaactggcaaaccgtttaatgcatccaagccgtgaagttgaacgtgaatatgccgtgcgtgtatttggtcaggttgacgacgcgaaactgcgtgatttgagtcgtggcgtgcagctggaagatggtccggcagcctttaaaaccatcaagttcagcggcggcgaagggatcaaccagtggtacaacgttactctgaccgaaggccgtaaccgtgaagttcgtcgtctttgggaagcggttggtgtgcaggtgagccgcctgattcgtgttcgttacggtgatatcccactgccaaaaggtctgccacgcggtggctggacggagctggacctcgcccagactaactatctgcgcgaactggtggaactaccgccagaaaccagctctaaagtcgctgtagaaaaagaccgtcgtcgtatgaaggcgaatcagattcgtcgtgcggtgaaacgtcacagtcaggtgagcggcggtcgtcgttctggcggacgtaataataacggttaa

SEQ ID NO: 3590 - protein, 291 aa, Escherichia coli
MSEKLQKVLARAGHGSRREIESIIEAGRVSVDGKIAKLGDRVEITPGLKIRIDGHLISVRESAEQICRVLAYYKPEGELCTRNDPEGRPTVFDRLPKLRGARWIAVGRLDVNTCGLLLFTTDGELANRLMHPSREVEREYAVRVFGQVDDAKLRDLSRGVQLEDGPAAFKTIKFSGGEGINQWYNVTLTEGRNREVRRLWEAVGVQVSRLIRVRYGDIPLPKGLPRGGWTELDLAQTNYLRELVELPPETSSKVAVEKDRRRMKANQIRRAVKRHSQVSGGRRSGGRNNNG

SEQ ID NO: 3591 - DNA, 1899 bp, Escherichia coli
atgatggcagggatatatcgctgcattttgctgttgatagttgggctttttttctcttcgttgagttatgcgaaaaacacggagatcccttcttatgaagaagggatctcgctctttgatgttgaagccactctgcaaccgaatggggtgctcgacatcaaagagaacattcattttcaggcgcgaaatcagcagattaagcacggattttatcgtgatttaccgcgactctggatgcagcctgatggggacgctgcactgctgaactatcatattgttggcgtcacccgtgatggtattcctgaaccctggcatcttgactggcatatcgggttaatgagtattgtcgtgggcgataaacaacgtttcttgcctcaaggcgactatcattatcaaattcattatcaggttaaaaatgctttcctgcgtgagggggattctgatctgctaatctggaacgtgaccggtaaccactggtcgtttgaaatttataagaccctattttcactcaagttgcctgatattgcgggtaatccatttagcgaaatcgatctctttactggagaagagggcgacacatatcgaaatggccgcatccttgaggacggaagaattgaatctcgcgatccgttttatcgtgaagatttcacggtcctctaccgctggcctcacgcattacttggtaatgccccggctccacaaacgacgaatattttcagtcatcttcttttaccctctacgtcatcgttgttaatttgctttccgagtctgttcctggcgtgtggatggttatatctctggaagcgcaggccgcaatttacgccggtagatgtgattgaaaccgatgtcattccgccagattacacgcccggcatgttacgtcttgatgcgaaactggtttacgacgataaaggtttttgcgccgatatcgtaaatctgattgtgaaaggaaaaattcatctggaagatcattatgacaagaaccagcaaatcctgattcgtgttaatgaaggcgcgaccagaaataatgcggtattactgcccgcagagcagttattactggaagcgttatttcgtaaaggcgataaggtcgttcttacggggagacgcaacagagtcttacgcaaggcatttttacggatgcagaaattttatctgccgcgtaaaaagtcttcgttttaccgacctgatgcgtttttgcaatggggcggaatggcaatattggcggtcattctctacggtaacctgagtcccgtaggctgggcaggaatgagtctggtaggcgatatgtttattatgatctgctggcttcttactttcttattttgttcccttgatcttttgtttgcccgcgatgatgacaagccttgcgttaatcgtgtcatcatcactttgtttttaccactgatttgttcaggtgtggctttttactctctctacatcaatgtcggagatgtattcttttactggtatatgccagcgggttattttagcgcggttttcctgaccggttatctcactggcatggggtatatttttctgccaaagtttacccaaaacgggcagcaacgttatgcccacggtgaagctatcgttaactatcttgcgcgtaaagaggcggcaacacacagtgggcggcggcggaaaggggaaacacggaaactggattacgctttgttaggttgggcagtctcggcaaaccttggcagagaatgggcagcacgtatcaccccatcactcacagcggctgttcgcgccccggaaattgcccgtagtggcgttttgttctcattacagatgcatctgagtctgggggccaataccagtttgttggggcgaagttattccggtggtggtgctggcggcggtgcgggtggcggaggcggtggtggttggtaa

SEQ ID NO: 3592 - protein, 632 aa, Escherichia coli
MMAGIYRCILLLIVGLFFSSLSYAKNTEIPSYEEGISLFDVEATLQPNGVLDIKENIHFQARNQQIKHGFYRDLPRLWMQPDGDAALLNYHIVGVTRDGIPEPWHLDWHIGLMSIVVGDKQRFLPQGDYHYQIHYQVKNAFLREGDSDLLIWNVTGNHWSFEIYKTLFSLKLPDIAGNPFSEIDLFTGEEGDTYRNGRILEDGRIESRDPFYREDFTVLYRWPHALLGNAPAPQTTNIFSHLLLPSTSSLLICFPSLFLACGWLYLWKRRPQFTPVDVIETDVIPPDYTPGMLRLDAKLVYDDKGFCADIVNLIVKGKIHLEDHYDKNQQILIRVNEGATRNNAVLLPAEQLLLEALFRKGDKVVLTGRRNRVLRKAFLRMQKFYLPRKKSSFYRPDAFLQWGGMAILAVILYGNLSPVGWAGMSLVGDMFIMICWLLTFLFCSLDLLFARDDDKPCVNRVIITLFLPLICSGVAFYSLYINVGDVFFYWYMPAGYFSAVFLTGYLTGMGYIFLPKFTQNGQQRYAHGEAIVNYLARKEAATHSGRRRKGETRKLDYALLGWAVSANLGREWAARITPSLTAAVRAPEIARSGVLFSLQMHLSLGANTSLLGRSYSGGGAGGGAGGGGGGGW

SEQ ID NO: 3593 - DNA, 657 bp, Escherichia coli
atgggaacagccgcagaacaccacagagagggaattatgagccagtttttttatattcatcctgataacccgcagcaacgcctgatcaaccaggcggtggagatcgtgcgtaaaggcggggtgattgtttatccaactgattccggctatgcgctcggctgtaaaattgaagataaaaacgcgatggagcgtatttgtcgtattcgccagctgccggacggtcacaactttaccctgatgtgtcgcgatctttctgaactctcgacctattcatttgtcgataacgttgcgtttcgtttgatgaaaaacaacacgccaggcaactataccttcatcctgaaggggacgaaggaggtgccacgccgtctgttgcaggaaaaacgcaaaaccatcggtatgcgcgtgccgtctaaccctattgcgcaggcgctgcttgaagcattgggcgaaccgatgctttccacttcgctaatgctgccaggcagtgaatttaccgaatccgatccggaagaaattaaagaccgtctggaaaaacaggtggatttgattattcacggcggctatctcgggcagaaaccaacaacggttattgatctcaccgatgatacgccggtcgtggtgcgtgaaggcgtaggtgatgtgaagcctttcttataa

SEQ ID NO: 3594 - protein, 218 aa, Escherichia coli
MGTAAEHHREGIMSQFFYIHPDNPQQRLINQAVEIVRKGGVIVYPTDSGYALGCKIEDKNAMERICRIRQLPDGHNFTLMCRDLSELSTYSFVDNVAFRLMKNNTPGNYTFILKGTKEVPRRLLQEKRKTIGMRVPSNPIAQALLEALGEPMLSTSLMLPGSEFTESDPEEIKDRLEKQVDLIIHGGYLGQKPTTVIDLTDDTPVVVREGVGDVKPFL

SEQ ID NO: 3595 - DNA, 861 bp, Escherichia coli
gtgatttacgacctgcacagccataccacagcttccgatggctgcctgacgccagaagcattggtgcaccgtgcagtcgagatgcgcgtcggcaccctggcgatcaccgaccatgacaccacagctgcaattgcaccagcaagagaggaaatttcacgttcgggactggcgctgaatcttattcctggtgtggaaatttccacggtctgggaaaatcatgaaattcatattgtcgggctgaatattgatattactcatccgctaatgtgcgagttcctcgcgcagcagacagaacggcgcaatcagcgggcgcagctgattgccgaaagacttgaaaaagcgcaaatacctggggcactggaaggcgcgcaacgactggcgcagggcggtgcggtgacgcgcggtcattttgcgcgtttccttgtggagtgcggaaaagccagttcaatggcggatgtctttaaaaagtatctggcgcgcgggaaaaccggatacgttccgccacagtggtgtacaatagagcaatctattgatgtcattcatcattctggcggtaaggcggtgctagctcatcctgggcggtacaatcttagtgctaaatggctgaaaagattggttgcgcattttgccgaacaccacggcgacgcgatggaagtcgcgcagtgccagcaatcgcccaatgaacgcacccagctggcgacacttgcgcgtcagcatcatttatgggcatcacaaggatctgattttcatcagccatgcccgtggatcgaactgggtcgtaaactctggctgcccgcaggcgttgaaggcgtctggcagctatgggaacagccgcagaacaccacagagagggaattatga

SEQ ID NO: 3596 - protein, 286 aa, Escherichia coli
MIYDLHSHTTASDGCLTPEALVHRAVEMRVGTLAITDHDTTAAIAPAREEISRSGLALNLIPGVEISTVWENHEIHIVGLNIDITHPLMCEFLAQQTERRNQRAQLIAERLEKAQIPGALEGAQRLAQGGAVTRGHFARFLVECGKASSMADVFKKYLARGKTGYVPPQWCTIEQSIDVIHHSGGKAVLAHPGRYNLSAKWLKRLVAHFAEHHGDAMEVAQCQQSPNERTQLATLARQHHLWASQGSDFHQPCPWIELGRKLWLPAGVEGVWQLWEQPQNTTEREL

SEQ ID NO: 3597 - DNA, 1563 bp, Escherichia coli
atgcaaacacaaaaaccgactctcgaactgctaacctgcaaaggcgcttatcgcgacaacccgactgcgctttttcaccagttgtgtggggatcgcccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcacccgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggcgtagtgcgtttgttgcaaaaagcgattcgcgccggagaaattttccaggtggtgccatctcgccgtttctctctgccctgcccgtcaccgctggcggcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctggtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagaccttctga

SEQ ID NO: 3598 - protein, 520 aa, Escherichia coli
MQTQKPTLELLTCKGAYRDNPTALFHQLCGDRPATLLLESADIDSKDDLKSLLLVDSALRITALSDTVTIQALSGNGEALLTLLDNALPAGVENEQSPNCRVLRFPPVSPLLDEDARLCSLSVFDAFRLLQNLLNVPKEEREAMFFGGLFSYDLVAGFENLPQLSAENSCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 3599 - DNA, 1596 bp, Escherichia coli
atggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaatattccggccggtttaaccatcaacgcccattttaatggcatggtgatggcggtgcgtcatgatgcggatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcgcagacccttagccagcaggaaagccaccagctgttttcagcggtggtacgtggcgagctgaaaccagaacaactggcggcggcgctggtgagcatgaaaattcgcggtgagcacccgaacgagatcgccggggcggcaaccgcgctactggaaaacgccgcgccgttcccgcgcccggattatctgtttgccgatatcgtcggtactggcggtgacggcagcaacagcatcaatatttctaccgccagcgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcaccgaaatatcacaccggattccgccatgcaatgccggttcgccagcaactgaaaacccgcacactgttcaatgtgctggggccattaattaacccggcgcatccgccgctggcgttaattggtgtctacagcccggagctggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcagttgaccgctgaagattttggcctgacaccctaccaccaggagcaactggcaggcggaacaccggaagaaaaccgtgacattttaacacgcttgttacaaggtaaaggcgacgccgctcacgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaa

SEQ ID NO: 3600 - protein, 531 aa, Escherichia coli
MADILLLDNIDSFTYNLADQLRSNGHNVVIYRNHIPAQTLIERLATMSNPVLMLSPGPGVPSEAGCMPELLTRLRGKLPIIGICLGHQAIVEAYGGYVGQAGEILHGKASSIEHDGQAMFAGLTNPLPVARYHSLVGSNIPAGLTINAHFNGMVMAVRHDADRVCGFQFHPESILTTQGARLLEQTLAWAQQKLEPTNTLQPILEKLYQAQTLSQQESHQLFSAVVRGELKPEQLAAALVSMKIRGEHPNEIAGAATALLENAAPFPRPDYLFADIVGTGGDGSNSINISTASAFVAAACGLKVAKHGNRSVSSKSGSSDLLAAFGINLDMNADKSRQALDELGVCFLFAPKYHTGFRHAMPVRQQLKTRTLFNVLGPLINPAHPPLALIGVYSPELVLPIAETLRVLGYQRAAVVHSGGMDEVSLHAPTIVAELHDGEIKSYQLTAEDFGLTPYHQEQLAGGTPEENRDILTRLLQGKGDAAHEAAVAANVAMLMRLHGHEDLQANAQTVLEVLRSGSAYDRVTALAARG

SEQ ID NO: 3601 - DNA, 1359 bp, Escherichia coli
atgcaaaccgttttagcgaaaatcgtcgcagacaaggcgatttgggtagaagcccgcaaacagcagcaaccgctggccagttttcagaatgagattcagccgagcacgcgacatttttatgatgcgctacagggtgcacgcacggcgtttattctggagtgcaaaaaagcgtcgccgtcaaaaggcgtgatccgtgatgatttcgatccggcacgcattgcaaccgtttacagaaattatgcttcggcaatttcggtgctgactgatgagaaatattttcagggaagctttgatttcctccccatcgtcagccaaatcgccccacagccgattttatgtaaagactttattatcgacccttaccagatctatctggcgcgctattaccaggccgatgcctgcttattaatgctttcagtactggatgatgaacaatatcgccagcttgccgccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaatgtgacggtaatcagcgaatccggcatcaatacttacgctcaggtgcgcgagttaagccacttcgctaacggttttctgattggttcggcgttgatggcccatgacgatttgaacgccgccgtgcgccgggtgttgctgggtgagaataaagtgtgtggcctgactcgcccacaagatgccagagccgcttatgacgctggtgctatatacggtggattaatatttgttacaacgtcaccgcgttgcgtcagcgttgaacaggcgcaggaagtgatggctgcggcaccgttgcagtatgttggcgtgttccgcaatcacgatattgccgatgtggtggacaaagctaaggtgttatcgctggcggcagtgcaactgcatggtaatgaagatcagctgtatatcgacactctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaa

SEQ ID NO: 3602 - protein, 452 aa, Escherichia coli
MQTVLAKIVADKAIWVEARKQQQPLASFQNEIQPSTRHFYDALQGARTAFILECKKASPSKGVIRDDFDPARIATVYRNYASAISVLTDEKYFQGSFDFLPIVSQIAPQPILCKDFIIDPYQIYLARYYQADACLLMLSVLDDEQYRQLAAVAHSLEMGVLTEVSNEEELERAIALGAKVVGINNRDLRDLSIDLNRTRELAPKLGHNVTVISESGINTYAQVRELSHFANGFLIGSALMAHDDLNAAVRRVLLGENKVCGLTRPQDARAAYDAGAIYGGLIFVTTSPRCVSVEQAQEVMAAAPLQYVGVFRNHDIADVVDKAKVLSLAAVQLHGNEDQLYIDTLREALPAHVAIWKALSVGETLPARDFQHIDKYVFDNGQGGSGQRFDWSLLNGQSLGNVLLAGGLGADNCVEAAQTGCAGLDFNSAVESQPGIKDARLLASVFQTLRAY

SEQ ID NO: 3603 - DNA, 1194 bp, Escherichia coli
atgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactaaaattattgccgaaaccggtgccggtcagcatggcgtggcgtcggcccttgccagcgccctgctcggcctgaaatgccgtatttatatgggtgccaaagacgttgaacgccagtcgcctaacgttttccggatgcgcttaatgggtgcggaagtgatcccggtgcatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatcccgaaaaagagcagctactggtggttaacctttccggtcgcggcgataaagacatcttcaccgttcacgatattttgaaagcacgaggggaaatctga

SEQ ID NO: 3604 - protein, 397 aa, Escherichia coli
MTTLLNPYFGEFGGMYVPQILMPALRQLEEAFVSAQKDPEFQAQFNDLLKNYAGRPTALTKCQNITAGTNTTLYLKREDLLHGGAHKTNQVLGQALLAKRMGKTKIIAETGAGQHGVASALASALLGLKCRIYMGAKDVERQSPNVFRMRLMGAEVIPVHSGSATLKDACNEALRDWSGSYETAHYMLGTAAGPHPYPTIVREFQRMIGEETKAQILEREGRLPDAVIACVGGGSNAIGMFADFINETDVGLIGVEPGGHGIETGEHGAPLKHGRVGIYFGMKAPMMQTEDGQIEESYSISAGLDFPSVGPQHAYLNSTGRADYVSITDDEALEAFKTLCLHEGIIPALESSHALAHALKMMRENPEKEQLLVVNLSGRGDKDIFTVHDILKARGEI

SEQ ID NO: 3605 - DNA, 807 bp, Escherichia coli
atggaacgctacgaatctctgtttacccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgaggtgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgcctaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagcagcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaa

SEQ ID NO: 3606 - protein, 268 aa, Escherichia coli
MERYESLFTQLKERKEGAFVPFVTLGDPGIEQSLKIIDTLIEAGADALELGIPFSDPLADGPTIQNATLRAFAAGVTPAQCFEVLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKAFVQPMKAATRS

SEQ ID NO: 3607 - DNA, 237 bp, Escherichia coli
gtgtcgacacacaacactcatattaatgaaacagtgcaacgcaacgggagaaataacatgaccgaacatcgtggtggttcaggaaatttcgccgaagaccgtgagaaggcatccaacgcaggccgtaaaggcggtcagcatagcggcggtaattttaaaaatgatccgcaacgcgcatccgaagcaggtaaaaaaggcggtcaacaaagcggtgataataaatcaggaaaatcctga

SEQ ID NO: 3608 - protein, 78 aa, Escherichia coli
MSTHNTHINETVQRNGRNNMTEHRGGSGNFAEDREKASNAGRKGGQHSGGNFKNDPQRASEAGKKGGQQSGDNKSGKS

SEQ ID NO: 3609 - DNA, 501 bp, Escherichia coli
atgaatatgaagaccattgaagatgtaattattcacctgctttcagatacctacagcgcagaaaaacaattaacccgggcactggcaaaactcgcaagagcaacatcaaacgaaaaattaagtcaggcttttcatgcgcacctcgaggaaacacatggacagattgaacgtattgatcaagttgtggaatcagaatcgaatctgaaaattaagcgcatgaaatgtgtggcaatggaaggtcttattgaagaagctaatgaggtcatcgaaaataccgagaaaaacgaagtgcgtgatgccgcactgattgccgcagcacagaaagtcgagcattatgagattgccagttacgggacattagcgacgctggctgaacaattaggttatcgtaaagcagcgaagcttctgaaagagaccctggaagaagaaaaggccaccgacatcaaattgactgatctggcccttaataacgtaaataagaaagccgaaaataaagcctga

SEQ ID NO: 3610 - protein, 166 aa, Escherichia coli
MNMKTIEDVIIHLLSDTYSAEKQLTRALAKLARATSNEKLSQAFHAHLEETHGQIERIDQVVESESNLKIKRMKCVAMEGLIEEANEVIENTEKNEVRDAALIAAAQKVEHYEIASYGTLATLAEQLGYRKAAKLLKETLEEEKATDIKLTDLALNNVNKKAENKA

SEQ ID NO: 3611 - DNA, 507 bp, Escherichia coli
atgaatcgtattgaacattatcatgactggttacgtgacgcccacgcaatggaaaagcaagccgaatctatgcttgagtccatggccagtcgtatagataattatcctgaactacgcgctcgtattgaacaacatcttagtgaaaccaaaaatcagattgttcaactggaaactattcttgatcgtaatgacatttcacgttcagtcattaaagattccatgagtaaaatagctgcacttgggcagtcaatcggtggtatattcccttctgatgaaatagtcaaaggctctattagcggatatgtcttcgagcaatttgaaatcgcctgttatacctcactcttagcagcagcaaaaaatgccggtgatacagcctcaattccgattatcgaagcgattttaaatgatgaaaagcacatggccgactggctaattcagcatattccgcaaacaactgagaaattcttaattcgctctgaaactgatggcgtagaagcgaagaaataa

SEQ ID NO: 3612 - protein, 168 aa, Escherichia coli
MNRIEHYHDWLRDAHAMEKQAESMLESMASRIDNYPELRARIEQHLSETKNQIVQLETILDRNDISRSVIKDSMSKIAALGQSIGGIFPSDEIVKGSISGYVFEQFEIACYTSLLAAAKNAGDTASIPIIEAILNDEKHMADWLIQHIPQTTEKFLIRSETDGVEAKK

SEQ ID NO: 3613 - DNA, 108 bp, Escherichia coli
atggatattgataccactgccaattataaactgggcggagcacagcaacacgatagcgtacgcctcgatccgtgggtgtttatgttctcagcaggatatcgtttttaa

SEQ ID NO: 3614 - protein, 35 aa, Escherichia coli
MDIDTTANYKLGGAQQHDSVRLDPWVFMFSAGYRF

SEQ ID NO: 3615 - DNA, 270 bp, Escherichia coli
atgctgccgcagcatagcgatattgaaatagcctggtatgcttcgatacagcaggagccgaatggctggaagaccgtcaccacacagttctacatccaggaattcagtgagtatattgcgccactgcaggatgctgtagatctggaaatcgcaacggaggaagaaagatcgttgctggaggcatggaataaatatcgggtattgttgaatcgtgttgatacatcaactgcacctgatattgagtggcctgcaaatcctgtcagggagtaa

SEQ ID NO: 3616 - protein, 89 aa, Escherichia coli
MLPQHSDIEIAWYASIQQEPNGWKTVTTQFYIQEFSEYIAPLQDAVDLEIATEEERSLLEAWNKYRVLLNRVDTSTAPDIEWPANPVRE

SEQ ID NO: 3617 - DNA, 585 bp, Escherichia coli
atggcattcagaatgagtgaacaagcacggaccataaaaatttataatctgctggccggaactaatgaatttattggtgaaggtgacgcatatattccgcctcatacaggtctgccagcaaacagtaccgatattgcaccaccagatattcctgctggctttgtggctgttttcaacagtgatgaggcatcgtggcatctcgttgaagaccatcggggtaaaacggtttatgacgtagcgtcaggggacgagttatttatttctgaactcggtccgttaccggaaaatgttacctggttatcgccggaaggggagtttcagaagtggaacggcacagcctgggtgaaggatacggaagcagaaaaaatgttccggatccgggaggcggaagaaacaaaaaacaacctgatgcaggtagccagtgagcatattgcgccgcttcaggatgctgcagatctggaaattgcaacggaggaagaaacctcattgctggaagcctggaaaaagtatcgggtgttgctgaaccgtgttgatacatcaactgcacctgatattgagtggcctacgaaccctgtcagggagtaa

SEQ ID NO: 3618 - protein, 194 aa, Escherichia coli
MAFRMSEQARTIKIYNLLAGTNEFIGEGDAYIPPHTGLPANSTDIAPPDIPAGFVAVFNSDEASWHLVEDHRGKTVYDVASGDELFISELGPLPENVTWLSPEGEFQKWNGTAWVKDTEAEKMFRIREAEETKNNLMQVASEHIAPLQDAADLEIATEEETSLLEAWKKYRVLLNRVDTSTAPDIEWPTNPVRE

SEQ ID NO: 3619 - DNA, 1743 bp, Escherichia coli
gtggcgcttgaggatgcgagcacgacgaaaaaggggatagtacagctcagcagtgcgactaacagcacttccgagtcactggcggcaacgccaaaagccgttaaggccgcgtatgagctggctaacgggaaatacaccgcacaggatgcaacgacagcacagaaagggatagttcagcttagcaacgcgaccaacagcacatctgaaatgctggcggcaacgccaaagtcggtaaaggcagcctatgaccttgctaacgggaaatatactgctcaggacgctacgacagcacaaaaaggaattgtccagctcagtagtgcaaccaacagcacatctgaaatgctggcggcaacgccaaagtcggtaaaggcagcctatgaccttgctaacgggaaatatactgctcaggacgctacgacagcacaaaaaggaattgtccagctcagtagtgcaaccaacagcgcatctgaaacgcttgccgcgacaccgaaagcagtgaaagcagctaataataatgcgaatggtcgggtaccttctgcccgtaaggtgaatggtaaggcgctttcagcggatataacactgacgccgaaagatattggtacgcttaactcaacaacaatgtcattcagcggtggtgctggttggttcaaattagcaacggtaaccatgccacaggcgagttctgttgtttcaattacgttgattggtggtgcgggatttaacgtggggtcacctcaacaggcaggtatatctgaacttgttttgcgtgcaggtaatggtaatccgaaggggattactggtgctttatggcagcgcacatcgacagggtttacaaattttgcctgggtcaatacatctggtgatacttacgatatttacgttgcaatcggaaattatgcgactggtgtaaatattcaatgggattataccagtaatgccagcgtgacgattcatacgtcaccagcatattctgctaataagccggaagggttaacggacggtacagtttattcactctatacgccatcagagcagttttatccgcctggcgcaccaatcccgtggccatcagataccgttccgtctggctatgccctgatgcaggggcagacttttgacaaatctgcatacccgaaacttgcagccgcttatccgtcaggcgtgatccctgatatgcgtggctggacgattaagggcaaacccgccagtggtcgtgccgtattgtctcaggaacaggacggcattaaatcgcacacccacagcgccagcgcatccagtacggatttggggacgaaaaacacatcgtcgtttgattacggaaccaaatccacgaataacaccggggcgcatacgcacagtctgagtggctctacggggtctgccggtgatcatactcatggtaatggtattcgttggccaggaggcggcggttctgcgttagcattttatgatggcggtgggttcacttatgtccaggattcacagtatcaagtaagcccggggacttcttcccgtagatcgtattatcaacgtattcagacacagtcagcaggtgctcatacccactcgctgtctggtactgcagcaagttctggcgcacatgcacatactgtaggtattggtgcgcatacgcactccgttgcgattggttcacatggacacaccatcaccgttaacgctgctggtaacgcggaaaacaccgtcaaaaacatcgcatttaactatattgtgaggcttgcataa

SEQ ID NO: 3620 - protein, 580 aa, Escherichia coli
MALEDASTTKKGIVQLSSATNSTSESLAATPKAVKAAYELANGKYTAQDATTAQKGIVQLSNATNSTSEMLAATPKSVKAAYDLANGKYTAQDATTAQKGIVQLSSATNSTSEMLAATPKSVKAAYDLANGKYTAQDATTAQKGIVQLSSATNSASETLAATPKAVKAANNNANGRVPSARKVNGKALSADITLTPKDIGTLNSTTMSFSGGAGWFKLATVTMPQASSVVSITLIGGAGFNVGSPQQAGISELVLRAGNGNPKGITGALWQRTSTGFTNFAWVNTSGDTYDIYVAIGNYATGVNIQWDYTSNASVTIHTSPAYSANKPEGLTDGTVYSLYTPSEQFYPPGAPIPWPSDTVPSGYALMQGQTFDKSAYPKLAAAYPSGVIPDMRGWTIKGKPASGRAVLSQEQDGIKSHTHSASASSTDLGTKNTSSFDYGTKSTNNTGAHTHSLSGSTGSAGDHTHGNGIRWPGGGGSALAFYDGGGFTYVQDSQYQVSPGTSSRRSYYQRIQTQSAGAHTHSLSGTAASSGAHAHTVGIGAHTHSVAIGSHGHTITVNAAGNAENTVKNIAFNYIVRLA

SEQ ID NO: 3621 - DNA, 1305 bp, Escherichia coli
gtggtgaacacggtggcctctgaaaatccggatgaagccggacgttacagcatggatgttgagcatggtcagtacagcgtcaccctgctggttgaaggttttccgccttcacatgccgggaccattaccgtctatgaaggttccagaccaggtacgctgaatgattttctcggtgccatgacggaggatgatgtccgaccggaggcactgcgccgctttgagcagatggtggaagaggtgtcacgtaacgcctccgcggttgcacagaatacggcagccgcgaaaaaatcagccagcgatgccagtgcatcagccagcgaggcggcaactcatgcaaccgatgctgcagcctcagcacgtgccgccagcacgtcagccggacaggccgcgtcgtcggctcagtcagcgtcttccagcgcaggaacggcatcgacaaaggcccgtgaagcagcaaaaagtgctgctgctgcagagtcatcaaaaagcgcggcagctaccagcgccagtgccgcgaaaacgtcagaaacgaatgccgcagcgtcacaacaatcagcagccacttctgcatccaccgcgaccacgaaagcgtcagaagcagccacttcagcacgggatgcgtcggcttcaaaagaggcggcaaaatcatcagaaacgaacgcagcctcgagcgccagcagcgcagcttcctcggcaacggcggcagcaaattctgcgaaggcggcaaaacgtccgagacgaacgccaggtcttctgaaacggcagcgggacagagcgcctcagctgcggcagactcaaaaacagcggctgcattatctgccagtgccgcgtcaacaagtgccgggcaggcctcagccagtgccaccgccgccggaaaatcggcagaaagtgctgcatcgtctgcttcaacagccacaacgaaggctggcgaagccgctgtacaggccagcgcagcagcgaggtctgcttccgcagcgaagacatccaagacgaacgcgaaagcgtcggaaaccagcgcagaatcctcaaaaacggctgccgcatcgtccgccagttcggcggcgtcatcggcatcatctgcgtctgcttcaaaagatgaggcgaccagacaggcgtcagcagcaaagggcagcgccacgacggcatccacgaaggcgacagaggcagctggcagtgcgacggcggcagctcagagcaaaagtacggcggaatccgcggcaacgcgcgctgagacagcggcaaaacgggcagaggatattgcatccgccgtggcgcttgaggatgcgagcacgacgaaaaaggggatag

SEQ ID NO: 3622 - protein, 434 aa, Escherichia coli
MVNTVASENPDEAGRYSMDVEHGQYSVTLLVEGFPPSHAGTITVYEGSRPGTLNDFLGAMTEDDVRPEALRRFEQMVEEVSRNASAVAQNTAAAKKSASDASASASEAATHATDAAASARAASTSAGQAASSAQSASSSAGTASTKAREAAKSAAAAESSKSAAATSASAAKTSETNAAASQQSAATSASTATTKASEAATSARDASASKEAAKSSETNAASSASSAASSATAAANSAKAAKRPRRTPGLLKRQRDRAPQLRQTQKQRLHYLPVPRQQVPGRPQPVPPPPENRQKVLHRLLQQPQRRLAKPLYRPAQQRGLLPQRRHPRRTRKRRKPAQNPQKRLPHRPPVRRRHRHHLRLLQKMRRPDRRQQQRAAPRRHPRRRQRQLAVRRRQLRAKVRRNPRQRALRQRQNGQRILHPPWRLRMRARRKRG

SEQ ID NO: 3623 - DNA, 654 bp, Escherichia coli
gtggatgccgtcgtggcgctgccctttgctgctgacgcctgtctggtcgcctcatcttttgaagcagacgcagatgatgccgatgacgccgccgaactggcggacgatgcggcagccgtttttgaggattctgcgctggtttccgacgctttcgcgttcgtcttggatgtcttcgctgcggaagcagacctcgctgctgcgctggcctgtacagcggcttcgccagccttcgttgtggctgttgaagcagacgatgcagcactttctgccgattttccggcggcggtggcactggctgaggcctgcccggcacttgttgacgcggcactggcagataatgcagccgctgtttttgagtctgccgcagctgaggcgctctgtcccgctgccgtttcagaagacctggcgttcgtctcggacgttttgccgccttcgcagaatttgctgccgccgttgccgaggaagctgcgctgctggcgctcgaggctgcgttcgtttctgatgattttgccgcctcttttgaagccgacgcatcccgtgctgaagtggctgcttctgacgctttcgtggtcgcggtggatgcagaagtggctgctgattgttgtgacgctgcggcattcgtttctgacgttttcgcggcactggcgctggtag

SEQ ID NO: 3624 - protein, 217 aa, Escherichia coli
MDAVVALPFAADACLVASSFEADADDADDAAELADDAAAVFEDSALVSDAFAFVLDVFAAEADLAAALACTAASPAFVVAVEADDAALSADFPAAVALAEACPALVDAALADNAAAVFESAAAEALCPAAVSEDLAFVSDVLPPSQNLLPPLPRKLRCWRSRLRSFLMILPPLLKPTHPVLKWLLLTLSWSRWMQKWLLIVVTLRHSFLTFSRHWRW

SEQ ID NO: 3625 - DNA, 204 bp, Escherichia coli
gtggctgcttctgacgctttcgtggtcgcggtggatgcagaagtggctgctgattgttgtgacgctgcggcattcgtttctgacgttttcgcggcactggcgctggtagctgccgcgctttttgatgactctgcagcagcagcactttttgctgcttcacgggcctttgtcgatgccgttcctgcgctggaagacgctgactga

SEQ ID NO: 3626 - protein, 67 aa, Escherichia coli
MAASDAFVVAVDAEVAADCCDAAAFVSDVFAALALVAAALFDDSAAAALFAASRAFVDAVPALEDAD

SEQ ID NO: 3627 - DNA, 600 bp, Escherichia coli
atgcgtaaagtttgtgcagtcattttgtccgcagccatctgtctgtccgtatccggtgcgcctgcatgggcgtctgaacatcagtccacactgagcgcggggtatcttcatgcccgtacgaacgctcccggcagcgataatctgaacgggattaacgtgaaataccgttatgagtttacggacgcgctggggctgattacgtccttcagttatgccaatgctgaggatgagcaaaaaacgcactacagcgatacccgctggcatgaagattccgtgcgtaaccgctggttcagcgtgatggcggggccgtctgtacgcgtgaatgaatggttcagcgcgtattcgatggcgggtgtggcttacagccgtgtgtcgactttctccggggattatctccgcgtaactgacaacaaggggaaaacgcacgatgtgctgaccggaagtgatgacggtcgccacagcaacacgtctctggcgtggggggctggcgtgcagtttaacccgaccgaatccgtgaccattgaccttgcttatgaaggttccggtagtggcgactggcgaacggatgcatttattgttggtatcggataccgtttctga

SEQ ID NO: 3628 - protein, 199 aa, Escherichia coli
MRKVCAVILSAAICLSVSGAPAWASEHQSTLSAGYLHARTNAPGSDNLNGINVKYRYEFTDALGLITSFSYANAEDEQKTHYSDTRWHEDSVRNRWFSVMAGPSVRVNEWFSAYSMAGVAYSRVSTFSGDYLRVTDNKGKTHDVLTGSDDGRHSNTSLAWGAGVQFNPTESVTIDLAYEGSGSGDWRTDAFIVGIGYRF

SEQ ID NO: 3629 - DNA, 1761 bp, Escherichia coli
gtgagtatccgtgagaacgatgacggcacgtatgccatcaccgccgtgcagcatgtaccggagaaagaagccatcgtggataacggggcgcactttgacggtgaccagagcggcacggtgaatggtgtcacgccgccagcagtgcagcacctgaccgccgaagtcactgcagacagcggggaatatcaggtgctggcgcgatgggacacaccgaaggtggtgaagggcgtgagcttcctgctccgtctgaccgtaacagcggacgacggcagtgagcgactggtcagcacggcccggacgacggaaaccacataccgcttcacgcaactggcgctggggaactacaggctgacagtccgggcggtaaatgcccgggggcagcagggcgatccggcgtcggtatcgttccggattgccgcaccggcagcaccgtcgaggattgagctgacgccgggctattttcagataaccgccacgccgcatcttgctgtttatgacccgacggtacagtttgagttctggttctcggaaaagcggattaccgatatcaggcaggttgaaaccacagcccgctatcttggtacggcgctgtactggatagccgccagtatcaatatcaaaccgggccatgattattatttttacgttcgcagtgtgaacaccgttggcaaatcggcattcgtggaggctgtcggtcgggcgagcgatgatgcggaaggttacctggattttttcaaaggagaaatcgggaaaacacatctggcccaggagttgtggacgcagattgataacggtcagcttgcgccggacctggctgaaatcaggacgtccattacgaatgtcagcaatgaaatcacgcagaccgtcaataaaaaactggaagaccagagtgcggcaatccagcagatacagaaagttcaggttgatacaaataataacctgaacagcatgtgggccgtgaaactgcagcagatgaaggacggacgcctttatattgcgggtatcggagccggtattgagaatacgccagcaggtatgcagagtcaggtgcttctggctgctgaccggattgcgatgattaatcctgcgaatggcaacacaaagccgatgtttgttggtcagggcgatcagatattcatgaacgacgtgttcctgaaacgcctgacggctccgaccattaccagcggcggtaatcctccggcattttccctgacaccggacgggcggctgacggcgaaaaatgccgatatcagcggtaacgtgaatgcgaactccgggacgctcaacaacgtcacgattaacgagaactgtcgggttctgggaaaattgtccgccaaccagattgaaggcgatctcgttaaaacagtgggcaaagctttcccccgggactcccgtgcaccggaacggtggccatcagggaccatcaccgtcagggtttatgacgatcagccgtttgaccggcagattgttattccggcggtggcattcagcggcgctaaacatgagcgggagaataacgatatttattcgtcatgccgcctgatagtacggaaaaacggtgctgaaatttataaccgtaccgcgctggataatacgctgatttacagtggtgttattgatatgccagctggtcgcggccacatgacgctggagttttcggtgtcagcatggctggtgaataactggtatcccacagcaagtatcagcgatttgctggttgtggtgatgaagaaagccaccgcaggcatcagtatcagctga

SEQ ID NO: 3630 - protein, 586 aa, Escherichia coli
MSIRENDDGTYAITAVQHVPEKEAIVDNGAHFDGDQSGTVNGVTPPAVQHLTAEVTADSGEYQVLARWDTPKVVKGVSFLLRLTVTADDGSERLVSTARTTETTYRFTQLALGNYRLTVRAVNARGQQGDPASVSFRIAAPAAPSRIELTPGYFQITATPHLAVYDPTVQFEFWFSEKRITDIRQVETTARYLGTALYWIAASINIKPGHDYYFYVRSVNTVGKSAFVEAVGRASDDAEGYLDFFKGEIGKTHLAQELWTQIDNGQLAPDLAEIRTSITNVSNEITQTVNKKLEDQSAAIQQIQKVQVDTNNNLNSMWAVKLQQMKDGRLYIAGIGAGIENTPAGMQSQVLLAADRIAMINPANGNTKPMFVGQGDQIFMNDVFLKRLTAPTITSGGNPPAFSLTPDGRLTAKNADISGNVNANSGTLNNVTINENCRVLGKLSANQIEGDLVKTVGKAFPRDSRAPERWPSGTITVRVYDDQPFDRQIVIPAVAFSGAKHERENNDIYSSCRLIVRKNGAEIYNRTALDNTLIYSGVIDMPAGRGHMTLEFSVSAWLVNNWYPTASISDLLVVVMKKATAGISIS

SEQ ID NO: 3631 - DNA, 1722 bp, Escherichia coli
atgggtaaaggaagcagtaaggggcataccccgcgcgaagcgagggacaacctgaagtccacgcagctgctgagtgtgatcgatgccatcagcgaagggccggttgaaggtccggtggacggattaaaaagcgtgctgctgaacagtacgccggtgctggacagtgaggggaataccaatatatccggtgtcacggtggtgttccgggcaggtgagcaggagcagacaccgccggagggatttgaatcctccggctccgagacggtgctgggtacggaagtgaaatatgacacgccgatcacccggaccatcacgtcggcaaacatcgaccgtctgcgctttaccttcggtgtgcaggcactggtggaaaccacctcaaagggggacaggaatccgtcggaagtccgcctgctggttcagatccagcgtaacggtggctgggtgacggaaaaagacatcaccattaagggcaaaaccacctcgcagtatctggcctcggtggtggtggataacctgccgccgcgcccgtttaatatccggatgcgcagaatgacgccggacagcaccacagaccagctgcagaacaaaacgctctggtcgtcatacaccgaaatcatcgatgtgaaacagtgctacccgaacacggcactggtcggcgtgcaggtggactcggaacagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgccctgaaggaccgccataatgccgttgaggtgaactggattgacccggataacggctgggagacggcgacagagcttgtggaggacacgcaggccattgcccgttacggtcgtaacgtcacgaagatggatgcctttggctgtaccagccgggggcaggcacaccgcgccgggctgtggctgattaaaacggaactgctggaaacgcagaccgtggacttcagcgtgggtgcagaagggcttcgccatgtaccgggcgatgtcattgaaatctgcgatgatgactatgcgggtatcagcaccggcgggcgcgtgctggcggtgaacagccagacccggacgctgacgctcgaccgtgaaatcacgctgccatcctccggcaccacgctgataagcctggttgacggacaggggaatccggtcagcgtggaggtccagtccgtcaccgacggcgtgaaggtgaaagtgagccgtgttcctgacggcgttgcagaatacagcgtgtgggggctgaagctgccgacgctgcgccagcgctgttccgctgcgtga

SEQ ID NO: 3632 - protein, 573 aa, Escherichia coli
MGKGSSKGHTPREARDNLKSTQLLSVIDAISEGPVEGPVDGLKSVLLNSTPVLDSEGNTNISGVTVVFRAGEQEQTPPEGFESSGSETVLGTEVKYDTPITRTITSANIDRLRFTFGVQALVETTSKGDRNPSEVRLLVQIQRNGGWVTEKDITIKGKTTSQYLASVVVDNLPPRPFNIRMRRMTPDSTTDQLQNKTLWSSYTEIIDVKQCYPNTALVGVQVDSEQFGSQQVSRNYHLRGRILQVPSNYNPQTRQYSGIWDGTFKPAYSNNMAWCLWDMLTHPRYGMGKRLGAADVDKWALYVIGQNCDQSVPDGFGGTEPRITCNAWLTTQRKAWDVLSDFCSAMRCMPVWNGQTLTFVQDRPSDKVWTYNRSNVVMPDDGAPFRYSFSALKDRHNAVEVNWIDPDNGWETATELVEDTQAIARYGRNVTKMDAFGCTSRGQAHRAGLWLIKTELLETQTVDFSVGAEGLRHVPGDVIEICDDDYAGISTGGRVLAVNSQTRTLTLDREITLPSSGTTLISLVDGQGNPVSVEVQSVTDGVKVKVSRVPDGVAEYSVWGLKLPTLRQRCSAA

SEQ ID NO: 3633 - DNA, 576 bp, Escherichia coli
ttgcaacgatttggccgccgcatcgaccttcgtgtgaaaacgggggctgaagccatccgggcactggccacacagctcccggcgtttcgtcagaaactgagcgatggctggtatcaggtacggattgccgggcgggatgcaggagaaaccgaattatcatcccgtcttaatgagccgctggcaaatggtgccgtgatccacatcgtgccgcgtcttgcgggagcaaaaagtggcggtgtgtttcaggcggtgctgggtgcggcgttgattgctacggcaatctggatgccggggatcagtatcgctttcagtgacattctcttttcaatgggtgcggcgatgacgcttggtggtgtggcgcagatgctggcaccgaaagccagaactccccgtacacagacaacggataacggcaaacagaacacctatttctcctcactggataacatggttgcccagggcaatgtcctgcctgttctgtacggtgaaatgcgcgtggggtcacgtgtggcatctcaggagatcagcacggcagatgaaggggatggtggtcaggttgtggtaattgggcggtaa

SEQ ID NO: 3634 - protein, 191 aa, Escherichia coli
MQRFGRRIDLRVKTGAEAIRALATQLPAFRQKLSDGWYQVRIAGRDAGETELSSRLNEPLANGAVIHIVPRLAGAKSGGVFQAVLGAALIATAIWMPGISIAFSDILFSMGAAMTLGGVAQMLAPKARTPRTQTTDNGKQNTYFSSLDNMVAQGNVLPVLYGEMRVGSRVASQEISTADEGDGGQVVVIGR

SEQ ID NO: 3635 - DNA, 636 bp, Escherichia coli
gtgaatatctccggtgagccggaggcgtatttccggatggctccggaggactggctgcaggcagagatgcagggtgagattgtggcgctggtccacagccaccccggtggtctgccctggctgagtgaggctgaccggcggctgcaggtgcagagcgatttgccgtggtggctggtctgccggggggcgattcacaagttccgctgtgtgccgcatctcaccgggcggcgctttgagtacggggtgacagactgttacacactgttccgggatgcttaccatctggcggggattgagatgccggattttcatcgcggggatgactggtggcgtcacggtcagaatctctatcttgacaatatggaggctactggtttttaccgtgtcgcactgacagaggcgcagccgggcgatgtgctgctgtgctgttttggttcatcggtgccgaatcacgccgccatttactgcggcgacggtgagctgctgcaccatattcctgaacaactgagtaaacgagagaggtataccgacaaatggcagcgacgcacacactccctctggcgtcaccgggaatggcacgcatctgcctttacggggatttgcaacgatttggccgccgcatcgaccttcgtgtga

SEQ ID NO: 3636 - protein, 211 aa, Escherichia coli
MNISGEPEAYFRMAPEDWLQAEMQGEIVALVHSHPGGLPWLSEADRRLQVQSDLPWWLVCRGAIHKFRCVPHLTGRRFEYGVTDCYTLFRDAYHLAGIEMPDFHRGDDWWRHGQNLYLDNMEATGFYRVALTEAQPGDVLLCCFGSSVPNHAAIYCGDGELLHHIPEQLSKRERYTDKWQRRTHSLWRHREWHASAFTGICNDLAAASTFV

SEQ ID NO: 3637 - DNA, 318 bp, Escherichia coli
gtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtgcggttatcacggtccggcagtcgcggatgaatatgaccagccgacgtccgatatcacgaaggataaatgcagcaaatgcctgagcggctgtaagtttcgcaataacgtcggcaactttggcggcttcctttccattaacaaacttttcgcagtaatcccatga

SEQ ID NO: 3638 - protein, 105 aa, Escherichia coli
MISRWRIEQCSELSAVSASFVLSTPTETDGAVFPGRIMLANTCTWTYRGDECGYHGPAVADEYDQPTSDITKDKCSKCLSGCKFRNNVGNFGGFLSINKLFAVIP

SEQ ID NO: 3639 - DNA, 321 bp, Escherichia coli
atgcaggatatccggcaggaaacactgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggaggcagtatcaggcgtatcccattcaggggagcggttttgaactgaatggcaaaggcaccagtacgcggcccacgctggcagtctctaacctgtacggcatggtcaccggtatggtggaagatatgcagagtctggtcggcggaacggtggtccgggcgtaa

SEQ ID NO: 3640 - protein, 106 aa, Escherichia coli
MQDIRQETLNECTRAEQSASVVLWEIDLTEVGGERYFFCNEQNEKGEPVTWQGRQYQAYPIQGSGFELNGKGTSTRPTLAVSNLYGMVTGMVEDMQSLVGGTVVRA

SEQ ID NO: 3641 - DNA, 330 bp, Escherichia coli; identical to SEQ ID NO: 3147

SEQ ID NO: 3642 - protein, 109 aa, Escherichia coli; identical to SEQ ID NO: 3148

SEQ ID NO: 3643 - DNA, 2574 bp, Escherichia coli
atgtcccagccggttggtgatcttgttattgacctgagtctggatgctgtccgtttcgatgagcagatgagccgggtaaggcgtcatttttcaggtctggataccgacgccagaaaaaccgccagtgctgttgaacagggcctgagccgccaggcgctggctgcacaaaaagccgggatttccgtcgggcagtataaagcggccatgcgaaccctgcccgcacagtttacggatatcgccacgcagcttgccggtggtcagaatccctggttgatcctgctgcaacagggcggtcaggtgaaggactccttcggcgggatgatccccatgttcagggggcttgccggtgcgatcaccctgccgatggtcggggtcacctcgctggcggtggcgacaggtgcgctggcgtacgcctggtaccagggcgacgccacgctttcagaatttaataaaacgctggtcctttccggcaatcaggccggactgactgccgatcgtatgctgacgctctcaagagccgggcaggcagcagggctgacgtttaaccaggcgagagagtcactggcagccctggtgaatgccggtgtgcgtggtggtgaacagtttgatgccatcaaccagagtgtcgcgcgttttgcgtctgcatccggtgtggaggtggataaagtcgctgaagccttcgggaagctgaccactgacccgacgtcgggactgatggcgatggcgcgccagttccgtaacgtgacggcagagcagattgcgtatgttgcacagctgcagcgttccggagacgaggccggggcattgcaggcggcgaacgatatcgccacgaaaggctttgatgagcagacccgtcgcctgaaagaaaacatgggaacactggagacctgggcggataaaacagggaaggcattcaaatcgatgtgggatgccattctggatatcggtcgtccggaatcctcagcggatatgctcgccagtgcgcagaaggcatttgatgaggcggataaaaaatggcagtggtaccagagccggagccagcgccggggaaagacctcctcttttcgtgcgaaccttcagggggcatgggatgtccgggaaaatgcccgtctgggtctggcagcggccacgctgcagtcggatatggaaaaagccggtgaactggcggcaagggacagggctgagcgtgagtcgtcacagctgaagtataccggagaggcgcagaaggcgtatgagcgcctgcagacgccgctggataaatataccgcccgtcagaaagagctgaataaggccctgaaagacggaaaaatcctgcaggcggattacaacacgctgatggcgtcggcaaaaaaggattatgaatcgacgctgaaaaagccgtcaggtgtgaaggtgtctgccggtgagcgccaggaagaccgggcgcatgcagccctgctggcgcttgaaaccgagctcaggacgctggaaaaacacagcggtgtgaatgagaaaatcagccagcagcgccgggatttatgggaagcggaaagtcagtatgtggtcctgaaagaggccgccacgaaacggcagttatctgagcaggaaaaatccctgctggctcatgagaaagagacgctggagtacaaacgccagctggctgagctgggagacaagattgaacaccagaagcggctgaatgagctggcacagcaggcggcgcggtttgaacagcagcaaagcgcgaagcaggcggcaatcagcgcaaaagcccgcggcctcaccgaccgtcaggcgcagcgggagtcggaagagcagcgccttcgtgaggtgtacggtgataatccggctgcgctggcgaaggccacatcggcactgaagaacacctggtctgcggaggagcagcttcgtggaagctggatggccgggatgaagtccggctggggagagtgggcggaaagtgcgacggacagtttttcgcaggttaaaagtgtggccacgcagacctttgacggtattgcacagaatatggcggcgatgctgaccggcagcgaacagaactggcggggattcacccgttccgtgctgtccatgatgacagaaattctgcttaagcaggcaatggtggggattgtcgggagtatcggcagcgccattggcggggctgttggtggcggcgcatccgcgtcaggcggtacagccattcaggccgctgcggcgaaactccattttgcaaccggaggatttacgggaaccggcggcaaatatgagccagcggggattgttcaccgtggtgaatttgtcttcacaaaggaggcaaccagccggattggcgtggggaatctctatcggctgatgcgcggctatgccaccggtggttatgtcggtacaccgggcagtctggctgacagccggtcgcaggcgtccgggacgtttgagcagaataaccatgtggtgattaacaacgacggcacgaacgggcagataggtccggctgctctgaaggcggtgtatgacatggcccgcaagggtgcccgtgatgaaattcagacacagatgcgtgatggtggactgttctccggaggtggacgatga

SEQ ID NO: 3644 - protein, 857 aa, Escherichia coli
MSQPVGDLVIDLSLDAVRFDEQMSRVRRHFSGLDTDARKTASAVEQGLSRQALAAQKAGISVGQYKAAMRTLPAQFTDIATQLAGGQNPWLILLQQGGQVKDSFGGMIPMFRGLAGAITLPMVGVTSLAVATGALAYAWYQGDATLSEFNKTLVLSGNQAGLTADRMLTLSRAGQAAGLTFNQARESLAALVNAGVRGGEQFDAINQSVARFASASGVEVDKVAEAFGKLTTDPTSGLMAMARQFRNVTAEQIAYVAQLQRSGDEAGALQAANDIATKGFDEQTRRLKENMGTLETWADKTGKAFKSMWDAILDIGRPESSADMLASAQKAFDEADKKWQWYQSRSQRRGKTSSFRANLQGAWDVRENARLGLAAATLQSDMEKAGELAARDRAERESSQLKYTGEAQKAYERLQTPLDKYTARQKELNKALKDGKILQADYNTLMASAKKDYESTLKKPSGVKVSAGERQEDRAHAALLALETELRTLEKHSGVNEKISQQRRDLWEAESQYVVLKEAATKRQLSEQEKSLLAHEKETLEYKRQLAELGDKIEHQKRLNELAQQAARFEQQQSAKQAAISAKARGLTDRQAQRESEEQRLREVYGDNPAALAKATSALKNTWSAEEQLRGSWMAGMKSGWGEWAESATDSFSQVKSVATQTFDGIAQNMAAMLTGSEQNWRGFTRSVLSMMTEILLKQAMVGIVGSIGSAIGGAVGGGASASGGTAIQAAAAKLHFATGGFTGTGGKYEPAGIVHRGEFVFTKEATSRIGVGNLYRLMRGYATGGYVGTPGSLADSRSQASGTFEQNNHVVINNDGTNGQIGPAALKAVYDMARKGARDEIQTQMRDGGLFSGGGR

SEQ ID NO: 3645 - DNA, 390 bp, Escherichia coli
atgcttgccgggatgacatccaccgaatatgccgactggcaccgtttttaccgcacgcattattttcaggatacccagctggatatgcatttttccgggctgacgtacgctgtactcagcctgtttttttgcgatccggatatgcatccctctgatttcagtctgcttgtcccccggcatgaggaagagcaggtggagaggccggatgaggacaaaatgctgatgcagaaagcggcaggacttgccggaggcgtccggttcggtggggacggagggcgcgatattttatcgtctgcggatgtggcggatgtcatggtggatgatgccgcattaatgatggcttcagcggggattccgggaggtgtgagatatgtcccagccggttggtga

SEQ ID NO: 3646 - protein, 129 aa, Escherichia coli
MLAGMTSTEYADWHRFYRTHYFQDTQLDMHFSGLTYAVLSLFFCDPDMHPSDFSLLVPRHEEEQVERPDEDKMLMQKAAGLAGGVRFGGDGGRDILSSADVADVMVDDAALMMASAGIPGGVRYVPAGW

SEQ ID NO: 3647 - DNA, 432 bp, Escherichia coli
atgtttctgaaaacagaacaatttgaatataacggtgtgtctgtcacgctttccgaattgtctgcgctgcagcgtatcgagcatcttgccctcctgaaacggcgtgcagaacaggcagaatcctgcggcaacctgcaggtaagcgtggaagatctcgtcagaaccggcgcgtttctggtggcgatgtccctgtggcataaccatccacagaaaacgcagtcaccgtcaatgaatgaggccgtgatgaagatagagcaggaagtgctcaccacctggcctgccgatgccattgcccgggcggaagacgtggtgttgtgcctgtccgggatgatcgaagctgttcgtccggatactgatattactgaagtggcgaaaaataacacgctgactgatgatgatttttctgcgggaaagtcttcgacggcgagctga

SEQ ID NO: 3648 - protein, 143 aa, Escherichia coli
MFLKTEQFEYNGVSVTLSELSALQRIEHLALLKRRAEQAESCGNLQVSVEDLVRTGAFLVAMSLWHNHPQKTQSPSMNEAVMKIEQEVLTTWPADAIARAEDVVLCLSGMIEAVRPDTDITEVAKNNTLTDDDFSAGKSSTAS

SEQ ID NO: 3649 - DNA, 753 bp, Escherichia coli
atggcaacaccaaatccccttgagccggtaaaaggtgccggtaccactctgtgggtttacaacggcaagggtgatgcttatgcaaacccgttgtcagacgatgactggcagcgactggctaaggtgaaggatctgacgccgggcgagatgacggcagaatcctacgatgataactacctggatgatgaagacgcggactggaccgcgaccgggcaggggcagaaatctgcaggtgataccagttttacgctggcctggaaaccgggagaggaaggccagaaagggcttataggctggtttgaaagcggcgatgtccgggcctataaaatccgttttccgaatggcacggtggatgtgtttcgtggctgggtcagcagtatcggtaaggccgtgacggcgaaagaagtgatcacccgcacggtgaaagtcactaacgtgggtaaaccttctgtagcggaagaacgcagcaaaattacgccggtcagtgcgattaaggtgacgccgacatccggtacggtggcaaaagggaaaacaaccaccctgacggtttcttttgagccggaaagtgcaaccgacaagacgttcagagcggtttccgccgatccgtcgaaagccaccattagtgtgaaagatatgacaattacggtaaacggcgtggcgacaggtaaggtgcagatccctgtggtgagcggaaatggtcagttcgccgcagtggctgaagtcaccgttactgaagcgggcgctgcagggtaa

SEQ ID NO: 3650 - protein, 250 aa, Escherichia coli
MATPNPLEPVKGAGTTLWVYNGKGDAYANPLSDDDWQRLAKVKDLTPGEMTAESYDDNYLDDEDADWTATGQGQKSAGDTSFTLAWKPGEEGQKGLIGWFESGDVRAYKIRFPNGTVDVFRGWVSSIGKAVTAKEVITRTVKVTNVGKPSVAEERSKITPVSAIKVTPTSGTVAKGKTTTLTVSFEPESATDKTFRAVSADPSKATISVKDMTITVNGVATGKVQIPVVSGNGQFAAVAEVTVTEAGAAG

SEQ ID NO: 3651 - DNA, 396 bp, Escherichia coli
atgaaacacactgacattcgtgccgcagtgctggatgcactcgagcagcatgaacacggggcgacgctgtttgatggtcgccccgttgtttttgacgaagaggattttcctgcgatcgcggtttatctgacggatgcagagtataccggtgaagagctggatgcagatacctggcgggccacgctgcatattgaggtgtttttaccggcacaggtaccggattcagagcttgatcagtggatggaaagccggatttacccggcgatgaccgcgatcccggcactggcaggactgattaccacgatggttacgcagggctatgagtatcgtcgtgatgacgatatggcgttatggagttctgcagatctgacttattccattacatacgagatgtga

SEQ ID NO: 3652 - protein, 131 aa, Escherichia coli
MKHTDIRAAVLDALEQHEHGATLFDGRPVVFDEEDFPAIAVYLTDAEYTGEELDADTWRATLHIEVFLPAQVPDSELDQWMESRIYPAMTAIPALAGLITTMVTQGYEYRRDDDMALWSSADLTYSITYEM

SEQ ID NO: 3653 - DNA, 534 bp, Escherichia coli
atggcgataaaagggcttgatcaggcgattgacaatctgagccgggttcgtaaaaacgccattccggcggcttcagcaatggccattaaccgcgtggccacaacggcgattaatcagtcttcatcacaggttgcccgggagacaaaggttcgccggaaactggttaaggaacggtccagactgaaacgggcgacggtcagaaatccgaatgccagaattatcgttaaccgcggtgatctccctgtgattaagctggggatcaggatgctggggcgtcgcccgaacagcatacttaaagccggtcagcatcggtatcagcgggcatttattcagagattaaaaaatggtcgctggcatgtcatgcagcgtgtggccgggaaaaaccgttaccccattgatgtggtgaaaatcccgatggcggccccactgaaacaggcatttgatgagaatgttgaccgtatccggcgtgaacgcctgcctaaagaactggcatacgcgctgaaacaacaactgaggattgcaataaaacgatga

SEQ ID NO: 3654 - protein, 177 aa, Escherichia coli
MAIKGLDQAIDNLSRVRKNAIPAASAMAINRVATTAINQSSSQVARETKVRRKLVKERSRLKRATVRNPNARIIVNRGDLPVIKLGIRMLGRRPNSILKAGQHRYQRAFIQRLKNGRWHVMQRVAGKNRYPIDVVKIPMAAPLKQAFDENVDRIRRERLPKELAYALKQQLRIAIKR

SEQ ID NO: 3655 - DNA, 354 bp, Escherichia coli
atgcgtgattttcagaatgcctttgatgctgccctcgccggggtagacagtacgatcgttgaagtgatggggctctgtgcgcagttcacctcgggggcacagtgtggcagcgaagttcagggggtttttgatgatccggagtcgctggggtttgccggtggcggggtccgtattgaaggaagcagcccgtcattatttgtgcggacggatacggttcgtgccgtgcggcgtggtgacacgctgaccattaatggtgagatattctgggtggatcgtgtttctccggatgacgggggcagctgttatctctggctcaaccgtggtcaaccacccgcagttaaccggcgacgataa

SEQ ID NO: 3656 - protein, 117 aa, Escherichia coli
MRDFQNAFDAALAGVDSTIVEVMGLCAQFTSGAQCGSEVQGVFDDPESLGFAGGGVRIEGSSPSLFVRTDTVRAVRRGDTLTINGEIFWVDRVSPDDGGSCYLWLNRGQPPAVNRRR

SEQ ID NO: 3657 - DNA, 384 bp, Escherichia coli
atggcaacaaaagaagaaaatctgaatcgtcttcgtcaactggctgacctgctggggcgcgaggcggatatgtcggggagtgctgcggatattgctcaacgtgtgtctgagtgggaagaggagcttgctgtttccccggagggcattatgcactctgatgagagcggggctgatcaaaatcacacagacgatggtgagcagttgaacaacacggatgctccggatgatgttaaagccgtccgggtacggaagtgcctgcaagtaatggggtattgcccggagacaggtcgtcccgttgagctggcgttacggggtatgcgtgttctggtgccatcatcactggcaacggccatgatacagcacggaacggctgaatatgcgtga

SEQ ID NO: 3658 - protein, 127 aa, Escherichia coli
MATKEENLNRLRQLADLLGREADMSGSAADIAQRVSEWEEELAVSPEGIMHSDESGADQNHTDDGEQLNNTDAPDDVKAVRVRKCLQVMGYCPETGRPVELALRGMRVLVPSSLATAMIQHGTAEYA

SEQ ID NO: 3659 - DNA, 1029 bp, Escherichia coli
atgggattgtttacgacccgccagttactcggttataccgaacaaaaagtgaaattccgtgcgctgtttctggagctgtttttccgccgtacggtgaatttccacaccgaagaggtgatgctggacaaaattaccggaaaaacgccggtggcggcctatgtctccccgatcgttgaaggaaaagtgcttcgccatcgcggtggtgaaacccgcgtgttacgtccgggctacgtcaagccgaaacacgaatttaattaccagcaggcggttgagcgccttcctggtgaagatccggctcagctgaacgacccggcctaccgtcgtctgcgtatcattaccgataacctcaaacaggaagagcacgccattgtccaggtggaagaaatgcaggcggtgaatgccgtgctgtatggcaaatacaccatggaaggggatcagtttgatactgtcgaggtggatttcgggcgctctgaaggaaataacattgagcaggctgacggtaaaaaatggtctgagcaggaccgtgatacgtttgatccgacgcatgatattgacctctactgcgatcaggccagcggccttgtgaatatcgccattatggacggtacggtctggcgtctgctgaatggctttaagctgttccgcgaaaaactggatacccgtcgcggctcaaattcacaactcgaaacggcagtgaaagatctgggcgcagtggtgtccttcaaggggtattacggcgatctggccattgtggtggcgaaaacgtcttatgtggcagaggacggtaccgaaaaacgttatctgccggagggcatgctggtgttggggaatacggcggcagaggggattcgttgctatggtgccattaaggatgcacaggcgttgtctgaaggagtggtggcttcttcccgttacccgaaacactggctgaccgtgggcgatccgtcctgtgaattcaccatgacgcagtccgctccgctgatggtgctgccggatccggatgagtttgtggtggtacaggtgaaataa

SEQ ID NO: 3660 - protein, 342 aa, Escherichia coli
MGLFTTRQLLGYTEQKVKFRALFLELFFRRTVNFHTEEVMLDKITGKTPVAAYVSPIVEGKVLRHRGGETRVLRPGYVKPKHEFNYQQAVERLPGEDPAQLNDPAYRRLRIITDNLKQEEHAIVQVEEMQAVNAVLYGKYTMEGDQFDTVEVDFGRSEGNNIEQADGKKWSEQDRDTFDPTHDIDLYCDQASGLVNIAIMDGTVWRLLNGFKLFREKLDTRRGSNSQLETAVKDLGAVVSFKGYYGDLAIVVAKTSYVAEDGTEKRYLPEGMLVLGNTAAEGIRCYGAIKDAQALSEGVVASSRYPKHWLTVGDPSCEFTMTQSAPLMVLPDPDEFVVVQVK

SEQ ID NO: 3661 - DNA, 348 bp, Escherichia coli
atggtgacgaaaaccatcactgaacagcgtgcggaagtacgtatttttgccggtaatgatccggctcataccgccacaggcagcagcgggatttcytckscaacaccggcwctgacgcccctgatgctggatgaagccaccgggaaactggtggtctgggatggacagaaagccggtagtgcggttggcatactggtactgccgcttgaaggcacagagacggtgctgacctattacaagtcggggacctttgcgacggaggcaatccgctggcctgacagtgtggatgaacacaaaaaggcaaatgcctttgccggcacagccctgagtcacgcggctctgccgtaa

SEQ ID NO: 3662 - protein, 115 aa, Escherichia coli
  Xaa 34: Xaa is any amino acid
MVTKTITEQRAEVRIFAGNDPAHTATGSSGISSXTPALTPLMLDEATGKLVVWDGQKAGSAVGILVLPLEGTETVLTYYKSGTFATEAIRWPDSVDEHKKANAFAGTALSHAALP

SEQ ID NO: 3663 - DNA, 1506 bp, Escherichia coli
gtgagacgtaatctttcacacattattgcmgcagcattcaatgaaccgctgcttctggagcccgcctatgcgcgggttttcttttgcgcgctggggcgcgagatgggggcagcaagtctttcggtaccgcaacagcaggtacagcttgatgctcccgggatgctggctgaaacggacgagtacatggccggaggtaaacgaccggcccgtgtttaccgggtggtgaacggtattgcggtactgccggtgaccggcacgctggtgcaccggctgggggggatgcggccattttccggaatgactggctatgacggcattgtcgcctgtcttcagcaggcaatggcagatagccaggtgcggggcatactgctggacattgacagtccgggcgggcaggccgccggcgcgtttgactgcgctgacatgatttaccgcctccggcagcagaagccggtctgggcactgtgtaatgacacggcctgttctgcggccatgctgctggcgtcggcctgctcccgacggctggttacccagacatcccgtatcggttccattggcgtgatgatgagccatgtcagctatgccggtcatctggcgcaggccggtgtggatatcacgctgatttactcaggggcgcacaaggtggatggcaatcagtttgaagcgttgccggcagaggttcgccaggacatgcagcagcggattgatgcggcgcgccggatgtttgccgaaaaagtggcgatgtttaccggtctgtctgttgatgcagtcacgggaacagaggccgctgtttttgaaggtcagtccggcattgaggccgggctggcggatgaattaatcaatgcgtcggatgccatcagtgtgatggccacggcgctgaacagtaatgtcagaggaggcactatgccgcaattaactgcaacggaagccgccgtgcaggagaaccagcgagtgatggggatcctgacatgccaggaagcgaaaggacgtgaacagcttgccacgatgctggcagggcaacagggcatgagcgttgaacaggcccgggcgattctggccgcggcggcaccgcagcagccggtggcatccgcgcagagtgaagccgatcgcattatggcgtgtgaagaagcgaacggtcgtgaacaactggcggcaacgctggcggcgatgccggagatgacggtggaaaaagcccgcccgatcctggcggctgcaccactggcggatgccgggccctcgcttcgtgatcagatcatggccctggatgaggcaaaaggggcagaagcgcaggctgaaaaactggcggcctgcccgggaatgaccgtggagaacgcccgggctgtgctggctgcgggatcaggtaaggccgaaccggtctctgcatccacaaccgccctgtttgaacatttcatggcgaatcattcaccggcagcggtgcggggtggcgtgtcacagacgtcagcagacggtgatgcggacgtgaaaatgctcatggccatgccatga

SEQ ID NO: 3664 - protein, 501 aa, Escherichia coli
MRRNLSHIIAAAFNEPLLLEPAYARVFFCALGREMGAASLSVPQQQVQLDAPGMLAETDEYMAGGKRPARVYRVVNGIAVLPVTGTLVHRLGGMRPFSGMTGYDGIVACLQQAMADSQVRGILLDIDSPGGQAAGAFDCADMIYRLRQQKPVWALCNDTACSAAMLLASACSRRLVTQTSRIGSIGVMMSHVSYAGHLAQAGVDITLIYSGAHKVDGNQFEALPAEVRQDMQQRIDAARRMFAEKVAMFTGLSVDAVTGTEAAVFEGQSGIEAGLADELINASDAISVMATALNSNVRGGTMPQLTATEAAVQENQRVMGILTCQEAKGREQLATMLAGQQGMSVEQARAILAAAAPQQPVASAQSEADRIMACEEANGREQLAATLAAMPEMTVEKARPILAAAPLADAGPSLRDQIMALDEAKGAEAQAEKLAACPGMTVENARAVLAAGSGKAEPVSASTTALFEHFMANHSPAAVRGGVSQTSADGDADVKMLMAMP

SEQ ID NO: 3665 - DNA, 1593 bp, Escherichia coli
atgaaacgaacgcctgtcctgattgatgtgaacggcgttccgcttcgkgagagyctcagctacamcggkggcggtgcaggatttggcgggcaaatggcwgagtggttgccaccskcgcagagtgccgatgcggccctgctgcccgcgttgcgtctggggaatgcccgkgcagatgatctggtgcgcaataacggaatagcggcyaatgcggtggcyctgcataaggatcacattgtcgggcatatgtttctgatyagctaccgtccgaactggcgctggctggggatgcgggagaccgcrgcaaaaagytttgtcgatgaggtggaggcggcctggtcrgaatacgcmgaagggatgtttggygagatcgacgtggaaggraaacgcacgttyacggaatttatccgtgaaggtgtgggcgttcatgcgtttaacggcgaaatctttgtgcagccggtctgggatacggarasyacgcarytrttycgtacgcgttttaaagccgtgagtccgaaacgggtggacacgccwggacacggtatsgggaaccgttttctgcgggccggtgtggaggtcgatcgatatggccgtgccgtygcgtaccatatctgtgaggatgattttcckykctcyggkagtggacgatgggaacggatcccgcgtgaactwcccaccgggcgtccggccatgctgcatattttcgagccggtggaggacgggcagacccgtggrgcyaatcagttttacagcgtyatggaacggctgaagatgctsgattccctgcaggcaacacagcttcagtcggccatagtgaaggcgatgtatgcagcgacgattgaaagtgamcttgataccgaaaaggcctttgaatatatcgccggygcgccrcaggrgcagaaggataatccgcttattaatattctggakaagttttccasctggtatgacacgaataacgtgacrctgggcggtgtcaaaattccgcaccttttccctggtgatgatctgaaactwcagacygcgcaggattcagacaatggattttckgcgcttgaacaggcgctgctgcggtatatcgccgccggtcttggcgtttcctacgaacagttgtcccgtgattactcgaaggtcagttactcaagtgcccgcgcmtccgccaatgagtcgtggcgctattttatggggcggcgaaaatttattgcgkcccggctggccacgcagatgttttcctgctggctggaagaggcacttcttcgggggattattcgtccgccacgggcacgktttgatttttatcaggcgcgatcagcctggtcacgggcwgagtggattggwgccggaagaatggccattgacgggctcaaggargtycaggaatcagtgatgcgcattgaggccggactgagcacgtatgagaaagagctggcgctgatgggcgaggattatcaggacattttccgccagcaggtcagggaatctgcwgagcggsaaaaagccggactctcacgtccggtgtggatagmgcaggcgtatcagcagcagatagcggagagtcgyaggccggaagaggagacaacaccacgtgagacgtaa

SEQ ID NO: 3666 - protein, 530 aa, Escherichia coli
  Xaa 22, 39, 158, 181, 210, 282, 298, 309, 313, 402, 508: Xaa is any amino acid
MKRTPVLIDVNGVPLRESLSYXGGGAGFGGQMAEWLPPXQSADAALLPALRLGNARADDLVRNNGIAANAVALHKDHIVGHMFLISYRPNWRWLGMRETAAKSFVDEVEAAWSEYAEGMFGEIDVEGKRTFTEFIREGVGVHAFNGEIFVQPVWDTEXTQLFRTRFKAVSPKRVDTPGHGXGNRFLRAGVEVDRYGRAVAYHICEDDFPXSGSGRWERIPRELPTGRPAMLHIFEPVEDGQTRGANQFYSVMERLKMLDSLQATQLQSAIVKAMYAATIESXLDTEKAFEYIAGAPQXQKDNPLINILXKFSXWYDTNNVTLGGVKIPHLFPGDDLKLQTAQDSDNGFSALEQALLRYIAAGLGVSYEQLSRDYSKVSYSSARASANESWRYFMGRRKFIAXRLATQMFSCWLEEALLRGIIRPPRARFDFYQARSAWSRAEWIGAGRMAIDGLKEVQESVMRIEAGLSTYEKELALMGEDYQDIFRQQVRESAERZKAGLSRPVWIXQAYQQQIAESRRPEEETTPRET

SEQ ID NO: 3667 - DNA, 207 bp, Escherichia coli
atggttacagtcgctgaactgcaggcgctgcgtcaggcgcgccttgatttattaaccggtaaacgggtggtgtctgtccagaaagatggtcgcagaattgaatatacggcrgcttctctggatgagcttaaccgggcgatcaatgatgcggagtcggtactggggacaacccgsygtcgccgtcgtccgctgggagtgaggttatga

SEQ ID NO: 3668 - protein, 68 aa, Escherichia coli
  Xaa 59: Xaa is any amino acid
MVTVAELQALRQARLDLLTGKRVVSVQKDGRRIEYTAASLDELNRAINDAESVLGTTRXRRRPLGVRL

SEQ ID NO: 3669 - DNA, 1929 bp, Escherichia coli
atgatttcagacgcacagaaggcagctaatgcagccggtgcgatagctacagggcttttatctctcattattcctgttccactgacgacagttcagtgggccaataaacattattaccttcctaaagagtcgtcttataccccggggcgrtgggaaacactgccgtttcaggttggcatcatgaactgtatgggcaacgatytgattcgcacggttaacctgattaaatctgcccgtgttggttatacaaagatgttgctgggagtggaggcttattttattgagcataaatcacgcaacagccttctttttcagcccacggactcagctgctgaagattttatgaaatctcatgttgagccaacgataagggatgttcctgcattgctggagctggctccatggttcggaagaaaacaccgcgataatacgctcaccctgaagcgtttttcctccggtgtgggtttctggtgtctggggggagcggcagcaaaaaactaccgtgaaaaatccgtggatgtggtytgttatgacgagctttcctcgttcgaaccggatgttgaaaaagagggttcgccaaccctgctgggggataaacgtattgagggctctgtatggccaaaatccattcgcggctcgacgcctaaaatcaaaggctcctgccagatcgaaaaagccgctaacgagtcggcacayttcatgcgtttttatgtgccctgtccgcactgtggggaggagcagtatctgaaatttggcgatgatgcctcgcctttcggtcttaagtgggagaagaataagccagaaagtgttttctacctttgtgagcatcatggctgtgtgatccatcagtctgagcttgaccagagtaacgggcggtggatctgtgaaaacacgggcatgtggactcgtgacggtctgacatttttcagcgccgcggataatgaaattccgccgccgcgctccatcacwttccatatctggacggcgtacagtccgttcaccacctgggtacagattgtctatgactggctggatgcactgaaagatcccaacggcctgaaaacctttgtgaacaccacgctgggcgagacctgggaagaggcygtgggcgaaaaactcgatcaccaggtgctgatggataaggttgtgcgttacacggcggcggtgcctgcccgggtggtttatctgacggcgggcattgactcgcagcgaaaccgttttgagatgtatgtctggggatgggctccgggagaggaagcctttctggtggataaaatcatcattatggggcgtcccgatgaggaagagacgctgttacgtgtggatgyggcgatcaacaaaaaataccgccatgcagacggaaccgaaatgaccatttcccgtgtctgctgggacaycggggggatcgatggcgaaatygtytatcagaggtcaaaaaaacacggtgttttccgggtgctgccggtaaaaggcgcatctgtytatggcaagccggtgatcaccatgccaaaaacccgcaatcagcggggcgtgtatctgtgygaagtggggacggacaccgcaaaagaaattctctatgcccgtatgaaagccgatcccacgcctgtggatgaagccacgtcgtatgctatccgttttcctgatgatccggagattttttcgcagacagaggcgcagcaactggtsgcggaagagcttgtggagaagtgggaaaaaggaaagatgcgtctgctgtgggataacaaaaagcggcgtaacgaagcgctggactgcctggtgtatgcctacgcggcattacgtgtgtccgtgcaacgctggcagcttgatctggctgtactggcaaaatcccgggaagaagagacgacccggccaacccttaaagaactggcagcgaagctgtccggaggagtgaatggttacagtcgctga

SEQ ID NO: 3670 - protein, 642 aa, Escherichia coli
  Xaa 443, 466: Xaa is any amino acid
MISDAQKAANAAGAIATGLLSLIIPVPLTTVQWANKHYYLPKESSYTPGRWETLPFQVGIMNCMGNDLIRTVNLIKSARVGYTKMLLGVEAYFIEHKSRNSLLFQPTDSAAEDFMKSHVEPTIRDVPALLELAPWFGRKHRDNTLTLKRFSSGVGFWCLGGAAAKNYREKSVDVVCYDELSSFEPDVEKEGSPTLLGDKRIEGSVWPKSIRGSTPKIKGSCQIEKAANESAHFMRFYVPCPHCGEEQYLKFGDDASPFGLKWEKNKPESVFYLCEHHGCVIHQSELDQSNGRWICENTGMWTRDGLTFFSAADNEIPPPRSITFHIWTAYSPFTTWVQIVYDWLDALKDPNGLKTFVNTTLGETWEEAVGEKLDHQVLMDKVVRYTAAVPARVVYLTAGIDSQRNRFEMYVWGWAPGEEAFLVDKIIIMGRPDEEETLLRVDXAINKKYRHADGTEMTISRVCWDXGGIDGEIVYQRSKKHGVFRVLPVKGASVYGKPVITMPKTRNQRGVYLCEVGTDTAKEILYARMKADPTPVDEATSYAIRFPDDPEIFSQTEAQQLVAEELVEKWEKGKMRLLWDNKKRRNEALDCLVYAYAALRVSVQRWQLDLAVLAKSREEETTRPTLKELAAKLSGGVNGYSR

SEQ ID NO: 3671 - DNA, 573 bp, Escherichia coli
ttgtatttgataatgggttgttctatgaaggttaataaaaagaggcttgccgaaatttttaacgtggacccgcggacgattgaacgctggcagtctcaggggctcccttgcgtctccaaaggcagtaagggcattgaatctgtatttgatactgccatggcaattcagtggtatgcgcagagggaaactgatatcgaaaacgaaaagctccgcaaagaactggccgatttgcgtgcggcagcggagtcagatttacaacccggcaccattgactatgaacgctaccggctcacaaaagcgcaggcagatgcgcaggaactgaaaaatgcccgtgaagacggagtggtgctggaaactgaactgtttaccttcattctgcaacgtgtggcacaggagatttcggggatacttgtgcgtgtgccgttgacattacagcgtaaatatccggacatttcaccatcacaccttgatgtggtgaaaactgaaatcgcgaaagcctccaatgttgcagctaaggccggtgaaaacgtgggcgggtggatcgatgatttcagacgcacagaaggcagctaa

SEQ ID NO: 3672 - protein, 190 aa, Escherichia coli
MYLIMGCSMKVNKKRLAEIFNVDPRTIERWQSQGLPCVSKGSKGIESVFDTAMAIQWYAQRETDIENEKLRKELADLRAAAESDLQPGTIDYERYRLTKAQADAQELKNAREDGVVLETELFTFILQRVAQEISGILVRVPLTLQRKYPDISPSHLDVVKTEIAKASNVAAKAGENVGGWIDDFRRTEGS

SEQ ID NO: 3673 - DNA, 93 bp, Escherichia coli
atgtaccgtctttgtgaagtcaatggatacctgatttatttctgtgcgctgtatcgtcgctgtactcttgcattaattatgactgtagcctga

SEQ ID NO: 3674 - protein, 30 aa, Escherichia coli
MYRLCEVNGYLIYFCALYRRCTLALIMTVA

SEQ ID NO: 3675 - DNA, 465 bp, Escherichia coli
atgaaccgcgtactgtgcgtggtcatcattgccctgctggtggcctgtggtgcgcttagtctggggctgaatcattaccgtgataacgccattacctacaaagcccagcgcgacaaaaatgtcagagaactgaagctggcgaacgcggcaattacagacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagcgcgactgataataatgcaaaaacaacttgaaggggcacagctatacattcgagagcaatgcctcagataa

SEQ ID NO: 3676 - protein, 154 aa, Escherichia coli
MNRVLCVVIIALLVACGALSLGLNHYRDNAITYKAQRDKNVRELKLANAAITDMQMRQRDVAALDAKYTKELADAKAENDALRDDVAAGRRRLHIKAVCQSVREATTASGVDNAASPRLADTAERDYFTLRARLIIMQKQLEGAQLYIREQCLR

SEQ ID NO: 3677 - DNA, 183 bp, Escherichia coli
atgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagcgcgactga

SEQ ID NO: 3678 - protein, 60 aa, Escherichia coli
MRKLKMMLCVMMLPLVVVGCTSKQSVSQCVKPPPPPAWIMQPPPDWQTPLNGIISPSERD

SEQ ID NO: 3679 - DNA, 174 bp, Escherichia coli
gtgtttcctgactccggaaaagtcaaaggagaaagtgtgtttgattttagcaaactgattcgggagattcgagtgatggctgaaaaattatccacctggaagttcattcttatctggctggtgtttgtgattatggcctctggttatttcatcggtcagatacgctggtggtga

SEQ ID NO: 3680 - protein, 57 aa, Escherichia coli
MFPDSGKVKGESVFDFSKLIREIRVMAEKLSTWKFILIWLVFVIMASGYFIGQIRWW

SEQ ID NO: 3681 - DNA, 534 bp, Escherichia coli
atgaacgcaaaaatcaaatacggcctgtcagctgcagttctggcgctgattggagcaggcgcatcagctcctcagatacttgaccagtttctggatgaaaaagagggtaaccacactacggcataccgcgatggttccggcaactggaccatctgtcggggggccacgatggtggatggaaaacccgtttttcccggtatgaaactgtcgaaggaaaaatgcgaccaggtcaacgccattgagcgtgataaggcgctggcatgggtggagaaaaacatcaaagtgccattgagcgaaccccagaaagcggggatcgcgtcattctgtccgtacaacattggtcccggtaagtgtttcccgtcgacgttttataaacgaattaatgcaggtgatcgcaggggagcgtgtgaggcgattcgctggtggattaaggacggtggcagagactgccgtattcgttcaaacaactgctacggtcaggtatcccgtcgtgaccaggagagcgcgctggcgtgctggggtatcgacagataa

SEQ ID NO: 3682 - protein, 177 aa, Escherichia coli
MNAKIKYGLSAAVLALIGAGASAPQILDQFLDEKEGNHTTAYRDGSGNWTICRGATMVDGKPVFPGMKLSKEKCDQVNAIERDKALAWVEKNIKVPLSEPQKAGIASFCPYNIGPGKCFPSTFYKRINAGDRRGACEAIRWWIKDGGRDCRIRSNNCYGQVSRRDQESALACWGIDR

SEQ ID NO: 3683 - DNA, 345 bp, Escherichia coli
atgactcaaaactatgaactgattgtgaaagggatccgcaattttgagaataaagttacggtaactttagcattacaggacaaagaacgctttgacggtgaaatttttgacctggacatctcgctggaccgtgttgaaggtgctgcgctggagttttatgaggcagcggccagaaggagcatcagacaggtcttcctggatgtcgctgccgggttatgtgaaggggatgagcagtcgccggaaaagcgccccgtaattttagaggcgcagaatgtatggataacctacaaaggaaagctaccgggaaggattactggttccctgaagactccgccgaaatggtag

SEQ ID NO: 3684 - protein, 114 aa, Escherichia coli
MTQNYELIVKGIRNFENKVTVTLALQDKERFDGEIFDLDISLDRVEGAALEFYEAAARRSIRQVFLDVAAGLCEGDEQSPEKRPVILEAQNVWITYKGKLPGRITGSLKTPPKW

SEQ ID NO: 3685 - DNA, 315 bp, Escherichia coli
gtgggtcgtctgagacgcttgcatgagttatcagagccatcagtagttaactggtggcttttttattgttttcagcttccggataacgggagacggggtatggaccagatggaaaaaatcacaacaggtgtgtcatacaccacgtcagcggtgggaacgggctactggttcctgcagttgctggacagggtttccccgtctcagtgggcggcaataggcgtgctggggagtctgctgtttgggctgctgacatatctgactaacctgtatttcaaaatcagagaggaccgtcgtaaggcggcacggggagagtaa

SEQ ID NO: 3686 - protein, 104 aa, Escherichia coli
MGRLRRLHELSEPSVVNWWLFYCFQLPDNGRRGMDQMEKITTGVSYTTSAVGTGYWFLQLLDRVSPSQWAAIGVLGSLLFGLLTYLTNLYFKIREDRRKAARGE

SEQ ID NO: 3687 - DNA, 105 bp, Escherichia coli
gtgggactaaatgcactgacgctgatggatattaccaaaaatgtaacgtatggcgttgagatagaaagtctggcgctggagataaatgcaccggcatcatcataa

SEQ ID NO: 3688 - protein, 34 aa, Escherichia coli
MGLNALTLMDITKNVTYGVEIESLALEINAPASS

SEQ ID NO: 3689 - DNA, 228 bp, Escherichia coli
atggcatttaaacactatgacgtggtcagggcggtatcgccgtcagaccttgcgaaacgactgacacaaaaactgaaggagggctggcagccgtttggtagtccggtggccataaccccttataccctgatgcaggcgattgcagcagaaggtgatgtggtggtcagtggtgcaactgagccggattggtactacgtcatcgtactggcccggcattccaggccataa

SEQ ID NO: 3690 - protein, 75 aa, Escherichia coli
MAFKHYDVVRAVSPSDLAKRLTQKLKEGWQPFGSPVAITPYTLMQAIAAEGDVVVSGATEPDWYYVIVLARHSRP

SEQ ID NO: 3691 - DNA, 1050 bp, Escherichia coli
atgcttaatactgtaaaaatatccagttgtgagttaatcaacgccgactgcctggaatttatccggtcgttacccgaaaattctgttgacctgatagtcacggacccgccgtactttaaagtgaagcctgagggctgggataaccagtggaagggcgacgatgattacctgaagtggctggaccagtgtctggcgcagttctggcgggtgctgaaacctgccggaagtctttacctgttctgtggtcatcgcctggcatctgatatcgaaatcatgatgcgtgaacgcttcagtgtgctgaaccatattatctgggcgaagccgtccggacgctggaacggatgcaacaaggaaagcctgcgggcgtatttccccgccacagagcgcattctgttcgcggaacattatcaggggccgtatcgtccgaaagatgccgggtatgcggcgaagggcagtgcactgaaacagcatgtgatggccccgctgatttcttactttcgtgatgcgcgcgcggccctggggataacggcaaaacagattgcagatgccacaggaaagaaaaacatggtgtcgcactggttcagtgccagtcagtggcagctaccgaatgaaagcgattatctgaaattacaggcgctgtttgcccgggtggcagaagagaagcatcggcgtggtgaactggaaaagctccaccaccagctggtggatacgtatacctcactgaaccggcagtatgcggagctgctgagtgaatataaacatctgcggcggtattttggcgtgacggtgcaggtgccgtataccgatgtgtggacgcataaaccggtgcagttctatcccgggaaacatccgtgcgaaaaaccggcagaaatgctgcagcagataatcagcgcaagtagccgtcctggtgatctggttgcggattttttcatggggtcgggttcaacggtaaaagcggcgatggcactggggcgtcgtgcgattggtgttgagctggagaccggacgttttgagcagacagtcagggaagttcaggatttaatcgtttga

SEQ ID NO: 3692 - protein, 349 aa, Escherichia coli
MLNTVKISSCELINADCLEFIRSLPENSVDLIVTDPPYFKVKPEGWDNQWKGDDDYLKWLDQCLAQFWRVLKPAGSLYLFCGHRLASDIEIMMRERFSVLNHIIWAKPSGRWNGCNKESLRAYFPATERILFAEHYQGPYRPKDAGYAAKGSALKQHVMAPLISYFRDARAALGITAKQIADATGKKNMVSHWFSASQWQLPNESDYLKLQALFARVAEEKHRRGELEKLHHQLVDTYTSLNRQYAELLSEYKHLRRYFGVTVQVPYTDVWTHKPVQFYPGKHPCEKPAEMLQQIISASSRPGDLVADFFMGSGSTVKAAMALGRRAIGVELETGRFEQTVREVQDLIV

SEQ ID NO: 3693 - DNA, 198 bp, Escherichia coli
atgctaaaacagcaggatatgacagaaaccgccagagtggtgtttaatgaattaagcgttaccgacccggcgacagtcggggagatagcgcagaatacttacctttcacgcgaacgctgccagttaatactgactcagctggttatggcgggtctggcagactatcagttcggttgttacagacgccttccgcagtga

SEQ ID NO: 3694 - protein, 65 aa, Escherichia coli
MLKQQDMTETARVVFNELSVTDPATVGEIAQNTYLSRERCQLILTQLVMAGLADYQFGCYRRLPQ

SEQ ID NO: 3695 - DNA, 822 bp, Escherichia coli
atgaaactggaagatttaccgaaatactactccccaaaatcccctggcctgaccgatgcatcggcctcaacgtcaaaagatgcgctgagtatcactgatgtgatggccgcgcagggcatgacacagaatcgggctgagatggggttttctgcgttcctggggaaaatgggcatcagtatgaatgacagggcgcgggcaacagaattactggcagattatgcactcagtcggtgcgatcgtgtggcggcgttgagaaaacttccggcagaaataaaaccggtagtgatgcgcattatggcttcgtatgcgtttgaagattatgcccgtagcgcggcgagcaaaaaacagtgcccttgctgtcacggaaaaaaatttattgaaagcgaggtttttacaaacaagatccagtatccggatggtaagccaccagtgtgggcaaagtgcacaaaaggcgtgtatccgtcttactgggaagaatggaaaaaagtcagggaggtggtaaaagttgcctgtccggagtgtggcggaaagggtgaggtttccaccgcctgtaaggattgccgtgggcgtggtgtcgccattcatcgtgaagagtcggtaaaacgtggtatgcctgttatcagagattgccagcgttgtggtggtcgtggctgtgaaaggctgccatcaacggaggcatttaatgccatatgcaaagtgacgagtgctatcacgcttgatacgtggaaaaaatcagtgaaacgcttttacgatacgttggtggttcggtttgacattgaagaggcatgggcggagcggcagttaaagagggtaacgcgatag

SEQ ID NO: 3696 - protein, 273 aa, Escherichia coli
MKLEDLPKYYSPKSPGLTDASASTSKDALSITDVMAAQGMTQNRAEMGFSAFLGKMGISMNDRARATELLADYALSRCDRVAALRKLPAEIKPVVMRIMASYAFEDYARSAASKKQCPCCHGKKFIESEVFTNKIQYPDGKPPVWAKCTKGVYPSYWEEWKKVREVVKVACPECGGKGEVSTACKDCRGRGVAIHREESVKRGMPVIRDCQRCGGRGCERLPSTEAFNAICKVTSAITLDTWKKSVKRFYDTLVVRFDIEEAWAERQLKRVTR

SEQ ID NO: 3697 - DNA, 375 bp, Escherichia coli
atgctcatagatttggttttaccttacccgccgacggtgaacacttactggcgacgccgtggcagcacatattttatctcggaggagggaaagcgttatcgccgggctgtggcgcttattgttcgccagcagcggctgaaattaagcctgtccggaaggctggcgataaaggtgattgcagagccaccggataagcgtcgtcgcgacctggacaatatcctgaaagcaccgctggatgcgctgacgcatgcgggagtgttaatggacgatgagcagtttgatgaaatcaatatcgttcgtggtcagccagtatctggtggacgtatgggggtgaagatttaccccataatgcatgaagagcaggtcaaaaaatga

SEQ ID NO: 3698 - protein, 124 aa, Escherichia coli
MLIDLVLPYPPTVNTYWRRRGSTYFISEEGKRYRRAVALIVRQQRLKLSLSGRLAIKVIAEPPDKRRRDLDNILKAPLDALTHAGVLMDDEQFDEINIVRGQPVSGGRMGVKIYPIMHEEQVKK

SEQ ID NO: 3699 - DNA, 1047 bp, Escherichia coli
gtgcgagtattacttcgacctgttctggtaccggaactcgggctggtgatcgttaagccgggccgtgaatccatgccggtattccacaatacccgggtactggtggagccggaaccgaaaagcatgcgtaatctgccgtccggggttgttcctgccgttcgccagccgctagtggaagacaaaacattgctgccgtttttcagtaacgcacgggtgattcgtgctgctggtggtgctggtgcattgtctgactggctgttgcgccatattaaatcctgccagtggccacacggcgattatcatcacagcgaaaccgtcattcaccgttatggtaccggcgcaatggtgttgtgctggcactgcgacaaccagctgcgtgaccagacatccgaatcactcgagcaacttgctcatcaaaacctgtcagcatggatgattgacgtcatactccatgcaatgaatggctcgcaggaacgggaattatcgctggctgaattatcctggtgggcggtccgcaatcaggtggcggacgcgctaccggaagcggtattacgtcgttcgctggggttgcgtgcggaaaaaatccgctcaatgtaccgtgaaagcgacatcgtaccgggagagcagaccgccaccagcatactgaagcagcgcacaaaaaatcttgcgccgctgcctcacgcccaccagcaaaacccgccacaggaagagacggtggtcagcattgccgttgatcctgagtctccggaatctttcatgaaacgacctaaacgtcgccgctgggttaacgagaaatacacacgctgggtgaagacacagccgtgtgcgtgttgtggtaagccagccgacgatccccatcacctgattggtcatggtcagggcggaatggggacaaaatctcacgatattttcacgctaccgctgtgtcgggagcatcacaacgagcttcatgcggatcctctggcgttcgaagaaaagcatggttctcaggttgatttaatttttcgttttcttgatcacgcctttgcaactggcgtgcttgggtaa

SEQ ID NO: 3700 - protein, 348 aa, Escherichia coli
MRVLLRPVLVPELGLVIVKPGRESMPVFHNTRVLVEPEPKSMRNLPSGVVPAVRQPLVEDKTLLPFFSNARVIRAAGGAGALSDWLLRHIKSCQWPHGDYHHSETVIHRYGTGAMVLCWHCDNQLRDQTSESLEQLAHQNLSAWMIDVILHAMNGSQERELSLAELSWWAVRNQVADALPEAVLRRSLGLRAEKIRSMYRESDIVPGEQTATSILKQRTKNLAPLPHAHQQNPPQEETVVSIAVDPESPESFMKRPKRRRWVNEKYTRWVKTQPCACCGKPADDPHHLIGHGQGGMGTKSHDIFTLPLCREHHNELHADPLAFEEKHGSQVDLIFRFLDHAFATGVLG

SEQ ID NO: 3701 - DNA, 153 bp, Escherichia coli
aagcagcaaaaggcgatgttaatcgccctgatcgtcatctgtttaaccgtcatagtgacggcactggtaacgaggaaagacctctgcgaggtacgaatccgaaccggccagacggaggtcgctgtcttcacagtttacgaacctgaggagtaa

SEQ ID NO: 3702 - protein, 50 aa, Escherichia coli
KQQKAMLIALIVICLTVIVTALVTRKDLCEVRIRTGQTEVAVFTVYEPEE

SEQ ID NO: 3703 - DNA, 1002 bp, Escherichia coli
atggatattcgcacacgaaagacaaaatttttagagtcgttagattcaactgaagtgatacgcaaagcagtaagtctcgctatagattgcattattgataatcataatagtaatgaagatacccccttagttattaccagctatgatgatctctgtagaatccaggtgctaaattatgtacaggagttttgcgaagctgcattccctgatatggatgaatattactttagtcctaacatacttcgcatcaacggcaagactagtgaagaagcttgtattaacttaattaaactcttaagaagtacaaaaggcatgctattctggtccgatgccccatcgtggttcgctagcctccccgacggattattccatgttgttaacattgatcaaaaaatcgttactcgcggccttaataagaaaaactctaagccgacaataatcaataaagattacagtgtagatacactactatcagagctatttttgaatggcgcacacatggagcaacccaacgtacacaacgtttctgagggaaacatgaagttctatgatgaatgccatgctggattaatcagaccaatacccgctccaataggcgcgtcatacgatgaagagatcacaattaattctccagattggcaaaagctcgcgtgtgtagctttacgccgctatcagtcgaaggaatgtcatgacggaatgcaatgggatacaaccgatcatggttggactgatgtaatcgcgtatccattcgtcgaagaaatacaatcaatggataatagtggttatcgacaatgtttagttgggctggtcacaataaacaattcaaatgcaaattctccgtacctatctaccgtttggatacatccattttatcgcaggagagggttattaagtaagttatggccaaaattacaagagttatatggaagtaacttcgaaattgagcgacctaatgaaaatatgaaagcatttctgaaaagtgcgaaacacgcagattactaa

SEQ ID NO: 3704 - protein, 333 aa, Escherichia coli
MDIRTRKTKFLESLDSTEVIRKAVSLAIDCIIDNHNSNEDTPLVITSYDDLCRIQVLNYVQEFCEAAFPDMDEYYFSPNILRINGKTSEEACINLIKLLRSTKGMLFWSDAPSWFASLPDGLFHVVNIDQKIVTRGLNKKNSKPTIINKDYSVDTLLSELFLNGAHMEQPNVHNVSEGNMKFYDECHAGLIRPIPAPIGASYDEEITINSPDWQKLACVALRRYQSKECHDGMQWDTTDHGWTDVIAYPFVEEIQSMDNSGYRQCLVGLVTINNSNANSPYLSTVWIHPFYRRRGLLSKLWPKLQELYGSNFEIERPNENMKAFLKSAKHADY

SEQ ID NO: 3705 - DNA, 1023 bp, Escherichia coli
atgccctgtatttcgctgtggtataatagttgcgcaattgatacaagggagcgttacatcgtgaaaattgttttcgaggttaatggaaagaaagttccactaaaatctttaaaatacataagcaaaaaagatcaactcgaagtaatgaaaaactggttctttgaaaactttgaagatccggcaaatgcttgtccgtatgaaagtagagaaggtggctatgcttacatatatggcgggccgtatgatgcgagcgaagaactacaatccatcttcggtcaatatgttaaatctgagtatattgaggaattagtagatgaattacaaacacaatgttttgactggtctggaaactcaaataatatagatgattggtacgatgatgatatctacgacgctgtaacgtcttccggtaatccgtatttaaaattcattgataatatcgataaaataaaaaaacttgcaaaagataaaactgaacaacagcaaaaaaaccacttgcttagtttgctctacacgaatgttattacagctttggaaacgctttatgttgagctattcattaattctatagagaaagatgatgtctacatagccaattgtatagaaaaaggtaagactgaatttaaagtaagcaaagatattgctgcgttgcctttcaagggtgaacccatcgagaaaattaggggagagctaatcaggtcaatcaaggaacacttgatcagtgcaagctggcatagcactaaaaaggtaatcgaccgctatgaagctacattcgatataaaagtacaaaaagactgtccgatagaagctattgaattggcaaccctcaatcgaaatcacttagtgcatcgtggtggaaaggataaagaagggaacctcgtagtgattacagaccaggatcttgaaacgctgattgaaaatgcatcgaacctggcaattatgctctacaacagtttaaatgtagcaacgaataaaaccaccattttgcaaccagatgacaaaccgttcattcatgaattttaa

SEQ ID NO: 3706 - protein, 340 aa, Escherichia coli
MPCISLWYNSCAIDTRERYIVKIVFEVNGKKVPLKSLKYISKKDQLEVMKNWFFENFEDPANACPYESREGGYAYIYGGPYDASEELQSIFGQYVKSEYIEELVDELQTQCFDWSGNSNNIDDWYDDDIYDAVTSSGNPYLKFIDNIDKIKKLAKDKTEQQQKNHLLSLLYTNVITALETLYVELFINSIEKDDVYIANCIEKGKTEFKVSKDIAALPFKGEPIEKIRGELIRSIKEHLISASWHSTKKVIDRYEATFDIKVQKDCPIEAIELATLNRNHLVHRGGKDKEGNLVVITDQDLETLIENASNLAIMLYNSLNVATNKTTILQPDDKPFIHEF

SEQ ID NO: 3707 - DNA, 423 bp, Escherichia coli
gtggcaaaagtttttacacaagaagagcgggaaaaaattaaaggacaggttgttgaactcgtacgccagagtgggcgtgagacgttacggcaactggaagtcaagacaggtgcgacaagatatctgatgagcgttctcgcaagagagctggttgccagcggcgatgtatgcaactctggttacgggttattcccgtctgaacaggcgcgtaaggactggcaaaatgcccgtaaaaagctctcaagggcaaagctgaagaaaccatctgcggttgatccggaccttatctggtcattacctgacggagaaatacgtcgctacgacaggcgtcagaacataatctgtcgcgagtgccggaagagtgaagttatgcagcgcatattgtcgttttatcagggtgatgttcggtatttattgaagtga

SEQ ID NO: 3708 - protein, 140 aa, Escherichia coli
MAKVFTQEEREKIKGQVVELVRQSGRETLRQLEVKTGATRYLMSVLARELVASGDVCNSGYGLFPSEQARKDWQNARKKLSRAKLKKPSAVDPDLIWSLPDGEIRRYDRRQNIICRECRKSEVMQRILSFYQGDVRYLLK

SEQ ID NO: 3709 - DNA, 1071 bp, Escherichia coli
atggctaacgcctggctcagattatggcatgacatgccaaatgaccctaagtggcgaacaattgccagggtgtcagggcagccaattgcaacagtgatggcagtgtatatccacctcctggtgagcgcgtcacgaaatgtcacgcgaggtcacattgatgtcacgacagaagatttggcaagtgcgctcgacgtgacagaagaggtaattgattcaattttgcagacgatgcaggggcgggtacttgatggtgatttaatcactggatgggaaaaacgccaggtgcttaaagaggacaacggcaatatttcgcaaaccgcaaaatctcctgcagagcgcaagagggcgcagcgagagagggaaagaaagcgggaacaaaatggcgattgtcacggcgcgtcacgaaatgtcacgcacatgtcacgacgagtcacgacagataaagatacagataaagatacagatcaagaagatcaaaacactatggtccatggcgtaaaaaacgccacgaaccaggcaggggatgttcagaccgtcaatcttggtcagccagcaggcacgacaccggaagccgattcagcgtatgcgctgaaagccgattcgggcgctgtgcagcaggtgatgaccgcaaggccggagcaatcacaccaactgcagcagccygaagccgattccgccattcagcgggaagccgatcgggtagtcccggaaaacaccgggcagyctgtgggacgagtggattatccggatgtgttcgaacaggtctggcgggartacccgttgcgtgctggggcaaacccgaagaaatccgctttcagtgcctggaaggccagattacgcgagggggtgccaccagaggccatgctggatggcgtgaggcgttacgcaagatacttggcggctaccgggaaaacgggaacggaatttgttcagcgagcgacgacgttttttggaccggaccggaattttgagaacccctggttgctcccggtaagcggcacgaacaatcagcgttgtgtgaatcatatttctgaaccggataacgaaattccgccgggcttcagggggtaa

SEQ ID NO: 3710 - protein, 356 aa, Escherichia coli
  Xaa 242: Xaa is any amino acid
MANAWLRLWHDMPNDPKWRTIARVSGQPIATVMAVYIHLLVSASRNVTRGHIDVTTEDLASALDVTEEVIDSILQTMQGRVLDGDLITGWEKRQVLKEDNGNISQTAKSPAERKRAQRERERKREQNGDCHGASRNVTHMSRRVTTDKDTDKDTDQEDQNTMVHGVKNATNQAGDVQTVNLGQPAGTTPEADSAYALKADSGAVQQVMTARPEQSHQLQQPEADSAIQREADRVVPENTGQXVGRVDYPDVFEQVWREYPLRAGANPKKSAFSAWKARLREGVPPEAMLDGVRRYARYLAATGKTGTEFVQRATTFFGPDRNFENPWLLPVSGTNNQRCVNHISEPDNEIPPGFRG

SEQ ID NO: 3711 - DNA, 426 bp, Escherichia coli
atgaaaatcaagcatgaacacatccgcatggcgatgaatgcctgggcgcgtcctgatggcgaaaaagttccggcagctggaataacccaggcttattttgagttgggtatgacgtttcctgaactgtacgacgacagccatccggaagccctggctcgcaatacccagaaaattttccgctggatagagaaagacacccctgatgcagttgaaaaaattcaggcgttgttaccagcgatcgaaaaggcaatgccacctttgctggtggccagaatgcgcagccacagttcagcttattttcgggagctggtggagacgcgggagcgactggtgagagacgctgatgattttgtcgcagtggcaatcgccggtttcaatcagatgaaccgtggtggcccggcaggaaatgctgtggcagtacattga

SEQ ID NO: 3712 - protein, 141 aa, Escherichia coli
MKIKHEHIRMAMNAWARPDGEKVPAAGITQAYFELGMTFPELYDDSHPEALARNTQKIFRWIEKDTPDAVEKIQALLPAIEKAMPPLLVARMRSHSSAYFRELVETRERLVRDADDFVAVAIAGFNQMNRGGPAGNAVAVH

SEQ ID NO: 3713 - DNA, 270 bp, Escherichia coli
gttctagagagtgacagtatgtcaacatctggtgggggagtttccatcccaaatggttcaacagtttttgttgatcccgatcgaaccgtacaaccaggaaatattgtccttgccttacccaaagggaccacaacacctgtcattcgtaaactggagatagaagggccggatattcttttagtccccacgaatcctcgctacccttcaattatgctggatgatctatcttgcatattgggcgtatgctttaaaattcaacaaaatatttaa

SEQ ID NO: 3714 - protein, 89 aa, Escherichia coli
VLESDSMSTSGGGVSIPNGSTVFVDPDRTVQPGNIVLALPKGTTTPVIRKLEIEGPDILLVPTNPRYPSIMLDDLSCILGVCFKIQQNI

SEQ ID NO: 3715 - DNA, 237 bp, Escherichia coli
atgacggcagggttcaactttaataactatgcagcaggtttttgttccgctaccccggcgttaaggggaaatgaggtcagcatggatactatcgatcttggcaacagcgaatctctggtatgtggcgtgttccccaaccaggacggtacgttcaccgcgatgacgtataccaaaagcaaaacgtttaaaaccgaaaatggtgcccgtcgctggctggaaagaaactcaggtgagtga

SEQ ID NO: 3716 - protein, 78 aa, Escherichia coli
MTAGFNFNNYAAGFCSATPALRGNEVSMDTIDLGNSESLVCGVFPNQDGTFTAMTYTKSKTFKTENGARRWLERNSGE

SEQ ID NO: 3717 - DNA, 129 bp, Escherichia coli
atggatttcgacacaatcatggaaaaggcttacgaagaatacttcgaaggccttgccgaaggcgaagaagctctcagcttcagtgagtttaaacaggcgctttccagctcggcaaaatctaacggctga

SEQ ID NO: 3718 - protein, 42 aa, Escherichia coli
MDFDTIMEKAYEEYFEGLAEGEEALSFSEFKQALSSSAKSNG

SEQ ID NO: 3719 - DNA, 222 bp, Escherichia coli
atgcagaaacgagaacccgtcatcatcgcgccagactataccaatgatgaactttatgagtggatgcgccagaaaattaatgcagcgcaggatttgaaatgggccaatgaagccagggctaagcaggctgaaaatctgtccgctctggagcaggatatcaccaatctggaaaaagcagcggcattaagcattgccagaatgattacatacccgcgtgaatag

SEQ ID NO: 3720 - protein, 73 aa, Escherichia coli
MQKREPVIIAPDYTNDELYEWMRQKINAAQDLKWANEARAKQAENLSALEQDITNLEKAAALSIARMITYPRE

SEQ ID NO: 3721 - DNA, 96 bp, Escherichia coli
gtgcgcttccggttgtggcaatccgcgaaatggcgcggcggtaagtatggcggggttattccttccaccgttgaggacaccgggttgtcaggttga

SEQ ID NO: 3722 - protein, 31 aa, Escherichia coli
MRFRLWQSAKWRGGKYGGVIPSTVEDTGLSG

SEQ ID NO: 3723 - DNA, 294 bp, Escherichia coli
gtgttatgggtggattctctgtatccggcgttaattgttaactggttaacgtcacctggaagcaccaggcaccgcatcacaaaattcattgttgaggacgcgataatggaaacgttattaccaaacgttaatacgtctgaaggttgttttgaaattggtgtcactatcagtaaccctgtatttactgaagatgccattaacaagagaaaacacgaacgggagctattaaataaaatatgcattctttcaatgttggcccgtttacgtccgatacaaaaaggatgctggcaatga

SEQ ID NO: 3724 - protein, 97 aa, Escherichia coli
MLWVDSLYPALIVNWLTSPGSTRHRITKFIVEDAIMETLLPNVNTSEGCFEIGVTISNPVFTEDAINKRKHERELLNKICILSMLARLRPIQKGCWQ

SEQ ID NO: 3725 - DNA, 246 bp, Escherichia coli
atgcattctttcaatgttggcccgtttacgtccgatacaaaaaggatgctggcaatgaatacagcatttgcacttgttctgacagtttttcttgtttccggagagccagttgatactgcagtcagtgttcacaggacaatgcaggagtgtgtgactgcagcaaccgaacagaaaattcccggtaactgttacccggtcgataaagttattcaccaggataataacgaaatcccggcaggtctttaa

SEQ ID NO: 3726 - protein, 81 aa, Escherichia coli
MHSFNVGPFTSDTKRMLAMNTAFALVLTVFLVSGEPVDTAVSVHRTMQECVTAATEQKIPGNCYPVDKVIHQDNNEIPAGL

SEQ ID NO: 3727 - DNA, 2472 bp, Escherichia coli
atgagtaaagtctttatttgcgccgccattccggacgaacaggcaataaaggaagaaggtgccgtcgctgtagccactgccattgaagccggtgatgaacgtcgcgcccgcgcaaaatttcactggcaattcctggaacattatccggctgctcaggactgcgcttataaatttcttgtttgcgaggataaacccggtataccccgccctgccctcgattcctgggatgctgaatatatgcaggaaaaccgctgggatgaggcgtctgcttcctttgttccggtcgagactgaatccgatccgatgaacgtcacttttgacaagctggcccctgaagtacagaacgctgtcatggttaagttcgacacatgtgaaaacatcaccgttgatatggttattagcgcacaggaattgttgcaggaagacatggcaacattcgacggacatatcgttgaagcgttgatgaaaatgccagaagttaacgccatgtatccggagcttaagttgcacgccattgggtgggttaagcataaatgtattcctggtgctaaatggcccgaaattcaggcagagatgcgcatctggaaaaaacgtcgcgaaggtgaacgcaaggaaaccggaaaatacacgtctgttgttgatctcgcccgcgccagagccaatcaacagtacactgaaaattcaacaggaaaaatcagcccggtcattgctgccattcatcgcgaatacaagcagacatggaaaacactggatgacgaactggcctacgctctctggcctggtgatgtggatgccggaaacattgacggcagcatccatcgctgggcaaaaaaagaagttatcgacaacgaccgcgaagactggaagcgtatctcggcatcaatgcgcaaacagcctgatgcccttcgctacgaccgccaaactatttttggccttgtccgtgagcgtccgatcgacattcacaaagatcccgtagcactgaacaaatatatctgcgaatacctgacgacaaagggcgtgtttgagaatgaagaaacagacctgggcactgttgatgttctccagtcatcagaaacacaaactgatgcagtggaaactgaggtatctgatatcccaaaaaatgaaaccgcgccggaagctgaaccatctgtagagcgtgaggggccgttctatttcctcttcgcagataaggacggagaaaaatacggtcgcgcaaacaaactttctggtctggataaggcactggctgctggcgccactgaaatcacaaaagaagaatattttgcccgaaaaaatggcacatacacgggcttaccgcaaaatgtagataccgctgaagattcagaacaaccagagccgataaaagttaccgctgacgaagtaaacaaaattatgcaggcagccaatatcagccagcctgacgccgataagttgcttgctgcatcacgtggtgaatttgttgaagggattagtgacccgaatgatccgaaatggattaaggggatccagacccgcgattctgtgagccagaaccagcatgaatcggaacggaactaccaaaaagcggaacaaaacagtccaaatgcgttacaaaacgagccagaaacgaaacagcctgaaccagtggcgcaccaggaagtggaaaaagcctgcaccgcctgcggtcagaccggcggcggcaactgtcctgattgtggcgcggtgatgggcgacgcaacataccaagaaacattcgatgaagagtatcaggttgaagttcaggaagatgatccggaggaaatggaaggcgctgaacatccacacaaggagaacactggcggcaatcagcatcacaatagcgataatgaaactggcgagacggcagatcacccaattaaggtgaacggtcatcacgaaatcacatccaccagcaggacgtgtgaccatctaatgatcgaccttgaaaccatgggaaaaaatcctgatgccccgatcatctcaataggtgcaatatttttcgatccgcaaaccggagatatgggaccggaatttagtaagactatcgatctggaaactgctggcggagtcattgatcgggacaccattaaatggtggcttaagcaatcacgcgaagcgcaatctgccattatgaccgatgaaatcccgttagatgatgcactgttacaattgcgggaatttatcgacgaaaactccggtgaattttttgttcaggtttggggaaatggagccaacttcgacaacacgattttgcgccgttcatacgaacggcaggggatcccctgcccgtggcgttactacaacgatcgcgatgtacgcacaatcgttgagctggggaaagccatagacttcgatgccagaacggctattccattcgaaggtgagcgccataatgcacttgatgacgcccgttaccaggcaaaatacgtttcagctatctggcaaaaactgatcccaaatcaggctgatttttaa

SEQ ID NO: 3728 - protein, 823 aa, Escherichia coli
MSKVFICAAIPDEQAIKEEGAVAVATAIEAGDERRARAKFHWQFLEHYPAAQDCAYKFLVCEDKPGIPRPALDSWDAEYMQENRWDEASASFVPVETESDPMNVTFDKLAPEVQNAVMVKFDTCENITVDMVISAQELLQEDMATFDGHIVEALMKMPEVNAMYPELKLHAIGWVKHKCIPGAKWPEIQAEMRIWKKRREGERKETGKYTSVVDLARARANQQYTENSTGKISPVIAAIHREYKQTWKTLDDELAYALWPGDVDAGNIDGSIHRWAKKEVIDNDREDWKRISASMRKQPDALRYDRQTIFGLVRERPIDIHKDPVALNKYICEYLTTKGVFENEETDLGTVDVLQSSETQTDAVETEVSDIPKNETAPEAEPSVEREGPFYFLFADKDGEKYGRANKLSGLDKALAAGATEITKEEYFARKNGTYTGLPQNVDTAEDSEQPEPIKVTADEVNKIMQAANISQPDADKLLAASRGEFVEGISDPNDPKWIKGIQTRDSVSQNQHESERNYQKAEQNSPNALQNEPETKQPEPVAHQEVEKACTACGQTGGGNCPDCGAVMGDATYQETFDEEYQVEVQEDDPEEMEGAEHPHKENTGGNQHHNSDNETGETADHPIKVNGHHEITSTSRTCDHLMIDLETMGKNPDAPIISIGAIFFDPQTGDMGPEFSKTIDLETAGGVIDRDTIKWWLKQSREAQSAIMTDEIPLDDALLQLREFIDENSGEFFVQVWGNGANFDNTILRRSYERQGIPCPWRYYNDRDVRTIVELGKAIDFDARTAIPFEGERHNALDDARYQAKYVSAIWQKLIPNQADF

SEQ ID NO: 3729 - DNA, 1131 bp, Escherichia coli
atggcgcgcccgcgaaaatataaaaccgatgttccgggattatctccgtattttgacaaaagaaataacaaagtttactggcgttacaggcatcccataacaggcaaaaatcacggtctcggcagtattgaccagaaactggcagaaactattgcagcagaagcgaacagccgtcttgcccggcagcaaatggaacaaatgctcagtctgcaggagaaaattattagtgacaccggcggttcatcaaccgttaccatttttctgaataattacagaaaaattcaacaggaaagatatgaaaacggcgagatcaaactcaacacgctgaaacagaaagcggcccctctcagggtatttgatgaacgttttggcaccagaccgttagatgccataaccgtaaaagatgtggtatcagtactggaagagtacaaggccagaggacataacagaatgggacaaattttcaggaaagtactgatcgatgttttccgggaagctcagcaaacgggcgatgtcccgccaggctttaaccctgcagaatcggcaaaaaaaccgcaggtgcggatatcaagacagcgactgacttttgatgagtggatgatgatttataacgcagcggaaaaggatggttactttttacagcgcggtatgctgctggcactgatgacaggccagcgcctttcagatatttgcaaaatgcaattttcggatatccgggatggttatcttcatgtcgaacagcaaaaaacaggaacccggattgccatccctctggctctgcgttgcgataaattaaatctcaccctagatgatgtggtgtcatcctgccgcgattgcgttcttagtccgtggctattgcaccaccatcacgcgaaagggacagctaagcgcggcgggatggttaagccagcaacattaaccgttgcatttaaaaaagcccgggattctgtggattacaactggcgtgctaatggcaccccaccctctttccatgagcagagatctttatcagagcgattgttcagagagcagggggttgataccaaaattttgctgggccattcgaatcaaaaaatgaccgatatttacaacgacgcacgcggtaaggaatggaaaaaactggtcatttga

SEQ ID NO: 3730 - protein, 376 aa, Escherichia coli
MARPRKYKTDVPGLSPYFDKRNNKVYWRYRHPITGKNHGLGSIDQKLAETIAAEANSRLARQQMEQMLSLQEKIISDTGGSSTVTIFLNNYRKIQQERYENGEIKLNTLKQKAAPLRVFDERFGTRPLDAITVKDVVSVLEEYKARGHNRMGQIFRKVLIDVFREAQQTGDVPPGFNPAESAKKPQVRISRQRLTFDEWMMIYNAAEKDGYFLQRGMLLALMTGQRLSDICKMQFSDIRDGYLHVEQQKTGTRIAIPLALRCDKLNLTLDDVVSSCRDCVLSPWLLHHHHAKGTAKRGGMVKPATLTVAFKKARDSVDYNWRANGTPPSFHEQRSLSERLFREQGVDTKILLGHSNQKMTDIYNDARGKEWKKLVI

SEQ ID NO: 3731 - DNA, 639 bp, Escherichia coli
atgaaaaagttaacagtggcggctttggcagtagcaactcttctctctggcagtgcctttgcacatgaagccggcgaattttttatgcgtgcaggttctgcaaccgtacgtccaacagaaggtgctggtggtacgttaggaagtttgggtggattcagcgtgaccaataacactcaactgggcctgacgtttacttatatggcgaccgacaacattggtgtggaattactggcagcaacgccgttccgccataaaatcggcacccgggcgaccggcgatattgcaaccgttcatcatctgccgccaacactgatggcgcagtggtattttggtgatgccagcagcaaattccgtccttacgttggtgcaggtattaactacaccaccttctttgataatggatttaacgatcatggcaaagaggcggggctttccgatctcagtctgaaagactcttggggagctgccgggcaggtgggggttgattatctgattaaccgtgactggttggttaacatgtcagtgtggtacatggatatcgataccacggctaagtacaaatctggtgttactaccgtaaaagactcggtacgactggatccgtgggtgtttatgttctccgcaggatatcgtttttaa

SEQ ID NO: 3732 - protein, 212 aa, Escherichia coli
MKKLTVAALAVATLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTAKYKSGVTTVKDSVRLDPWVFMFSAGYRF

SEQ ID NO: 3733 - DNA, 744 bp, Escherichia coli
atgtctatcacggcgcagtccgtataccgtgacaccggaaattttttccgtaatcaatttatgaccattctgttggtatcgttgctatgtgcgtttatcacagtggtgttagggcatgttttctcacccagtgatgcacagcttgcgcagctcaatgacggcgtacccgttagcggcagtagtgggttgttcgacctggttcagaatatgtcaccggaacagcaacaaattttgctgcaggcttcagcggcgtccactttttcaggattaatcggtaacgccattctcgccgggggcgtaatattaattatccagctggtgtctgcgggtcagagagtcagtgcgctgcgagctattggtgccagtgcgccgatattaccaaagttatttattctgatttttctgactacccttttagtacagattggcatcatgctggtggtcgttccgggaattatcatggccattttactggctctggcaccggtgatgctggtacaggacaaaatgggcgtttttgcctcgatgcgtagcagtatgcggctgacatgggcgaatatgcgtctggtggcacccgcagtactgagctggttgctggcaaaaacactgttgctgctttttgcctcttcttttgccgcattaaccccggaaattggtgccgtactggcgaacaccttgagcaacctgatttcagccgtattgctcatctatctgttccgcctgtatatgttgattcgccaataa

SEQ ID NO: 3734 - protein, 247 aa, Escherichia coli
MSITAQSVYRDTGNFFRNQFMTILLVSLLCAFITVVLGHVFSPSDAQLAQLNDGVPVSGSSGLFDLVQNMSPEQQQILLQASAASTFSGLIGNAILAGGVILIIQLVSAGQRVSALRAIGASAPILPKLFILIFLTTLLVQIGIMLVVVPGIIMAILLALAPVMLVQDKMGVFASMRSSMRLTWANMRLVAPAVLSWLLAKTLLLLFASSFAALTPEIGAVLANTLSNLISAVLLIYLFRLYMLIRQ

SEQ ID NO: 3735 - DNA, 540 bp, Escherichia coli
atgaagcagtttcttgattttttaccgctggttgtctttttcgcgttttacaagatttatgacatctatgcggctactgcggcgctcatcgtcgccacggcgattgtgcttatatatagctgggttcgctttcgtaaggttgagaagatggccctgatcacttttgttctggtggtcgtcttcggtggcttgacgctgttcttccacaatgatgagtttattaaatggaaggttactgtcatttatgccctgtttgcgggtgccctgttagtcagccaatgggtgatgaaaaagccgctaattcagcggatgctgggtaaagaactcaccctgccgcaatcggtatggtcgaagctgaatctggcctgggctgttttctttatcctttgcggtctggcaaacatctacatcgcattctggctgccgcaaaatatttgggtcaactttaaagtctttggcctgaccgcccttaccttaatcttcacattgttaagcggtatctatatctaccgccacatgccgcaggaagataaatcctaa

SEQ ID NO: 3736 - protein, 179 aa, Escherichia coli
MKQFLDFLPLVVFFAFYKIYDIYAATAALIVATAIVLIYSWVRFRKVEKMALITFVLVVVFGGLTLFFHNDEFIKWKVTVIYALFAGALLVSQWVMKKPLIQRMLGKELTLPQSVWSKLNLAWAVFFILCGLANIYIAFWLPQNIWVNFKVFGLTALTLIFTLLSGIYIYRHMPQEDKS

SEQ ID NO: 3737 - DNA, 399 bp, Escherichia coli
atgtctacaacacataacgtccctcagggcgatcttgttttacgtactttagccatgcccgccgataccaatgccaatggtgacatctttggtggttggttaatgtcacaaatggatattggcggcgctattctggcgaaagaaattgcccatggtcgtgtagtgaccgtgcgggttgaaggaatgactttcttacggccggttgcggtcggcgatgtggtgtgctgctatgcacgctgtgtccagaaagggacgacatcagtcagcattaatattgaagtgtgggtgaaaaaagtggcgtctgaaccaatcgggcaacgctataaagcaacagaagcattatttaagtatgtcgcggttgatcccgaaggaaaacctcgcgccttacccgttgagtaa

SEQ ID NO: 3738 - protein, 132 aa, Escherichia coli
MSTTHNVPQGDLVLRTLAMPADTNANGDIFGGWLMSQMDIGGAILAKEIAHGRVVTVRVEGMTFLRPVAVGDVVCCYARCVQKGTTSVSINIEVWVKKVASEPIGQRYKATEALFKYVAVDPEGKPRALPVE

SEQ ID NO: 3739 - DNA, 768 bp, Escherichia coli
ttgcatttaaaatcgggacctggtttttctactgaaatgattatgacttcaatgacccttgatttacctcgccgcttcccctggccgacgttactttcggtctgcattcatggtgctgttgtggcgggtttgctctatacctcggtacatcaggttattgaactacctgcgcctgcgcagccgatttctgtcacgatggttgcgcctgctgatcttgaaccgccacaagccgttcagccaccaccggagccggtggtagagccagaaccggaacctgagccgatccctgaaccgccaaaagaagctccggtggtcattgaaaagccgaagccgaaacctaagccaaaaccgaagccggtgaaaaaggtggagcagccaaaacgcgatgtcaaacccgtagagtcgcgtccggcatcaccgtttgaaaatacggcacccgcgcgcccgacatcaagtacggcaacggctgcaaccagcaagccggttaccagtgtggcttcaggaccacgcgcattaagccgtaatcagccgcagtatccggcacgagcacaggcattgcgcattgaagggcaggttaaagttaaatttgatgtcacgccagatggtcgcgtggataacgtacaaatcctctcagccaagcctgcaaacatgtttgagcgtgaggtgaaaaatgcgatgcgcagatggcgttatgagccgggtaagccaggcagtgggattgtggtgaatatcctgtttaaaattaacggcactaccgaaattcagtaa

SEQ ID NO: 3740 - protein, 255 aa, Escherichia coli
MHLKSGPGFSTEMIMTSMTLDLPRRFPWPTLLSVCIHGAVVAGLLYTSVHQVIELPAPAQPISVTMVAPADLEPPQAVQPPPEPVVEPEPEPEPIPEPPKEAPVVIEKPKPKPKPKPKPVKKVEQPKRDVKPVESRPASPFENTAPARPTSSTATAATSKPVTSVASGPRALSRNQPQYPARAQALRIEGQVKVKFDVTPDGRVDNVQILSAKPANMFEREVKNAMRRWRYEPGKPGSGIVVNILFKINGTTEIQ

SEQ ID NO: 3741 - DNA, 297 bp, Escherichia coli
gtgttgtatgttatttacgctcaagacaaagctgatagcctcgaaaaacgcctttccgttcgtccggcacatttggcacgtttacagttactgcatgatgaaggtcgtttgttgaccgccggtccaatgccagcggtagacagtaacgatccaggggctgcgggatttactggctcaaccgttattgctgaatttgagtcgctggaagcagctcaggcctgggccgatgctgacccgtacgtagcggcaggagtctatgaacacgtttcagtgaaaccatttaagaaagtgttctga

SEQ ID NO: 3742 - protein, 98 aa, Escherichia coli
MLYVIYAQDKADSLEKRLSVRPAHLARLQLLHDEGRLLTAGPMPAVDSNDPGAAGFTGSTVIAEFESLEAAQAWADADPYVAAGVYEHVSVKPFKKVF

SEQ ID NO: 3743 - DNA, 1254 bp, Escherichia coli
gtgagtcactggactacattcaaacaaacagcaacaaagttatgggtgaccctacggcacgacattctcgcgctggccgtctttttaaatggattgcttatttttaaaacaatctatggtatatcggtcaatttgcttgatattttccatatcaaagcattttcagagctggatctctccttgctggcaaacgccccactctttatgctcggcgtatttcttgtcctgaactccattggcttactgttccgggcaaagctcgcatgggcaatcagtatcattttgttgttgatagcgctaatttacactctgcatttttatccctggctgaaatttagtattggattttgcatttttacgctggtgtttttgctgatactgcgcaaagacttctcccacagtagcgcagcagccgggacaattttcgcatttattagtttcacgacgttactgttttactccacttacggtgcgctttatttaagcgaaggttttaatccgcgaatagaaagtttgatgaccgcgttctatttttcgatagaaaccatgtcaaccgtcggctatggcgatattgtccctgtttctgaatcagcacgattgttcactatttcggtcattatttccggcattaccgtttttgccacatctatgacctcaatttttggtccgcttatccgcgggggattcaacaaacttgtaaaaggaaacaatcatacaatgcatcgtaaagatcattttattgtttgcggacattcgattctcgccatcaatacgattctgcaactgaatcaacgcggacaaaacgtaacggttatcagcaacttgcctgaagatgatatcaagcaacttgagcaacgcttaggcgataacgccgatgttatccccggtgacagtaatgacagttcagtgttaaagaaagcgggaatcgatcgttgccgggccattctggcgctgagtgataacgatgcagataacgcgtttgttgtactctcggcaaaagatatgagcagtgatgtcaaaacagttctcgccgtcagtgatagcaaaaacctgaataagattaagatggtacatccggatatcattctctcaccacaactgtttggcagcgaaattctggcgcgagttttaaatggtgaagagattaataatgatatgctcgtttcaatgttgttgaactccggtcatggcattttcagcgataacgatgaacaagaaacgaaagctgacagtaaagaatcggcgcaaaaatag

SEQ ID NO: 3744 - protein, 417 aa, Escherichia coli
MSHWTTFKQTATKLWVTLRHDILALAVFLNGLLIFKTIYGISVNLLDIFHIKAFSELDLSLLANAPLFMLGVFLVLNSIGLLFRAKLAWAISIILLLIALIYTLHFYPWLKFSIGFCIFTLVFLLILRKDFSHSSAAAGTIFAFISFTTLLFYSTYGALYLSEGFNPRIESLMTAFYFSIETMSTVGYGDIVPVSESARLFTISVIISGITVFATSMTSIFGPLIRGGFNKLVKGNNHTMHRKDHFIVCGHSILAINTILQLNQRGQNVTVISNLPEDDIKQLEQRLGDNADVIPGDSNDSSVLKKAGIDRCRAILALSDNDADNAFVVLSAKDMSSDVKTVLAVSDSKNLNKIKMVHPDIILSPQLFGSEILARVLNGEEINNDMLVSMLLNSGHGIFSDNDEQETKADSKESAQK

SEQ ID NO: 3745 - DNA, 1461 bp, Escherichia coli
atgacaaccgtttatacgttggtgagttggttggccattctgggatactggttgctcattgcaggcgtaactttacgcattctaatgaaacgacgcgcagttccctccgcgatggcctggctgttgattatttacattctgccgttagtcggaattattgcctatcttgccgttggcgagctccatttaggcaaacgccgcgctgagcgcgccagagcgatgtggccttccaccgcaaaatggcttaacgaccttaaagcctgtaagcatatcttcgccgaagaaaatagcagtgtcgctgcgccattattcaagctttgcgagcgtcgtcaggggatcgctggggtcaaagggaatcagctacaactgatgaccgagtcagatgatgtgatgcaggcgttaatccgcgacatccagctcgcgcgccataatattgagatggtgttttatatctggcagcccggcggcatggcggaccaggtggctgaatcattaatggccgctgcacggcgcggtattcattgccgattgatgctcgactccgccgggagtgtggcttttttccgcagcccgtggcccgagctaatgcgtaatgccggtattgaagttgtcgaagccttaaaggtcaatctgatgcgtgtgtttttacgccgtatggacctgcgccaacatcgcaagatgatcatgattgataattacatcgcgtacaccggcagcatgaatatggtcgaccctcgctacttcaaacaagatgcgggcgtagggcaatggattgatctgatggcgcgtatggaaggccccatcgccaccgcgatggggattatttattcctgcgactgggagattgaaaccgggaaacgtattctgccgccgccaccagatgtcaatattatgccgtttgagcaggccagcggtcacactattcacacaattgcttctggccccggctttccggaagatctcattcaccaggcattattgactgctgcttattcggctcgtgaatatttgatcatgacaacgccctattttgtgccaagcgatgatttacttcatgcgatttgcacggcggcgcagcgcggggtggatgtcagtattatccttccgcgaaaaaatgactcgatgctggtcggctgggccagtcgcgcattctttacagaactgctggctgctggggttaaaatttatcagtttgaaggcgggttactgcataccaagagcgtgctggtcgatggtgaactaagtctggttggcaccgttaaccttgatatgcgtagtctgtggctaaatttcgagattaccctggcaatcgacgataaaggttttggtgcagacctcgccgccgttcaggacgattatatttcgcgttctcgtctgctcgatgcccgtttatggctaaaacgtccattatggcaacgtgtcgccgagcgactgttttacttcttcagcccgttgctgtaa

SEQ ID NO: 3746 - protein, 486 aa, Escherichia coli
MTTVYTLVSWLAILGYWLLIAGVTLRILMKRRAVPSAMAWLLIIYILPLVGIIAYLAVGELHLGKRRAERARAMWPSTAKWLNDLKACKHIFAEENSSVAAPLFKLCERRQGIAGVKGNQLQLMTESDDVMQALIRDIQLARHNIEMVFYIWQPGGMADQVAESLMAAARRGIHCRLMLDSAGSVAFFRSPWPELMRNAGIEVVEALKVNLMRVFLRRMDLRQHRKMIMIDNYIAYTGSMNMVDPRYFKQDAGVGQWIDLMARMEGPIATAMGIIYSCDWEIETGKRILPPPPDVNIMPFEQASGHTIHTIASGPGFPEDLIHQALLTAAYSAREYLIMTTPYFVPSDDLLHAICTAAQRGVDVSIILPRKNDSMLVGWASRAFFTELLAAGVKIYQFEGGLLHTKSVLVDGELSLVGTVNLDMRSLWLNFEITLAIDDKGFGADLAAVQDDYISRSRLLDARLWLKRPLWQRVAERLFYFFSPLL

SEQ ID NO: 3747 - DNA, 330 bp, Escherichia coli
atggatatggatctaaacaatcgcctgactgaagatgaaacgcttgagcaggcctacgatatttttctcgaactggctgccgacaatctcgatccagctgatgttctgctgttcaatcttcagtttgaagagcgcggcggcgcggagttattcgatccggcggaagactggctggaacatgttgatttcgatttgaacccggacttttttgccgaagtggtgattggtctggcggacagtgaagatggtgaaatcaacgatgttttcgcgcgcattctgttatgccgcgaaaaagatcacaaactttgccatatcatctggcgggaataa

SEQ ID NO: 3748 - protein, 109 aa, Escherichia coli
MDMDLNNRLTEDETLEQAYDIFLELAADNLDPADVLLFNLQFEERGGAELFDPAEDWLEHVDFDLNPDFFAEVVIGLADSEDGEINDVFARILLCREKDHKLCHIIWRE

SEQ ID NO: 3749 - DNA, 1005 bp, Escherichia coli
atgaatgctgtaaccgaaggaagaaaagtcctcctcgaaatcgccgatctgaaagtgcactttgaaatcaaagatggcaaacagtggttctggcaaccgccgaaaacgctcaaagccgtcgatggtgtaactcttcgcctgtatgaaggggaaacattaggtgtggtaggggaatcgggatgcgggaagtccacctttgctcgcgccatcattggcttggttaaagcgaccgacggtcatgtggcctggttaggtaaagagttgctgggcatgaagcccgatgaatggcgtgccgtacgcagtgatattcagatgattttccaggatccgttggcatcactgaacccgcgtatgaccatcggcgagatcatcgctgaaccactgcgtatttatcatccgaaaatgtcacgccaggaagttcgcgagcgcgtgaaggcgatgatgctgaaagtcggtttgttgcctaacctgattaaccgctatccgcatgagttctccggtgggcagtgccagcgtatcgggattgctcgtgctcttattcttgaaccgaagctgattatctgtgatgagccggtgtcggcgctggacgtgtcaattcaggcgcaggtggtcaacctgctccagcagttgcaacgtgagatgggattgtcattaatttttatcgctcacgacctggccgtggtaaaacacatttccgatcgtgtgctggtgatgtatctcggccatgcggtagaactggggacctatgatgaggtctaccacaatccgctacatccttacaccagggcattgatgtcggcagtccccatacctgatccggatctggagaagaacaaaaccatccagttactggaaggggaattaccgtcgccgatcaacccgccttccggttgtgttttccgtacccgttgtccgattgcaggtccggagtgcgccaaaacacgtcctgtgctggaagggagtttcagacacgccgtttcttgcctgaaagtcgatccgctttaa

SEQ ID NO: 3750 - protein, 334 aa, Escherichia coli
MNAVTEGRKVLLEIADLKVHFEIKDGKQWFWQPPKTLKAVDGVTLRLYEGETLGVVGESGCGKSTFARAIIGLVKATDGHVAWLGKELLGMKPDEWRAVRSDIQMIFQDPLASLNPRMTIGEIIAEPLRIYHPKMSRQEVRERVKAMMLKVGLLPNLINRYPHEFSGGQCQRIGIARALILEPKLIICDEPVSALDVSIQAQVVNLLQQLQREMGLSLIFIAHDLAVVKHISDRVLVMYLGHAVELGTYDEVYHNPLHPYTRALMSAVPIPDPDLEKNKTIQLLEGELPSPINPPSGCVFRTRCPIAGPECAKTRPVLEGSFRHAVSCLKVDPL

SEQ ID NO: 3751 - DNA, 1014 bp, Escherichia coli
atgagcgtaattgaaactgcaactgtgccgctcgcacaacaacaggctgacgcactgctgaacgtgaaagatttgcgtgtcacctttagtaccccggatggcgacgtcacggcggtcaatgatttgaatttttcgctacgtgccggagaaacgctgggcatcgtaggtgagtctggttcgggcaaatcgcaaaccgcatttgcgttgatgggcctgctggctgccaacggacgtattggcggatcggcaaccttcaatgggcgtgaaatcctcaatttgccagagcgtgaactcaataaactgcgagctgaacaaatctcaatgatttttcaggacccaatgacttcgttgaatccctatatgcgcgtcggtgagcagttgatggaagtgctgatgctgcataagaacatgagcaaagctgaggcgtttgaagaatcggtgcggatgctcgatgcggtaaaaatgccggaagcgcgtaaacgcatgaaaatgtacccgcacgaattttctggcggcatgcgtcagcgagtcatgattgcgatggcattgctatgtcgacctaagctgctgattgcggatgaacccactactgcgctggacgtcaccgtacaggcgcagatcatgacgctattgaatgaactgaagcgggaatttaataccgccatcattatgattacccacgatcttggcgtggtagcggggatctgcgacaaagtgctggtaatgtacgccgggcgcacgatggaatatggcaacgcgcgcgatgtcttttatcaacccgtacatccttattctatcggtttgctcaacgcggtgccgcgtctcgatgcggaaggtgaaacaatgttgactattccgggtaatccgccaaacctgctgcgattaccgaaaggttgcccgttccagccacgttgtccgcatgcgatggacatttgtagtagcgcaccgccgctggaagagtttacgcctggccgtctgcgtgcttgctttaaaccagtggaggaactgttatga

SEQ ID NO: 3752 - protein, 337 aa, Escherichia coli
MSVIETATVPLAQQQADALLNVKDLRVTFSTPDGDVTAVNDLNFSLRAGETLGIVGESGSGKSQTAFALMGLLAANGRIGGSATFNGREILNLPERELNKLRAEQISMIFQDPMTSLNPYMRVGEQLMEVLMLHKNMSKAEAFEESVRMLDAVKMPEARKRMKMYPHEFSGGMRQRVMIAMALLCRPKLLIADEPTTALDVTVQAQIMTLLNELKREFNTAIIMITHDLGVVAGICDKVLVMYAGRTMEYGNARDVFYQPVHPYSIGLLNAVPRLDAEGETMLTIPGNPPNLLRLPKGCPFQPRCPHAMDICSSAPPLEEFTPGRLRACFKPVEELL

SEQ ID NO: 3753 - DNA, 909 bp, Escherichia coli
atgatgttaagtaagaaaaacagcgagacgctggaaaatttcagtgaaaagctggaggtcgaagggcgcagcttgtggcaggacgcacgtcgacgttttatgcataaccgtgcggcggttgccagtctgatagtgctggtgctgatcgcgttatttgtaatcctggcaccgatgctttcgcagtttgcctatgacgatactgactgggcgatgatgtccagcgccccggatatggagtccggtcactactttggtactgactcatccggtcgcgacctgcttgtgcgcgttgcgattggcgggcgtatctcactcatggtcggtgttgctgcggcactggtggcagtggtcgtggggacactttatggttcgctttccggttatctgggcggtaaagtggattcggtaatgatgcgtctgctggaaatcctcaactccttcccattcatgttcttcgtcattttgctggtgacctttttcggtcaaaacatcctgctgattttcgtggcgattggcatggtttcctggctggatatggctcgtattgtgcgtgggcaaaccctgagtctgaagcgcaaagagtttattgaggcggcacaagttggcggtgtatcgacgccgggcattgttattcgccacattgtgccgaacgtactcggtgtggtggtggtctatgcgtcgcttctggtgcccagcatgatcctctttgaatctttccttagcttcctgggattaggtacgcaagagccgttaagcagctggggtgcattgctgagtgatggcgcgaactcgatggaagtctctccatggttactgttgttccctgcgggattcctcgtggtaacgctgttttgtttcaactttatcggcgatggcttgcgtgatgccctcgacccgaaagatcgttaa

SEQ ID NO: 3754 - protein, 302 aa, Escherichia coli
MMLSKKNSETLENFSEKLEVEGRSLWQDARRRFMHNRAAVASLIVLVLIALFVILAPMLSQFAYDDTDWAMMSSAPDMESGHYFGTDSSGRDLLVRVAIGGRISLMVGVAAALVAVVVGTLYGSLSGYLGGKVDSVMMRLLEILNSFPFMFFVILLVTFFGQNILLIFVAIGMVSWLDMARIVRGQTLSLKRKEFIEAAQVGGVSTPGIVIRHIVPNVLGVVVVYASLLVPSMILFESFLSFLGLGTQEPLSSWGALLSDGANSMEVSPWLLLFPAGFLVVTLFCFNFIGDGLRDALDPKDR

SEQ ID NO: 3755 - DNA, 921 bp, Escherichia coli
atgttaaaatttattctacgtcgctgtctggaagcgattccgacgctatttattcttattactatttcgttctttatgatgcgcctcgctccgggcagtccttttaccggcgaacgtactttaccaccggaagtgatggccaatatcgaagcgaaatatcatcttaatgatccgatcatgacacagtatttcagctacctgaaacaactggcgcatggcgatttcggtccatcgtttaaatataaagattattcggtcaatgacctggttgcatccagttttcccgtttctgccaaactgggagccgcagcattttttcttgcggtaatactgggtgttagtgctggcgttattgccgcattaaagcaaaacaccaaatgggactataccgtgatggggctggcaatgaccggggttgttatccccagttttgtggttgcgccattattagtcatgatatttgcgatcattttgcattggctgccgggcggtggctggaatggtggagcgcttaaattcatgatattgccaatggtggcgttatcactcgcctatatcgccagtattgcgcgtatttcccgtggctctatgattgaggttttacactccaactttattcgtactgcccgggcgaaagggttacctatgcggcggatcattttacgccacgcattaaaacctgctctgttacccgtgctctcctatatggggcccgcatttgtcggcattattaccggttcgatggtcatcgaaaccatttatggtttaccggggattgggcaattgttcgttaatggcgcattgaaccgtgactattccttagtgttaagtctgaccattctggttggcgcgttaaccattttgtttaatgccattgtcgatgtgctatatgcggttatcgacccgaaaatccgttactga

SEQ ID NO: 3756 - protein, 306 aa, Escherichia coli
MLKFILRRCLEAIPTLFILITISFFMMRLAPGSPFTGERTLPPEVMANIEAKYHLNDPIMTQYFSYLKQLAHGDFGPSFKYKDYSVNDLVASSFPVSAKLGAAAFFLAVILGVSAGVIAALKQNTKWDYTVMGLAMTGVVIPSFVVAPLLVMIFAIILHWLPGGGWNGGALKFMILPMVALSLAYIASIARISRGSMIEVLHSNFIRTARAKGLPMRRIILRHALKPALLPVLSYMGPAFVGIITGSMVIETIYGLPGIGQLFVNGALNRDYSLVLSLTILVGALTILFNAIVDVLYAVIDPKIRY

SEQ ID NO: 3757 - DNA, 1632 bp, Escherichia coli
atgaccaacatcaccaagagaagtttagtagcagctggcgttttggctgcgcttatggcagggaatgtcgcgctggcagctgatgtacccgcaggtgtcacactggcggaaaaacaaacgctggtacgtaacaatggttcagaagttcagtcattagatccgcacaaaattgaaggtgttccggagtctaatatcagccgagacctgtttgaaggcttactggtcagcgatcttgacggtcatccggcacctggcgtcgctgaatcatgggataataaagacgcgaaagtctggaccttccatttgcgtaaagatgcgaaatggtctgatggcacgccagttacagcacaagactttgtgtatagctggcaacgttctgttgatccaaacactgcttctccgtatgccagttatctgcaatatgggcatatcgccggtattgatgaaattcttgaagggaaaaaaccgattaccgatctcggcgtgaaagctattgatgatcacacattagaagtcaccttaagtgaacctgttccgtacttctataaattacttgttcacccatcaacttcaccggtgccaaaagccgctatcgagaaattcggcgaaaaatggacccagcctggtaatatcgtcaccaacggtgcctataccttaaaagattgggtcgtaaacgaacgaatcgttcttgaacgcagcccgacctactggaacaacgcgaaaaccgttattaaccaggtaacctatttgcctattgcttctgaagttaccgatgtcaaccgctaccgtagtggtgaaatcgacatgacttataacaacatgccgatcgaattgttccagaagctgaaaaaagagatcccggacgaagttcacgttgatccatacctgtgcacttactattacgaaattaacaaccagaaaccgccatttaatgacgtgcgtgtgcgtaccgcactgaaattgggtatggaccgcgatatcattgttaataaagtgaaagcgcagggcgacatgcccgcctatggttacactccaccatatactgatggcgcaaaattgactcagccggaatggtttggctggagccaggaaaaacgtaacgaagaagcgaaaaaactgctggctgaagcgggttataccgcagacaaaccgttgaccatcaacctgttgtataacacctccgatctgcataaaaagctggcgattgctgcctcttcattgtggaagaaaaacattggtgtaaacgtcaaactggttaaccaggagtggaaaacgttcctcgacacccgtcaccagggcacttttgatgtggcccgtgcaggctggtgtgcagactacaacgaaccaacttccttcctgaacaccatgctgtcgaacagctcaatgaataccgcgcattataagagcccggcctttgacagcattatggcggaaacgctgaaagtgactgacgaggcgcagcgtacagctctgtacactaaagcagaacaacagctggataaggattcggccattgttcctgtttattactacgtgaatgcgcgtttggtgaaaccgtgggttggtggctataccggcaaagatccgctggataatacctacacccggaatatgtacattgtgaagcactaa

SEQ ID NO: 3758 - protein, 543 aa, Escherichia coli
MTNITKRSLVAAGVLAALMAGNVALAADVPAGVTLAEKQTLVRNNGSEVQSLDPHKIEGVPESNISRDLFEGLLVSDLDGHPAPGVAESWDNKDAKVWTFHLRKDAKWSDGTPVTAQDFVYSWQRSVDPNTASPYASYLQYGHIAGIDEILEGKKPITDLGVKAIDDHTLEVTLSEPVPYFYKLLVHPSTSPVPKAAIEKFGEKWTQPGNIVTNGAYTLKDWVVNERIVLERSPTYWNNAKTVINQVTYLPIASEVTDVNRYRSGEIDMTYNNMPIELFQKLKKEIPDEVHVDPYLCTYYYEINNQKPPFNDVRVRTALKLGMDRDIIVNKVKAQGDMPAYGYTPPYTDGAKLTQPEWFGWSQEKRNEEAKKLLAEAGYTADKPLTINLLYNTSDLHKKLAIAASSLWKKNIGVNVKLVNQEWKTFLDTRHQGTFDVARAGWCADYNEPTSFLNTMLSNSSMNTAHYKSPAFDSIMAETLKVTDEAQRTALYTKAEQQLDKDSAIVPVYYYVNARLVKPWVGGYTGKDPLDNTYTRNMYIVKH

SEQ ID NO: 3759 - DNA, 648 bp, Escherichia coli
gtgattcagaccctttttgattttcccgtttacttcaaatttttcatcgggttatttgcgctggtcaacccggtagggattattcccgtctttatcagcatgaccagttatcagacagcggcagcgcgaaacaaaactaaccttacagccaacctgtctgtggccattatcttgtggatctcgctttttctcggcgacacgattctacaactttttggtatatcaattgattcattccgtatcgccggtggcatcctggtggtgacaatagcgatgtcgatgatcagcggcaagcttggtgaggataaacagaacaagcaagaaaaatcagaaaccgcggtacgtgaaagcattggtgtggtgccattggcgttgccgttgatggcggggccaggggcgatcagttctaccatcgtctggggtacgcgttatcacagcattagctatctgtttggtttctttgtggctattgcattgttcgctttatgttgctggggattgttccgcatggcaccgtggctggtacgagttttacgccagaccggcatcaacgtgattacgcgtattatggggctattgctgatggcgttggggattgaatttatcgttactggtattaaggggattttccccggcctgcttaattaa

SEQ ID NO: 3760 - protein, 215 aa, Escherichia coli
MIQTLFDFPVYFKFFIGLFALVNPVGIIPVFISMTSYQTAAARNKTNLTANLSVAIILWISLFLGDTILQLFGISIDSFRIAGGILVVTIAMSMISGKLGEDKQNKQEKSETAVRESIGVVPLALPLMAGPGAISSTIVWGTRYHSISYLFGFFVAIALFALCCWGLFRMAPWLVRVLRQTGINVITRIMGLLLMALGIEFIVTGIKGIFPGLLN

SEQ ID NO: 3761 - DNA, 2676 bp, Escherichia coli
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatttacaacgcctataaagatgaaaaaacctgtggtgttctgtctgaagacgacacttttggtaccatcactatcgctgaacccatcggtattatttgcggtatcgttccgaccactaacccgacttcaactgctatcttcaaatcgctgatcagcctgaagacccgtaacgccattatcttctccccgcacccgcgtgcaaaagatgcaaccaacaaagcggctgatatcgttctacaggctgctatcgctgccggtgctccgaaagatctgatcggctggatcgatcaaccttctgttgagctgtctaacgcactgatgcaccacccagacatcaacctgatcctcgcgactggtggtccgggcatggttaaagccgcatacagctccggtaaaccagctatcggcgtaggcgcgggcaacactccggttgttatcgatgaaactgctgatatcaaacgtgcagttgcatctgtactgatgtccaaaaccttcgacaacggtgtaatctgtgcttctgaacagtctgttgttgttgttgactctgtttatgacgcagtacgtgaacgtttcgcaacccacggcggctatctgttgcagggtaaagagctgaaagctgttcaggacgttatcctgaaaaacggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgtgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacggctcgtatcctgattaacaccccggcttctcagggtggtatcggtgacctgtataacttcaaactcgcaccttccctgactctgggttgtggttcctggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggctatgctgatcagatcacttccgtattgaaagcagcaggcgttgaaactgaagtcttcttcgaagtagaagctgacccgaccctgagcatcgttcgtaaaggtgcagaactggcaaactccttcaaaccagacgtgattatcgcgctgggtggtggttccccgatggacgctgcgaagatcatgtgggttatgtacgaacatccggaaactcacttcgaagaactggcgctgcgctttatggatatccgtaaacgtatctacaagttcccgaaaatgggtgtgaaagcgaaaatgatcgctgtcaccaccacttctggtacaggttctgaagtcactccgtttgcggttgtaactgacgacactactggtcagaaatatccgctggcagactatgcactgaccccggatatggcgattgtcgacgccaaccttgttatggacatgccgaagtccctgtgtgctttcggtggtctggacgcagtaactcacgccatggaagcttatgtttctgtactggcatctgagttctctgatggtcaggctctgcaggcactgaaactactgaaagaatatctgccagcgtcctaccacgaagggtctaaaaatccggtagcgcgtgaacgtgttcacagtgcagcgactatcgcgggtatcgcgtttgcgaacgccttcctgggtgtatgtcactcaatggcgcacaaactgggttcccagttccatattccgcacggtctggcaaacgccctgctgatttgtaacgttattcgctacaacgcgaatgacaacccgaccaagcagactgcattcagccagtatgaccgtccgcaggctcgccgtcgttatgctgaaattgccgaccacctgggtctgagcgcaccgggcgaccgtactgcagctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagattctgctggatacttactacggtcgtgattatgtagaaggcgaaactgcagcgaagaaagaagccgctccggctaaagctgagaaaaaagcgaaaaaatccgcttaa

SEQ ID NO: 3762 - protein, 891 aa, Escherichia coli
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDTTGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 3763 - DNA, 1182 bp, Escherichia coli
ttggtatcccgttacgattctctgcgtaacccactgacttctctgggggattacctcgcccccaaactcatctctcgttgccttgccgaatcaggtactgtaacgctacgcaagcgccgtcttcccctcgaaatgatggtctggtgtattgttggcatggcgcttgagcgtaaagaacctcttcaccagattgtgaatcgcctggacatcatgctgccgggcaatcgccccttcgttgcccccagtgccgttattcagacccgccagcgtctgggaattgaggctgtccgccgcgtgttcacgaaaacagcgcagctctggcataacgccacgccgcatccgcactggtgcggcctgaccctgctggccatcgatggtgtgttctggcgcacaccggatacaccagagaacgatgcagccttcccccgccagacacatgccgggaacccggcgctctacccgcaggtcaaaatggtctgccagatggaactgaccagccatctgctgacgactgcagccttcggcacgatgaagaacagcgaaaatgagcttgctgagcaacttatagaacaaaccggcgataacactctgacgttaatggataaaggttattactcaccaggactgttaaatgcctggagcctggcgggagaacaccgccactggatgatccctctcagaaagggagcgcaatatgaagagatcagaaaactgggtaaaggcgatcatctggtgaagctgaacatcagcccgcaggcacgaaaaaagtggccgggactgggaaatgaggtgacagcccgcctgctgaccgtgacgcgcaaaggaaaagtctgccatctgctgacgtcgatgacggacgccatacgcttcaccgggacgtataccggagctgatgcgcgatcttgcaagtatgggacaaccagtgaaattaccgacaagaagggaaagggccttcccgagagtggtaaaggagaggccctggaaataccccacagccccgaaaaagagccagtcagttgcttaactgactggcattaccccttctggggccgttttttgttttcccaaaacaacttttccataaaccggcagcattgtccttcatcatatttgcgacgatgtataacgcctacacacagcgatattgtactttacaggttacaagtcaatgtcggtgtataa

SEQ ID NO: 3764 - protein, 393 aa, Escherichia coli
MVSRYDSLRNPLTSLGDYLAPKLISRCLAESGTVTLRKRRLPLEMMVWCIVGMALERKEPLHQIVNRLDIMLPGNRPFVAPSAVIQTRQRLGIEAVRRVFTKTAQLWHNATPHPHWCGLTLLAIDGVFWRTPDTPENDAAFPRQTHAGNPALYPQVKMVCQMELTSHLLTTAAFGTMKNSENELAEQLIEQTGDNTLTLMDKGYYSPGLLNAWSLAGEHRHWMIPLRKGAQYEEIRKLGKGDHLVKLNISPQARKKWPGLGNEVTARLLTVTRKGKVCHLLTSMTDAIRFTGTYTGADARSCKYGTTSEITDKKGKGLPESGKGEALEIPHSPEKEPVSCLTDWHYPFWGRFLFSQNNFSINRQHCPSSYLRRCITPTHSDIVLYRLQVNVGV

SEQ ID NO: 3765 - DNA, 618 bp, Escherichia coli
atggcacagctatatttctactattccgcaatgaatgcgggtaagtctacagcattgttgcaatcttcatacaattaccaggaacgcggcatgcgcactgtcgtatatacggcagaaattgatgatcgctttggtgccgggaaagtcagttcgcgtataggtttgtcatcacctgcaaaattatttaaccaaaattcatcattatttgatgagattcgtgcggaacatgaacagcaggcaattcattgcgtactggttgatgaatgccagtttttaaccagacaacaagtatatgaattatcggaggttgtcgatcaactcgatatacccgtactttgttatggtttacgtaccgattttcgaggtgaattatttattggcagtcaatacttactggcatggtccgacaaactggttgaattaaaaaccatctgtttttgtggccgtaaagcaagcatggtgctgcgtcttgatcaagcaggcagaccttataacgaaggtgagcaggtggttattggtggtaatgaacgctacgtttctgtatgccgtaaacactataaagaagcgttagaagtcggctcattaacggctattcaggaaaggcatcgccacgattaa

SEQ ID NO: 3766 - protein, 205 aa, Escherichia coli
MAQLYFYYSAMNAGKSTALLQSSYNYQERGMRTVVYTAEIDDRFGAGKVSSRIGLSSPAKLFNQNSSLFDEIRAEHEQQAIHCVLVDECQFLTRQQVYELSEVVDQLDIPVLCYGLRTDFRGELFIGSQYLLAWSDKLVELKTICFCGRKASMVLRLDQAGRPYNEGEQVVIGGNERYVSVCRKHYKEALEVGSLTAIQERHRHD

SEQ ID NO: 3767 - DNA, 129 bp, Escherichia coli
atgaatcaggaagttttaacctcacgtgctgcgaaatcatcggtgcaaatagggctatatgccgcgtcttttctggctaattttatgaaaagatatttattggcggcacaaaataaagaacaattttga

SEQ ID NO: 3768 - protein, 42 aa, Escherichia coli
MNQEVLTSRAAKSSVQIGLYAASFLANFMKRYLLAAQNKEQF

SEQ ID NO: 3769 - DNA, 414 bp, Escherichia coli
atgagcgaagcacttaaaattctgaacaacatccgtactcttcgtgcgcaggcaagagaatgtacacttgaaacgctggaagaaatgctggaaaaattagaagttgttgttaacgaacgtcgcgaagaagaaagcgcggctgctgctgaagttgaagagcgcactcgtaaactgcagcaatatcgcgaaatgctgatcgctgacggtattgacccgaacgaactgctgaatagccttgctgccgttaaatctggcaccaaagctaagcgtgctcagcgtccggcaaaatatagctacgttgacgaaaacggcgaaactaaaacctggactggccagggccgtactccagctgtaatcaaaaaagcaatggatgagcaaggtaaatccctcgacgatttcctgatcaagcaataa

SEQ ID NO: 3770 - protein, 137 aa, Escherichia coli
MSEALKILNNIRTLRAQARECTLETLEEMLEKLEVVVNERREEESAAAAEVEERTRKLQQYREMLIADGIDPNELLNSLAAVKSGTKAKRAQRPAKYSYVDENGETKTWTGQGRTPAVIKKAMDEQGKSLDDFLIKQ

SEQ ID NO: 3771 - DNA, 909 bp, Escherichia coli
atggctgccattaatacgaaagtcaaaaaagccgttatccccgtagcgggattaggaaccaggatgttgccggcgacgaaagccatcccgaaagagatgctgccacttgtcgataagccattaattcaatacgtcgtgaatgaatgtattgcggctggcattactgaaattgtgctggttactcactcatctaaaaactctattgaaaaccactttgataccagttttgaactggaagcaatgctggaaaaacgtgtaaaacgtcaactgcttgatgaagtgcagtctatttgtccgccacacgtgactattatgcaagttcgtcaggggctggcgaaaggcctgggacacgcggtattgtgtgctcacccggtagtgggtgatgaaccggtagctgttattttgcctgacgttattctggatgaatatgaatccgatttatcacaggataacctggcagagatgatccgccgctttgatgaaacgggtcatagccagatcatggttgaaccggttgctgatgtgaccgcatatggcgttgtggattgcaaaggcgttgaattagcgccgggtgaaagcgtaccgatggttggcgtggttgaaaaaccaaaagcggatgttgcgccgtctaatctcgctattgtgggtcgttacgtacttagcgcggatatttggccgttgctggcaaaaacccctcctggagctggtgatgaaattcagctcactgacgcaattgatatgctgatcgaaaaagaaacggttgaagcctatcatatgaaagggaagagccatgactgcggtaataaattaggttacatgcaggccttcgttgaatacggtattcgtcataacacccttggcacggaatttaaagcctggcttgaagaagagatgggcattaagaagtaa

SEQ ID NO: 3772 - protein, 302 aa, Escherichia coli
MAAINTKVKKAVIPVAGLGTRMLPATKAIPKEMLPLVDKPLIQYVVNECIAAGITEIVLVTHSSKNSIENHFDTSFELEAMLEKRVKRQLLDEVQSICPPHVTIMQVRQGLAKGLGHAVLCAHPVVGDEPVAVILPDVILDEYESDLSQDNLAEMIRRFDETGHSQIMVEPVADVTAYGVVDCKGVELAPGESVPMVGVVEKPKADVAPSNLAIVGRYVLSADIWPLLAKTPPGAGDEIQLTDAIDMLIEKETVEAYHMKGKSHDCGNKLGYMQAFVEYGIRHNTLGTEFKAWLEEEMGIKK

SEQ ID NO: 3773 - DNA, 1014 bp, Escherichia coli
atgacgcagccattggtcggaaaacagattctcattgttgaagatgagcaggtatttcgctcgcttctggattcgtggttttcctcattgggagcgacaacggtactggcggctgatggggtggatgcccttgagttgctgggaggtttcactccagacctgatgatatgtgatatcgcgatgccacgaatgaacgggcttaaactgctggaacatatacgcaacagtggtgaccagacaccggttctggtgatatctgccactgaaaatatggcagatattgccaaagcgttacgtctgggcgttgaagatgttttgctgaaaccggttaaagatctgaatcgcttgcgcgagatggtttttgcctgtctctatcccagcatgtttaattcccgcgttgaggaagaggaaaggctttttcgcgactgggatgcaatggttgataaccctgctgcagcggcgaaattattacaggaactacaaccgccagttcagcaggtgatttcccaatgccgggttaattatcgtcaattagttgccgcggacaaacccggcctggtgcttgatattgccgcactttcggaaaacgatctggcattttattgccttgatgtcacccgagctggacataatggcgtacttgctgccttgttattacgcgcattgtttaacggattattacaggaacagcttgcacaccaaaatcaacggttgccagagttgggcgcgttattgaagcaggtaaaccatttactccgtcaggccaatctgccggggcagtttccgctattagttggctattatcatcgcgaactgaaaaatctcattctggtttctgcgggtctgaatgcgacgttaaataccggcgaacatcaggtgcaaatcagtaatggtgttccgttaggcactttaggtaacgcttatttgaatcaattgagccagcgatgcgatgcctggcaatgccaaatatggggaaccggtggtcggctgcgcttgatgttgtctgcagaatga

SEQ ID NO: 3774 - protein, 337 aa, Escherichia coli
MTQPLVGKQILIVEDEQVFRSLLDSWFSSLGATTVLAADGVDALELLGGFTPDLMICDIAMPRMNGLKLLEHIRNSGDQTPVLVISATENMADIAKALRLGVEDVLLKPVKDLNRLREMVFACLYPSMFNSRVEEEERLFRDWDAMVDNPAAAAKLLQELQPPVQQVISQCRVNYRQLVAADKPGLVLDIAALSENDLAFYCLDVTRAGHNGVLAALLLRALFNGLLQEQLAHQNQRLPELGALLKQVNHLLRQANLPGQFPLLVGYYHRELKNLILVSAGLNATLNTGEHQVQISNGVPLGTLGNAYLNQLSQRCDAWQCQIWGTGGRLRLMLSAE

SEQ ID NO: 3775 - DNA, 906 bp, Escherichia coli
atgagaaagataaaaatagggctggcgctgggatctggcgcggcaagaggttggtcgcatattggcgtaattaatgcgctaaaaaaagtgggtattgaaattgatatcgttgcaggatgttcaattggttcgctggtgggcgctgcctatgcatgcgatcgattatctgcgctggaagattgggtgacctctttcagttattgggatgttttacgcctgatggatctctcctggcagcgcggtgggttactgcgcggcgagcgtgtcttcaatcaatatcgcgaaataatgccggaaacagagatcgaaaattgttcccgtcgcttcgcggctgttgccaccaatttaagtactgggcgtgaattatggtttactgaaggcgatctccatcttgctattcgtgcatcatgcagtattccaggactaatggcacccgttgcgcataacggctactggctggttgatggcgctgtagttaacccaattcctatttccctcacgcgtgcattgggggctgatattgtgatagcggtcgacctgcagcacgatgctcatttgatgcaacaagatttgctctcctttaatgtcagtgaagaaaatagcgagaatggtgattctctgccgtggcatgcgcgtctgaaagaaaggttaggcagcataacgacacgtcgggcggtgacagcgccaacggcaacagagattatgaccacttctatccaggtgctggagaaccgccttaaaaggaaccgcatggcaggtgatccgcccgatattctgattcaacctgtttgcccgcaaatatctacgcttgatttccatcgcgcgcacgctgccattgcggccgggcagctggcagtggaaaagaaaatggacgaacttttgccgttggtacgcaccaacatttga

SEQ ID NO: 3776 - protein, 301 aa, Escherichia coli
MRKIKIGLALGSGAARGWSHIGVINALKKVGIEIDIVAGCSIGSLVGAAYACDRLSALEDWVTSFSYWDVLRLMDLSWQRGGLLRGERVFNQYREIMPETEIENCSRRFAAVATNLSTGRELWFTEGDLHLAIRASCSIPGLMAPVAHNGYWLVDGAVVNPIPISLTRALGADIVIAVDLQHDAHLMQQDLLSFNVSEENSENGDSLPWHARLKERLGSITTRRAVTAPTATEIMTTSIQVLENRLKRNRMAGDPPDILIQPVCPQISTLDFHRAHAAIAAGQLAVEKKMDELLPLVRTNI

SEQ ID NO: 3777 - DNA, 459 bp, Escherichia coli
gtgtctcagctttgtccctgtggtagtgctgtcgagtatagcctatgttgccacccttatgtgtctggtgaaaaggttgcacctgatccagaacatctcatgcgttcgcgttactgcgcttttgtgatgcaagacgcagattatttaataaagacctggcatccatcttgtggagcagcggcgttacgagccgaattgattgccggatttgcgcatactgaatggttgggattgaccgtatttgaacattgctggcaggacggcggcaatatcggatttgtcagttttgttgctcgatttaccgagggtggcaaaacaggtgcaataattgaacgttcgcgatttttgaaagaaaacggtcaatggtactatattgacggtacacgtccgcagtttggccgcaacgatccctgcccttgtggttcaggtaaaaaatttaaaaagtgctgcggccaataa

SEQ ID NO: 3778 - protein, 152 aa, Escherichia coli
MSQLCPCGSAVEYSLCCHPYVSGEKVAPDPEHLMRSRYCAFVMQDADYLIKTWHPSCGAAALRAELIAGFAHTEWLGLTVFEHCWQDGGNIGFVSFVARFTEGGKTGAIIERSRFLKENGQWYYIDGTRPQFGRNDPCPCGSGKKFKKCCGQ

SEQ ID NO: 3779 - DNA, 843 bp, Escherichia coli
atgcattcactccaacgtaaagttctgcgtactatttgtccggaccaaaaaggtctgatcgcacgtattaccaatatttgctacaagcacgagttaaatatcgtgcagaacaatgaatttgtagatcatcgtaccgggcgcttttttatgcgcacggaactggaagggatttttaatgattccaccctgctggcggatctcgatagcgcattgccagaaggctccgtgcgtgagctgaatcctgccggtcgtcgccggatagtaattctggtcactaaagaagcgcattgccttggcgatttgttgatgaaagccaattacggcggcctggatgtcgaaatcgcggcagttattggtaaccacgatactttacgttctctggttgagcggtttgatattccgtttgagctggtaagccatgaagggttaagccgcaacgagcacgatcaaaagatggcggatgccattgatgcttatcaacctgactatgtggtgctggcgaagtatatgcgggtattaacgccggaatttgtggcacgcttcccgaataagatcatcaatattcaccattcattcctgccagcgtttatcggcgcacgtccttatcaccaggcctatgagcgtggcgtgaagattattggcgcaaccgctcactatgtgaatgacaatctggacgaaggcccaatcatcatgcaggacgttattcatgtcgatcatacctacacagctgaagatatgatgcgcgcaggtcgtgacgtcgagaaaaacgtcttaagtcgtgcgctatacaaagtactggcgcagcgcgtctttgtttacggtaatcggacgattattctttaa

SEQ ID NO: 3780 - protein, 280 aa, Escherichia coli
MHSLQRKVLRTICPDQKGLIARITNICYKHELNIVQNNEFVDHRTGRFFMRTELEGIFNDSTLLADLDSALPEGSVRELNPAGRRRIVILVTKEAHCLGDLLMKANYGGLDVEIAAVIGNHDTLRSLVERFDIPFELVSHEGLSRNEHDQKMADAIDAYQPDYVVLAKYMRVLTPEFVARFPNKIINIHHSFLPAFIGARPYHQAYERGVKIIGATAHYVNDNLDEGPIIMQDVIHVDHTYTAEDMMRAGRDVEKNVLSRALYKVLAQRVFVYGNRTIIL

SEQ ID NO: 3781 - DNA, 1200 bp, Escherichia coli
atgcctgctcgccaagtatgtcagaattttttccgcggtgctttagcaccatttcacaaataccgacaaaatgctttgttggatgccactatcgcactaatcaatggcgcatctctgacgctgaccagcatcggacgttatttacccggtaatgctcaggtcaaaaataaaataaaacgtgttgatcgtctgctcggtaatgagtctcttcatcacgacatccccctgattttcagaaacattatttccatgctgacgagcaagctgtcactgtgtgtcatcgccgttgactggagtggatacccctctcaggagtatcacgtactccgcgccagcctgatttgctatggacattcgattccattgctgagttggatagttccttcggaaaaacagcaaaatgcaaagatacagcaagcctttcttaatactctttccgaagcggtaaacccaaaagcaagggtaatcatcgtcacggatgcagggttccagaatgcctggtttcggcacataaaatcactcggctgggattttattggccggatacgaggcaataaacaactgcatctggcgagaaaaggggaatgctggttcaggcgtcaggaattacaggccagtaacaaacctgaatatctggggccggggacgctttcccgggcggaatacgcccgttgcgatggtcatttttatttgcacaaaaaagagccgaaaggccggagaaataaacgttcgcgttgtggtatagccagaccatcacagataaaagatgccaggtcggcggcaaaagaaccatggttaatattcagcagcacagatgactttaaaccgcgagaaatcatgaagttatacagccgccgaatgcagattgagcaaaacttcagggatgaaaaaagtgagcgttttgggttcggtctgcgagccagttacagctgttcggcaggaagaatgctggtactgagcctgctggcaacactgagcacaatagtgctgtggcttattggctatcacgctgaaaatcaagggttacatcttagatatcaggccaacagcattaaaacgcggcgggtaatctcgtatctgacgttagcggagaatgtcttacgacactccccgctaattttaaaacgaacggtgctaagcaccattcttaatcacctcaccagaacctaccagaatatggtgttggtttattatcgctga

SEQ ID NO: 3782 - protein, 399 aa, Escherichia coli
MPARQVCQNFFRGALAPFHKYRQNALLDATIALINGASLTLTSIGRYLPGNAQVKNKIKRVDRLLGNESLHHDIPLIFRNIISMLTSKLSLCVIAVDWSGYPSQEYHVLRASLICYGHSIPLLSWIVPSEKQQNAKIQQAFLNTLSEAVNPKARVIIVTDAGFQNAWFRHIKSLGWDFIGRIRGNKQLHLARKGECWFRRQELQASNKPEYLGPGTLSRAEYARCDGHFYLHKKEPKGRRNKRSRCGIARPSQIKDARSAAKEPWLIFSSTDDFKPREIMKLYSRRMQIEQNFRDEKSERFGFGLRASYSCSAGRMLVLSLLATLSTIVLWLIGYHAENQGLHLRYQANSIKTRRVISYLTLAENVLRHSPLILKRTVLSTILNHLTRTYQNMVLVYYR

SEQ ID NO: 3783 - DNA, 678 bp, Escherichia coli
atgcaattcctgaatatgttcttctttgatatctacccgtacatagccggggcggtcttcctgattggtagctggctgcgttatgactacgggcagtacacatggcgtgcggcgtccagccagatgctggatcgcaaagggatgaacctcgcgtcgaacctgttccatatcggtattctggggatttttgtcggtcacttcttcggtatgctgacgccgcactggatgtatgaagcctggctgccgattgaagtgaaacagaaaatggcgatgtttgctggtggtgccagcggcgtactgtgtctgattggtggcgtgctgttgctgaagcgtcgtctgttcagcccacgcgtgcgtgcaaccactaccggagcggatatcctgatcctgtcgctgctcgttatccagtgcgcgctgggcttgctgaccattccgttctcagcccagcatatggacggtagcgagatgatgaaactggttggctgggcgcagtcggtagtgaccttccacggtggtgcttctcaacaccttgatggtgtggcgtttatcttccgtctgcacctggtgttggggatgacgttattcctgctgttcccgttctcgcgtctggtgcacatctggagcgtcccggtggagtatctgacgcgtaagtatcagctggtgcgcgctcgtcactaa

SEQ ID NO: 3784 - protein, 225 aa, Escherichia coli
MQFLNMFFFDIYPYIAGAVFLIGSWLRYDYGQYTWRAASSQMLDRKGMNLASNLFHIGILGIFVGHFFGMLTPHWMYEAWLPIEVKQKMAMFAGGASGVLCLIGGVLLLKRRLFSPRVRATTTGADILILSLLVIQCALGLLTIPFSAQHMDGSEMMKLVGWAQSVVTFHGGASQHLDGVAFIFRLHLVLGMTLFLLFPFSRLVHIWSVPVEYLTRKYQLVRARH

SEQ ID NO: 3785 - DNA, 711 bp, Escherichia coli
atgatcgaactcgtgattgtatcgcgtctccttgaatatccggatgctgccttatggcagcatcaacaagagatgtttgaggcgattgccgcgtcgaaaaatctgccaaaagaggatgcccatgcgctgggcattttcctgcgcgatttaacgacgatggatccgctcgatgcccaggcgcagtacagcgaactgttcgaccgtggccgcgccacgtcactgttgctatttgaacatgttcacggtgaatcccgtgaccgcggccaggcgatggtggatctgctggcgcagtacgagcagcacggcttgcagttaaacagccgcgaattgcccgaccatctgccgctgtatctggagtacctggcgcagctgccgcaaagcgaagccgtggagggtttgaaagatattgcgccgattctggcattgctgagcgcgcgtctgcaacagcgtgaaagccgttatgccgtgctgtttgatctgctgctgaaactggcgaataccgcaatcgacagcgacaaagtggcggaaaaaattgccgacgaagcgcgcgacgatacgccgcaggcgctggatgcagtctgggaagaagagcaggttaaattctttgctgacaaaggctgcggtgattcagcaatcactgctcatcagcgtcgctttgccggtgccgtcgcgccgcaatatctgaatatcaccaccggaggacagcactaa

SEQ ID NO: 3786 - protein, 236 aa, Escherichia coli
MIELVIVSRLLEYPDAALWQHQQEMFEAIAASKNLPKEDAHALGIFLRDLTTMDPLDAQAQYSELFDRGRATSLLLFEHVHGESRDRGQAMVDLLAQYEQHGLQLNSRELPDHLPLYLEYLAQLPQSEAVEGLKDIAPILALLSARLQQRESRYAVLFDLLLKLANTAIDSDKVAEKIADEARDDTPQALDAVWEEEQVKFFADKGCGDSAITAHQRRFAGAVAPQYLNITTGGQH

SEQ ID NO: 3787 - DNA, 1539 bp, Escherichia coli
atgaaaattcgttcacaagtcggcatggtgctgaatctcgataagtgcatcggctgccacacctgttcagtgacctgtaaaaacgtctggaccagccgtgaaggcgtggaatacgcgtggttcaacaacgtggaaaccaagccgggccagggcttcccgactgactgggaaaaccaggaaaaatacaaaggcggctggatccgtaaaatcaacggcaaacttcagccgcgcatgggtaaccgtgccatgctgctgggtaaaatcttcgctaacccgcatctgccggggatcgacgattattacgagccattcgattttgattatcagaacctgcataccgcgccggaaggcagcaaatcacagccgattgcccgtccgcgttcactgattaccggcgaacggatggcgaaaatcgaaaaagggccgaactgggaagatgacctgggcggtgagtttgacaagctggcgaaagacaagaacttcgacaacatccagaaggcgatgtatagccagttcgaaaacaccttcatgatgtatttgccgcgcctgtgcgaacactgtctgaacccggcatgtgtggcgacctgcccgagcggtgcgatttacaagcgtgaagaagatggcatcgtcctgatcgaccaggataaatgccgtggctggcgtatgtgcatcaccggatgcccgtacaaaaaaatctacttcaactggaagagcggtaagtctgagaagtgcatcttctgctatccgcgtattgaagccggccagccgacaatatgttcagaaacctgtgtcggtcgtatccgttatcttggcgtgctgctgtacgatgccgacgcgattgaacgtgcggcaagtaccgagaacgagaaagatctctaccagcgtcagctggatgtgttcctcgatccgaacgatccgaaagtcatcgagcaggcgattaaagacggtattccgctgagcgttattgaggctgcacagcagtcgccagtttataaaatggcgatggaatggaaactggcgctgccgctgcatccggaatatcgcacactgccgatggtctggtacgtgccgcctctgtcgccgattcagtctgcggcagacgcgggtgaactgggcagcaacggcattctgccagacgtcgaaagcctgcgtattccggtacagtatctggcgaatctgctgaccgccggtgataccaaaccggtactgcgcgcgctgaaacgtatgctggcgatgcgtcattacaaacgtgctgaaaccgttgacggtaaagtcgatacccgtgcgctggaagaggtcggtctgaccgaagcccaggcacaggagatgtatcgttatctggctattgccaactacgaagatcgctttgtggtgccgagcagtcatcgtgaactggcgcgggaagccttcccggagaaaaatggctgcggctttacctttggtgatggctgccacggttcagataccaaattcaatctgttcaacagccgccgtatcgatgccatcgacgtaaccagcaaaacggagccgcacccatga

SEQ ID NO: 3788 - protein, 512 aa, Escherichia coli
MKIRSQVGMVLNLDKCIGCHTCSVTCKNVWTSREGVEYAWFNNVETKPGQGFPTDWENQEKYKGGWIRKINGKLQPRMGNRAMLLGKIFANPHLPGIDDYYEPFDFDYQNLHTAPEGSKSQPIARPRSLITGERMAKIEKGPNWEDDLGGEFDKLAKDKNFDNIQKAMYSQFENTFMMYLPRLCEHCLNPACVATCPSGAIYKREEDGIVLIDQDKCRGWRMCITGCPYKKIYFNWKSGKSEKCIFCYPRIEAGQPTICSETCVGRIRYLGVLLYDADAIERAASTENEKDLYQRQLDVFLDPNDPKVIEQAIKDGIPLSVIEAAQQSPVYKMAMEWKLALPLHPEYRTLPMVWYVPPLSPIQSAADAGELGSNGILPDVESLRIPVQYLANLLTAGDTKPVLRALKRMLAMRHYKRAETVDGKVDTRALEEVGLTEAQAQEMYRYLAIANYEDRFVVPSSHRELAREAFPEKNGCGFTFGDGCHGSDTKFNLFNSRRIDAIDVTSKTEPHP

SEQ ID NO: 3789 - DNA, 3744 bp, Escherichia coli
atgagtaaattcctggaccggtttcgctacttcaaacagaagggtgaaacctttgccgatgggcatggccagcttctcaataccaaccgtgactgggaggatggatatcgccagcgttggcagcatgacaaaatcgtccgctctacccacggggtaaactgcaccggctcctgcagctggaaaatctacgtcaaaaacggtctggtcacctgggaaacccagcagactgactatccgcgaactcgcccggacctgccaaaccatgaacctcgcggctgcccgcgcggtgccagctactcctggtatctttacagcgctaaccgcctgaaatacccgatgatgcgcaaacgcctgatgaaaatgtggcgtgaagcgaaggcgctgcatagcgatccggttgaggcatgggcttctatcattgaagacgccgataaagcgaaaagctttaagcaggcgcgtggacgcggtggttttgttcgttcttcctggcaggaagtgaacgaactgatcgccgcatctaacgtttacaccatcaaaaattacggcccggaccgtgtcgctggcttctcgccaattccggcaatgtcgatggtttcttacgcatcgggtgcgcgctatctctcgctgattggcggtacttgcttaagcttctacgactggtactgcgacctgcctcctgcgtctccgcaaacctggggtgagcaaactgacgtaccggaatctgctgactggtacaactccagctacatcatcgcctggggttcaaacgtgccgcagacgcgtaccccggatgctcacttctttactgaagtgcgttacaaagggaccaaaactgttgccgtcacaccagactacgctgaaatcgccaaactgtgcgatctgtggctggcaccgaaacagggcaccgatgcggcaatggcgctggcaatgggtcacgtaatgctgcgtgaattccacctcgacaacccaagccagtatttcaccgactatgtgcgccgctacaccgacatgccgatgctggtgatgctggaagagcgcgacggttactacgctgcgggtcgtatgctgcgcgctgctgatctggtggatgcactgggccaggaaaacaatccggaatggaaaactgtcgcctttaataccaatggtgaaatggttgcgccgaacggttctattggcttccgctggggcgagaagggcaaatggaatcttgagcagcgcgacggcaaaactggcgaagaaaccgagctgcaactgagcctgctgggtagccaggatgagatcgctgaggtgggcttcccgtactttggtggcgatggcacggaacacttcaacaaagtggaactggaaaacgtgctgctgcataagctgccggtgaaacgcctgcaactggctgatggcagcaccgccctggtgaccaccgtttatgatctgacgctggcaaactacggtctggaacgtggcctgaacgacgttaactgtgcaaccagctatgacgatgtgaaagcttacacccctgcctgggccgagcagattaccggcgtttctcgcagccagattattcgcatcgcccgtgaatttgccgataacgctgataaaacgcacggtcgttcgatgattatcgtcggcgctgggctgaaccactggtatcacctggacatgaactatcgtggtctgatcaacatgctgattttctgcggctgtgtcggtcagagcggcggtggctgggcgcactatgtaggtcaggaaaaactgcgtccgcaaaccggctggcagccgctggcgtttgccctcgactggcagcgtccggcgcgtcacatgaacagtacctcttatttctataaccactccagccagtggcgttatgaaaccgtgactgcggaagaactgctgtcgccgatggcggataaatctcgctatactggacacctgatcgactttaacgtccgtgcagaacgcatgggctggctgccgtctgcgccgcagttaggcactaacccgctgactatcgctcgcgaagcagaaaaagctgggatgaatccggtggactatacggttaaatccctgaaagagggttctatccgtttcgctgcggaacagccggaaaacggtaaaaaccacccgcgtaatctgttcatctggcgttctaacctgctcggttcttccggtaaaggtcatgagtttatgctcaagtacctgctggggacggagcacggtatccagggcaaagacctggggcagcagggcggcgtgaagccggaagaagtggactggcaggacaacggtctggaaggcaagctggatctggtggtgacgctggacttccgtctgtcgagcacctgtctctattccgacatcattttgccgacggcgacctggtacgaaaaagacgacatgaatacttcggatatgcatccgtttattcacccgctgtctgcggcggtcgatccggcctgggaagcgaaaagcgactgggaaatctacaaagccatcgcgaagaaattctccgaagtgtgcgttggtcatctgggtaaagaaactgacatcgtcacgctgcctatccagcacgactctgccgctgaactggcgcaaccgctggatgtgaaagactggaaaaaaggcgaatgcgacctgatcccaggtaaaactgcaccgcacattatggtcgtagagcgcgattatccagcaacttacgaacgctttacctctatcggcccgctgatggagaaaatcggtaacggcggtaaagggattgcctggaacacccagagcgagatggatctgctgcgtaagctcaactacaccaaagcggaaggtccggcaaaaggccagccgatgctcaataccgcaattgatgcggcagagatgatcctgacgctggcaccggaaaccaatggtcaggtagctgtaaaagcctgggctgccctgagcgagtttaccggccgtgaccatacgcatctggcgctgaataaagaagacgagaagattcgcttccgcgatattcaggcacagccgcgcaaaatcatctccagcccgacatggtctggccttgaagatgaacacgtttcttacaacgccggttacaccaacgttcacgagctgatcccgtggcgtacgctctctggtcgtcagcaactgtatcaggatcaccagtggatgcgtgatttcggtgaaagcctgctggtttatcgtccgccgatcgacacccgttcggtgaaagaagtgatggggcagaaatccaacggcaacccggaaaaagcgctcaacttcctgacgccgcaccagaagtggggtatccactccacctacagcgacaacctgctgatgctaactttaggtcgcggtggtccggtggtctggctgagtgaagccgatgccaaagagctgggtatcgccgataacgactggattgaagtcttcaacagcaacggtgcactgactgcccgtgcggttgtcagccagcgtgttccggcagggatgaccatgatgtaccacgcgcaggaacgtatcgttaacctgcctggttcggaaattacccaacagcgtggtggtatccataactcggtcacccgtatcacgccgaaaccgacgcatatgatcggcggctatgcccatctggcatatggctttaactactacggcaccgtaggttctaaccgcgatgagtttgttgtagtgcgtaagatgaagaacattgactggttagatggcgaaggcaatgaccaggtacaggagagcgtaaaatga

SEQ ID NO: 3790 - protein, 1247 aa, Escherichia coli
MSKFLDRFRYFKQKGETFADGHGQLLNTNRDWEDGYRQRWQHDKIVRSTHGVNCTGSCSWKIYVKNGLVTWETQQTDYPRTRPDLPNHEPRGCPRGASYSWYLYSANRLKYPMMRKRLMKMWREAKALHSDPVEAWASIIEDADKAKSFKQARGRGGFVRSSWQEVNELIAASNVYTIKNYGPDRVAGFSPIPAMSMVSYASGARYLSLIGGTCLSFYDWYCDLPPASPQTWGEQTDVPESADWYNSSYIIAWGSNVPQTRTPDAHFFTEVRYKGTKTVAVTPDYAEIAKLCDLWLAPKQGTDAAMALAMGHVMLREFHLDNPSQYFTDYVRRYTDMPMLVMLEERDGYYAAGRMLRAADLVDALGQENNPEWKTVAFNTNGEMVAPNGSIGFRWGEKGKWNLEQRDGKTGEETELQLSLLGSQDEIAEVGFPYFGGDGTEHFNKVELENVLLHKLPVKRLQLADGSTALVTTVYDLTLANYGLERGLNDVNCATSYDDVKAYTPAWAEQITGVSRSQIIRIAREFADNADKTHGRSMIIVGAGLNHWYHLDMNYRGLINMLIFCGCVGQSGGGWAHYVGQEKLRPQTGWQPLAFALDWQRPARHMNSTSYFYNHSSQWRYETVTAEELLSPMADKSRYTGHLIDFNVRAERMGWLPSAPQLGTNPLTIAREAEKAGMNPVDYTVKSLKEGSIRFAAEQPENGKNHPRNLFIWRSNLLGSSGKGHEFMLKYLLGTEHGIQGKDLGQQGGVKPEEVDWQDNGLEGKLDLVVTLDFRLSSTCLYSDIILPTATWYEKDDMNTSDMHPFIHPLSAAVDPAWEAKSDWEIYKAIAKKFSEVCVGHLGKETDIVTLPIQHDSAAELAQPLDVKDWKKGECDLIPGKTAPHIMVVERDYPATYERFTSIGPLMEKIGNGGKGIAWNTQSEMDLLRKLNYTKAEGPAKGQPMLNTAIDAAEMILTLAPETNGQVAVKAWAALSEFTGRDHTHLALNKEDEKIRFRDIQAQPRKIISSPTWSGLEDEHVSYNAGYTNVHELIPWRTLSGRQQLYQDHQWMRDFGESLLVYRPPIDTRSVKEVMGQKSNGNPEKALNFLTPHQKWGIHSTYSDNLLMLTLGRGGPVVWLSEADAKELGIADNDWIEVFNSNGALTARAVVSQRVPAGMTMMYHAQERIVNLPGSEITQQRGGIHNSVTRITPKPTHMIGGYAHLAYGFNYYGTVGSNRDEFVVVRKMKNIDWLDGEGNDQVQESVK

SEQ ID NO: 3791 - DNA, 1392 bp, Escherichia coli
atgagtcactcatccgcccccgaaagggctactggagctgtcattacagattggcgaccggaagatcctgcgttctggcaacaacgcggtcaacgtattgccagccgcaacctgtggatttccgttccctgtctgctgctggcgttttgcgtatggatgttgttcagcgctgttgcggtgaacttaccgaaagtcggttttaattttacgaccgatcagctatttatgttgactgcgctgccttcggtttctggcgcgttattacgtgttccatactcctttatggttcctatcttcggtggtcgtcgctggacggcgttcagcaccggtattctgattattccttgcgtctggctgggttttgccgtgcaggatacctccacgccttatagcgtcttcatcatcatttctctgctgtgcggctttgctggcgcgaacttcgcatccagtatggcaaacatcagcttcttctttccgaaacagaagcagggtggcgcgctgggtctgaatggtggtctgggcaacatgggcgtcagcgtcatgcagttggttgctccgctggtggtatcactgtcgattttcgcagtatttggtagccagggcgtcaaacagccggatgggactgagctgtatctggcgaatgcgtcctggatatgggtgccgttccttgccatcttcaccattgcggcgtggtttggcatgaacgatcttgctacctcgaaagcctccatcaaggagcagttgccggtactcaaacggggtcatctgtggattatgagcctgctgtatctggcaaccttcggctccttcatcggcttctccgcgggctttgcgatgctgtcaaaaacgcagttcccggatgttcagattctgcaatacgctttcttcgggccgtttattggtgcgctggcgcgttctgcaggtggtgcattatctgaccgtctgggcggaactcgtgtcactctggtgaactttatcctgatggcgattttcagcggcctgctgttcctgaccttaccgactgacggacagggcggaagcttcatggcgttcttcgcagtcttcctggcgctgttcctgaccgctgggctgggtagtggttccactttccagatgatttccgtgatcttccgtaaactgacaatggatcgtgtgaaagcagaagggggttctgacgaacgtgcgatgcgtgaagcggcaaccgacacggcggcggcgctgggtttcatctctgcgattggcgcgattggtggcttctttatcccgaaagcgtttggtagctcgctggcattaacgggttcgccagtcggcgcaatgaaagtatttttgattttctatatcgcctgcgtggtgattacctgggcggtatatggtcggcattctaaaaaataa

SEQ ID NO: 3792 - protein, 463 aa, Escherichia coli
MSHSSAPERATGAVITDWRPEDPAFWQQRGQRIASRNLWISVPCLLLAFCVWMLFSAVAVNLPKVGFNFTTDQLFMLTALPSVSGALLRVPYSFMVPIFGGRRWTAFSTGILIIPCVWLGFAVQDTSTPYSVFIIISLLCGFAGANFASSMANISFFFPKQKQGGALGLNGGLGNMGVSVMQLVAPLVVSLSIFAVFGSQGVKQPDGTELYLANASWIWVPFLAIFTIAAWFGMNDLATSKASIKEQLPVLKRGHLWIMSLLYLATFGSFIGFSAGFAMLSKTQFPDVQILQYAFFGPFIGALARSAGGALSDRLGGTRVTLVNFILMAIFSGLLFLTLPTDGQGGSFMAFFAVFLALFLTAGLGSGSTFQMISVIFRKLTMDRVKAEGGSDERAMREAATDTAAALGFISAIGAIGGFFIPKAFGSSLALTGSPVGAMKVFLIFYIACVVITWAVYGRHSKK

SEQ ID NO: 3793 - DNA, 1797 bp, Escherichia coli
atgcttaaacgttgtctctctccgctcaccctggttaatcaggttgcgcttattgtgttgctttctactgctattggactggcagggatggcggtttctggctggctggtgcaaggcgttcagggcagcgcccatgcgatcaacaaagcgggatcgctgcgcatgcaaagttaccgtctgttggcagcagtgccattaagcgagaaagacaagcccttaattaaagagatggaacaaacagcatttagcgccgagttgactcgagcagcagaacgagacgggcaactggcgcaattacagggtttacaagattactggcgtaatgaactgatccctgcactgatgcgtgcacaaaaccgcgaaacggtgtcagcggatgtcagccagtttgttgccgggcttgatcagctggtatctggttttgatcgcaccacggaaatgcgcattgagacagtggtgctggtccatcgggtaatggcggtatttatggcacttttactggtattcactattatctggttgcgggcgagattgctacaaccgtggcggcaactgctggcaatggcgagtgccgtcagccatcgcgattttacccaacgcgcaaacatcagcgggcgcaacgaaatggcgatgcttggaactgcgttgaacaatatgtctgcagaactggccgaaagttatgccgtacttgagcagcgggttcaggagaaaaccgccgggctggagcataaaaatcagatcctctcttttttatggcaggccaaccgccgattgcattcccgcgccccgctgtgtgaacgcctgtcacctgtactcaacggattacagaatttaaccctgctacgtgatatcgaactgcgggtgtatgacactgatgatgaagagaatcatcaggagtttacctgccagccagatatgacttgtgatgataaaggctgccagctctgcccgcgcggcgtattacccgttggcgatcgcggcacaaccctgaagtggcggctggctgacactcatacgcagtacggtattttgctggcgaccctgccgcaggggcgtcatcttagccatgatcaacaacaactggtggataccctggttgaacaactcaccgccacgctggcgctggatcgccatcaggaacgtcagcaacagttgatcgtgatggaagagcgtgccaccattgcgcgcgaactgcatgattctattgcccaatctctctcttgcatgaagatgcaggtgagttgcttacagatgcagggcgatgcgctgccagaaagcagccgcgaactgttaagtcagatccgtaacgaactgaatgcatcctgggtgcagttgcgtgaattgctcaccacattccgtttgcagctcaccgagcctggattacgtccggcgctggaggcgagttgcgaagagtacagcgccaaatttggcttcccggtgaagctggattatcaattgccgcctcgtctggtgccttcgcatcaggcaatccacttgttgcaaattgcccgtgaggcattaagtaacgccctcaaacattcgcaagcgagtgaggtcgtggtgacggtggcgcaaaacgataatcaggtcaaactgaccgtccaggataacggctgcggcgtgcctgaaaatgccatccgcagcaatcactacggcatgataataatgcgcgaccgtgcgcaaagtttacgaggcgattgccgcgtccgccgtcgtgaatcaggtggcaccgaagtggtggtcacctttattcccgaaaaaactttcacagacgtccaaggagatacccatgagtaa

SEQ ID NO: 3794 - protein, 598 aa, Escherichia coli
MLKRCLSPLTLVNQVALIVLLSTAIGLAGMAVSGWLVQGVQGSAHAINKAGSLRMQSYRLLAAVPLSEKDKPLIKEMEQTAFSAELTRAAERDGQLAQLQGLQDYWRNELIPALMRAQNRETVSADVSQFVAGLDQLVSGFDRTTEMRIETVVLVHRVMAVFMALLLVFTIIWLRARLLQPWRQLLAMASAVSHRDFTQRANISGRNEMAMLGTALNNMSAELAESYAVLEQRVQEKTAGLEHKNQILSFLWQANRRLHSRAPLCERLSPVLNGLQNLTLLRDIELRVYDTDDEENHQEFTCQPDMTCDDKGCQLCPRGVLPVGDRGTTLKWRLADTHTQYGILLATLPQGRHLSHDQQQLVDTLVEQLTATLALDRHQERQQQLIVMEERATIARELHDSIAQSLSCMKMQVSCLQMQGDALPESSRELLSQIRNELNASWVQLRELLTTFRLQLTEPGLRPALEASCEEYSAKFGFPVKLDYQLPPRLVPSHQAIHLLQIAREALSNALKHSQASEVVVTVAQNDNQVKLTVQDNGCGVPENAIRSNHYGMIIMRDRAQSLRGDCRVRRRESGGTEVVVTFIPEKTFTDVQGDTHE

SEQ ID NO: 3795 - DNA, 651 bp, Escherichia coli
atgagtaatcaggaaccggctactatcctgctgatcgacgatcacccgatgttgcgaactggcgtaaaacagcttatcagtatggcaccagatatcaccgtggttggcgaagcgagtaatggcgaacagggtattgaactggcggagtctcttgatcccgatctgatcctgttagatctcaatatgcccggcatgaacggtctggaaacgctggataaactgcgcgaaaagtccctctccgggcgcattgtggtattcagcgtctctaaccatgaagaagatgtggtcaccgcactgaaacgcggcgcggatggctatctgttaaaagatatggaaccggaagatctgctgaaagcgttacatcaggcagctgctggcgaaatggtattaagcgaagcattaacgcctgttctggccgccagcttgcgcgctaaccgtgccactactgagcgcgatgttaaccagttaaccccacgcgagcgcgatattctcaagctaattgcccagggtttgccgaacaagatgattgcccgccgcctggacatcaccgaaagcacagtaaaagttcacgtcaagcacatgctgaagaaaatgaagctaaagtctcgcgtggaagctgcggtatgggtgcatcaggagcgcattttctga

SEQ ID NO: 3796 - protein, 216 aa, Escherichia coli
MSNQEPATILLIDDHPMLRTGVKQLISMAPDITVVGEASNGEQGIELAESLDPDLILLDLNMPGMNGLETLDKLREKSLSGRIVVFSVSNHEEDVVTALKRGADGYLLKDMEPEDLLKALHQAAAGEMVLSEALTPVLAASLRANRATTERDVNQLTPRERDILKLIAQGLPNKMIARRLDITESTVKVHVKHMLKKMKLKSRVEAAVWVHQERIF

SEQ ID NO: 3797 - DNA, 1395 bp, Escherichia coli
ttgagccgtttcgttcctcgcattattccgttttatttactcttgctggcggcaggcggtacagctaacgcacaatctaccttcgagcaaaaagcggcaaatccctttgataataacaatgatggtctgccggatttaggcatggcacctgaaaatcatgatggggaaaaacactttgctgaaattgtgaaagatttcggcgaaaccagtatgaatgataacgggctggatactggcgagcaggcaaaagctttcgcattgggaaaggtccgcgacgcgcttagtcaacaggttaatcagcacgtagagtcctggctatcaccgtggggaaatgccagtgttgacgtcaaagtggataacgaaggacatttcaccggcagtcgtggaagctggtttgtgccgttacaagataatgatcgttatctcacctggagccagcttggtcttactcagcaggatgatgggctggtgagcaatgtgggcgttgggcaacgctgggcgcgcggcagctggctggtgggttataacactttttatgacaacttgctggacgaaaatcttcagcgagcgggctttggcgctgaagcgtggggcgaatatttgcgactatcggcaaacttttatcagccgtttgctgcatggcatgaacagacagccacgcaggaacaacggatggcgcgcgggtacgacctgacagcccggatgcgcatgccgttctatcaacacctcaataccagtgtcagcgtagaacagtattttggtgatcgtgtcgatttgtttaactctggtacgggttatcacaatcccgtcgcgttgagtctgggattaaattacacccctgtgcccttagtcactgtgacggcccagcataaacagggtgaaagtggcgagaatcaaaataacctcgggctgaatcttaactaccgctttggtgtaccgctcaaaaaacaactttctgcgggcgaggttgccgaaagtcagtcgttacgtggtagtcgctatgacaatccgcagcgaaataatctgccgactcttgagtaccgacagcgaaaaacgttaacggtgtttctggcgacacctccgtgggatctaaaacctggcgaaacagtgccgctgaaattacaaatccgcagtcgttacggtattcggcaactgatttggcagggcgatacgcagatattaagtttgacgccgggcgcacaagccaacagtgaggagggctggacgctgatcatgcctgactggcaaaacggggaaggcgcaagcaatcactggcgattgtcagtggtggtggaagataaccaggggcagcgtgtctcctccaatgagatcacgctaacgcttgtcgaaccgttcgacgcattgtcaaacgacgaactgcgctgggaaccgtaa

SEQ ID NO: 3798 - protein, 464 aa, Escherichia coli
MSRFVPRIIPFYLLLLAAGGTANAQSTFEQKAANPFDNNNDGLPDLGMAPENHDGEKHFAEIVKDFGETSMNDNGLDTGEQAKAFALGKVRDALSQQVNQHVESWLSPWGNASVDVKVDNEGHFTGSRGSWFVPLQDNDRYLTWSQLGLTQQDDGLVSNVGVGQRWARGSWLVGYNTFYDNLLDENLQRAGFGAEAWGEYLRLSANFYQPFAAWHEQTATQEQRMARGYDLTARMRMPFYQHLNTSVSVEQYFGDRVDLFNSGTGYHNPVALSLGLNYTPVPLVTVTAQHKQGESGENQNNLGLNLNYRFGVPLKKQLSAGEVAESQSLRGSRYDNPQRNNLPTLEYRQRKTLTVFLATPPWDLKPGETVPLKLQIRSRYGIRQLIWQGDTQILSLTPGAQANSEEGWTLIMPDWQNGEGASNHWRLSVVVEDNQGQRVSSNEITLTLVEPFDALSNDELRWEP

SEQ ID NO: 3799 - DNA, 354 bp, Escherichia coli
atgcaaaaaatcgtgatcgttgccaatggcgcaccttacgggagcgaatccttgtttaacagcttgcggctggccattgcgttacgagagcaggagaacaatctggatctgcgtctgttcctgatgtctgatgcggtcacagccgggttgcgcgggcaaaaaccaggggaaggctacaacattcagcaaatgctggagatccttaccgctcagaatgtaccggtgaaattgtgcaaaacctgtaccgacgggcgcgggattagtacacttcctctgattgatggggtggaaatcggtactcttgttgaactggcgcaatggacgctgtcagccgataaagtgctcacattttaa

SEQ ID NO: 3800 - protein, 117 aa, Escherichia coli
MQKIVIVANGAPYGSESLFNSLRLAIALREQENNLDLRLFLMSDAVTAGLRGQKPGEGYNIQQMLEILTAQNVPVKLCKTCTDGRGISTLPLIDGVEIGTLVELAQWTLSADKVLTF

SEQ ID NO: 3801 - DNA, 717 bp, Escherichia coli
atgcagtggcggaggtgtaaggtgataacgcgtgatttcttgatgaatgccgattgtaaaacggcatttggtgccattgaagaatcactcttatggtcagcagaacaacgggcggcttcgctggcggcgacgctggcttgtcgacctgatgagggaccggtgtggatcttcggttatggatcgttgatgtggaatccggcactggagtttaccgagtcgtgcaccggtacactggttggatggcatcgcgcgttttgcctgcgcctgaccgccgggcgcgggactgcgcaccagccgggacgaatgcttgcactgaaagagggcggacgcaccacaggcgtcgcctatcgactgccagaagagacgctggagcaggaactaaccctgctgtggaagcgcgagatgattaccggctgttatctgccaacctggtgtcagcttgatcttgatgatggacgcacagtaaacgccattgtgtttattatggacccgcgacatccagaatatgaatctgacactcgcgctcaggtcatagcgccgttgattgcggcggcgagcggtccgctgggaaccaatgcacaatacctgttttcactggaacaggagcttatcaaactgggaatgcaggacgatgggctgaatgaattgctggtatcggtaaaaaaactgctggcggagaattatccggatggtgtgttacggccgggattcgcctga

SEQ ID NO: 3802 - protein, 238 aa, Escherichia coli
MQWRRCKVITRDFLMNADCKTAFGAIEESLLWSAEQRAASLAATLACRPDEGPVWIFGYGSLMWNPALEFTESCTGTLVGWHRAFCLRLTAGRGTAHQPGRMLALKEGGRTTGVAYRLPEETLEQELTLLWKREMITGCYLPTWCQLDLDDGRTVNAIVFIMDPRHPEYESDTRAQVIAPLIAAASGPLGTNAQYLFSLEQELIKLGMQDDGLNELLVSVKKLLAENYPDGVLRPGFA

SEQ ID NO: 3803 - DNA, 231 bp, Escherichia coli
atgccgtataaaacgaaaagcgatctgccggaaagcgtaaagcacgtgcttccgtctcatgcccaggatatctataaagaagcgttcaacagcgcatgggatcaatataaagataaagaagatcggcgtgatgacgccagtcgcgaagaaacagcgcataaagtggcctgggctgctgtgaagcatgaatatgccaaaggggatgatgataaatggcataaaaaatcgtaa

SEQ ID NO: 3804 - protein, 76 aa, Escherichia coli
MPYKTKSDLPESVKHVLPSHAQDIYKEAFNSAWDQYKDKEDRRDDASREETAHKVAWAAVKHEYAKGDDDKWHKKS

SEQ ID NO: 3805 - DNA, 1188 bp, Escherichia coli
atgttaccgatatccagacaatttctgttatttttcctacctattttttacattttcgataaattcatctgcaaagggataaccataatgtcaaatgctcaagaggcggtaaaaacccgccacaaggagacttcgcttattttcccggttctggcgctggtagtgctgttcctgtggggaggcagccagacactaccagtggtcattgccatcaatcttcttgcgcttattggtattttaagtagcgcctttagtgttgtccgtcatgcggacgtattagcccatcgcctgggagaaccttacggttcgcttattcttagcctttcagtggttattcttgaagtcagtttgatttcagctttaatggcaaccggcgacgccgcgccaacgctaatgcgtgatacgctctattcaatcattatgattgttaccggtgggctggttggcttttcattattgttgggcggacgcaagtttgccacccaatatatgaatctgtttggtatcaagcagtatttaattgcgctgttccccctggcgataatcgtactggtatttccaatggctctgcctgcggcgaatttttcaacaggtcaggcgttactggtagcattaatttctgcggcaatgtatggcgtatttttgctgatccagaccaaaacgcatcaaagtttatttgtctacgagcacgaagatgacagtgatgatgacgacccgcaccacggtaaaccgtctgcccatagcagcctgtggcatgctatctggttgattgtccatctgattgccgttattgcggtgaccaaaatgaacgccagcccgctggagacattgctcgacagcatgaatgcccctgtcgcctttactggcttcctggtggctctgttgattctgtcgccggaaggtttaggtgcgttaaaagcagtgttgaacaaccaggtccagcgcgcgatgaatctgttctttggttcagtgttagcaaccatttcgcttaccgtacctgtcgtcacgctaattgcctttatgacgggtaacgaattgcagtttgcacttggtgcgccagaaatggtggtgatggtggcctctttagtgctgtgccatatctccttctccaccggacgtactaacgtgctcaatggcgcagcgcatctggcactgtttgccgcctatttgatgacgatatttgcctga

SEQ ID NO: 3806 - protein, 395 aa, Escherichia coli
MLPISRQFLLFFLPIFYIFDKFICKGITIMSNAQEAVKTRHKETSLIFPVLALVVLFLWGGSQTLPVVIAINLLALIGILSSAFSVVRHADVLAHRLGEPYGSLILSLSVVILEVSLISALMATGDAAPTLMRDTLYSIIMIVTGGLVGFSLLLGGRKFATQYMNLFGIKQYLIALFPLAIIVLVFPMALPAANFSTGQALLVALISAAMYGVFLLIQTKTHQSLFVYEHEDDSDDDDPHHGKPSAHSSLWHAIWLIVHLIAVIAVTKMNASPLETLLDSMNAPVAFTGFLVALLILSPEGLGALKAVLNNQVQRAMNLFFGSVLATISLTVPVVTLIAFMTGNELQFALGAPEMVVMVASLVLCHISFSTGRTNVLNGAAHLALFAAYLMTIFA

SEQ ID NO: 3807 - DNA, 168 bp, Escherichia coli
ttgaaccatcaacaattcaagaatagccgcaaaatgttgtcattacaacaaggcggctatatgacgctcgcgcagtttgccatgattttctggcacgacctggcagcaccgatcctggcgggaattattaccgcagcgattgtcggctggtggcgtaaccggaagtaa

SEQ ID NO: 3808 - protein, 55 aa, Escherichia coli
MNHQQFKNSRKMLSLQQGGYMTLAQFAMIFWHDLAAPILAGIITAAIVGWWRNRK

SEQ ID NO: 3809 - DNA, 855 bp, Escherichia coli
atgaaacaaaaagtggttagcattggcgacatcaacgtagcaaatgacctgccgttcgtactgtttggcggtatgaacgtgttggaatctcgcgatctggcgatgcgcatttgcgagcactacgtaaccgtgacccagaaactgggtatcccttacgtgttcaaagcctcttttgacaaagccaaccgctcctccatccactcttatcggggaccgggcctggaagaagggatgaaaatcttccaggagttgaagcagacttttggcgtgaaaattatcaccgacgttcacgaaccaagccaggcacagcccgttgctgatgttgtagatgtgattcagttgccggcgtttcttgctcgccagactgacctggttgaagccatggcgaaaaccggtgcggtaattaacgtcaagaaaccgcagtttgtcagcccgggacagatgggtaatatcgttgataaattcaaagaaggcggcaacgaaaaagtgattctttgcgatcgcggtgctaacttcggctatgacaacctggttgttgatatgctgggcttcagcatcatgaagaaagtgtctggtaattcgccggtgattttcgacgttacccacgcactgcaatgccgcgatccatttggcgcagcttccggcggtcgccgtgctcaggtggctgagctggcaagagccggtatggcggtaggtctggcggggctgtttattgaagcgcatccggatccggaacatgcgaaatgtgatggtccatccgcgctgccgctggctaaactggaaccgttcctcaagcaaatgaaagcgattgatgatctggtgaaaggtttcgaagaactggataccagcaagtaa

SEQ ID NO: 3810 - protein, 284 aa, Escherichia coli
MKQKVVSIGDINVANDLPFVLFGGMNVLESRDLAMRICEHYVTVTQKLGIPYVFKASFDKANRSSIHSYRGPGLEEGMKIFQELKQTFGVKIITDVHEPSQAQPVADVVDVIQLPAFLARQTDLVEAMAKTGAVINVKKPQFVSPGQMGNIVDKFKEGGNEKVILCDRGANFGYDNLVVDMLGFSIMKKVSGNSPVIFDVTHALQCRDPFGAASGGRRAQVAELARAGMAVGLAGLFIEAHPDPEHAKCDGPSALPLAKLEPFLKQMKAIDDLVKGFEELDTSK

SEQ ID NO: 3811 - DNA, 144 bp, Escherichia coli
ttgatttatgcgcaactggattgcgaacacgttgcgttgaacgatttaagttatttcgttgaacagtgtccggaagacccgatcagcgaaatgatccgtgcgcaaataaataacatcgcgcataaacatattgtgctgcattaa

SEQ ID NO: 3812 - protein, 47 aa, Escherichia coli
MIYAQLDCEHVALNDLSYFVEQCPEDPISEMIRAQINNIAHKHIVLH

SEQ ID NO: 3813 - DNA, 672 bp, Escherichia coli
atgagatcgttagctgatttcgaatttaataaagcgccattgtgcgaaggcatgatcctggcttgcgaagcaatccgccgcgattttccctcgcaagatgtttacgacgaactggagcgtctcgttagtctggcgaaggaagaaattagccagcttctgccattagaagagcagctagaaaaattaatcgcgctgttttacggcgaatgggggtttaaagcctcacgcggcgtttatcgtctttccgatgcattatggctggaccaggtgttaaagaatcgacagggcagtgcggtatcattaggtgcggttttattatgggtcgcgaatcgtctcgatttgccgctgctgccggtgattttccctacgcagctgatattgcgcattgaatgtccggatggcgaaatttggctgattaatccttttaacggtgaatcgttaagcgaacatatgctggatgtgtggttaaagggaaatatcagcccgtcggcggaactgttttatgaagaccttgatgaagctgataacattgaggtaatccgcaaattgctggatacactcaaagcttcgtttgatggaagaaaatcagatggagctggcgttacgcaccagcgaagctttattacaattcaacccsggaagatccctatgaaattcgcgatcgcgggttga

SEQ ID NO: 3814 - protein, 223 aa, Escherichia coli
  Xaa 213: Xaa is any amino acid
MRSLADFEFNKAPLCEGMILACEAIRRDFPSQDVYDELERLVSLAKEEISQLLPLEEQLEKLIALFYGEWGFKASRGVYRLSDALWLDQVLKNRQGSAVSLGAVLLWVANRLDLPLLPVIFPTQLILRIECPDGEIWLINPFNGESLSEHMLDVWLKGNISPSAELFYEDLDEADNIEVIRKLLDTLKASFDGRKSDGAGVTHQRSFITIQPXKIPMKFAIAG

SEQ ID NO: 3815 - DNA, 393 bp, Escherichia coli
atgacaagtttttctacgttgcttagcgttcatctcattagtatcgcgctttctgttgggctattgaccttacgtttctggctacgttatcagaagcatccacaggcatttgctcgctggacgcgcattgtgccgccggttgtcgatacgctgttattgttaagcggcattgcgttgatggctaaagcgcacatccagccattttccgggcaggcacagtggctgactgaaaagctgtttggagttatcatttatattgttttgggttttattgcactcgattatcgtcgtatgcacagtcagcaggcgcgcattattgccttcccgctggcgttggtggtgctgtacatcatcattaaactcgccaccacaaaagtaccgttactggggtaa

SEQ ID NO: 3816 - protein, 130 aa, Escherichia coli
MTSFSTLLSVHLISIALSVGLLTLRFWLRYQKHPQAFARWTRIVPPVVDTLLLLSGIALMAKAHIQPFSGQAQWLTEKLFGVIIYIVLGFIALDYRRMHSQQARIIAFPLALVVLYIIIKLATTKVPLLG

SEQ ID NO: 3817 - DNA, 834 bp, Escherichia coli
atggaatatcaacactggttacgtgaagcaataagccaacttcaggcgagcgaaagcccgcggcgtgatgctgaaatcctgctggagcatgttaccggcagagggcgtacttttattctcgcctttggtgaaacgcagctgactgacgaacaatgtcagcaacttgatgcgctactgacgcgtcgtcgcgatggtgaacccattgctcatttaaccggggtgcgagaattctggtcgttgccgttatttgtttcgccagcgaccttaattccgcgcccggatacggagtgtctggtggagcaggcactggcgcggttgcctgaacaaccttgccgtattctcgatctcgggacgggtaccggggcgattgcgctggcgctggccagcgagcgtccggactgcgaaattaccgctgtagatcgtatgccagatgctgtctctctggcgcaacgtaatgcccagcatctggctatcaaaaatatccacattctgcaaagcgactggtttagcgcgctagccgggcagcagtttgcgatgattgtcagcaatccgccgtatattgacgagcaggacccacatcttcaacaaggcgatgtccgctttgagccgctcactgcgctggttgcggcagacagtggaatggcagacatcgtgcatatcatcgaacagtcgcgtaacgcgctggtatccggcggctttctgcttctggagcatggctggcagcagggtgaagcggtgcgacaggcatttatcttcgcggggtatcatgacgtcgaaacctgccgtgactatggggataacgagcgcgtaacgctcggccgctattatcaatga

SEQ ID NO: 3818 - protein, 277 aa, Escherichia coli
MEYQHWLREAISQLQASESPRRDAEILLEHVTGRGRTFILAFGETQLTDEQCQQLDALLTRRRDGEPIAHLTGVREFWSLPLFVSPATLIPRPDTECLVEQALARLPEQPCRILDLGTGTGAIALALASERPDCEITAVDRMPDAVSLAQRNAQHLAIKNIHILQSDWFSALAGQQFAMIVSNPPYIDEQDPHLQQGDVRFEPLTALVAADSGMADIVHIIEQSRNALVSGGFLLLEHGWQQGEAVRQAFIFAGYHDVETCRDYGDNERVTLGRYYQ

SEQ ID NO: 3819 - DNA, 1083 bp, Escherichia coli
atgaagccttctatcgttgccaaactggaagccctgcatgaacgccatgaagaagttcaggcgctgctgggtgatgcgcaaaccatcgctgaccaggaacgttttcgcgcattatctcgtgaatatgcgcagttaagtgatgtttcgcgctgttttaccgactggcaacaggttcaggaagatatcgaaaccgcacagatgatgctcgacgatcctgaaatgcgtgagatggcgcaggatgaactgcgcgaagctaaagaaaaaagcgagcaactggaacagcaattacaggttctgttactaccaaaagatcctgatgacgaacgtaacgccttcctcgaagtccgtgccggaaccggcggcgacgaagcggcgctgttcgctggcgatctgttccgtatgtacagccgttacgccgaagcccgccgctggcgtgtagaaatcatgagcgccagcgaaggtgaacatggtggttataaagagatcatcgccaaaattagcggtgatggtgtatatggtcgtttgaaattcgaatctggcggtcatcgcgtgcagcgtgttcctgctacggaatcgcagggtcgtattcatacttctgcttgtaccgttgcggtaatgccagaactgcctgatgcagaactgccggacatcaacccagcagatttacgcattgatactttccgctcgtcaggggcgggtggtcagcacgttaacaccaccgattcggcaattcgtattactcacttgccgaccgggattgttgttgaatgtcaggacgaacgttcacaacataaaaacaaagctaaagcactttctgtactcggtgctcgcatccacgctgctgaaatggcaaaacggcaacaggccgaagcgtctacccgtcgtaacctgctggggagtggcgatcgcagcgaccgtaaccgtacttacaacttcccgcaggggcgcgttaccgatcaccgcatcaacctgacgctctaccgcctggatgaagtgatggaaggtaagctggatatgctgattgaaccgattatccaggaacatcaggccgaccaactggcggcgttgtccgagcaggaataa

SEQ ID NO: 3820 - protein, 360 aa, Escherichia coli
MKPSIVAKLEALHERHEEVQALLGDAQTIADQERFRALSREYAQLSDVSRCFTDWQQVQEDIETAQMMLDDPEMREMAQDELREAKEKSEQLEQQLQVLLLPKDPDDERNAFLEVRAGTGGDEAALFAGDLFRMYSRYAEARRWRVEIMSASEGEHGGYKEIIAKISGDGVYGRLKFESGGHRVQRVPATESQGRIHTSACTVAVMPELPDAELPDINPADLRIDTFRSSGAGGQHVNTTDSAIRITHLPTGIVVECQDERSQHKNKAKALSVLGARIHAAEMAKRQQAEASTRRNLLGSGDRSDRNRTYNFPQGRVTDHRINLTLYRLDEVMEGKLDMLIEPIIQEHQADQLAALSEQE

SEQ ID NO: 3821 - DNA, 1455 bp, Escherichia coli
ttgagatacgttgcagttataacccttaatgctagcgttaccgttagccatcgtctatgttcacgttgtcttaattgccagaatctaacggctttcggcaattactccaaaagggggcgctctcttttattgatcttacgcatcctgtatgatgcaagcagactaaccctatcaacgttggtattatttcccgcagacatgacccttttagcactcggtatcaaccataaaacggcacctgtatcgctgcgagaacgtgtatcgttttcgccggataagctcgatcaggcgcttgacagcctgcttgcgcagccgatggtgcagggcggtgtggtgctgtcgacgtgtaaccgcacagaactttatctcagcgttgaagaacgggatgacctgcaagaggcgctcattcgctggttgtgtgattaccataatctcaacgaagacgatctgcgtaatagcctctactggcatcaggataacgatgcggtcagtcatttaatgcgcgttgccagtgggcttgattctctcgtccttggcgagccgcagatcctcggtcaggttaaaaaagcgtttgccgattcgcaaaaaggtcatatgaaggccagcgaactggaacgcatgtttcagaaatctttctctgtggcgaaacgcgttcgcactgaaacagatatcggtgccagtgctgtgtctgtcgcttttgcggcttgtacgctggcgcggcagatctttgaatcgctctctacggtgacggtactgctggttggcgcgggcgaaaccatcgagctggtggcacgtcatctgcgcgaacacaaagtacagaagatgattatcgccaatcgcactcgcgaacgtgcccaaattctggcagatgaggttggcgcggaagtgattgccctgagtgatatcgacgaacgtctgcgcgaagccgatatcatcatcagttccaccgccagcccgttgccgattatcggtaaaggcatggtggagcgcgcattaaaaagccgtcgcaatcaaccaatgctgctggtggatattgccgttccgcgcgatgttgagccggaagttggtaaactggcgaatgcttatctttatagcgttgacgatctgcaaagcattatttcgcacaacctggcgcaacggaaagctgctgctgtggaggcggaaactatcgtcgcccaggaggccagtgaatttatggcatggcttcgagcacaaagcgccagcgaaactattcgcgattatcgtagccaggcagagcaggttcgtgatgagttaactgctaaagcgttagcggcccttgaacagggcggcgatgcgcaaaccattatgcaggatctggcatggaaactgactaaccgcctgatccatgcaccaacaaaatcacttcaacaggccgcccgtgacggggataacgaacgcctgaatattctgcgcgacagcctcgggctggagtag

SEQ ID NO: 3822 - protein, 484 aa, Escherichia coli
MRYVAVITLNASVTVSHRLCSRCLNCQNLTAFGNYSKRGRSLLLILRILYDASRLTLSTLVLFPADMTLLALGINHKTAPVSLRERVSFSPDKLDQALDSLLAQPMVQGGVVLSTCNRTELYLSVEERDDLQEALIRWLCDYHNLNEDDLRNSLYWHQDNDAVSHLMRVASGLDSLVLGEPQILGQVKKAFADSQKGHMKASELERMFQKSFSVAKRVRTETDIGASAVSVAFAACTLARQIFESLSTVTVLLVGAGETIELVARHLREHKVQKMIIANRTRERAQILADEVGAEVIALSDIDERLREADIIISSTASPLPIIGKGMVERALKSRRNQPMLLVDIAVPRDVEPEVGKLANAYLYSVDDLQSIISHNLAQRKAAAVEAETIVAQEASEFMAWLRAQSASETIRDYRSQAEQVRDELTAKALAALEQGGDAQTIMQDLAWKLTNRLIHAPTKSLQQAARDGDNERLNILRDSLGLE

SEQ ID NO: 3823 - DNA, 690 bp, Escherichia coli
atggctaacggtaacgctagcattaagggttataactgcaacgtatctcaaggacttgtcattattatgcccctgcccgattttcgtcttatccgcctgctaccgctggctgctcttgtgctcactgcctgttccgttaccacgcccaaaggtcctggcaaaagcccggattcgccacaatggcgtcagcatcagcaagacgtgcgcaatcttaatcagtatcaaactcgcggcgcgttcgcttatatttctgaccaacaaaaagtgtacgcccgtttcttctggcaacaaactggccaggatcgctaccgtctgctgctgactaacccattgggcagcacagaactggagctgaatgctcaaccgggtaacgtgcagttagtcgacaataaaggtcagcgttatacctccgatgacgccgaagagatgattggcaaattgaccggaatgccaattccgctcaacagcttgcgccagtggattttaggtttaccgggtgatgcgactgactacaaacttgacgaccagtaccgcctgagtgaaatcacctacagccagaatggcaaaaactggaaagttgtttacggtggttatgacacaaaaactcaacctgcgatgccagccaatatggaactcaccgacggtggtcaacgcatcaagttaaaaatggataactggatagtgaaataa

SEQ ID NO: 3824 - protein, 229 aa, Escherichia coli
MANGNASIKGYNCNVSQGLVIIMPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTSDDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 3825 - DNA, 852 bp, Escherichia coli
atgcggacacagtggccctctccggcaaaacttaatctgtttttatacattaccggtcagcgtgcggatggttaccacacgctgcaaacgctgtttcagtttcttgattacggcgacaccatcagcattgagcttcgtgacgatggggatattcgtctgttaacgcccgttgaaggcgtggaacatgaagataacctgatcgttcgcgcagcgaggttgttgatgaaaactgcggcagacagcgggcgtctttcgacgggaagcggtgcgaatatcagcattgacaagcgtttgccgatgggcggcggtctcggcggtggttcatccaatgccgcgacggttctggtggcgttaaatcatctctggcaatgcggactaagcatggatgagctggcggaaatggggctgacgctgggcgcagatgttcctgtctttgtccgtggtcatgccgcctttgccgaaggtgttggcgaaatattaacgccggtagacccgccagagaaatggtatctggtcgcacaccctggcgtgagtattccgacgccggtgatttttaaagatcctgaactcccgcgcaatacgccaaaaaggtcaatagaaacgttgctaaaatgtgaattcagcaatgattgcgaggttatcgcaagaaaacgttttcgcgaggttgatgcggtgctttcctggctgttagaatacgccccgtcgcgcctgactgggacaggggcctgtgtctttgctgaatttgatacagagtctgaagcccgccaggtgctagagcaagccccggaatggctcaatggctttgtggcgaaaggcgttaatctttccccattgcacagagccatgctttaa

SEQ ID NO: 3826 - protein, 283 aa, Escherichia coli
MRTQWPSPAKLNLFLYITGQRADGYHTLQTLFQFLDYGDTISIELRDDGDIRLLTPVEGVEHEDNLIVRAARLLMKTAADSGRLSTGSGANISIDKRLPMGGGLGGGSSNAATVLVALNHLWQCGLSMDELAEMGLTLGADVPVFVRGHAAFAEGVGEILTPVDPPEKWYLVAHPGVSIPTPVIFKDPELPRNTPKRSIETLLKCEFSNDCEVIARKRFREVDAVLSWLLEYAPSRLTGTGACVFAEFDTESEARQVLEQAPEWLNGFVAKGVNLSPLHRAML

SEQ ID NO: 3827 - DNA, 1014 bp, Escherichia coli
atgcctggcccgcacagttttcggcagattctttccaccaatggacgcatgcctgaggttcttctcgtgcctgatatgaagctttttgctggtaacgccaccccggaactagcacaacgtattgccaaccgcctgtacacttcactcggcgacgccgctgtaggtcgctttagcgacggcgaagtcagtgtacaaattaatgaaaatgtacgcggtggtgatattttcatcatccagtccacttgtgcccctactaacgacaacctgatggaattagtcgttatggttgatgccctgcgtcgtgcttccgcaggtcgtatcaccgctgttatcccctactttggctatgcgcgccaggaccgtcgcgtccgttccgctcgtgtaccaatcactgcgaaagtggttgcagacttcctctccagcgtcggtgttgaccgtgtgctgacagtggatctgcacgctgaacagattcagggtttcttcgacgttccggttgataacgtatttggtagcccgatcctgctggaagacatgctgcagctgaatctggataacccaattgtggtttctccggacatcggcggcgttgtgcgtgcccgcgctatcgctaagctgctgaacgataccgatatggcaatcatcgacaaacgtcgtccgcgtgcgaacgtttcccaggtgatgcatatcatcggtgacgttgcaggtcgtgactgcgtactggtcgatgatatgatcgacactggcggtacgctgtgtaaagctgctgaagctctgaaagaacgtggtgctaaacgtgtatttgcgtacgcgactcacccgatcttctctggcaacgcggcgaacaacctgcgtaactctgtaattgatgaagtcgttgtctgcgataccattccgctgagcgatgaaatcaaatcactgccgaacgtgcgtactctgaccctgtcaggtatgctggccgaagcgattcgtcgtatcagcaacgaagaatcgatctctgccatgttcgaacactaa

SEQ ID NO: 3828 - protein, 337 aa, Escherichia coli
MPGPHSFRQILSTNGRMPEVLLVPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESISAMFEH

SEQ ID NO: 3829 - DNA, 1680 bp, Escherichia coli
gtgaacaaaatattttcctcacatgtgatgcctttccgcgctctgatcgacgcttgctggaaagaaaaatatactgccgcacggtttacccgtgacctgattgccgggataaccgtcgggattattgctatcccgctggcgatggcgttggctattggtagtggtgtggccccccagtacggtttatataccgcagctgttgcggggattgtcattgctctgacgggggggtcacgctttagcgtttccggtccgactgcggcatttgtggtaattctctatcccgtttcgcaacagtttggactggcaggactgctggttgcgaccttgctgtcggggatctttttgattctgatggggctggcacgctttgggcgcctgattgagtatattccggtttccgtcaccttaggtttcacctcgggtatcgggatcaccatcggtaccatgcagattaaagattttctcggtctgcaaatggcccatgtcccggaacattatctacaaaaagtcggcgcattatttatggcgctgccgaccattaatgtgggtgatgcagccattggcattgtgacgcttggcattctggttttctggccgcgtctgggcatacgtttacccggccaccttccggccttgctggctggttgcgcggtgatggggattgttaacctgctcggcggacatgttgctaccatcggttcgcaattccactacgtcctggccgatggttctcagggtaacggtattccgcaactgctgccgcaactggtgctgccgtgggatctgcctaattcagaattcacgctaacctgggattctattcgcaccctgctgcctgcggcattctcaatggcaatgctcggcgcaatcgaatctctgctctgcgccgtggtgctggatggtatgaccgggacgaaacacaaggcgaacagcgaactggttggacagggactggggaatattatcgctccgttctttggtggtattaccgctacagctgccatcgcgcgttctgccgctaacgtccgtgccggggcaacttcccctatctcggcggtgatccactctattctggttattcttgccctgctggtactggcaccgctgctctcctggctgccgctttccgccatggcagccctgctgttgatggtggcgtggaacatgagtgaagcgcacaaagtggtcgacttgctgcgtcatgcaccgaaagatgacatcatcgtcatgctgctgtgcatgtcgctgaccgtgctgttcgatatggttattgccatcagcgtggggatcgtgctggcatcgctgctgtttatgcgtcgtatcgcacgtatgactcgcctggcaccggtagtcgtagacgttccagacgatgtcctggttctgcgcgttattggcccgctgttttttgctgccgcagaaggcttattcacggacctggagtcacgtcttgaaggcaaacggattgtgattctgaagtgggatgccgttccggtacttgatgctggtggtcttgatgcgttccagcgttttgtgaagcgtctgcccgaaggatgtgaactgcgcgtgtgcaacctggaattccagccactgcgcactatggctcgcgcaggcattcaaccgatcccgggacgcctcgcattcttcccgaatcgtcgcgcggcgatggcggatttataa

SEQ ID NO: 3830 - protein, 559 aa, Escherichia coli
MNKIFSSHVMPFRALIDACWKEKYTAARFTRDLIAGITVGIIAIPLAMALAIGSGVAPQYGLYTAAVAGIVIALTGGSRFSVSGPTAAFVVILYPVSQQFGLAGLLVATLLSGIFLILMGLARFGRLIEYIPVSVTLGFTSGIGITIGTMQIKDFLGLQMAHVPEHYLQKVGALFMALPTINVGDAAIGIVTLGILVFWPRLGIRLPGHLPALLAGCAVMGIVNLLGGHVATIGSQFHYVLADGSQGNGIPQLLPQLVLPWDLPNSEFTLTWDSIRTLLPAAFSMAMLGAIESLLCAVVLDGMTGTKHKANSELVGQGLGNIIAPFFGGITATAAIARSAANVRAGATSPISAVIHSILVILALLVLAPLLSWLPLSAMAALLLMVAWNMSEAHKVVDLLRHAPKDDIIVMLLCMSLTVLFDMVIAISVGIVLASLLFMRRIARMTRLAPVVVDVPDDVLVLRVIGPLFFAAAEGLFTDLESRLEGKRIVILKWDAVPVLDAGGLDAFQRFVKRLPEGCELRVCNLEFQPLRTMARAGIQPIPGRLAFFPNRRAAMADL

SEQ ID NO: 3831 - DNA, 279 bp, Escherichia coli
atgaaacgcaaaaacgcttcgttactcggtaacgtgctcatggggttgggtctggtggtaatggtggtcggcgtggggtattcaatcctcaaccagttaccacagtttaatatgccccagtatttcgcacatggtgcagtgctaagtattttcgtcggtgcgattctctggctggcaggtgcccgtgttggcgggcatgaacaggtgtgcgaccgttactggtgggttcgccactatgacaaacgttgccgccgtagcgataatcgccgtcatagctaa

SEQ ID NO: 3832 - protein, 92 aa, Escherichia coli
MKRKNASLLGNVLMGLGLVVMVVGVGYSILNQLPQFNMPQYFAHGAVLSIFVGAILWLAGARVGGHEQVCDRYWWVRHYDKRCRRSDNRRHS

SEQ ID NO: 3833 - DNA, 585 bp, Escherichia coli
gtgacgattaaattgattgtcggcctggcgaaccccggtgctgaatacgccgcaacgcgacataatgctggtgcctggttcgttgacttactggcagagcgattgcgcgctccgctgcgcgaagaggctaaattctttggttatacttcgcgagtcacccttggaggcgaagatgtccgcctgttagtcccgactacatttatgaatctcagcggcaaagccgttgcggcgatggccagttttttccgcattaatccggacgaaattctggtggcccacgacgaactggatctgcctcctggcgtcgccaaatttaagttgggtggcggtcatggtggtcacaatggactgaaagacatcatcagtaaattgggtaataaccctaactttcaccgtttacgcatcggaatcggtcatccgggcgataaaaataaagttgtcggttttgtgttaggcaaaccgcctgttagtgaacagaagttaattgatgaagccatcgacgaagcggcgcgttgtactgaaatgtggtttacagatggcttgaccaaagcaacgaaccgattgcacgcctttaaagcgcaataa

SEQ ID NO: 3834 - protein, 194 aa, Escherichia coli
MTIKLIVGLANPGAEYAATRHNAGAWFVDLLAERLRAPLREEAKFFGYTSRVTLGGEDVRLLVPTTFMNLSGKAVAAMASFFRINPDEILVAHDELDLPPGVAKFKLGGGHGGHNGLKDIISKLGNNPNFHRLRIGIGHPGDKNKVVGFVLGKPPVSEQKLIDEAIDEAARCTEMWFTDGLTKATNRLHAFKAQ

SEQ ID NO: 3835 - DNA, 1092 bp, Escherichia coli
atgggattcaaatgcggtatcgtcggtttgcccaacgtcgggaaatctaccctgttcaacgcgctgaccaaagccggtattgaagcggccaactttccattctgcaccatcgagccgaacactggcgtcgtaccaatgcctgaccctcgcctggatcaactggctgaaatcgtgaaaccgcagcgtacacttcccacgaccatggaatttgtcgatatcgccggtctggtaaaaggcgcatcgaaaggcgaaggtctgggtaaccagttcctgaccaacatccgtgaaaccgaagcgatcggtcacgttgttcgctgctttgaaaatgacaacatcattcacgtttccggcaaagttaacccggcggatgatattgaagttatcaacaccgaactggcgctggcggatctcgacacctgtgaacgtgcgattcatcgcgtacagaagaaagccaaaggtggcgataaagacgcgaaagccgagctggcggtactggaaaaatgcctgccccagctggaaaacgcaggtatgctgcgtgcgctggatttaagcgctgaagagaaagcggctgttcgttacctgagcttcctgacgctaaaaccaacaatgtacatcgccaacgtcaacgaagacggttttgaaaacaacccgtatcttgaccaggtgcgtgaaatcgcagcgaaagaaggttctgttgtagttccggtttgtgctgctgttgaagcagacattgccgaactggacgacgaagagcgtgacgagtttatgcaggagcttgggctggaagagccgggcctgaaccgtgtgatccgtgccggttataagctgctgaacctgcaaacttacttcaccgctggggtgaaagaagtgcgtgcatggaccattccggttggtgcaaccgcgccgcaggcagcgggcaaaatccatactgattttgaaaaaggctttatccgtgcacaaaccatctcgtttgaagatttcatcacttacaaaggtgaacaaggcgcgaaagaagcaggcaaaatgcgtgcagaaggcaaagattacatcgttaaagatggcgatgtgatgaacttcctgttcaacgtctaa

SEQ ID NO: 3836 - protein, 363 aa, Escherichia coli
MGFKCGIVGLPNVGKSTLFNALTKAGIEAANFPFCTIEPNTGVVPMPDPRLDQLAEIVKPQRTLPTTMEFVDIAGLVKGASKGEGLGNQFLTNIRETEAIGHVVRCFENDNIIHVSGKVNPADDIEVINTELALADLDTCERAIHRVQKKAKGGDKDAKAELAVLEKCLPQLENAGMLRALDLSAEEKAAVRYLSFLTLKPTMYIANVNEDGFENNPYLDQVREIAAKEGSVVVPVCAAVEADIAELDDEERDEFMQELGLEEPGLNRVIRAGYKLLNLQTYFTAGVKEVRAWTIPVGATAPQAAGKIHTDFEKGFIRAQTISFEDFITYKGEQGAKEAGKMRAEGKDYIVKDGDVMNFLFNV

SEQ ID NO: 3837 - DNA, 1920 bp, Escherichia coli
atgagtggcgcttttaacaacgatggtcggggcatatctcccttaattgcaacctcctgggagagatgcaataagctgatgaaacgggagacatggaacgtaccacaccaggcccagggcgtgacatttgcttctatttatcggcgtaagaaagcgatgctgacgctcgggcaggctgcgctggaagatgcctgggaatatatggcatcgcgagagtgtgcgttgcttatcctcgatgaaaccgcctgcattctcagccgtaatggcgatccgcaaaccttgcagcaactaagtacactgggattcaatgacggcacgtattgcgccgagggaattattggtacttgtgcgctatcgttagcggctatctctggtcaggccgtgaaaacgatggccgatcaacatttcaaacaggcactctggaactgggccttttgcgcaacgccgttgtttgacagcaagggccgattgacgggaacaatagcgctggcgtgtccggttgagcaaactaccgcagctgatttgccgttgacgttggcaatcgcacgcgaggtcggaaatttactgctgacggacagtttgctcgctgaaactaaccgtcatttaaatcaacttaatgccctgttagaaagtatggatgatggcgtgattagctgggacgagcagggtaatttgcaatttatcaatgcccaggcggcgcgggtcttgcgccttgacgcgacggcaagtcagggacgagcaatcactgaactcttaacgttacccgccgtattgcaacaagcaataaaacagtcacatccgctcaaacacgtagaagccacctttgaaagtcagcatcagtttattgatgcggtgataacccttaaaccgataatagaaacgcagggaaccagctttattttattgctccatcctgtggaacagatgcggcagttaatgaccagtcaattaggaaaagtcagccataccttcgctcatatgccacaggacgatccgcaaacccgccgcttgattcattttggtcgccaggcggcacgcagtagctttcctgtcctgctttgtggagaagagggcgtgggcaaggcactgctaagtcaggcaattcataatgaaagcgagcgtgcagcggggccttatatcgccgtcaattgtgagttatatggtgatgcggcgctggcggaagaatttattggtggcgatcgcacggatagtgaaaatggccgtctgagtcggctggaactggcgcacggcggcacgctgtttcttgaaaagattgaatatctggcggtggagttacagtctgccttgcttcaggttatcaagcagggggttatcacgcgactggatgcgcggcgtttaatacccattgatgtcaaagtgattgccacaacgaccgcggacctcgcaatgctggtggaacaaaatcgttttagtcgccagctgtattacgcgctgcatgcatttgaaattaccatcccgccactgcgtatgcggcgtggcagcattccggcgctggtgaataacaaattacgcagccttgaaaaacgcttctctacgcggctgaaaattgatgacgatgccctcgctcgcctggtttcctgtgcatggcctggcaacgattttgaactttacagcgtcatcgagaatcttgctctgagtagtgataatgggcgcattcgcgtcagtgatttgccggaacatctgtttaccgagcaggcgacagatgatgtcagcgccacccgcctttccaccagtctgtcatttgcggaagttgaaaaagaggcaattattaacgcagcccaggtcacaggcggtcgcattcaggaaatgtcggctttacttggaatcggccgcaccacgctgtggcggaaaatgaagcaacatggcattgatgtgagtcagtttaagcgccgtggatag

SEQ ID NO: 3838 - protein, 639 aa, Escherichia coli
MSGAFNNDGRGISPLIATSWERCNKLMKRETWNVPHQAQGVTFASIYRRKKAMLTLGQAALEDAWEYMASRECALLILDETACILSRNGDPQTLQQLSTLGFNDGTYCAEGIIGTCALSLAAISGQAVKTMADQHFKQALWNWAFCATPLFDSKGRLTGTIALACPVEQTTAADLPLTLAIAREVGNLLLTDSLLAETNRHLNQLNALLESMDDGVISWDEQGNLQFINAQAARVLRLDATASQGRAITELLTLPAVLQQAIKQSHPLKHVEATFESQHQFIDAVITLKPIIETQGTSFILLLHPVEQMRQLMTSQLGKVSHTFAHMPQDDPQTRRLIHFGRQAARSSFPVLLCGEEGVGKALLSQAIHNESERAAGPYIAVNCELYGDAALAEEFIGGDRTDSENGRLSRLELAHGGTLFLEKIEYLAVELQSALLQVIKQGVITRLDARRLIPIDVKVIATTTADLAMLVEQNRFSRQLYYALHAFEITIPPLRMRRGSIPALVNNKLRSLEKRFSTRLKIDDDALARLVSCAWPGNDFELYSVIENLALSSDNGRIRVSDLPEHLFTEQATDDVSATRLSTSLSFAEVEKEAIINAAQVTGGRIQEMSALLGIGRTTLWRKMKQHGIDVSQFKRRG

SEQ ID NO: 3839 - DNA, 1071 bp, Escherichia coli
atgaaaaaattgatcaatgatgtgcaagacgtactggacgaacaactggcaggactagcgaaggcgcatccatcgctgacactgcatcaggatccggtgtatgtcacccgagctgatgcccccgttgcagggaaagtcgccctgctgtcgggtggcggcagcggacacgagccgatgcactgtggctatatcggtcaggggatgctttctggggcctgtccgggcgaaattttcacctcaccgacgcccgataaaatctttgaatgcgccatgcaaattgatggcggcgaaggtgtactgttgattatcaaaaattacaccggcgatattcttaacttcgaaacagcaaccgagttactgcacgatagcggcgtaaaagtgaccactgtggtcattgatgacgacgttgcagtaaaagacagtctttataccgccgggcggcgcggcgttgccaacaccgtattaattgaaaaactcgtaggtgcagcggcggagcgtggcgactcactggacgcctgtgcggaactggggcgtaagttgaataatcaaggccattcaataggtatcgctctcggtgcctgtaccgttcctgccgcgggcaaaccttcttttaccctggcggataatgagatggagtttggcgtcggcattcatggtgagccaggtattgaccgccgccccttctcttcccttgatcaaaccgtcgatgaaatgttcgacaccctgctggaaaatggctcataccatcgcactttgcgtttctgggattatcaacaaggcagctggcaggaagaaccacaaaccaaacaaccgctccagtctggcgatcgggtgattgcgctggttaacaatcttggcgcaactccgctttctgagctgtacggcgtctataaccgcctgaccacacgttgccagcaagcgggattgactatcgaacgtaatttaattggcgcgtactgcacctcactggatatgaccggtttctcaatcaccttactgaaagttgatgacgaaacgctggcattctgggacgcccctgtccacaccccggcccttaactggggtaaataa

SEQ ID NO: 3840 - protein, 356 aa, Escherichia coli
MKKLINDVQDVLDEQLAGLAKAHPSLTLHQDPVYVTRADAPVAGKVALLSGGGSGHEPMHCGYIGQGMLSGACPGEIFTSPTPDKIFECAMQIDGGEGVLLIIKNYTGDILNFETATELLHDSGVKVTTVVIDDDVAVKDSLYTAGRRGVANTVLIEKLVGAAAERGDSLDACAELGRKLNNQGHSIGIALGACTVPAAGKPSFTLADNEMEFGVGIHGEPGIDRRPFSSLDQTVDEMFDTLLENGSYHRTLRFWDYQQGSWQEEPQTKQPLQSGDRVIALVNNLGATPLSELYGVYNRLTTRCQQAGLTIERNLIGAYCTSLDMTGFSITLLKVDDETLAFWDAPVHTPALNWGK

SEQ ID NO: 3841 - DNA, 633 bp, Escherichia coli
atgtcactgagcagaactcaaattgttaactggctcactcgttgtggcgatattttcagcaccgagagcgagtatcttactggactggatcgcgagattggcgacgctgaccacgggctaaatatgaatcgaggctttagcaaagtggtagaaaaactccctgctatcgcagataaagatatcggtttcattctcaagaataccggcatgacactactttccagcgtcggaggtgccagtggtccgctgttcggtaccttctttatccgcgccgcacagacaacccaggcacggcaaagcctgacgctggaagagctttatcagatgttccgcgatggcgcggacggcgtaatcagtcgcgggaaagccgaacctggcgataaaaccatgtgtgatgtgtgggtgccggtggtggaatcgttacgtcagtcctgcgagcaaaatctccctgttccggcggcgctcgacgctgccagtagcatcgccgaatccgctgcacaaagtacgattacgatgcaagcccgcaaaggccgcgccagttatctcggtgaacgcagtattggtcaccaggatcccggcgcgacctcggtgatgtttatgatgcaaatgttggcgttagccgcaaaagagtaa

SEQ ID NO: 3842 - protein, 210 aa, Escherichia coli
MSLSRTQIVNWLTRCGDIFSTESEYLTGLDREIGDADHGLNMNRGFSKVVEKLPAIADKDIGFILKNTGMTLLSSVGGASGPLFGTFFIRAAQTTQARQSLTLEELYQMFRDGADGVISRGKAEPGDKTMCDVWVPVVESLRQSCEQNLPVPAALDAASSIAESAAQSTITMQARKGRASYLGERSIGHQDPGATSVMFMMQMLALAAKE

SEQ ID NO: 3843 - DNA, 1419 bp, Escherichia coli
atggtaaacctggtcatagtttcacatagcagccgactgggagaaggtgtcggtgaattagcccgtcagatgttaatgagtgatagttgtaaaatcgccattgccgcgggaattgacgatccacataatcccattggtaccgatgccgtcaaagtgatggaggccatcgaatctgttgccgatgccgaccatgtgctggtcatgatggatatgggtagcgcattattgagtgctgaaactgcgctggaattgctggctcccgagatcgccgcaaaagtacgtttgtgtgctgcgccgttggtcgaaggtacactggcagcaacggtcagcgcggcctcgggggcggatatcgacaaagttatctttgacgccatgcatgcgctggaagccaaacgtgaacaactgggtttaccgtcctccgacactgaaatctctgacacatgtcctccgtacgatgaagaagcccgttctctgtcggtggtcataaaaaaccgtaacggcctgcatgtacgtccggcctcccggctggtttataccttatcgacatttaatgccgatatgttgctggagaaaaacggcaaatgcgttacaccggatagtattaaccagattgcgttactacaagttcgctataacgatacgctgcgcctgattgcgaaaggaccagaagctgaagaggcactgatcgctttccgtcagctggctgaagataactttggtgaaacggaggaagttgctccacctactctgcgtcccgttccgcctgtttcgggtaaagccttttattatcaacctgttttatgtacggtacaggcaaaatcaaccctgaccgtggaagaagaacaagaacgattacgccaggccattgacttcacgttattagatctgatgacgttaacagcgaaagcagaaacctgcgggcttgacgatattgccgcaatcttttctggtcaccatacactgttagatgatccggaactgcaggcggcggcaagcgaactccttcagcatgaacattgcacggcggaatatgcctggcagcaagttcttaaagaacttagccagcaataccaacagctggatgatgaatatctacaggctcgctatatcgatgtggacgatcttctgcatcgcaccctggtccacctgacccaaacgaaagaagaactcccgcagtttaactcgccaactattctactggcggagaacatttatccctccacagtactgcaactggatccagcggttgtaaaaggtatctgccttagcgccggaagtccgctatcccacagtgccctaatcgcccgtgaactgggaattggctggatttgccagcagggtgagaaactgtatgcgatacaaccagaagaaacgctaacgctggacgttaaaacgcaacgtttcaaccgtcagggttaa

SEQ ID NO: 3844 - protein, 472 aa, Escherichia coli
MVNLVIVSHSSRLGEGVGELARQMLMSDSCKIAIAAGIDDPHNPIGTDAVKVMEAIESVADADHVLVMMDMGSALLSAETALELLAPEIAAKVRLCAAPLVEGTLAATVSAASGADIDKVIFDAMHALEAKREQLGLPSSDTEISDTCPPYDEEARSLSVVIKNRNGLHVRPASRLVYTLSTFNADMLLEKNGKCVTPDSINQIALLQVRYNDTLRLIAKGPEAEEALIAFRQLAEDNFGETEEVAPPTLRPVPPVSGKAFYYQPVLCTVQAKSTLTVEEEQERLRQAIDFTLLDLMTLTAKAETCGLDDIAAIFSGHHTLLDDPELQAAASELLQHEHCTAEYAWQQVLKELSQQYQQLDDEYLQARYIDVDDLLHRTLVHLTQTKEELPQFNSPTILLAENIYPSTVLQLDPAVVKGICLSAGSPLSHSALIARELGIGWICQQGEKLYAIQPEETLTLDVKTQRFNRQG

SEQ ID NO: 3845 - DNA, 114 bp, Escherichia coli
atgtcatccggcaatttactctgcactgatgtttttaactacctgttatatttttcaccaaattatgatgatttttcttcgctaatcgcaaacccaacgtcgctggctgactaa

SEQ ID NO: 3846 - protein, 37 aa, Escherichia coli
MSSGNLLCTDVFNYLLYFSPNYDDFSSLIANPTSLAD

SEQ ID NO: 3847 - DNA, 216 bp, Escherichia coli
atgcaggctggaattaacgccattttttgcgggcgagaaggtgcgggggatttcatcagtcattctcctttggcgaaaccgaataaaacggtattcaagtatcagaaaaccttagttcaggatcgcactagctgcatgatcgaaatcacattctgcgaactgacagacattttagaaaagggaattaaagggataaataacggcgaaatagagtga

SEQ ID NO: 3848 - protein, 71 aa, Escherichia coli
MQAGINAIFCGREGAGDFISHSPLAKPNKTVFKYQKTLVQDRTSCMIEITFCELTDILEKGIKGINNGEIE

SEQ ID NO: 3849 - DNA, 1665 bp, Escherichia coli
atggcgttaattccagcctgcatctttttgtgtttcgctgcgctatcggtgcaggcagaagaaacatcggtaacaccacaaccgcctgatattttattagggccgctgtttaatgatgtgcaaaacgccaaactttttccggaccaaaaaacctttgccgatgccgtgccgaacagcgatccgctgatgatccttgctgattatcggatgcagcaaaaccagagcggatttgatctacgccatttcgttaacgtcaatttcaccctgccgaaagagggcgagaaatatgttccgccagaggggcaatcactgcgcgaacatattgacggactttggccggtattaacgcgttctaccgaaaacaccgaaaaatgggattctctattaccgctgccaaaaccttatgtcgtgcccggcggacgttttcgcgaggtatattactgggacagttacttcaccatgttaggacttgccgaaagcggtcactgggataaagtcgcggatatggtggccaattttgctcatgaaatagacaattacggtcatattcccaacggcaaccgcagttactatttaagccgctcgcaaccgcccttctttgccctgatggtagagttactggcgcagcatgaaggcgacgccgcgttgaaacaatacctgccgcaaatgcaaaaagaatatgcttactggatggacggtgttgaaaacctgcaagccggacaacaggaaaaacgcgttgtaaaacttcaggatggtacccttctcaaccgctactgggacgatcgcgatacgccacgaccagagtcatgggtggaagatattgccactgccaaaagcaatccgaatcgacctgccactgaaatttaccgcgacctgcgctctgccgctgcgtctggctgggatttcagctcgcgctggatggacaatccgcagcagttaaacaccttacgcaccaccagcatcgtaccggtcgatctgaacagcttgatgttcaaaatggaaaaaatcctcgcccgcgccagcaaagctatcggagataacgcgatggcaaaccagtacgaaacgctggcaaatgcccgtcaaaaagggatcgaaaaatacctgtggaacgatcaacaaggctggtatgccgattacgacctgaaaagtcataaagtgcgcaatcagttaaccgcggccgccctgttcccgctgtacgtcaatgcggcagcgaaagatcgcgccagcaaaatggcgacggcgacgaaaacacatctgctgcaacccggcggcctgaacaccacgtcggtgaaaagtgggcaacaatgggatgcgccaaacggctgggcaccgttgcagtgggtcgcgactgaaggattacaaaactacgggcaaaaagaggtagcgatggacattagctggcacttcctgaccaatgttcagcacacctatgaccgggagaaaaagctggtggaaaaatatgatgtcagcaccaccggaacagggggcggcggtggcgaatatccattacaggatggctttggctggaccaatggcgtgacgctgaaaatgctggatttgatctgcccgaaagagcaaccgtgtgacaatgttccggcgacgcgtccactcagtgaatcaacaacacagccgctaaaacaaaaagaggcggaacctacgccttaa

SEQ ID NO: 3850 - protein, 554 aa, Escherichia coli
MALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDNYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAIGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 3851 - DNA, 1023 bp, Escherichia coli
atgtcactaaccagacggaggtttacacagattcttgcgtcgacattgttcctgcatcatctgccgtccttcgcacaatcagtcaaattctgggcctcacggacgcttcccgaagcccaaaacattacacgcatcgtcagcgcaggcgcgcccgccgatttactattgctggctgtcgcgccagaaaaaatggtcggtttttcctcttttgattttgcccgtcaggcattaattccattgccagagcacattcgccagttccccaggctgggacgactcgccgggcgcgccagcacactctcgctggaagggcttatggcgttacatcccgatttggtcgttgattgcggcaatacggatgaaacctggatctcccaggcacggcaggttagcgaacagacacaaataccctggttattgcttaacgggaaactggaacaatcagcagaacagttaacaacgcttggcaaaacgttaggcgaagagcaccgcgccgcagaacaagccaatctcgccagccgcttcgttggtgaagctcaggcattcgccacctcacccgccgctaatctcagcttttatgctgcgcgcggtcctcgagggctggaaacgggcttacagggttcgttgcataccgaggcggcggaattattaggtttgcacaacgtcgcgcaaatagccgatcgccacggtctgacacaggtttccatggaaaatctcctgcgctggcagccggatattattctggttcaggaggccgttactgcagattttattcgtcgtgatcctctctggcagggcgtgaaagcggttgcggaacaacgcatcttatttttaagtggcctgccctttggctggctggatgccccgccgggaatcaaccgtcttctgggattacgcagacttcacgcctggctggatcccgccatcaatcgccagtttaaaagtgacatacagcattacgcccaactgttctggcattgttcactcagtgacgccgactatcaaaaattggtggcgagctaa

SEQ ID NO: 3852 - protein, 340 aa, Escherichia coli
MSLTRRRFTQILASTLFLHHLPSFAQSVKFWASRTLPEAQNITRIVSAGAPADLLLLAVAPEKMVGFSSFDFARQALIPLPEHIRQFPRLGRLAGRASTLSLEGLMALHPDLVVDCGNTDETWISQARQVSEQTQIPWLLLNGKLEQSAEQLTTLGKTLGEEHRAAEQANLASRFVGEAQAFATSPAANLSFYAARGPRGLETGLQGSLHTEAAELLGLHNVAQIADRHGLTQVSMENLLRWQPDIILVQEAVTADFIRRDPLWQGVKAVAEQRILFLSGLPFGWLDAPPGINRLLGLRRLHAWLDPAINRQFKSDIQHYAQLFWHCSLSDADYQKLVAS

SEQ ID NO: 3853 - DNA, 981 bp, Escherichia coli
atgagaaccgtaaacggatgtattttgctgctggcagctatcagtatcacttttgccgccgtaagtggggcttatcatctcgatatgcagcaactgctggcgctcattcttcgtcaagaaaatgttcctgtgcaggaacaaattgtcttctggcaaatccgcgtgccgcgtattcttgctgcgctgtttctgggcgcggcgctggcaggggccggaaccacctatcagggaatgttccgtaatcccttagtgtcaccggatattttaggcgtctccgccggtgccggacttggtgcctgcgcggcaatcctgtggggattatccattgtttacatccagctgtacgcattttgcggcgggctgatggtggtcgcgggcgtctggttgattacgcgtcgggtgacccgccacgatccgatcttaaccctggtgctggtaggcattgcgttaggaacgttgtgcggagcggggatatcgctaataaaaacgctggccgatccttatacccagttaccgtcaattaccttctggttgctgggggggctgtccaccgtgaccttacgcgatctctgctatgctgcaccgatcattctcataggctccttgcccctgttttttctccgctggcgcatgaatttactcacgctttccgacgacgaagcccgttcgctgggactgaacgtgacacgtctgcgctttggattgattgtctgtgccacactcatcaccgccagcacggtagcaatagcgggcataattggttgggtcggcctggtcgttccgcacattgcccgcttgttgaccggtcataaccatcagcagctgttgcccatggcaatgtgtactggcgcgattctgctcctgcttaccgatacgctggcacgcagcattggaacaacagaaatcccacttggcattctgaccgcttttgttggcgcaccgtttttcctgtttttgttgttacgcggaggtcgccagtga

SEQ ID NO: 3854 - protein, 326 aa, Escherichia coli
MRTVNGCILLLAAISITFAAVSGAYHLDMQQLLALILRQENVPVQEQIVFWQIRVPRILAALFLGAALAGAGTTYQGMFRNPLVSPDILGVSAGAGLGACAAILWGLSIVYIQLYAFCGGLMVVAGVWLITRRVTRHDPILTLVLVGIALGTLCGAGISLIKTLADPYTQLPSITFWLLGGLSTVTLRDLCYAAPIILIGSLPLFFLRWRMNLLTLSDDEARSLGLNVTRLRFGLIVCATLITASTVAIAGIIGWVGLVVPHIARLLTGHNHQQLLPMAMCTGAILLLLTDTLARSIGTTEIPLGILTAFVGAPFFLFLLLRGGRQ

SEQ ID NO: 3855 - DNA, 174 bp, Escherichia coli
gtgatccggcgttttttctgtgcgatgggccagcctgagttgctgaaggtaaaggtctgcaaaatcaatatcgtcaatgagcatgatttttccttagtgcttaattgcagagaggtgatggtgaatctggtcggcagaaacccggtacagggcagccagttttttcgttgttaa

SEQ ID NO: 3856 - protein, 57 aa, Escherichia coli
MIRRFFCAMGQPELLKVKVCKINIVNEHDFSLVLNCREVMVNLVGRNPVQGSQFFRC

SEQ ID NO: 3857 - DNA, 759 bp, Escherichia coli
gtgactttgcttgccgtccgtcatgcgtctctgggttactcccgccatccggtgctacgcgacgtgtccttcaccctgtcgcaaggaacaatttgttgtctgttaggagccaatggttgcggcaaaaccacactcatgcgctccattcttggcgttataccgttattaaaaggcgagatcttactggatagcctccctgtgcagacactcagccatcgccagcgcgcgcaggctattgcctgggtgccgcaggcgcacgacggcatttttgcttttagtgtgctggatatggtgttgatgggcctggcccccaccataggcgctttttccgttcccggtaagcaagaacgcctgaaagcaacggagcaactggaaaagctgggcattttgcatctggcggcacgacgctggaatacgcttagcggcggtgaacgtcagctggctttaatcgcccgtgcactcgtccagcaaccgcgcttgttattactggatgagcctgcctccagcctcgatttcggtcatcagatccaacttctggacacgctggcgcagctcaaaaataacggcatgacaatgttaatgtcgactcatcatccgctccatgcaaacgccattgccgacagcattatccaggtagagccagatggacgagtaacacaaggcttaccgaccgaacagttaacaacgaaaaaactggctgccctgtaccgggtttctgccgaccagattcaccatcacctctctgcaattaagcactaa

SEQ ID NO: 3858 - protein, 252 aa, Escherichia coli
MTLLAVRHASLGYSRHPVLRDVSFTLSQGTICCLLGANGCGKTTLMRSILGVIPLLKGEILLDSLPVQTLSHRQRAQAIAWVPQAHDGIFAFSVLDMVLMGLAPTIGAFSVPGKQERLKATEQLEKLGILHLAARRWNTLSGGERQLALIARALVQQPRLLLLDEPASSLDFGHQIQLLDTLAQLKNNGMTMLMSTHHPLHANAIADSIIQVEPDGRVTQGLPTEQLTTKKLAALYRVSADQIHHHLSAIKH

SEQ ID NO: 3859 - DNA, 708 bp, Escherichia coli
atggcggaaaattgcgcctcgcctacggacagctacctgcaacaactgacctcaaaaattgacctgcaaggcgcgcaaaccttattcgatatgggctgcggaccgggtaccgtatcgctggcgctggcggacaaactcacgacgatttatggcgttgattacagtcaggggatgctgaacgttgccgcccgtcgcgccgccgcgctaaaggcagacaatgtccactggatccagcgcgcctgggaagaggactggagtgacctgccacgctgcgatattgccgtggcttcccgctccactctggtggctgatatgcgccaggcaatgagcaaactgaataatcaggcacggcttcgcgtctatacgactcatctggtcagcacctcgttcgtctctccagccattcagcgggcggctggtcgggaagtgatcgaattacccaactatatctttgcactcaacgtcctgtatcagatgggaatttatgctcacgttgattttatccgtggacaaaattgccaacaggataacagcacctgggaacgttttgagcagaacgtcagctggagtctgggcgcgcttaacgacgatgagcgtgagcggttatatcgctggtatcaacaacaagatgctcgtgccctcgcccctgccagccgcgactgggcgctcatctggtgggatagcgtaccgcaggagacactgcgatga

SEQ ID NO: 3860 - protein, 235 aa, Escherichia coli
MAENCASPTDSYLQQLTSKIDLQGAQTLFDMGCGPGTVSLALADKLTTIYGVDYSQGMLNVAARRAAALKADNVHWIQRAWEEDWSDLPRCDIAVASRSTLVADMRQAMSKLNNQARLRVYTTHLVSTSFVSPAIQRAAGREVIELPNYIFALNVLYQMGIYAHVDFIRGQNCQQDNSTWERFEQNVSWSLGALNDDERERLYRWYQQQDARALAPASRDWALIWWDSVPQETLR

SEQ ID NO: 3861 - DNA, 855 bp, Escherichia coli
atgattttcctttctcaggcacaaatcgatgcgttacttctggaagatatccagggcggtgacctgaccacgcgagcattaaatattggacaccagcatggctatatagagttttttctccgtcagggcggctgcgtcagcggaatttctgtcgcgtgtaagatgttaactacgctgggattaactattgatgacgcggtcagcgacggttcacaagcgaacgcgggtcagcggctaatccgtgcgcaaggtaatgccgcagcacttcatcagggatggaaggcagtccagaatgtgctggagtggagttgcggtgtttctgattatctcgctcaaatgctggcgttacttcgtgaacgttaccctgatggcaatatcgcctgcacccgaaaagcaattccgggcacccgcttactggcctcgcaggcaattctggctgccggaggactgattcatcgtgccggatgtgcggaaaccatattattgtttgccaaccaccgccattttcttcatgacaatcaggactggtcaggcgcaatcaatcagttacgtcgccacgcacccgagaagaaaatagttgttgaagccgacacgccgaaagaggcaatcgccgcgttacgcgcgcaaccagacgtacttcagctcgacaaatttagtccgcaacaggcaactgaaattgcgcaaatagcaccgtcgctggctccccactgcacgctggctctgaccggcggaattaatctgacaacactcaaaaattacctcgactgcggcattcgcctttttattacctccgcgccttattacgcggcacctgctgacattaaagtcagtctgcaacccgcagcctctatttaa

SEQ ID NO: 3862 - protein, 284 aa, Escherichia coli
MIFLSQAQIDALLLEDIQGGDLTTRALNIGHQHGYIEFFLRQGGCVSGISVACKMLTTLGLTIDDAVSDGSQANAGQRLIRAQGNAAALHQGWKAVQNVLEWSCGVSDYLAQMLALLRERYPDGNIACTRKAIPGTRLLASQAILAAGGLIHRAGCAETILLFANHRHFLHDNQDWSGAINQLRRHAPEKKIVVEADTPKEAIAALRAQPDVLQLDKFSPQQATEIAQIAPSLAPHCTLALTGGINLTTLKNYLDCGIRLFITSAPYYAAPADIKVSLQPAASI

SEQ ID NO: 3863 - DNA, 1992 bp, Escherichia coli
ttgttaaacggaatttattctatgagactcaaaaaacgttatctctgcacagtattaacacttgcctttacccagcaggccgtagcggctcaggagagcgacacgctgaccgtatggtccagtccggtatcatcaacgacgaccaccgttctcgatcaacccaccatgaaggccctggataaacagaatgtcgctcaggcattaagtgtcgtccccggcgtggtgctgcaaaagtcaggtagccgcaacgaagaacaggtcaaagttcgtggctttgatagtcgtcaggtgccggtctatttcgacggtgtgcccatttatgttccctatgacggcaacctcgatctggcgcggattctgaccaacaatttgggggcagttgaagtttccaaagggtattcgtcgctgcttcaggggcctaatcagatgggcggagccattaatatcaccacccagaagccgactaaaccgctggaagccagtctgggatatcgtcagggatggagccgtagccaggacaatgcctacgatatgcatgcttcatttgccgccagcagcgatctggggtatttgcaagtcagcggtagccagctaaagcaggattttctcggcctgccgcatggtgtaaataatgatattgcaggcaaacacggcaagatgattaattcatcggctgatgataaacgcggcattgtgaagctcggttttacaccacgcgaaaacgatgaatacacattgacttacattaagcaggatggtgaaaaagataacccgccatacagtggaaatagtggtcagaaatcacgctactggcagtggccagagtatgacaaagaaagtttttattatcagggaacgacccaactaaacgatcgttttaccctgaaaagtcggctgtatcgcgacacctttgaaaatacgctaatgatgtacaactcgctggctgatttgaaaaataaaaaaggcagctacagccattattccgattacagcgacggtgccgggttacaactggcagccgatgtgcgtgaaaacgatctgctgtcgtttgccgttaactggaaagatgacgtacaccgggaaaaaggtgcgccgcacgccgcttacgatcgctatgaagatcgtacctggtcgctcgccagtgaatatcaatgggctgctgccgataatgtcgatgtcgtggctggaatcagctatgactggcgcgatagcgtagaagcgaaaaaacatgagaaagatggcagtatcacccattatgacgacaacaatcagtcagcttttaactggcaggtgatggggaaataccactttgccaatgaagacacgctggcgctttcgtactatgaccgcacacgctttccgacgctgaaagaacgctataccacgtccaaacctgcgtataaccagatagcgattgttaacccgcagctcaagccggaacgcgcgcgcggggtggatttaacctggaatggtgccttcacgcacgactggggatttgaggtcagcgtttactataaccgggtgagtgatgccatcctctcgcacaatatcgatgccgataccattcaaaatcagaacagcggcacggtggattacagcggtctggatgccggtattaaggggaaaatcagcaatatactggatgtaggattgagctacgccctgatccacgctgatgccaaacgtaaagacatcggcaagataaccgatctgccaacgcagacaatgaccgcatggatgactctcaaaccgtgggagccgttaagcgtaacgctgtcggaagaggcgcgttcctccagctacagcaacagtgacggttcacaaaaagccgccggttttgcggtgacccacattcgagccgattacaccttaggtcatggcttcagcgttaatgcgtcggtcaataacctgtttgataccaaatatgcctacagtgaagggtttattgaagaaggtcgcaatttctgggctggtatcgagtatacgttctga

SEQ ID NO: 3864 - protein, 663 aa, Escherichia coli
MLNGIYSMRLKKRYLCTVLTLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 3865 - DNA, 288 bp, Escherichia coli
ttgcgtccgattcatcgaaacgagggcctgaacatgggaattattgcctggattatttttggcctgatagccggcataatcgccaagctaatcatgccgggacgtgatggtggtggatttttcctgacctgtattcttgggatagtcggtgcggtggtcggcggctggctggcgaccatgtttggcattggcggctccatcagcggttttaatttgcacagcttcctggtggcggtggtgggcgctatcctggtgctgggcgtattccgcctcctgcgaagagaataa

SEQ ID NO: 3866 - protein, 95 aa, Escherichia coli
MRPIHRNEGLNMGIIAWIIFGLIAGIIAKLIMPGRDGGGFFLTCILGIVGAVVGGWLATMFGIGGSISGFNLHSFLVAVVGAILVLGVFRLLRRE

SEQ ID NO: 3867 - DNA, 735 bp, Escherichia coli
gtgagtcattaccatgagcagttcctgaaacaaaatctgttagccgtcctgggcgtgttacgcgatttgcacaaagccgcaattcctttgcgtatcagttggaatggcgggcagctgatcagcaaaatactggtaataaccccggataaactggtgctggatttcggcagtcaggccgaagataacaacgctgtgttaaaggcgcagcatattaccattaccgccgaaacccagggcgcgaaagtcgagtttactgttgaacaactacagcagagtgaatacttgcagcttccggcatttattaccgtaccgcctcccaccttgtggtttgtacaacgacgccgatatttccgcatctccgccccactccatccgccttatttttgccagaccaaactggcggataacagtacgttacgtttccgcctgcatgatttgtcgttaggcggcatgggcgcattactggaaacagcaaagcctgccgaattacacgaaggcatgcgcttcgctcagattgaagtcaacatggggcaatggggtgtttttcactttgacgcccagttaatctccatcagcgagcgcaaagtgattgatggcaaaaatgaaaccatcaccactccccgtctgagcttccgttttcttaacgtcagcccgacggtggagcggcaattacagcggattattttctctctcgagcgagaagcccgggagaaagcggacaaagtgcgcgactga

SEQ ID NO: 3868 - protein, 244 aa, Escherichia coli
MSHYHEQFLKQNLLAVLGVLRDLHKAAIPLRISWNGGQLISKILVITPDKLVLDFGSQAEDNNAVLKAQHITITAETQGAKVEFTVEQLQQSEYLQLPAFITVPPPTLWFVQRRRYFRISAPLHPPYFCQTKLADNSTLRFRLHDLSLGGMGALLETAKPAELHEGMRFAQIEVNMGQWGVFHFDAQLISISERKVIDGKNETITTPRLSFRFLNVSPTVERQLQRIIFSLEREAREKADKVRD

SEQ ID NO: 3869 - DNA, 726 bp, Escherichia coli
gtgaaacagagacatggcaattccttgctgacaacagaaacgaaatgtatatcatgccgcttaggtgtgccgttgtcacctcaacggcgattccaggctataaggatagaagaagtgaaattgagatggtttgcctttttgattgtgttattagcgggttgttcatcaaagcatgactatacgaacccgccgtggaacgcgaaagttccggtgcaacgtgcgatgcagtggatgccaataagccagaaagccggtgcagcctggggcgtcgatccacaattgatcacggcgattatcgctatcgaatcgggtggtaatccgaacgcggtgagtaaatcgaatgccattggtttgatgcagataaaagcttcaacctccggacgtgatgtatatcgtcgtatgggctggagtggtgagccgacgaccagcgagctgaaaaatccggagcgtaatatttcaatgggggcggcttacctgaatattctggaaaccggcccgctggcaggcattgaagatccgaaggtactgcaatatgcgctggtggtgtcatacgctaacggggcaggtgcgctgctacggactttctcgtcagatcggaaaaaggcgatcagcaaaatcaacgatctggatgctgatgagttcctcgatcacgtagcgcgaaatcatcctgcgccgcaggctccgcgctatatctacaaacttgagcaggcactggacgcgatgtaa

SEQ ID NO: 3870 - protein, 241 aa, Escherichia coli
MKQRHGNSLLTTETKCISCRLGVPLSPQRRFQAIRIEEVKLRWFAFLIVLLAGCSSKHDYTNPPWNAKVPVQRAMQWMPISQKAGAAWGVDPQLITAIIAIESGGNPNAVSKSNAIGLMQIKASTSGRDVYRRMGWSGEPTTSELKNPERNISMGAAYLNILETGPLAGIEDPKVLQYALVVSYANGAGALLRTFSSDRKKAISKINDLDADEFLDHVARNHPAPQAPRYIYKLEQALDAM

SEQ ID NO: 3871 - DNA, 915 bp, Escherichia coli
atgtctctgtttcacttaattgccccatcgggttactgcattaaacagcacgccgcgctgcgtggtatccagcgccttaccgacgcggggcatcaggtcaataacgtcgaggttattgcccgtcgttgtgagcgttttgcgggtacggaaacggagcgtctggaagatctcaattctcttgccagactgactacccccaacaccatcgtgctgtctgtacgcggcggttacggtgccagtcgtttactggcagatattgactggcaggcactggtggctcgccaacaacatgacccgttactcatttgcggacatagcgattttaccgccattcagtgcggtcttctggcgcaaggcaatgtcatcacctttagcggccccatgctggtagcaaactttggcgcggatgaactaaatgcctttaccgagcaccacttctggctggcgttacgcaataaaacgttcaccattgaatggcaaggggaaggcccgacatgtcagaccgaaggcacgctgtggggaggcaatcttgcgatgctgatttcactgattggtacaccgtggatgccaaaaattgagaacggtattctggtgctggaagatattaacgagcaccctttccgcgtcgaacgtatgctgttgcagctctatcatgctggaattttgccacgtcagaaggcgattattctcggtagctttagcggcagcacgcctaatgattatgacgcaggttacaacctggagtcagtgtacgcgtttttgcgttcccgcctgtcgattccactcattaccggcctcgattttggtcatgaacaacgcacggttacgctgccgttgggcgcacatgccattctgaataacacccaggaaggcactcagttgacgattagcggtcatcctgttcttaaaatgtaa

SEQ ID NO: 3872 - protein, 304 aa, Escherichia coli
MSLFHLIAPSGYCIKQHAALRGIQRLTDAGHQVNNVEVIARRCERFAGTETERLEDLNSLARLTTPNTIVLSVRGGYGASRLLADIDWQALVARQQHDPLLICGHSDFTAIQCGLLAQGNVITFSGPMLVANFGADELNAFTEHHFWLALRNKTFTIEWQGEGPTCQTEGTLWGGNLAMLISLIGTPWMPKIENGILVLEDINEHPFRVERMLLQLYHAGILPRQKAIILGSFSGSTPNDYDAGYNLESVYAFLRSRLSIPLITGLDFGHEQRTVTLPLGAHAILNNTQEGTQLTISGHPVLKM

SEQ ID NO: 3873 - DNA, 1737 bp, Escherichia coli
ttggatgccacaacaataattagccttttcatcttaggatccatccttgtcaccagcagtattttacttagttcattttcttcccgtcttggcattcccattctggttatttttctggcgatcggcatgctggcgggggttgatggcgtcggcggtatcccgtttgataattatcccttcgcctacatggtaagtaacctggcgctggcgattattttgctcgacggcgggatgcgcactcaggccagttcctttcgtgtggcgttaggaccggcactgtcgctggcgacgctgggcgtgcttatcacctctggtttaaccggcatgatggcggcgtggctgtttaatcttgatttgattgaaggattattaatcggcgctatcgtcggctccaccgatgctgcagcggtcttttctctgctgggtggtaaggggcttaacgaacgtgttggctcgacgctggaaattgaatccggcagtaatgatccaatggcggtctttctgacgattaccctgattgcgatgatccagcagcatgaaagcagtgtcagctggatgttcgtggtcgatattctgcagcaatttggcctcgggattgtcatcgggcttggcggtggttatttactgctgcaaatgattaatcgcatcgccctgcccgccggattatatccattgctggcattaagcggcggtattttaatttttgctttaaccacggcgctggaaggcagcggtattctggctgtttatctgtgcggttttctgctgggtaatcggccgattcgcaaccgctacggcatcctgcaaaatttcgacggcctcgcctggctggcgcaaatcgccatgttcctggtgctggggctattggttaacccaagcgatctgctgcctattgccattccggcgctcattttgtccgcatggatgattttcttcgcccgtcctctttcggtatttgccggattgctaccgttccgtggcttcaatctgcgtgagcgcgtgtttatcagctgggtaggattacgcggcgcggtgccgattattctggctgtgttcccgatgatggcggggctggagaatgcgcgactgttctttaatgtcgccttctttgtggtcctggtttcactgctattgcagggaacatcactctcgtgggcggcgaaaaaagccaaagtggtcgttccgccagtgggacgtccggtgtcacgcgttggcctggatattcatccggaaaatccgtgggagcagtttgtttatcaattgagtgccgataaatggtgcgtgggcgcggcactgcgtgatttgcatatgccaaaagagacgcgtattgcggcactgtttcgtgataaccagttgcttcatcccaccggcagcacccgactgcgcgaaggcgatgtgttgtgtgtaattggtcgggaacgcgatctcccggcgctcggtaaactgttcagccagtcgccgccggtcgcgctggatcaacgcttctttggtgacttcattctcgaagccagcgccaaatatgctgatgtggcgctgatatatggcctggaagacgggcgagaatatcgcgataagcagcaaacgctgggtgaaatcgtccagcagttgttaggcgcagcaccggttgtcggtgaccaggtagagtttgccgggatgatctggacggtggccgagaaagaagataatgaagtgttgaagattggtgttcgggtagcggaggaagaagccgaatcttaa

SEQ ID NO: 3874 - protein, 578 aa, Escherichia coli [sequence omitted]

SEQ ID NO: 3875 - DNA, 1071 bp, Escherichia coli
atgacccgtccgatacaggccagcctcgatctgcaggcattaaaacagaatctgtccattgtccgccaggccgcgccgcgcgcgcgcgtctggtcggtggtaaaagcgaacgcttacgggcacggtattgagcgtatctggagcgcgatcggggctaccgatggctttgcattgcttaacctggaagaggcaataacgttacgtgagcgcggctggaaaggaccgatcctgatgctggaaggatttttccatgctcaggatctggagatttatgaccagcaccgcctgaccacctgcgtacacagcaactggcagctcaaagcactgcaaaatgcgcggctaaaagcaccgttggatatttatcttaaagtgaacagtggaatgaatcggttgggcttccagcccgatcgcgtgcttaccgtctggcagcagttgcgggcgatggcgaatgttggcgaaatgaccctgatgtcacattttgccgaagcggaacatcctgatggaatttccggcgcgatggcgcgtattgagcaggcggcggaagggctggagtgtcggcgttcgttgtccaattcggcggcgactctgtggcacccggaagcgcattttgactgggttcggcctggcattattttgtatggcgcttcgccgtccggtcagtggcgtgatatcgccaataccggattacgtccggtgatgacgctaagcagtgagattattggtgtccagacgctaaaagcgggcgagcgtgtgggctacggcggtcgctatactgcgcgcgatgaacagcgaatcggcattgtcgccgcaggatacgccgacggttatccgcgccacgcgcctaccggtacccctgttttagtggacggcgttcgcaccatgacggtggggacagtctcgatggatatgctggcggtcgatttaacgccttgcccgcaagcgggtattggtacgccagttgagctgtggggcaaggagatcaaaattgatgatgtcgccgccgctgccggaacggtaggctatgagttgatgtgcgcgctggcgttacgcgtcccggttgtgacggtgtaa

SEQ ID NO: 3876 - protein, 356 aa, Escherichia coli
MTRPIQASLDLQALKQNLSIVRQAAPRARVWSVVKANAYGHGIERIWSAIGATDGFALLNLEEAITLRERGWKGPILMLEGFFHAQDLEIYDQHRLTTCVHSNWQLKALQNARLKAPLDIYLKVNSGMNRLGFQPDRVLTVWQQLRAMANVGEMTLMSHFAEAEHPDGISGAMARIEQAAEGLECRRSLSNSAATLWHPEAHFDWVRPGIILYGASPSGQWRDIANTGLRPVMTLSSEIIGVQTLKAGERVGYGGRYTARDEQRIGIVAAGYADGYPRHAPTGTPVLVDGVRTMTVGTVSMDMLAVDLTPCPQAGIGTPVELWGKEIKIDDVAAAAGTVGYELMCALALRVPVVTV

SEQ ID NO: 3877 - DNA, 1299 bp, Escherichia coli
atgcgagttgtcatactgggaagtggtgtggtaggcgttgccagcgcctggtacttaaatcaggcaggacatgaggtcaccgtcattgatcgggagccgggggccgccctggaaaccagtgccgcgaatgcagggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactatatggaaaacaaagggcggatggtgcgtctggcggaatacagccgtgattgcctgaaagcattgcgcgccgaaaccaatattcagtatgaagggcgtcagggtgggacgctgcaactgttccgtaccgaacaacagtatgaaaacgcgacccgcgatatcgccgtgctggaagatgccggcgtaccgtatcagctgctggaatccagccgcctggcggaagtggagcccgcgctggcagaagtggcgcacaaactgacgggcggcctgcaactgcccaatgatgaaaccggagactgccagctgtttacccagaatctggcgcggatggcggagcaggcgggggttaaattccgctttaatacgcccgttgaccaactgctttgcgacggcgagcaaatctacggcgtgaagtgtggtgatgaagtgattaaggccgatgcgtatgtgatggcgtttggttcttactcgacggcgatgctcaaaggcattgttgatattccggtgtatccgctgaaaggctactcgctgactattccgattgcgcaggaagatggtgcgccggtgtctactatccttgatgaaacctacaaaatcgccattacccgtttcgataaccgcattcgtgttggcggaatggcggaaattgttggctttaacaccgagctgttgcaaccgcgtcgtgaaacgctggagatggtggttcgcgatctctatccacgcggcggtcatgttgagcaggcgactttctggactggcctgcgcccgatgacgccagacggcacgccggttgtcgggcgtacacgctttaaaaatctgtggctgaataccggtcacggcacgctcggctggacgatggcttgcggttccggtcagttgttaagcgatctgctctcggggcgcacgccagcgatcccgtatgaagatctaagcgtagcgcgctacagccgtggatttacgccattacgcccgggccatttacatggcgcacacagctaa

SEQ ID NO: 3878 - protein, 432 aa, Escherichia coli
MRVVILGSGVVGVASAWYLNQAGHEVTVIDREPGAALETSAANAGQISPGYAAPWAAPGVPLKAIKWMFQRHAPLAVRLDGTQFQLKWMWQMLRNCDTSHYMENKGRMVRLAEYSRDCLKALRAETNIQYEGRQGGTLQLFRTEQQYENATRDIAVLEDAGVPYQLLESSRLAEVEPALAEVAHKLTGGLQLPNDETGDCQLFTQNLARMAEQAGVKFRFNTPVDQLLCDGEQIYGVKCGDEVIKADAYVMAFGSYSTAMLKGIVDIPVYPLKGYSLTIPIAQEDGAPVSTILDETYKIAITRFDNRIRVGGMAEIVGFNTELLQPRRETLEMVVRDLYPRGGHVEQATFWTGLRPMTPDGTPVVGRTRFKNLWLNTGHGTLGWTMACGSGQLLSDLLSGRTPAIPYEDLSVARYSRGFTPLRPGHLHGAHS

SEQ ID NO: 3879 - DNA, 1533 bp, Escherichia coli
atggcgacgatcgattctatgaataaggacaccacacgtttgagcgatggacccgactggacgttcgacctgctggatgtttatctggcagagatagaccgggtggcgaaactctaccggctggatacctacccgcaccagattgaagtgataacctcagaacagatgatggatgcctactccagcgtcggcatgccaattaactatccgcactggtcattcggtaaaaagtttatcgagactgaacggctgtataagcacggtcagcaaggactggcctatgaaatcgtcattaactctaacccgtgtatcgcttacctgatggaagagaacaccattaccatgcaagcgctggtgatggctcatgcctgctatgggcataactctttcttcaaaaacaattacttattccgtagctggaccgacgccagttcgattgtcgattatctgatttttgcccgtaaatatattaccgagtgcgaagagcgttatggcgttgatgaagtagaacggcttctggactcgtgccacgcgctgatgaactacggcgtggaccggtacaaacgcccgcaaaaaatctcgctgcaagaagagaaagcccggcagaagagtcgcgaagagtatctgcaaagtcaggtcaatatgctctggcgtaccctgccgaagcgcgaggaagagaaaacggttgctgaagcgcgccgctatccgtccgaaccacaagaaaacctgctctattttatggagaaaaatgcgccactgctggaatcatggcagcgtgaaatcctgcgtattgtgcgtaaggtgagccagtatttttatccgcaaaaacagactcaggtgatgaacgaaggctgggcgaccttctggcactacaccatccttaaccatctgtatgatgaagggaaagtaacggaacgttttatgctggagtttttgcacagccacaccaatgtggtcttccagccgccctataacagcccgtggtacagcggcatcaacccgtatgccctcgggtttgccatgttccaggatattaaacggatttgtcagtcaccaacggaagaagacaaatactggttcccggatatcgccggttccgactggctggaaacgctgcatttcgcgatgcgtgatttcaaagatgagagttttatcagccagttcctgtcaccgaaagtgatgcgtgatttccgcttcttcaccgtgctggatgatgatcggcataattatctggagatttccgctattcataatgaagaaggttatcgggaaatccgtaaccggttatcgtcgcaatataacttaagtaatctggagccgaatattcagatctggaacgtggatttgcgcggcgaccgttcgctgacgctgcgttacattccacataatcgcgcaccgctggatcgggggcgcaaagaagtgctgaagcatgtgcatcgcctgtggggatttgatgtgatgctggaacagcaaaacgaagacggcagcgtcgagttgctggaacgttgcccgccgagaatgggaaatctgtaa

SEQ ID NO: 3880 - protein, 510 aa, Escherichia coli
MATIDSMNKDTTRLSDGPDWTFDLLDVYLAEIDRVAKLYRLDTYPHQIEVITSEQMMDAYSSVGMPINYPHWSFGKKFIETERLYKHGQQGLAYEIVINSNPCIAYLMEENTITMQALVMAHACYGHNSFFKNNYLFRSWTDASSIVDYLIFARKYITECEERYGVDEVERLLDSCHALMNYGVDRYKRPQKISLQEEKARQKSREEYLQSQVNMLWRTLPKREEEKTVAEARRYPSEPQENLLYFMEKNAPLLESWQREILRIVRKVSQYFYPQKQTQVMNEGWATFWHYTILNHLYDEGKVTERFMLEFLHSHTNVVFQPPYNSPWYSGINPYALGFAMFQDIKRICQSPTEEDKYWFPDIAGSDWLETLHFAMRDFKDESFISQFLSPKVMRDFRFFTVLDDDRHNYLEISAIHNEEGYREIRNRLSSQYNLSNLEPNIQIWNVDLRGDRSLTLRYIPHNRAPLDRGRKEVLKHVHRLWGFDVMLEQQNEDGSVELLERCPPRMGNL

SEQ ID NO: 3881 - DNA, 744 bp, Escherichia coli
ttgctgtgttatggaaatctcactatggtcattaaggcgcaaagcccggcgggtttcgcggaagagtacattattgaaagtatctggaataaccgcttccctcccgggactattttgcccgcagaacgtgaactttcagaattaattggcgtaacgcgtactacgttacgtgaagtgttacaacgtctggcacgagatggctggttgaccattcaacacggcaagccgacgaaggtgaataatttctgggaaacctctggtttaaatatccttgaaacactggcgcgactggaccacgaaagtgtgccgcaacttattgataatttgctgtcggtgcgtaccaatatttcaactatttttattcgcaccgcgtttcgtcaacatcccgataaagcgcaggaagtgctggcaaccgctaatgaagtggccgatcacgccgacgcctttgccgagctggattacaacattttccgcggcctggcgtttgcttccggcaacccgatttacggtctgatccttaacgggatgaaagggctgtatacgcgcattggtcgtcactatttcgccaatccggaagcgcgcagtctggcgctgggcttctatcacaaactgtcggcgttgtgcagtgaaggcgcacacgatcaggtatatgaaacagtgcgtcgctatgggcatgagagtggcgagatttggcaccggatgcagaaaaatctgccgggtgatttagccattcagggacgataa

SEQ ID NO: 3882 - protein, 247 aa, Escherichia coli
MLCYGNLTMVIKAQSPAGFAEEYIIESIWNNRFPPGTILPAERELSELIGVTRTTLREVLQRLARDGWLTIQHGKPTKVNNFWETSGLNILETLARLDHESVPQLIDNLLSVRTNISTIFIRTAFRQHPDKAQEVLATANEVADHADAFAELDYNIFRGLAFASGNPIYGLILNGMKGLYTRIGRHYFANPEARSLALGFYHKLSALCSEGAHDQVYETVRRYGHESGEIWHRMQKNLPGDLAIQGR

SEQ ID NO: 3883 - DNA, 1542 bp, Escherichia coli
atggagatctcctggggccgcgcactatggcgcaattttttgggacagtcccccgactggtacaaactcgccctcatcattttcttaatcgtaaatccgttaattttcctcatcagccctttcgtcgctggctggttgctggtagcggaatttattttcactctggcgatggccctgaaatgctacccgctgctccccggtggtctgttggctatcgaagcggtattcatcggcatgaccagcgcggaacatgttcgtgaagaagtggcggcaaatcttgaagtcttgctgttactgatgtttatggtggcgggtatctattttatgaaacagctgttgttgttcatatttacccgtttgctgttaagtattcgctccaaaatgctgctgtcgctctctttttgcgtggcggcggcgttcctctccgcgttcctcgatgccttaaccgtcgtggcggtggtgatcagcgttgcagtcggtttttatggtatttatcaccgcgtagcctcttcccgtactgaagataccgacctgcaagacgatagtcatatcgacaagcattacaaagtggttctggaacagttccgtggctttctgcgtagtctgatgatgcatgccggtgtcggcaccgcattaggcggcgtgatgaccatggtgggcgaaccacaaaacctgatcatcgctaaagcggctggctggcattttggcgatttcttcctgcgcatgtcgccggtgaccgtcccggttctgatttgtggcctgttaacctgcctgctggtagagaagctgcgttggtttggctacggtgaaacgctgccggagaaagtccgcgaagtgctgcaacagtttgacgatcaaagccgtctccagcgtacacgtcaggacaaaattcgtctgattgtgcaggcgattatcggcgtctggctggtcaccgcgctggcactacatctggcagaagtcggtttgattggtttgtcggtcattattctggcgacatcattgaccggtgttaccgatgaacatgctatcggtaaagccttcaccgaatctctgccattcaccgcactgttgacggtgtttttctcagtagtcgcggtgattatcgaccaacaactgttttcgccgattattcagtttgtgttgcaggcatctgaacatgctcagctgtcgttgttctatattttcaacggtctgctgtcatccatttcggataacgtcttcgtggggacgatttatatcaacgaagcgaaagcggcaatgaaaagtggcgctatcacgttgaagcaatatgagctgctggcggtcgccattaataccggtaccaatctgccctccgtcgctacgccgaacggtcaggctgcgttcctgttcctgctgacctctgcactcgcgccattgattcgtctctcttatggccgcatggtgtggatggccctgccttacaccctcgtcctgacactcgtcgggctgctctgcgtcgagtttacgcttgctcctgtaaccgaatggtttatgcaaatgggctggatagcaacgctttga

SEQ ID NO: 3884 - protein, 513 aa, Escherichia coli
MEISWGRALWRNFLGQSPDWYKLALIIFLIVNPLIFLISPFVAGWLLVAEFIFTLAMALKCYPLLPGGLLAIEAVFIGMTSAEHVREEVAANLEVLLLLMFMVAGIYFMKQLLLFIFTRLLLSIRSKMLLSLSFCVAAAFLSAFLDALTVVAVVISVAVGFYGIYHRVASSRTEDTDLQDDSHIDKHYKVVLEQFRGFLRSLMMHAGVGTALGGVMTMVGEPQNLIIAKAAGWHFGDFFLRMSPVTVPVLICGLLTCLLVEKLRWFGYGETLPEKVREVLQQFDDQSRLQRTRQDKIRLIVQAIIGVWLVTALALHLAEVGLIGLSVIILATSLTGVTDEHAIGKAFTESLPFTALLTVFFSVVAVIIDQQLFSPIIQFVLQASEHAQLSLFYIFNGLLSSISDNVFVGTIYINEAKAAMKSGAITLKQYELLAVAINTGTNLPSVATPNGQAAFLFLLTSALAPLIRLSYGRMVWMALPYTLVLTLVGLLCVEFTLAPVTEWFMQMGWIATL

SEQ ID NO: 3885 - DNA, 531 bp, Escherichia coli
atgttgcgatttttgaaccaatgttcacaaggccggggtgcatggctgttgatggcgtttactgctctggcactggaactgacggcgctgtggttccagcatgtgatgttactgaaaccttgcgtgctctgtatttatgaacgctgcgcgttattcggcgttctgggtgctgcgctgattggcgcgatcgccccgaaaactccgctgcgttatgtagcgatggttatctggttgtatagtgcgttccgcggtgtgcagttaacttacgagcacaccatgcttcagctctatccttcgccgtttgcgacctgtgattttatggctcgtttcccggaatggctgccgctggataaatgggtgccgcaagtgtttgtcgcctctggcgattgcgccgagcgtcagtgggaatttttaggtctggaaatgccgcagtggctgctcggtatttttatcgcttacctgattgtcgcggtgctggtggtgatttcccagccgtttaaagcgaaaaaacgtgacctgttcggtcgctaa

SEQ ID NO: 3886 - protein, 176 aa, Escherichia coli
MLRFLNQCSQGRGAWLLMAFTALALELTALWFQHVMLLKPCVLCIYERCALFGVLGAALIGAIAPKTPLRYVAMVIWLYSAFRGVQLTYEHTMLQLYPSPFATCDFMARFPEWLPLDKWVPQVFVASGDCAERQWEFLGLEMPQWLLGIFIAYLIVAVLVVISQPFKAKKRDLFGR

SEQ ID NO: 3887 - DNA, 1269 bp, Escherichia coli
atgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgctgggcgttaaaatgggcgatccctggttcaaacaaaaagatctgtttcgtcgctgtggcgtggtttgctttagcagcaattatgagctttacgcagacatgagtaatcgggtgatgtcgacgctggaagaactatcgccccgcgtcgagatttacagtattgatgaggcattctgcgatctgacaggtgtgcataattgtcgcgatctgactgattttggcagagaaatttgcgcaacggtgctacaacgtacccatcttactgttggtgtggggatcgcccagaccaaaacgctggctaagcttgccaatcatgcggcaaaaaaatggcagcggcagacgggcggggtggtggatttatcaaatctggaacgccagcgtaaattaatgtctgctctccccgtggatgaagtctgggggattggacggcggatcagcaaaaaactggacgcgatggggatcaaaaccgttctcgatttggcggattcagatatccggtttatccgtaaacattttaatgtcgtgctcgaaagaacggtgcgtgaactgcgcggtgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgttcaatgaaccttattacggcaatagcgcatcggtaaaactgctgacgcccactcaggacagcagggatatcattaacgccgctacgcgatctctggatgccatctggcaagcgggccattgctaccaaaaagcgggcgtgatgctgggggatttcttcagtcagggagtcgcgcagctcaatttattcgatgacaacgcaccgcgccccgggagtgagcaattgatggcggtaatggatacgctgaatgctaaagagggcagaggaacactctattttgccgggcaggggatccagcaacaatggcagatgaagcgtgccatgctttcaccatgttatacaacgcgaagttctgatttactgcgggtcaaataa

SEQ ID NO: 3888 - protein, 422 aa, Escherichia coli
MFALCDVNAFYASCETVFRPDLWGKPVVVLSNNDGCVIARNAEAKALGVKMGDPWFKQKDLFRRCGVVCFSSNYELYADMSNRVMSTLEELSPRVEIYSIDEAFCDLTGVHNCRDLTDFGREICATVLQRTHLTVGVGIAQTKTLAKLANHAAKKWQRQTGGVVDLSNLERQRKLMSALPVDEVWGIGRRISKKLDAMGIKTVLDLADSDIRFIRKHFNVVLERTVRELRGEPCLQLEEFAPTKQEIICSRSFGERITDYPSMRQAICSYAARAAEKLRSEHQYCRFISTFIKTSPFAFNEPYYGNSASVKLLTPTQDSRDIINAATRSLDAIWQAGHCYQKAGVMLGDFFSQGVAQLNLFDDNAPRPGSEQLMAVMDTLNAKEGRGTLYFAGQGIQQQWQMKRAMLSPCYTTRSSDLLRVK

SEQ ID NO: 3889 - DNA, 420 bp, Escherichia coli
atgttgtttatcaagcctgcggatctccgcgaaattgtgacttttccgctatttagcgatcttgttcagtgtggctttccttcaccggccgcagattacgttgaacagcgcatcgatctgaatcaactgttgatccagcatcccagcgcgacttatttcgtcaaagcaagtggtgattctatgattgatggtgggattagtgacggtgatttactgattgtcgatagcgctattaccgccagccatggtgatattgtcatcgctgctgttgacggtgagtttacggtgaaaaaattgcaactacgcccgacggtacagcttactcctatgaacagtgcgtactcgcccattaccatcagtagcgaagatacgctggatgtctttggtgtggtgatccacgtcgttaaggcgatgcgctga

SEQ ID NO: 3890 - protein, 139 aa, Escherichia coli
MLFIKPADLREIVTFPLFSDLVQCGFPSPAADYVEQRIDLNQLLIQHPSATYFVKASGDSMIDGGISDGDLLIVDSAITASHGDIVIAAVDGEFTVKKLQLRPTVQLTPMNSAYSPITISSEDTLDVFGVVIHVVKAMR

SEQ ID NO: 3891 - DNA, 219 bp, Escherichia coli
ttgaagaacaagttaaaatctgcgcagagtttctttaccaccctgtctaacacggttaaacaagcgaataaagatatcgatgccgccaaattgaaattaactaccgaaatagccgccatcggggtgataaaaacggaaactgaaacaaccagattctacgttgattatgatgatttaatgctttctttactaaaagtaagcggccaaaaaaatgattaa

SEQ ID NO: 3892 - protein, 72 aa, Escherichia coli
MKNKLKSAQSFFTTLSNTVKQANKDIDAAKLKLTTEIAAIGVIKTETETTRFYVDYDDLMLSLLKVSGQKND

SEQ ID NO: 3893 - DNA, 477 bp, Escherichia coli
gtgcgttttaacgtaatggcggaacacctgatgagcgatgtacctttctggcaaagtaaaaccctggacgaaatgagcgatgcggaatgggagtcgttgtgtgatggttgcggtcagtgttgcctgcataaactgatggatgaagacaccgacgaaatctacttcactaacgtcgcctgtcgccagctcaatattaaaacctgtcaatgtcggaactacgaacgtcgtttcgagtttgaacccgactgcattaaattaacccgtgaaaatctgccaacattcgaatggctgccaatgacctgcgcttatcgtttgctggcggaaggtaaaggtttacctgcgtggcatccgctacttactggttcgaaagcggcaatgcatggtgaacgtatctctgtgcgtcatatcgcagtaaaagaatcagaagtgattgactggcaggatcatatcttaaataaacctgactgggcgcagtga

SEQ ID NO: 3894 - protein, 158 aa, Escherichia coli
MRFNVMAEHLMSDVPFWQSKTLDEMSDAEWESLCDGCGQCCLHKLMDEDTDEIYFTNVACRQLNIKTCQCRNYERRFEFEPDCIKLTRENLPTFEWLPMTCAYRLLAEGKGLPAWHPLLTGSKAAMHGERISVRHIAVKESEVIDWQDHILNKPDWAQ

SEQ ID NO: 3895 - DNA, 660 bp, Escherichia coli
atgtatcaacatcacaactggcaaggtgcgctgctggattatccggtgagtaaagtagtctgtgttggcagtaactatgccaaacatattaaagagatgggcagcgcagtacccgaagagccagtgctgtttattaaaccagaaacggcactgtgcgatctgcggcagccattggcgatcccatccgatttcggttcagttcatcatgaagtcgaactggcggtgttgattggcgcgacgctgcgtcaggctacggaagagcatgtccgcaaagccattgccggttacggcgtggcgctcgatctgacattgcgtgatgttcagggaaaaatgaagaaagccgggcagccgtgggaaaaggccaaagcgtttgataactcttgtccgctttccgggtttattcccgcggcggagtttaccggcgatccgcaaaatacaacgctgggcctgagcgtaaacggcgagcaacgccagcaaggtacgactgcggacatgatccataaaatcgttccgctgatcgcttatatgagcaagttttttaccctcaaggccggtgacgttgtgctgacaggcacgcctgatggtgtcggcccgttgcaaagcggtgatgagctgacagtcactttcgatgggcattctttgacaactcgcgttttgtaa

SEQ ID NO: 3896 - protein, 219 aa, Escherichia coli
MYQHHNWQGALLDYPVSKVVCVGSNYAKHIKEMGSAVPEEPVLFIKPETALCDLRQPLAIPSDFGSVHHEVELAVLIGATLRQATEEHVRKAIAGYGVALDLTLRDVQGKMKKAGQPWEKAKAFDNSCPLSGFIPAAEFTGDPQNTTLGLSVNGEQRQQGTTADMIHKIVPLIAYMSKFFTLKAGDVVLTGTPDGVGPLQSGDELTVTFDGHSLTTRVL

SEQ ID NO: 3897 - DNA, 327 bp, Escherichia coli
atgccaaaacctggcatcttaaagagtaaaagtatgttttgtgtgatttatcgaagcagcaagcgtgaccagacctatttatatgtcgaaaaaaaagacgatttttcgcgtgttcctgaggaactgatgaaaggttttggtcagcctcagttagcgatgattcttccgctggatgggcggaagaaactggtcaatgccgatattgaaaaggttaaacaggcattaaccgagcaaggttactatttgcagttaccgccaccacccgaagatttgctgaagcaacatctttccgtcatggggcagaaaacagacgacacgaacaaataa

SEQ ID NO: 3898 - protein, 108 aa, Escherichia coli
MPKPGILKSKSMFCVIYRSSKRDQTYLYVEKKDDFSRVPEELMKGFGQPQLAMILPLDGRKKLVNADIEKVKQALTEQGYYLQLPPPPEDLLKQHLSVMGQKTDDTNK

SEQ ID NO: 3899 - DNA, 369 bp, Escherichia coli
atgaatatgatgcgtattttttatatcggattgtcaggtgtggggatgatgttctcatcaatggcgtctggaaatgacgctggcgggcttcaatctcctgcgtgtggcgttgtttgcgacccgtatatttgtgtgagttcagatggcatttccccagagttaacaaggaaatatctcggcgaaaaagccgctgaaaacttacaatcattacaaggctacgatcccagcgaatttacattctctaacggtgtattttgcgatgttaaagaaaaattatgtcgtgatgatcgttattttggtgtggatggtaagcggagtggaaaaatcaatcaaaccaccacaaagatgttatttatgtgtcgtgagtga

SEQ ID NO: 3900 - protein, 122 aa, Escherichia coli
MNMMRIFYIGLSGVGMMFSSMASGNDAGGLQSPACGVVCDPYICVSSDGISPELTRKYLGEKAAENLQSLQGYDPSEFTFSNGVFCDVKEKLCRDDRYFGVDGKRSGKINQTTTKMLFMCRE

SEQ ID NO: 3901 - DNA, 696 bp, Escherichia coli
  n 669, 670, 671, 672, 673: n is any nucleotide
ttgagtaaggccaggatgtcaaacacgccaatcgagcttaaaggcagtagcttcactttatctgtggttcatctgcatgaggcagaacctaaggttatccatcaggcgctggaagacaaaatcgctcaggcccccgcatttttaaaacatgcccccgttgtactcaacgtcagtgcactggaagacccggtaaactggtcagcgatgcataaggcggtttcggcaactggtttgcgggttattggcgtaagtggctgcaaagatgcgcaacttaaagccgaaattgaaaagatggggctgcctatcctgacggaaggaaaggaaaaagcgccgcgtccagctcccgcaccgcaggctccagcgcaaaatacaacgccggtcacaaaaacgcgtttaattgataccccagtgcgttccggtcagcgtatttatgctccacaatgtgatctgattgttacaagccacgttagcgcaggggccgaattgattgccgatggtaacattcatgtctatggcatgatgcgcggtcgtgcgctggcaggggcaagtggtgaccgggaaacgcaaatattttgtacgaacctgatggcggaactggtgtccatcgcaggtgaatactggctgagtgatcaaatcccagcagaattttatggcaaagcggcacgactnnnnncattccattcattaattaattaa

SEQ ID NO: 3902 - protein, 231 aa, Escherichia coli
  Xaa 224, 225: Xaa is any amino acid
MSKARMSNTPIELKGSSFTLSVVHLHEAEPKVIHQALEDKIAQAPAFLKHAPVVLNVSALEDPVNWSAMHKAVSATGLRVIGVSGCKDAQLKAEIEKMGLPILTEGKEKAPRPAPAPQAPAQNTTPVTKTRLIDTPVRSGQRIYAPQCDLIVTSHVSAGAELIADGNIHVYGMMRGRALAGASGDRETQIFCTNLMAELVSIAGEYWLSDQIPAEFYGKAARLXXFHSLIN

SEQ ID NO: 3903 - DNA, 600 bp, Escherichia coli; identical to SEQ ID NO: 3627

SEQ ID NO: 3904 - protein, 199 aa, Escherichia coli; identical to SEQ ID NO: 3628

SEQ ID NO: 3905 - DNA, 228 bp, Escherichia coli
atgccgctgatagtacggaaaaacggtgctgaaatttataaccgtaccgcgctggataatacgctgatttacagtggtgttattgatatgccagctggtcgcggccacatgacgctggagttttcggtgtcagcatggctggtgaataactggtatcccacagcaagtatcagcgatttgctggttgtggtgatgaagaaagccaccgcaggcatcagtatcagctga

SEQ ID NO: 3906 - protein, 75 aa, Escherichia coli
MPLIVRKNGAEIYNRTALDNTLIYSGVIDMPAGRGHMTLEFSVSAWLVNNWYPTASISDLLVVVMKKATAGISIS

SEQ ID NO: 3907 - DNA, 600 bp, Escherichia coli; identical to SEQ ID NO: 3627

SEQ ID NO: 3908 - protein, 199 aa, Escherichia coli; identical to SEQ ID NO: 3628

SEQ ID NO: 3909 - DNA, 228 bp, Escherichia coli; identical to SEQ ID NO: 3905

SEQ ID NO: 3910 - protein, 75 aa, Escherichia coli; identical to SEQ ID NO: 3906

SEQ ID NO: 3911 - DNA, 222 bp, Escherichia coli
  n 196, 197, 198, 199, 200: n is any nucleotide
atgagccataagtcgggggaaaagactctcaccccggatgggatgagaggaaatgaattactcttcgctaaaccagtcgctgttttcctggcggatctggcgcacagattcgctgatttcctgcaaatgttgcgtcattgcacgttctaccgcatcgccatcacgtttttgcagggcagagaaaatatcaagatgnnnnncattcattcattaattaattaa

SEQ ID NO: 3912 - protein, 73 aa, Escherichia coli
  Xaa 66, 67: Xaa is any amino acid
MSHKSGEKTLTPDGMRGNELLFAKPVAVFLADLAHRFADFLQMLRHCTFYRIAITFLQGRENIKMXXIHSLIN

SEQ ID NO: 3913 - DNA, 150 bp, Escherichia coli
  n 8, 9, 10, 11, 12: n is any nucleotide
atgaatgnnnnncatcttgatattttctctgccctgcaaaaacgtgatggcgatgcggtagaacgtgcaatgacgcaacatttgcaggaaatcagcgaatctgtgcgccagatccgccaggaaaacagcgactggtttagcgaagagtaa

SEQ ID NO: 3914 - protein, 49 aa, Escherichia coli
  Xaa 3, 4: Xaa is any amino acid
MNXXHLDIFSALQKRDGDAVERAMTQHLQEISESVRQIRQENSDWFSEE

SEQ ID NO: 3915 - DNA, 204 bp, Escherichia coli
atgacgacctacgatcgtaaccgtaacgcaatcaccactggcagccgtgttatggttagcggcaccggtcacactggcaagatcctgtcgattgatactgaaggtctgaccgctgagcaaatccgccgcggaaaaaccgtagttgttgaaggttgtgaagagaaactggcaccactggacctgattcgtctcggcatgaactaa

SEQ ID NO: 3916 - protein, 67 aa, Escherichia coli
MTTYDRNRNAITTGSRVMVSGTGHTGKILSIDTEGLTAEQIRRGKTVVVEGCEEKLAPLDLIRLGMN

SEQ ID NO: 3917 - DNA, 1461 bp, Escherichia coli
atgggaaatcatttgttatcagcaaaagcgacgctccctgtttatgatcgtaataacctggccccaagaattgttcatttaggctttggtgcatttcaccgtgcgcatcagggcgtgtatgccgatattcttgctacggaacatttcagtgactggggatattatgaggtcaacttaatcggcggcgaacagcaaattgccgatttacaacagcaagataatctttataccgttgcggaaatgtcggctgatgcgtggacggctcgcgtcgttggcgtcgttaaaaaagccttgcacgtacaaatagatggcttagaaaccgtgttggctgcgatgtgtgaaccgcaaatcgcgattgtctctctgacaatcaccgaaaaagggtatttccactctccggcgaccggacagttaatgcttgatcacccgatggtcgttgccgacgtgcaaaatccccaccagccgaaaactgcaacaggggtgattgttgaggcgctggctcgccgtaaagcggcaggacttcccgcatttaccgtcatgtcatgtgacaacatgccagaaaacggtcatgttatgcgtgacgttgtcacttcctatgcgcaagccattgatgtaaaactggcacaatggatcgaagataacgtgactttcccatcaacaatggtggaccgtattgtgcccgcagtgacagaggatacgctggcgaaaatcgaacaacttaccggtgtgcgcgatgcggcaggcgttgcctgtgaacctttccgccagtgggtaatagaagataactttgttgccggacgtccggaatgggaaaaagcgggagctgaactggttagcgatgtgctgccttatgaagaaatgaaactgcgtatgcttaacggcagtcattcattcctggcgtatctgggctatcttgccggatatcagcacattaatgactgcatggaggatgaacattatcgtcatgcggcgtataccttaatgttgcaggaacaagcgccgacgctgaaagtgcagggcgttgatttgcaagattacgctaaccgattaattgaacgctatagcaacccggcgttacgtcatcgaacctggcagattgcgatggatggcagccagaaattgccacagcggatgttggattctgttcgctggcatctggcgcatgacagcaagttcgatctgctggcgctgggcgtcgcgggttggatgcgttatgtcggtggtgttgatgaacagggaaatccgatagaaatcagtgatccactgttacctgttattcagaaggcagtacaaagtagtgctgaagggacagcgcgcgtccagtcactgctggcaattaaggcgatctttggtgatgatttaccaggcaatagtttgtttacgacaaaagtaacggaagcgtacttgtctttattagcgcatggcgcgaaagcgaccgtggcgaaatattccgtgaagtaa

SEQ ID NO: 3918 - protein, 486 aa, Escherichia coli
MGNHLLSAKATLPVYDRNNLAPRIVHLGFGAFHRAHQGVYADILATEHFSDWGYYEVNLIGGEQQIADLQQQDNLYTVAEMSADAWTARVVGVVKKALHVQIDGLETVLAAMCEPQIAIVSLTITEKGYFHSPATGQLMLDHPMVVADVQNPHQPKTATGVIVEALARRKAAGLPAFTVMSCDNMPENGHVMRDVVTSYAQAIDVKLAQWIEDNVTFPSTMVDRIVPAVTEDTLAKIEQLTGVRDAAGVACEPFRQWVIEDNFVAGRPEWEKAGAELVSDVLPYEEMKLRMLNGSHSFLAYLGYLAGYQHINDCMEDEHYRHAAYTLMLQEQAPTLKVQGVDLQDYANRLIERYSNPALRHRTWQIAMDGSQKLPQRMLDSVRWHLAHDSKFDLLALGVAGWMRYVGGVDEQGNPIEISDPLLPVIQKAVQSSAEGTARVQSLLAIKAIFGDDLPGNSLFTTKVTEAYLSLLAHGAKATVAKYSVK

SEQ ID NO: 3919 - DNA, 279 bp, Escherichia coli
ttgaatttatggactaaccgctttacccgaatggctatttctaaagaaattggtggtcttatcgcttccggttttggtcctatcctggcggggattttctgcaccatgacggaatcctggtatccgatcgccattatgatcatggcatattctgtgattggtttaatctctgcgctgaaaatgccagaagtgaaagaccgtgatttaagtgcgctggaagacgccgcagaagatcaaccacatgttgtaagagctgcgcaaccgtccagaagtctgtaa

SEQ ID NO: 3920 - protein, 92 aa, Escherichia coli
MNLWTNRFTRMAISKEIGGLIASGFGPILAGIFCTMTESWYPIAIMIMAYSVIGLISALKMPEVKDRDLSALEDAAEDQPHVVRAAQPSRSL

SEQ ID NO: 3921 - DNA, 1020 bp, Escherichia coli
atgaaaagcattttaattgaaaaaccgaatcaactgtcgattatcgaacgtgaaatacccaccccgtcagcgggtgaagtacgagtaaaagtgaaacttgccggaatttgtggttcagatagccatatttaccgtgggcataatccttttgcgaaatatccgcgcgtcattggtcatgaattctttggcgtcattgatgcagtgggtgacggcgtggaaagcgccagagtcggtgaacgcgttgctgtcgatccggtggtcagctgtgggcattgctatccgtgctctataggtaagccgaacgtttgtacgacacttgctgtattaggtgtgcacgctgacggtggtttcagtgaatatgccgtggttccggcaaaaaatgcgtggaaaattcctgaagctgtggccgatcaatatgcggtgatgatcgaaccttttaccattgcggctaacgttaccggtcatggtcaaccgactgaaaatgataccgttctggtttacggtgccggcccaatcggcctgacgatcgttcaggtattaaaaggcgtctataacgttaaaaatgtgattgttgccgatcgcattgatgaacgactggaaaaagcgaaagagagcggggcagactgggcgattaataacagccagacaccgcttggcgagagtttcgctgaaaaaggcatcaagccgactttaattatcgatgccgcttgtcatccttcaatcttgaaagaggccgtaacgctggcttctccagcggcacgtattgtattgatgggcttctccagtgaaccgtctgaagtgattcagcaaggaattaccggaaaagaactctctattttctcttcacgcttaaatgcaaataaattcccggtcgttatcgactggttaagtaaagggttaattaaaccagaaaaactaattacccatacatttgatttccagcatgttgcggatgccattagtttatttgaacaggatcaaaaacattgctgcaaagtcttactcactttttctgaataa

SEQ ID NO: 3922 - protein, 339 aa, Escherichia coli
MKSILIEKPNQLSIIEREIPTPSAGEVRVKVKLAGICGSDSHIYRGHNPFAKYPRVIGHEFFGVIDAVGDGVESARVGERVAVDPVVSCGHCYPCSIGKPNVCTTLAVLGVHADGGFSEYAVVPAKNAWKIPEAVADQYAVMIEPFTIAANVTGHGQPTENDTVLVYGAGPIGLTIVQVLKGVYNVKNVIVADRIDERLEKAKESGADWAINNSQTPLGESFAEKGIKPTLIIDAACHPSILKEAVTLASPAARIVLMGFSSEPSEVIQQGITGKELSIFSSRLNANKFPVVIDWLSKGLIKPEKLITHTFDFQHVADAISLFEQDQKHCCKVLLTFSE

SEQ ID NO: 3923 - DNA, 1215 bp, Escherichia coli
atgaagatcgtaaaggctgaagtttttgttacctgtccggggcgtaatttcgtcacattaaaaatcaccactgaggacggtattacgggccttggggatgccaccctaaatggacgtgagctttccgtggcctcttatttgcaggatcacctttgtccgcagcttattggtcgcgatgcacaccgtatcgaagatatctggcagtttttctataaaggtgcttactggcgtcgcggtccggttacgatgtcggccatttcagcggttgatatggcgctgtgggatattaaagccaaagctgccaacatgccgctttaccagttactcggcggcgcgtctcgtgaaggggtgatggtttattgccataccaccggtcacagtattgatgaagctctggatgattatgcccgtcatcaggagctgggattcaaagccatccgcgtgcagtgcggaatccctggtatgaaaaccacctacggcatgtcgaaaggtaaaggtctggcttatgaacccgcaaccaaaggacagtggccggaagagcagctgtggtcgacggagaaatacctcgatttcatgccgaaattgtttgacgcggtacgtaacaagtttggttttgatgaacatctgctgcatgacatgcaccatcgcttaacgcctattgaagcggcgcgctttggtaagagcattgaagattatcgcatgttctggatggaagacccgacgcctgcggaaaaccaggaatgcttccgtctcattcgccaacataccgtcacacccatcgcggtgggtgaagtcttcaacagcatctgggactgcaaacaactgattgaagagcaactcatcgattatatccgcaccacgctgacccatgcaggcggaattaccggtatgcgtcggattgccgattttgcttcgctgtatcaggtacgtactggctcacacggtccttccgatttgtcaccagtctgcatggctgcggcgctgcactttgatctgtgggtccccaatttcggtgtccaggaatacatgggttattccgaacaaatgctcgaagtcttcccgcacaactggactttcgataacggctatatgcatccgggagaaaaaccgggccttggcatcgaattcgatgaaaagctggcggcgaaatatccctatgaacctgcttatctgccagtcgcacgtctggaagatggcacgctgtggaactggtaa

SEQ ID NO: 3924 - protein, 404 aa, Escherichia coli
MKIVKAEVFVTCPGRNFVTLKITTEDGITGLGDATLNGRELSVASYLQDHLCPQLIGRDAHRIEDIWQFFYKGAYWRRGPVTMSAISAVDMALWDIKAKAANMPLYQLLGGASREGVMVYCHTTGHSIDEALDDYARHQELGFKAIRVQCGIPGMKTTYGMSKGKGLAYEPATKGQWPEEQLWSTEKYLDFMPKLFDAVRNKFGFDEHLLHDMHHRLTPIEAARFGKSIEDYRMFWMEDPTPAENQECFRLIRQHTVTPIAVGEVFNSIWDCKQLIEEQLIDYIRTTLTHAGGITGMRRIADFASLYQVRTGSHGPSDLSPVCMAAALHFDLWVPNFGVQEYMGYSEQMLEVFPHNWTFDNGYMHPGEKPGLGIEFDEKLAAKYPYEPAYLPVARLEDGTLWNW

SEQ ID NO: 3925 - DNA, 336 bp, Escherichia coli
gtgacaaagatgattaaaacaacgttactattttttgctactgcgctgtgtgaaattattggatgctttttgccctggctgtggttgaagcgaaacgccagtatctggctgttgcttccggcggggatttcactggcgctgtttgtctggttgttaacgttgcatcctgcggcgagtgggcgtgtttacgcggcttatggtggcgtttatgtctgcacggcgttgatttggctgcgcgttgtggatggcgtgaaactgactctttatgactggacgggggcgttaattgcgctttgcggcatgttgatcattgttgcgggctgggggcgcacgtag

SEQ ID NO: 3926 - protein, 111 aa, Escherichia coli
MTKMIKTTLLFFATALCEIIGCFLPWLWLKRNASIWLLLPAGISLALFVWLLTLHPAASGRVYAAYGGVYVCTALIWLRVVDGVKLTLYDWTGALIALCGMLIIVAGWGRT

SEQ ID NO: 3927 - DNA, 342 bp, Escherichia coli
atgaaaatcactctcagcaaacgaatcggcctgctcgcttttctgctgccttgcgcactggcattgagcacaactgttcatgccgaaactaacaaactggtgattgagtctggcgacagtgcacaaagccgccagcgcgccgctatggaaaaagagcaatggaatgacacgcgtaatctgcgccagaaagtgaataaacgcactgaaaaagagtgggataaagccgacgctgcttttgataaccgcgataaatgtgagcaaagcgccaacatcaatgcctactgggagccaaatactttgcgctgcctggaccgtcgaactggccgcgttattatcccctaa

SEQ ID NO: 3928 - protein, 113 aa, Escherichia coli
MKITLSKRIGLLAFLLPCALALSTTVHAETNKLVIESGDSAQSRQRAAMEKEQWNDTRNLRQKVNKRTEKEWDKADAAFDNRDKCEQSANINAYWEPNTLRCLDRRTGRVIIP

SEQ ID NO: 3929 - DNA, 561 bp, Escherichia coli
atgccaagcgcccacagtgttaagctacgcccgctggagcgtgaagatttacgctatgtacatcaactcgacaataacgccagtgtgatgcgttactggtttgaggaaccctacgaagcctttgttgaactctctgatctgtatgataagcatattcacgatcagagcgaacggcgctttgtggtggaatgtgacggcgaaaaagccggtctggtggagctggtggaaattaaccatgttcatcgccgcgcagaatttcagataattatctccccggagtatcaggggaaaggtctggcaacccgtgccgccaaattagcaatggactatggcttcaccgttctcaatctctataagctgtatctgatcgttgataaagagaatgaaaaagcgattcacatttaccgcaagcttggctttacggttgaaggtgaattgatgcatgagttctttattaatggtcaatatcgtaatgccattcgcatgtgtatattccagcatcagtatctggctgagcacaaaacaccgggtcagactctcctgaagccgaccgcacaatag

SEQ ID NO: 3930 - protein, 186 aa, Escherichia coli
MPSAHSVKLRPLEREDLRYVHQLDNNASVMRYWFEEPYEAFVELSDLYDKHIHDQSERRFVVECDGEKAGLVELVEINHVHRRAEFQIIISPEYQGKGLATRAAKLAMDYGFTVLNLYKLYLIVDKENEKAIHIYRKLGFTVEGELMHEFFINGQYRNAIRMCIFQHQYLAEHKTPGQTLLKPTAQ

SEQ ID NO: 3931 - DNA, 711 bp, Escherichia coli
gtgaaatacaaattactgccatgcttactcgcgatattactcacaggatgtgaccgcacagaggtaacactttcatttaccccggagatggccagtttctctaatgaattcgattttgatccgctgcgtggtcccgtaaaagatttcactcagacattaatggatgagcaaggtgaagtgacgaaacgtgtttcggggactttgtcggaagaaggctgttttgattctctcgaattactggatctggaaaataataccttggttgccctggtactggacgccaattattaccgtgatgctgagacgctggagaaaagagttcgtttgcagggaaaatgccagctagcagaattaccttctgccggggtgagttgggaaaccgatgataatggtttcgtgattaaagccagcagcaaacagatgcagatggaatatcgctatgatgatcaggggtatccgctgggtaaaaccacgaaaagtaacgataaaacattatctgtcagcgccacgccatcaacggacccgatcaaaaaattagattacacagcggttactttactgaataatcaacgggttggaaatgtaaaacagagctgtgaatatgacaatcacgccaatccggtggactgtcagctaatcattgttgatgaaggagtaaaacccgccgtcgaacgggtttacaccatcaaaaatacgatcgattattattaa

SEQ ID NO: 3932 - protein, 236 aa, Escherichia coli
MKYKLLPCLLAILLTGCDRTEVTLSFTPEMASFSNEFDFDPLRGPVKDFTQTLMDEQGEVTKRVSGTLSEEGCFDSLELLDLENNTLVALVLDANYYRDAETLEKRVRLQGKCQLAELPSAGVSWETDDNGFVIKASSKQMQMEYRYDDQGYPLGKTTKSNDKTLSVSATPSTDPIKKLDYTAVTLLNNQRVGNVKQSCEYDNHANPVDCQLIIVDEGVKPAVERVYTIKNTIDYY

SEQ ID NO: 3933 - DNA, 306 bp, Escherichia coli
atgaaactctcaacctgctgtgccgcgcttctgctcgccctcgcctcacccgcggtactcgccgcgccgggatcctgtgagcgcatacagagcgatatatcacagcgcattatcaataatggcgtacccgaaagcagcttcacgttaagtattgtacccaatgaccaggttgatcagcctgattcccaggtcgtcgggcattgcgctaatgatacgcataaaattctctacacccgtaccaccagcggtaacgtctctgctcccgcgcagtctacccaggataacgcgcctgctgaaccgcagtaa

SEQ ID NO: 3934 - protein, 101 aa, Escherichia coli
MKLSTCCAALLLALASPAVLAAPGSCERIQSDISQRIINNGVPESSFTLSIVPNDQVDQPDSQVVGHCANDTHKILYTRTTSGNVSAPAQSTQDNAPAEPQ

SEQ ID NO: 3935 - DNA, 1158 bp, Escherichia coli
atgtccaaaaatgaacaaatggtgggcatcagccgcagaacactcgttaaatctaccgcgataggttctctggcgctggctgcaggcggtttttctttgccgtttaccctgcgcagtgcagaagcagcggtacaacaggccaacgaaaaagtggtctggggtgcctgttccgtcaactgtggtagccgctgtgcacttcgtctgcatgttaaagataatgaagtgacctgggtggaaactgacaacaccggcagcgacgagtatggcaaccatcaggtacgcgcctgtttgcgcggtcgctccatccgtcggcgtattaatcatcccgatcgcctgaattacccaatgaaacgcgtgggcaaacgcggcgaaggcaaattcgaacggattagctgggatgaagccctggatactatcgccagtagcctgaaaaaaaccgtcaaacaatatggcaatgaggctgtatatattcagtactcttcggggattgttggcggcaatatgacccgctcttctccatcagcctcggcggtcaaacgcctgatgaactgctacggcggttcactaaatcagtatggctcctacagcactgcgcaaatttcctgtgccatgccctacacctacggcagtaatgatggcaacagcaccacggatattgaaaacagcaagctggtcgtgatgtttggtaacaacccggctgaaacccgcatgagcggcggtggcatcacttatcttcttgaaaaagcacgcgagaaatcgaacgcaaaaatgattgttatcgatccgcgatataccgatacggctgctggtcgtgaagatgaatggcttcctattcgccctggcaccgatgccgcgctggttgcgggtattgcctgggtattgattaacgaaaatctcgttgatcaaccttttctcgataaatactgcgtcggctatgacgaaaaaaccttacccgcagatgcacccaaaaatggtcactataaagcctatattcttggtgaaggcgatgataaaacagcgaaaacgccgcagtgggcttcgcaaattacaggtatcccggtagaccgtatcatcaaactggcgcgtgaaattgcacagcaaaacccgcttatatctgccagggctgggggccgcaacgccaggcaaacggcgagctga

SEQ ID NO: 3936 - protein, 385 aa, Escherichia coli
MSKNEQMVGISRRTLVKSTAIGSLALAAGGFSLPFTLRSAEAAVQQANEKVVWGACSVNCGSRCALRLHVKDNEVTWVETDNTGSDEYGNHQVRACLRGRSIRRRINHPDRLNYPMKRVGKRGEGKFERISWDEALDTIASSLKKTVKQYGNEAVYIQYSSGIVGGNMTRSSPSASAVKRLMNCYGGSLNQYGSYSTAQISCAMPYTYGSNDGNSTTDIENSKLVVMFGNNPAETRMSGGGITYLLEKAREKSNAKMIVIDPRYTDTAAGREDEWLPIRPGTDAALVAGIAWVLINENLVDQPFLDKYCVGYDEKTLPADAPKNGHYKAYILGEGDDKTAKTPQWASQITGIPVDRIIKLAREIAQQNPLISARAGGRNARQTAS

SEQ ID NO: 3937 - DNA, 1164 bp, Escherichia coli
ttgccggtgctggataatccggtcaaaacgtcaatctcctgcttcagctggacagatgctatcgatcatggcccgcaaatgacggcaatccgcgacggcgtccggggcaaagataaactagatgtgcccattaagttcatctggaactacgcgggaaataccctggttaatcagcattctgacatcaacaaaacgcatgaaattctgcaggacgaatcgaaatgcgaaatgattgtggtcatcgaaaactttatgacctcatcggcaaaatatgccgacattctgctgccagacctgatgaccgttgagcaggaagatattattcctaacgactacgccggtaacatgggatatctcattttcctccagcctgtcaccagcgaaaaattcgaacgcaaaccaatttactggatcctgagtgaagtcgcgaaacgtcttggacctgacgtctatcaaaagttcactgaaggtcgcacgcaggaacaatggttacaacatctgtacgccaaaatgcttgccaaagatccggcgttaccgtcttacgacgaattaaaaaaaatgggtatctataagcgtaaagatcccaatggtcattttgtcgcctacaaagcatttcgtgacgaccccgaggcaaatccacttaaaacgccttccggtaagattgaaatttattccagcaagctggcggaaattgcccgtacctgggaactggaaaaagatgaagtgataagcccactgccggtttatgcctcaacctttgaaggctgggactcccctgaacgtagtgccttcccactgcaactgtttggtttccattacaaatcccgtacgcactcgacctacgacaacattgatgtcctgaaggcagcctgccgtcaggaagtgtggatcaaccctatagatgcacagaaacgtgggattgccaacggcgatatggtgcgggtgtttaaccatcgtggcgaagttcggctaccagccaaagtgacaccacgcattctccctggagttagtgctatgggccagggagcctggcacgaggccaatatgtctggcgataaaatcgaccacggcggctgtgtgaatacgctaaccactctgcgaccttcaccactggcgaagggaaacccgcagcacactaatctggtcgagatcgaaaaaatataa

SEQ ID NO: 3938 - protein, 387 aa, Escherichia coli
MPVLDNPVKTSISCFSWTDAIDHGPQMTAIRDGVRGKDKLDVPIKFIWNYAGNTLVNQHSDINKTHEILQDESKCEMIVVIENFMTSSAKYADILLPDLMTVEQEDIIPNDYAGNMGYLIFLQPVTSEKFERKPIYWILSEVAKRLGPDVYQKFTEGRTQEQWLQHLYAKMLAKDPALPSYDELKKMGIYKRKDPNGHFVAYKAFRDDPEANPLKTPSGKIEIYSSKLAEIARTWELEKDEVISPLPVYASTFEGWDSPERSAFPLQLFGFHYKSRTHSTYDNIDVLKAACRQEVWINPIDAQKRGIANGDMVRVFNHRGEVRLPAKVTPRILPGVSAMGQGAWHEANMSGDKIDHGGCVNTLTTLRPSPLAKGNPQHTNLVEIEKI

SEQ ID NO: 3939 - DNA, 2424 bp, Escherichia coli
atgaaaatccataacacagaggcgctcatgtcggctgaaatcagtcgtagaagtctgatgaaaacctccgcacttggcagtctcgcgctggcaagcagtgctttcactttgccgttttcccaaatggtccgagcggcacaggcaccggtagaagagaaagcggtctggagttcctgcaccgttaactgcgggagccgctgtctgttacgtttgcatgtgaaagatgacaccgtgtactgggtggagtctgatacgacaggtgacgacgtttacggtaatcatcaggttcgggcatgtttacgcgggcgctctatccgccgacggatgaatcatcctgacaggttgaaatatcccatgaagcgcgtcggcaagcgcggtgaaggtaaatttgaacggataagttgggacgaagccctggataccatcagtgataatcttcggcggatcctaaaagattacggcaatgaggctgtacatgttctctatggaacaggcgtagatggcggaaacatcaccaactcaaacgtcccgtaccgtctgatgaactcttgcggtggttttctcagtcgctatggcagctacagtaccgcacagatcagtgccgcaatgagttatatgttcggtgccaatgatggcaacagcccggatgatatcgccaatacgaaactggtcgttatgttcggaaataacccggcagaaacacggatgagcggcggtggtgtcacttactacgtcgagcaagcccgcgaacgttcaaacgcacgcatgatcgtcatcgatccacgttataacgacacagctgccgggcgtgaagatgaatggctgcccattcgccctggcaccgatggcgcactggcctgtgcaattgcctgggtactgattactgaaaacatggtcgatcagccatttctcgacaaatattgtgttggttacgatgaaaaaacgctgccagctaacgctccacgtaacgcgcattataaagcctatattctgggcgaagggcctgacggcatagctaaaacgccggaatgggcagcaaaaatcaccagcatcccggcagaaaaaattatccagttggcacgagagatcggttcagcaaaaccggcttatatttgtcaggggtgggggccacaacgacattccaacggcgagcaaacgtcccgcgctattgccatgctttccgttctcaccggtaacgtcggcataaacggcggcaactcaggtgtacgcgaaggtagctgggatctgggggtagaatggttcccgatgctcgagaatcctgttaaaacgcagatttccgtctttacatggacagatgctatcgaccatggtacggaaatgaccgcgccccgtgatggtgttcgtggaaaagaaaaactggatgtccccatcaagtttttatggtgctacgccagtaacacattgatcaatcaacatggcgacatcaatcacacccatgaggtgcttcaggatgacagcaagtgcgagatgattgttggcattgaccacttcatgactgcctcggctaagtattgcgatatcctgttacccgacctgatgccaacagagcaagaagacctcatctctcatgagtctgccgggaatatgggctatgtgatcctcgcccaacccgcaacctcagcaaaatttgaacgcaaacccatctactggatgctgagtgaagtcgccaaacgcttaggaccagacgtttatcaaacctttactgaaggtcgcagtcagcatgaatggatcaaatatctccatgcgaaaacgaaggaacgtaaccctgagatgcccgactacgaggagatgaaaacgaccgggatctttaagaaaaaatgcccggaagaacactacgtcgctttccgcgcattccgtgtagatccacaggcaaacccattgaaaacaccttcgggaaaaatcgaaatttattctgaacgactggcgaagattgcggatacctgggaattgaaaaaagatgaaattattcatcctcttccagcttatacgccaggttttgatggctgggacgatcccctgcggaaaacttatccactgcagttaacgggcttccactacaaagcgcgtacccactccagttacggcaatattgatgtattacagcaggcctgcccacaagaggtgtggatcaaccccattgatgctcaggcacgcggtatccgtcatggcgataccgtgcgggtatttaacaataatggagaaatgctgattgccgcaaaagtgactccgcgtattctgcctggcgttaccgccatcgggcaaggtgcttggcttaaagcggatatgtttggtgaccgggtcgatcacggcggcagtatcaatattctgacctctcaccgcccttcaccgctggcaaagggaaacccgtcgcacagcaatcttgtccagatcgaaaaggtttaa

SEQ ID NO: 3940 - protein, 807 aa, Escherichia coli
MKIHNTEALMSAEISRRSLMKTSALGSLALASSAFTLPFSQMVRAAQAPVEEKAVWSSCTVNCGSRCLLRLHVKDDTVYWVESDTTGDDVYGNHQVRACLRGRSIRRRMNHPDRLKYPMKRVGKRGEGKFERISWDEALDTISDNLRRILKDYGNEAVHVLYGTGVDGGNITNSNVPYRLMNSCGGFLSRYGSYSTAQISAAMSYMFGANDGNSPDDIANTKLVVMFGNNPAETRMSGGGVTYYVEQARERSNARMIVIDPRYNDTAAGREDEWLPIRPGTDGALACAIAWVLITENMVDQPFLDKYCVGYDEKTLPANAPRNAHYKAYILGEGPDGIAKTPEWAAKITSIPAEKIIQLAREIGSAKPAYICQGWGPQRHSNGEQTSRAIAMLSVLTGNVGINGGNSGVREGSWDLGVEWFPMLENPVKTQISVFTWTDAIDHGTEMTAPRDGVRGKEKLDVPIKFLWCYASNTLINQHGDINHTHEVLQDDSKCEMIVGIDHFMTASAKYCDILLPDLMPTEQEDLISHESAGNMGYVILAQPATSAKFERKPIYWMLSEVAKRLGPDVYQTFTEGRSQHEWIKYLHAKTKERNPEMPDYEEMKTTGIFKKKCPEEHYVAFRAFRVDPQANPLKTPSGKIEIYSERLAKIADTWELKKDEIIHPLPAYTPGFDGWDDPLRKTYPLQLTGFHYKARTHSSYGNIDVLQQACPQEVWINPIDAQARGIRHGDTVRVFNNNGEMLIAAKVTPRILPGVTAIGQGAWLKADMFGDRVDHGGSINILTSHRPSPLAKGNPSHSNLVQIEKV

SEQ ID NO: 3941 - DNA, 618 bp, Escherichia coli
atgaccacacaatatggattttttatcgattccagccgctgtactggctgtaaaacctgcgaactggcgtgcaaagattttaaagatcttggcccggaagtcagtttccgccgtatttatgaatatgctggcggcgactggcaggaagataatggcgtctggcaccagaacgtgttcgcttattatctctccatctcctgtaaccattgcgatgaccccgcatgtacaaaagtctgccccagcggtgcaatgcataagcgtgaagatggtttcgtggtggttgatgaagatgtttgtatcggctgccgctactgccacatggcttgtccgtacggcgcgccacagtacaatgctgaaaaagggcacatgacgaagtgcgatggttgttattcgcgcgtcgccgaggggaaacaacccatatgtgtcgaatcctgcccactgcgtgcacttgagttcggtccaattgaagaattgcgccagaagcacggcactctggctgccgtcgcgccactgccgcgcgcgcatttcacaaaacccaatatcgttatcaaacctaacgccaacagccgcccgaccggcgataccactggttatctggctaatccggaggaagtgtaa

SEQ ID NO: 3942 - protein, 205 aa, Escherichia coli
MTTQYGFFIDSSRCTGCKTCELACKDFKDLGPEVSFRRIYEYAGGDWQEDNGVWHQNVFAYYLSISCNHCDDPACTKVCPSGAMHKREDGFVVVDEDVCIGCRYCHMACPYGAPQYNAEKGHMTKCDGCYSRVAEGKQPICVESCPLRALEFGPIEELRQKHGTLAAVAPLPRAHFTKPNIVIKPNANSRPTGDTTGYLANPEEV

SEQ ID NO: 3943 - DNA, 855 bp, Escherichia coli
atgggaaatggatggcatgaatggccactggttatctttaccgtattgggtcaatgcgtagtaggcgcgctgattgttagcggaattggctggttcgccgccaaaaataacgcagaccgtcagcacattattcgtggcatgtttttcctctggctgttgatgggcatcgggtttattgcctctgtcatgcacctgggatcgccactgcgggcgtttaactcgctgaatagaatcggagcttctggtctgagtaacgagattgctgccggttccatattttttgccgttggcggattatggtggctggtggcggtcatcggtaaaatgccgcaagcgttggggaaactctggttacttgtcagcatggcgctcggcatcattttcgtctggatgatgacctgcgtgtatcaaatcgacactgtgccaacctggcataacggttacactacgctggctttcttcctgacggtattgttgagcggtccaatacttgctgccacaattctacgtgcagcccgcgttacatttaataccacaccatttgccatcattagcattctggcgctgatcgcttgtgccgggttgattgtgctgcaaggtttgtctctggcgtctattcactcatccgtacaacaagccagcgcactggtaccagattacgcctccttacaggtctggcgtgtggtattgttatgcgcaggtctaggatgctggctttgtccgctcattcgtcgccgtgaacctcacgttgccggacttgttctggggttaatcctcattcttggcggtgagatgatcgggcgtgtgctcttttatggcctgcacatgacggtaggaatggctattgcaggttaa

SEQ ID NO: 3944 - protein, 284 aa, Escherichia coli
MGNGWHEWPLVIFTVLGQCVVGALIVSGIGWFAAKNNADRQHIIRGMFFLWLLMGIGFIASVMHLGSPLRAFNSLNRIGASGLSNEIAAGSIFFAVGGLWWLVAVIGKMPQALGKLWLLVSMALGIIFVWMMTCVYQIDTVPTWHNGYTTLAFFLTVLLSGPILAATILRAARVTFNTTPFAIISILALIACAGLIVLQGLSLASIHSSVQQASALVPDYASLQVWRVVLLCAGLGCWLCPLIRRREPHVAGLVLGLILILGGEMIGRVLFYGLHMTVGMAIAG

SEQ ID NO: 3945 - DNA, 615 bp, Escherichia coli
atgacccatttttcacagcaagataatttttctgtcgcggcgcgcgtgttgggcgcgctgttttattacgctccagagagtgcggaagccgcacctctggttgcggtactcaccaatgacagctgggaaactcagtggcctctaccagaagcgtcattagcgccgctggtgacggcttttcagacacagagtgaagagactcacgcccaggcctggcagcgtttgtttgtcggcccgtgggcactgccgtctccgccgtggggatcggtctggctggatcgcgaatctgtgctgtttggcgattcaacattggcacttcgtcagtggatgcgcgagaaaggcattcagttcgaaatgaagcaaaacgaaccggaagatcattttggttcactgctgctgatggctgcgtggttggcggagaatggtcgccagacagaatgcgaagaattgctggcatggcacctttttccgtggtcaacacgttttcttgacgtttttatcgaaaaagcagaacaccctttctaccgtgcactgggtgaactcgctcgcttaacgctggcgcaatggcaatcacaactgttgattcctgtcgcggttaaaccgctgtttcgatag

SEQ ID NO: 3946 - protein, 204 aa, Escherichia coli
MTHFSQQDNFSVAARVLGALFYYAPESAEAAPLVAVLTNDSWETQWPLPEASLAPLVTAFQTQSEETHAQAWQRLFVGPWALPSPPWGSVWLDRESVLFGDSTLALRQWMREKGIQFEMKQNEPEDHFGSLLLMAAWLAENGRQTECEELLAWHLFPWSTRFLDVFIEKAEHPFYRALGELARLTLAQWQSQLLIPVAVKPLFR

SEQ ID NO: 3947 - DNA, 696 bp, Escherichia coli
atgctgaagcgtttctttattaccggtacagacacttctgtagggaaaacggtggtttcccgcgcattgctacaagcgttagcctcccagggaaaaacggttgcgggatataaacccgtagcgaaggggagcaaagagacacccgaagggctgcgtaataaagatgccctggtgttgcagagtgtttcaaccatcgaactgccttatgaagcagttaatcctatcgcgttaagcgaagaagaaagtagcgtggcgcacagttgcccaatcaattacaccctcatttcaaacggcctggcaaacctgaccgataaagtcgatcatgtcgtggtagaagggactggcggctggcgcagtctgatgaatgatttgcgtccgctctctgaatgggtggtgcaggaacaactgccggtgttgatggttgtcggtattcaggaaggttgcattaaccatgcactgctaacagctcaggcgattgccaacgacgggctgccgctcattggctgggtggctaaccgaatcaacccaggactggcgcattatgcggaaatcattgatgtgctcggtaaaaaacttccggcaccgctcattggtgaactgccttatctgccgcgcgccgaacagcgtgaactggggcaatacatccgcttagctatgcttcgcagtgtgctggcggtagatagagtcacggtgtaa

SEQ ID NO: 3948 - protein, 231 aa, Escherichia coli
MLKRFFITGTDTSVGKTVVSRALLQALASQGKTVAGYKPVAKGSKETPEGLRNKDALVLQSVSTIELPYEAVNPIALSEEESSVAHSCPINYTLISNGLANLTDKVDHVVVEGTGGWRSLMNDLRPLSEWVVQEQLPVLMVVGIQEGCINHALLTAQAIANDGLPLIGWVANRINPGLAHYAEIIDVLGKKLPAPLIGELPYLPRAEQRELGQYIRLAMLRSVLAVDRVTV

SEQ ID NO: 3949 - DNA, 1242 bp, Escherichia coli
gtgtttcattgcccatttctgctcatgcatcatctacacatctatccggatctgcgcactatgttccgccgtctgcttatcgcaacaatcgtcggtattcttgcggcctttgccgttgccgggtttcgtcatgcgatgctgctactggagtggctgttcctcaataatgactccggcagtctggtcaatgcagcgacaaatctttccccgtggcgacggctgctaaccccggcgctcggcggactggcggcgggtttgttgctgatgggctggcagaaatttacccagcaacgccctcatgcgccgaccgattacatggaagcgttgcaaaccgatggtcagtttgattacgcagcaagcctggttaaatcgcttgcctctctactggtagtaaccagcggcagtgcaattggtcgcgaaggtgcgatgattcttttagctgcccttgcagcctcgtgttttgcccaacgtcttacgccacgccaggagtggaaattatggatcgcctgtggagctgcggcgggaatggctgcggcctatcgcgccccgcttgctggcagtttatttatagccgaagtgctgtttggcactatgatgttggcctctctcggcccggtgattatttccgccgtcgtggcgttgctggttagcaatcttattaatcatagcgacgcattactctacagcggaccactgttgttaacgttaatgaacgcctgtcatcgtggatttgtgagtctcaagcttgcgccgccctggcaactggcactgggcgggttgatcgtgggtctgctttccctgttcacacctgcagtgtggggcaacggctatagcaccgtacaatcctttttaaccgctccgccactgttaatgatcattgccgggatcttcctctgtaaactgtgtgccgtgctggcgagtagtggttctggcgcgcccggtggtgtctttacaccgacgctatttatcggtcttgccattggcatgttgtatggtcgtagcctgggattatggttacctgatggcgaagaaattacgcttttactcggattgacagggatggcgacactgttggcggcgaccacgcacgcgccgattatgtcgacgttgatgatatgtgaaatgaccggggagtatcagctactccccggtttattgattgcctgcgtaattgcgtcggtaatttcgcggacgttacaccgtgactctatctaccgccagcacactgcgaagcatagctaa

SEQ ID NO: 3950 - protein, 413 aa, Escherichia coli
MFHCPFLLMHHLHIYPDLRTMFRRLLIATIVGILAAFAVAGFRHAMLLLEWLFLNNDSGSLVNAATNLSPWRRLLTPALGGLAAGLLLMGWQKFTQQRPHAPTDYMEALQTDGQFDYAASLVKSLASLLVVTSGSAIGREGAMILLAALAASCFAQRLTPRQEWKLWIACGAAAGMAAAYRAPLAGSLFIAEVLFGTMMLASLGPVIISAVVALLVSNLINHSDALLYSGPLLLTLMNACHRGFVSLKLAPPWQLALGGLIVGLLSLFTPAVWGNGYSTVQSFLTAPPLLMIIAGIFLCKLCAVLASSGSGAPGGVFTPTLFIGLAIGMLYGRSLGLWLPDGEEITLLLGLTGMATLLAATTHAPIMSTLMICEMTGEYQLLPGLLIACVIASVISRTLHRDSIYRQHTAKHS

SEQ ID NO: 3951 - DNA, 1221 bp, Escherichia coli
gtggttgctgaaaatcagcctgggcacattgatcaaataaagcagaccaacgcgggcgcggtttatcgcctgattgatcagcttggtccagtctcgcgtatcgatctttcccgtctggcgcaactggctcctgccagtatcactaaaattgtccgtgagatgctcgaagcacacctggtgcaagagctggaaatcaaagaagcggggaaccgtggccgtccggcagtggggctggtggttgaaactgaagcctggcactatctttctctgcgcattagtcgcggggagattttccttgctttgcgcgatctgagcagcaaactggtagtggaggagtcgcaggaactggcgttaaaagatgactcgccattgctggatcgtatcatttcccatatcgatcagttttttatccgccaccagaaaaaacttgagcgtctgacttcgattgccataaccttgccgggaattattgatacggaaaatggtattgtacatcgcatgccgttctacgaggatgtaaaagagatgccgctcggcgaggcgctggagcagcataccggcgtaccggtttatattcagcatgatatcagcgcatggacgatggctgaggccttgtttggtgcctcacgcggggcgcgcgatgtgattcaggtggttatcgatcacaacgtgggggcgggcgtcattaccgatggtcatctgctacacgcaggcagcagtagcctcgtggaaataggccacacacaggtcgacccgtatgggaaacgctgttattgcgggaatcacggttgcctcgaaaccatcgccagtgtggacagtattcttgagctggcacagctgcgtctcaatcaatccatgagctcgatgttacatggacaaccgttaaccgtggactcattgtgtcaggcggcattgcgcggcgatctactggcaaaagacatcattaccggggtaggcgcgcatgtcggtcgcattcttgccatcatggtgaatttatttaacccacaaaaaatactgattggctcaccgttaagtaaagcggcagatatcctcttcccagttatctcggacagcatccgtcagcaggcccttcctgcgtatagtcagcacattagcgttgagagtactcagttttctaaccagggcacgatggcaggcgctgcgctggtaaaagacgcgatgtataacggttctttgttgattcgtctgttgcagggttaa

SEQ ID NO: 3952 - protein, 406 aa, Escherichia coli
MVAENQPGHIDQIKQTNAGAVYRLIDQLGPVSRIDLSRLAQLAPASITKIVREMLEAHLVQELEIKEAGNRGRPAVGLVVETEAWHYLSLRISRGEIFLALRDLSSKLVVEESQELALKDDSPLLDRIISHIDQFFIRHQKKLERLTSIAITLPGIIDTENGIVHRMPFYEDVKEMPLGEALEQHTGVPVYIQHDISAWTMAEALFGASRGARDVIQVVIDHNVGAGVITDGHLLHAGSSSLVEIGHTQVDPYGKRCYCGNHGCLETIASVDSILELAQLRLNQSMSSMLHGQPLTVDSLCQAALRGDLLAKDIITGVGAHVGRILAIMVNLFNPQKILIGSPLSKAADILFPVISDSIRQQALPAYSQHISVESTQFSNQGTMAGAALVKDAMYNGSLLIRLLQG

SEQ ID NO: 3953 - DNA, 894 bp, Escherichia coli
atgaatcttgaacttcgtcatctgcgttactttgtcgctgttgcagaagagctgcatttcgggcgtgccgctgcccgcctgaatatttcgcaaccaccgctaagtcagcagattcaggcgctggagcaacaaattggtgcccgactgctggcacggaccaatcgcagtgtattgctgacggaagcaggaaaacagtttcttgtagatagtcggcaaatcctgtctatggtggatgatgctgccgctcgcgctgaaaggctgcatcagggcgaagcgggggagttgcgcattggttttacttcgtccgctccttttattcgggcggtgtccgatacgttatcgctgtttcgccgtgattatcccgatgtccatttacaaacccgcgaaatgaacactcgcgagcaaatcgctccgctcattgaaggaacgctggatatgggattgctgcgtaacacagcgttaccggagacgcttgaacacgcagtcatcgtccatgaaccgcttatggcgatgatcccgcacgatcatcccctggcaaataacccgagtgtaacgctggctgaactggcgaaagaaccctttgtcttttttgatccgcacgtcggaacagggctgtatgacgatattctcgggctgatgagacgttacaatttgacgcccgtcatcactcaggaggtgggtgaggcaatgaccatcatcggtctggtttccgctggtctgggtgtttcaattttgcctgcgtcatttaaacgtgttcagctcaacgaaatgcgctgggtgccgattgctgaagaggatgcggtttctgaaatgtggttggtctggccgaaacatcatgaacaaagtccggctgcgcgtaactttcgtattcatctgctgaatgctctcaggtga

SEQ ID NO: 3954 - protein, 297 aa, Escherichia coli
MNLELRHLRYFVAVAEELHFGRAAARLNISQPPLSQQIQALEQQIGARLLARTNRSVLLTEAGKQFLVDSRQILSMVDDAAARAERLHQGEAGELRIGFTSSAPFIRAVSDTLSLFRRDYPDVHLQTREMNTREQIAPLIEGTLDMGLLRNTALPETLEHAVIVHEPLMAMIPHDHPLANNPSVTLAELAKEPFVFFDPHVGTGLYDDILGLMRRYNLTPVITQEVGEAMTIIGLVSAGLGVSILPASFKRVQLNEMRWVPIAEEDAVSEMWLVWPKHHEQSPAARNFRIHLLNALR

SEQ ID NO: 3955 - DNA, 1254 bp, Escherichia coli
gtgagccgtactacaactgttgatggcgctccggcaagcgacactgacaagcaaagcatttctcagtcaaatcaatttattaaacgcggtacgccgcaatttatgcgcgtcaccctggcgcttttctctgccggactggcaactttcgcacttctctattgtgtgcaacctatccttccggtgctttcacaagagtttggcttaacgcccgcgaacagtagtatttcactgtccatttcaacggcgatgttggctatcggtttgctgtttactggcccgctatccgatgccattggtcgcaaaccagtgatggtcacggcgctactgttggcctccatttgtacgttactttcgacaatgatgaccagctggcacggcattttgattatgcgcgccttgattgggctttcgttaagtggcgtggcagccgttggcatgacttatcttagcgaggaaatccaccccagtttcgtggccttttcaatggggttgtatatcagcggcaactcaattggcggcatgagcggacgcttaattagcggtgtcttcacggacttttttaactggcgaattgctctggcggcaatcggttgtttcgcgttggcctcggcgttgatgttctggaaaatcctccctgaatcacgccattttcgcccgacttcgctgcgccctaagacgttattcatcaactttcgtctgcactggcgtgaccggggattaccgttattgttcgcagaaggctttttgctgatggggtcgttcgtcacgctgtttaattacatcggctataggttgatgctttccccctggcatgtcagtcaggccgtggttggcttattatcgctggcttatttgaccggtacatggagctcacccaaagccggaaccatgaccacccgctatggacgcggtccggtgatgttgttttcgacgggggttatgctgtttggtttactgatgaccttattcagctcgctgtggctgatctttgccggaatgttactcttctcagccggattcttcgcagcccactccgttgccagcagctggatcggcccccgcgcaaaacgcgctaaaggccaggcctcctcgctgtatctgttcagttactatctggggtcgagtattgccgggacgctgggtggtgttttctggcataactatggctggaacggcgtcggcgcatttattgctctgatgctggtcattgctctgctggtcgggacgcgtttgcatcatcgtctgcacgcctga

SEQ ID NO: 3956 - protein, 417 aa, Escherichia coli
MSRTTTVDGAPASDTDKQSISQSNQFIKRGTPQFMRVTLALFSAGLATFALLYCVQPILPVLSQEFGLTPANSSISLSISTAMLAIGLLFTGPLSDAIGRKPVMVTALLLASICTLLSTMMTSWHGILIMRALIGLSLSGVAAVGMTYLSEEIHPSFVAFSMGLYISGNSIGGMSGRLISGVFTDFFNWRIALAAIGCFALASALMFWKILPESRHFRPTSLRPKTLFINFRLHWRDRGLPLLFAEGFLLMGSFVTLFNYIGYRLMLSPWHVSQAVVGLLSLAYLTGTWSSPKAGTMTTRYGRGPVMLFSTGVMLFGLLMTLFSSLWLIFAGMLLFSAGFFAAHSVASSWIGPRAKRAKGQASSLYLFSYYLGSSIAGTLGGVFWHNYGWNGVGAFIALMLVIALLVGTRLHHRLHA

SEQ ID NO: 3957 - DNA, 336 bp, Escherichia coli
atgaaaaaacaaattgagggtatgacaatgaaaaaagtattagctctggttgttgccgctgctatgggtctgtcttctgctgcctttgctgcagagactgcgaccacacctgctccgactgcgacgaccaccaaagcagcgcctgcgaaaaccacacatcataaaaaacagcataaagcagcacctgcccagaaagcgcaggcggctaaaaagcatcataaaaatgccaaagctgaacagaaagctcctgaacaaaaagcgcaggcagcgaagaaacacgccaagaaacacagccatcagcaaccggcaaaacctgctgcacaacccgcagcgtaa

SEQ ID NO: 3958 - protein, 111 aa, Escherichia coli
MKKQIEGMTMKKVLALVVAAAMGLSSAAFAAETATTPAPTATTTKAAPAKTTHHKKQHKAAPAQKAQAAKKHHKNAKAEQKAPEQKAQAAKKHAKKHSHQQPAKPAAQPAA

SEQ ID NO: 3959 - DNA, 783 bp, Escherichia coli
ttgacgtctgcttttgtgtttgcagataaaccagacgttgccaaatcggcaaacgatgaggtcagcaccctgttttttggtcatgatgatcgtgtgccagtgaatgacacgacccaatcaccgtgggatgcggttggccaactggaaacggccagcggcaatttatgtacggcgacgctgattgcacccaatctggcattaacggcaggacactgtttattgacgccgccaaagggtaaagccgataaagcggtagcgctgcgtttcgtgtcaaataaaggtctttggcgctatgagatccacgacatagaaggccgcgttgatccgacactgggaaagcggttaaaagcagatggggatggctggattgtacctcccgcagctgcgccctgggacttcggtttgattgtgctacgtaatcccccttctggcattacaccgttgccgttatttgagggagataaagccgcgcttaccgccgcattaaaagcggctggtcgtaaagtgactcaggcgggctaccctgaagatcatctcgatacgttgtacagtcatcaaaactgtgaagtgactggctgggcgcaaacgtcggtgatgtcgcatcagtgcgataccttgccgggtgacagcggttcgcctctgatgttgcataccgatgacggctggcaattaattggggtgcaaagctcggctcctgccgcgaaagatcgctggcgcgccgataaccgggccatttctgttaccggttttcgcgacaagctggatcaactgtcgcaaaaataa

SEQ ID NO: 3960 - protein, 260 aa, Escherichia coli
MTSAFVFADKPDVAKSANDEVSTLFFGHDDRVPVNDTTQSPWDAVGQLETASGNLCTATLIAPNLALTAGHCLLTPPKGKADKAVALRFVSNKGLWRYEIHDIEGRVDPTLGKRLKADGDGWIVPPAAAPWDFGLIVLRNPPSGITPLPLFEGDKAALTAALKAAGRKVTQAGYPEDHLDTLYSHQNCEVTGWAQTSVMSHQCDTLPGDSGSPLMLHTDDGWQLIGVQSSAPAAKDRWRADNRAISVTGFRDKLDQLSQK

SEQ ID NO: 3961 - DNA, 330 bp, Escherichia coli
atggcgcagtttgaatgggttcacgccgcctggctggcattggcaatcgtgctggaaatcgttgctaacgtctttttgaaattttctgacggctttcgtcgcaaaatatttggcttgctctctctggcggcggtgctggctgcctttagtgcgctttctcaggccgttaaagggatcgacttgtctgtcgcttatgcattgtggggcgggtttggtattgccgccacgttagccgcaggttggatcttgtttggtcaaaggttaaatcgtaaaggctggattggcctggtgctgctgttggctggaatgatcatggtgaaacttgcctga

SEQ ID NO: 3962 - protein, 109 aa, Escherichia coli
MAQFEWVHAAWLALAIVLEIVANVFLKFSDGFRRKIFGLLSLAAVLAAFSALSQAVKGIDLSVAYALWGGFGIAATLAAGWILFGQRLNRKGWIGLVLLLAGMIMVKLA

SEQ ID NO: 3963 - DNA, 366 bp, Escherichia coli
atgtatatttattggattttattaggtctggctattgctacggaaattaccggtacgctgtcaatgaaatgggcgagcgtcagtgagggaaatggcggctttattttaatgctggtgatgatttctctgtcgtatatatttctctctttcgccgttaaaaaaatcgccttaggcgtagcttatgcgctgtgggaaggtatcggtattttatttattaccttgtttagcgttttgttattcgacgaaagtttatcgctgatgaaaattgccgggttaaccaccctggtggccgggattgtgttgatcaagtcaggtacccgtaaagcgcgtaaacctgaactggaggtgaaccatggcgcagtttga

SEQ ID NO: 3964 - protein, 121 aa, Escherichia coli
MYIYWILLGLAIATEITGTLSMKWASVSEGNGGFILMLVMISLSYIFLSFAVKKIALGVAYALWEGIGILFITLFSVLLFDESLSLMKIAGLTTLVAGIVLIKSGTRKARKPELEVNHGAV

SEQ ID NO: 3965 - DNA, 1035 bp, Escherichia coli
atggcaaagccgatcatcacgctcaatggcctaaaaatcgtcattatgttgggaatgctggtcattattctctgcggtatccgttttgccgccgagatcatcgtgccgtttattctcgcattatttattgctgttattcttaacccgctggtgcaacacatggtccgctggcgtgtgccgcgtgtactggcagtgtcaattttgatgaccatcatcgtgatggcgatggtgttgctgttagcttatctgggttccgcgctcaatgagttgacgcggacgttaccgcaatatcgcaactctattatgacgccgctgcaagcgattgaaccgttgttgcaacgcgtagggattgatgtctcagttgaccaactggcgcattacattgatccgaacgcggcgatgacgttgctcaccaacttattgacgcagttatctaatgccatgtcatcaatatttttattgctgctgacggtgctgtttatgttgctcgaagtgccacaattgcccggaaaatttcagcaaatgatggcgcgtccggttgaagggatggcggcgattcagcgtgcgattgacagtgtgtctcattatctggtgctgaaaacagccatcagcatcatcaccggcctggtcgcctgggcgatgctcgccgcactcgatgttcgcttcgcttttgtctggggattgctggcctttgcgcttaattacatcccgaatattggttcagttctcgcggcaatcccccctatcgctcaggtactggtgtttaatggcttctacgaagcgttgctggtgctggcgggatatctgctgattaatctggtcttcggcaatattctggagccacgcatcatggggcgtgggctggggctttccacattggtggtatttttgtcgttgattttttggggatggttgttaggaccggtgggtatgctgctttccgtgccgttgacaattattgtcaaaattgcgcttgaacaaacagcgggaggtcaaagcatcgccgttctgttaagcgatctcaataaagagtga

SEQ ID NO: 3966 - protein, 344 aa, Escherichia coli
MAKPIITLNGLKIVIMLGMLVIILCGIRFAAEIIVPFILALFIAVILNPLVQHMVRWRVPRVLAVSILMTIIVMAMVLLLAYLGSALNELTRTLPQYRNSIMTPLQAIEPLLQRVGIDVSVDQLAHYIDPNAAMTLLTNLLTQLSNAMSSIFLLLLTVLFMLLEVPQLPGKFQQMMARPVEGMAAIQRAIDSVSHYLVLKTAISIITGLVAWAMLAALDVRFAFVWGLLAFALNYIPNIGSVLAAIPPIAQVLVFNGFYEALLVLAGYLLINLVFGNILEPRIMGRGLGLSTLVVFLSLIFWGWLLGPVGMLLSVPLTIIVKIALEQTAGGQSIAVLLSDLNKE

SEQ ID NO: 3967 - DNA, 1389 bp, Escherichia coli
atgtctggaggattagttacagctgcatacattgttgccgcgatcctgtttatcttcagtctggccgggctttcgaaacatgaaacgtctcgccagggtaacaatttcggtatcgccgggatggcgattgcgttaatcgcaaccatttttggaccggatacgggtaatgttggctggatcttgctggcgatggttattggtggggcaattggtatccgtctggcgaagaaagttgaaatgaccgaaatgccagaactggtggcgatcctgcatagcttcgtgggtctggcggcagtgctggttggctttaacagctatctgcatcatgacgcgggaatggcaccgattctggtcaatattcacctgacggaagtgttcctcggtatcttcatcggggcggtaacgtttacgggttcggtggtggcgttcggcaaactgtgtggcaagatttcgtctaaaccgttgatgctgccaaaccgtcacaaaatgaacctggcagctctggtcgtttccttcctgctactgattgtatttgttcgcacggatagcgtcggcctgcaagtgctggcattgctgataatgaccgccattgcgctggtattcggctggcatttagtcgcctccatcggtggtgcagatatgccagtggtggtgtcgatgctgaactcgtactccggctgggcggctgcggctgcgggctttatgctcagcaacgacctgctgattgtgaccggtgcgctggtcggttcttcgggggctatcctttcttacattatgtgtaaggcgatgaaccgttcctttatcagcgttattgcgggtggtttcggcaccgacggctcttctactggtgatgatcaggaagtgggcgagcaccgcgaaatcaccgcagaagagacagcggaactgctgaaaaactcccattcagtgatcattactccggggtacggcatggcagttgcgcaggcgcaatatcctgtcgctgaaattactgagaaattgcgcgctcgtggtattaacgtgcgtttcggtatccacccggttgcggggcgtttgcctggacatatgaacgtattactggctgaagcaaaagtaccgtatgacatcgtgctggaaatggacgagatcaacgatgactttgctgataccgataccgtactggtgattggtgctaacgatacggttaacccggcggcgcaggatgatccgaagagtccgattgctggtatgcctgtgctggaagtgtggaaagcgcagaacgtgattgtctttaaacgttcgatgaacactggctatgctggtgtgcaaaacccgctgttcttcaaggaaaacacccacatgctgtttggtgacgccaaagccagcgtggatgcaatcctgaaagctctgtaa

SEQ ID NO: 3968 - protein, 462 aa, Escherichia coli
MSGGLVTAAYIVAAILFIFSLAGLSKHETSRQGNNFGIAGMAIALIATIFGPDTGNVGWILLAMVIGGAIGIRLAKKVEMTEMPELVAILHSFVGLAAVLVGFNSYLHHDAGMAPILVNIHLTEVFLGIFIGAVTFTGSVVAFGKLCGKISSKPLMLPNRHKMNLAALVVSFLLLIVFVRTDSVGLQVLALLIMTAIALVFGWHLVASIGGADMPVVVSMLNSYSGWAAAAAGFMLSNDLLIVTGALVGSSGAILSYIMCKAMNRSFISVIAGGFGTDGSSTGDDQEVGEHREITAEETAELLKNSHSVIITPGYGMAVAQAQYPVAEITEKLRARGINVRFGIHPVAGRLPGHMNVLLAEAKVPYDIVLEMDEINDDFADTDTVLVIGANDTVNPAAQDDPKSPIAGMPVLEVWKAQNVIVFKRSMNTGYAGVQNPLFFKENTHMLFGDAKASVDAILKAL

SEQ ID NO: 3969 - DNA, 1587 bp, Escherichia coli
gtggctcctgacacaggcaaaccatcatcaataaaaccgatggaagggaatatcatgcgaattggcataccaagagaacggttaaccaatgaaacccgtgttgcagcaacgccaaaaacagtggaacagctgctgaaactgggttttaccgtcgcggtagagagcggcgcgggtcaactggcaagttttgacgataaagcgtttgtgcaagcgggcgctgaaattgtagaagggaatagcgtctggcagtcagagatcattctgaaggtcaatgcgccgttagatgatgaaattgcgttactgaatcctgggacaacgctggtgagttttatctggcctgcgcagaatccggaattaatgcaaaaacttgcggaacgtaacgtgaccgtgatggcgatggactctgtgccgcgtatctcacgcgcacaatcgctggacgcactaagctcgatggcgaatatcgccggttatcgcgccattgttgaagcggcacatgaatttgggcgcttctttaccggacaaatcactgcggccgggaaagtgccaccggcaaaagtgatggtgattggtgccggtgtcgcaggtctggccgccattggcgcagcaaacagtctcggcgcgattgtgcgtgcattcgacacccgcccggaagtgaaagaacaagttcaaagtatgggcgcagaattcctcgagctggattttaaagaggaagcgggcagcggcgatggctatgccaaagtgatgtcggacgcgttcatcaaagcggaaatggaactctttgccgcccaggcaaaagaggtcgatatcattgtcaccaccgcgcttattccaggcaaaccagcgccgaagctaattacccgtgaaatggttgactccatgaaggcgggcagtgtgattgtcgacctggcagcccaaaacggcggcaactgtgaatacaccgtgccgggtgaaatcttcactacggaaaatggtgtcaaagtaattggttacaccgatcttccgggccgtctgccgacgcaatcctcacagctttacggcactaacctcgttaatctgctgaaactgttgtgcaaagagaaagacggcaacatcactgtggattttgatgatgtggtgattcgtggcgtgaccgtgatccgtgcgggcgaaattacctggccggcaccgccgattcaggtatcagctcagccgcaggcggcacaaaaagcggcaccggaagtgaaaactgaggaaaaatgtgcctgctcaccgtggcgtaaatacgcgttgatggcgttggcaatcatccttttcggctggatggcaagcgttgcgccaaaagagttccttggacacttcactgtgttcgcgctggcctgcgttgtcggttattacgtggtgtggaatgtatcgcacgcgctgcatacaccgttgatgtcggtcaccaacgcgatttcagggattattgttgtcggagcactgttgcagattggccagggcggctgggttagcttccttagttttatcgcggtgcttatagccagcattaatattttcggtggcttcaccgtgactcagcgcatgctgaaaatgttccgcaaaaattaa

SEQ ID NO: 3970 - protein, 528 aa, Escherichia coli
MAPDTGKPSSIKPMEGNIMRIGIPRERLTNETRVAATPKTVEQLLKLGFTVAVESGAGQLASFDDKAFVQAGAEIVEGNSVWQSEIILKVNAPLDDEIALLNPGTTLVSFIWPAQNPELMQKLAERNVTVMAMDSVPRISRAQSLDALSSMANIAGYRAIVEAAHEFGRFFTGQITAAGKVPPAKVMVIGAGVAGLAAIGAANSLGAIVRAFDTRPEVKEQVQSMGAEFLELDFKEEAGSGDGYAKVMSDAFIKAEMELFAAQAKEVDIIVTTALIPGKPAPKLITREMVDSMKAGSVIVDLAAQNGGNCEYTVPGEIFTTENGVKVIGYTDLPGRLPTQSSQLYGTNLVNLLKLLCKEKDGNITVDFDDVVIRGVTVIRAGEITWPAPPIQVSAQPQAAQKAAPEVKTEEKCACSPWRKYALMALAIILFGWMASVAPKEFLGHFTVFALACVVGYYVVWNVSHALHTPLMSVTNAISGIIVVGALLQIGQGGWVSFLSFIAVLIASINIFGGFTVTQRMLKMFRKN

SEQ ID NO: 3971 - DNA, 945 bp, Escherichia coli
atgaagcttaagaacaccctcctggcgtcggcactgctttctgctacggcattctccgttaacgcagcaacagaactgacaccggagcaagcggcagcggttaaaccttttgaccgtgtagtggttaccggtcgttttaatgctattggcgaagcggtgaaagccgtttctcgtcgcgcagataaagaaggtgccgcctctttttatgttgtcgacacttctgattttggtaacagcggtaactggcgtgtggtcgctgacctctataaagccgatgctgaaaaagcagaagaaacaagtaatcgcgtaattaacggtgttgtcgaactgccgaaagatcaggctgttctgattgaaccgtttgacacggtcaccgtccagggcttctatcgtagccagccagaagtcaatgatgccatcaccaaagcagcaaaagcgaaaggtgcctactctttctacatcgttcgtcaaatcgatgccaaccagggcggcaaccagcgtattactgcattcatctataaaaaagatgctaagaaacgtatcgtccagagcccggatgtcatcccggcagattccgaagcaggacgtgcagctctggctgccggtggcgaagctgcgaagaaagttgagatcccgggtgttgcgactaccgcatcaccaagttctgaagtcggtcgcttctttgaaacccagtcatcaaaaggcgggcgttacaccgtcacgctcccggatggcactaaagtcgaagaactgaacaaagcgaccgcagcgatgatggtcccgttcgacagcatcaaattctctggcaactacggcaacatgaccgaagtctcctatcaggttgcgaaacgtgccgcgaagaaaggtgctaagtattaccacatcacccgccagtggcaggaacgtggtaataacctgaccgtcagcgcagatctgtataaataa

SEQ ID NO: 3972 - protein, 314 aa, Escherichia coli
MKLKNTLLASALLSATAFSVNAATELTPEQAAAVKPFDRVVVTGRFNAIGEAVKAVSRRADKEGAASFYVVDTSDFGNSGNWRVVADLYKADAEKAEETSNRVINGVVELPKDQAVLIEPFDTVTVQGFYRSQPEVNDAITKAAKAKGAYSFYIVRQIDANQGGNQRITAFIYKKDAKKRIVQSPDVIPADSEAGRAALAAGGEAAKKVEIPGVATTASPSSEVGRFFETQSSKGGRYTVTLPDGTKVEELNKATAAMMVPFDSIKFSGNYGNMTEVSYQVAKRAAKKGAKYYHITRQWQERGNNLTVSADLYK

SEQ ID NO: 3973 - DNA, 96 bp, Escherichia coli
gtgaagcggatggcgcagcttgtgcgttctggcgcgcaaaaatgcgcgggaatgctttatgagtggctgcaaggaacggaacttctgctgccatga

SEQ ID NO: 3974 - protein, 31 aa, Escherichia coli
MKRMAQLVRSGAQKCAGMLYEWLQGTELLLP

SEQ ID NO: 3975 - DNA, 1383 bp, Escherichia coli
atggaaaagaaactgggactgagcgcactcaccgcgctggtattaagctcaatgctgggcgcgggtgttttcagtctgccgcaaaatatggcggcagttgccagcccggcagcactgctcatcggctggggtattactggcgctggcattttattgctggcctttgccatgctgatcctcacgcgcattcgtcccgaacttgacggcggtatctttacctatgcccgcgaagggtttggcgagctaatcggcttttgttccgcatggggatactggctgtgcgcagtcatcgccaacgtctcctatctggtgatcgttttttccgcgttaagcttttttacggacacgccggaattgcgcctgtttggcgatggtaatacctggcaatcgatcgtcggtgcatcgactttattgtggattgttcactttttgatcctgcgcggggtgcaaaccgctgccagcattaacctggtggcgacactggcaaaactgttgccgctgggtctgtttgttgtactggcgatgatgatgttcaaactggataccttcaagctcgacttcaccggacttgcacttggcgtacccgtgtgggaacaggtgaaaaacaccatgctgatcaccctgtgggttttcattggtgtggaaggtgccgtggttgtttctgcgcgtgcgcgtaataagcgtgatgttggcaaagcgacactgctggcggttctctccgctctgggcgtttatttgctggtaacgctgctttcgctgggcgtggtggcacgtcctgaactggctgaaattcgtaacccgtcaatggccggtctgatggtggaaatgatgggaccgtggggcgaaatcatcatcgctgccggtttgatcgtttccgtttgcggcgcgtacttaagctggaccatcatggcagcagaagttccgttccttgcagccactcataaagcattcccgcgcatttttgcgcgccagaacgcacaagctgcgccatccgcttcactgtggctgaccaacatctgcgtgcaaatttgtctggtgctcatctggctgaccggttccgattacaacacattgctgaccatcgcctcagaaatgattctggtgccctatttcctggtcggcgcgttcttgctgaaaatcgcaacccgtccactgcataaggcggtaggtgtcggtgcctgcatttatggcttatggttactgtacgcctctggtccaatgcacttgctgttatccgttgttctgtatgcgccggggctgctggttttcctgtacgcgcgtaaaacgcatacacatgataatgtactgaaccgtcaggaaatggtgctgattggcatgctgttaattgcctcagttccggcgacctggatgctggtgggataa

SEQ ID NO: 3976 - protein, 460 aa, Escherichia coli
MEKKLGLSALTALVLSSMLGAGVFSLPQNMAAVASPAALLIGWGITGAGILLLAFAMLILTRIRPELDGGIFTYAREGFGELIGFCSAWGYWLCAVIANVSYLVIVFSALSFFTDTPELRLFGDGNTWQSIVGASTLLWIVHFLILRGVQTAASINLVATLAKLLPLGLFVVLAMMMFKLDTFKLDFTGLALGVPVWEQVKNTMLITLWVFIGVEGAVVVSARARNKRDVGKATLLAVLSALGVYLLVTLLSLGVVARPELAEIRNPSMAGLMVEMMGPWGEIIIAAGLIVSVCGAYLSWTIMAAEVPFLAATHKAFPRIFARQNAQAAPSASLWLTNICVQICLVLIWLTGSDYNTLLTIASEMILVPYFLVGAFLLKIATRPLHKAVGVGACIYGLWLLYASGPMHLLLSVVLYAPGLLVFLYARKTHTHDNVLNRQEMVLIGMLLIASVPATWMLVG

SEQ ID NO: 3977 - DNA, 723 bp, Escherichia coli
atgggtaaaacccagtccttgccaatattaattactggcggaggtcgccgcatcggcctcgccctcgcatggcatttcattaatcaaaagcaaccggtgattgtcagctatcggacgcactatcccgccattgatggactgattaaggcaggtgcgcagtgtattcaggctgatttttcgaccaacgacggtgtgatggcgtttgccgatgaagtactaaaaagcacccatggtctgcgtgctattttgcataacgccagcgcgtggatggcggaaaaaccgggagcgccactgaccgatgtactggcttgcatgatgcagatccacgttaataccccatacctgctcaaccatgctctggaaagattactgcgtgggcacggacacgccgccagcgatatcattcactttaccgattatgtggtggagcgcggtagcgacaaacatattgcgtatgctgcaagcaaagcggcactggataatatgacccgctcgtttgcccgcaagctggcaccggaagtgaaagtgaattctattgcgccatcgctgatcctgtttaatgaacatgatgatgctgaatatcgacaacaggcgctgaataaatcactgatgaaaacagcgcctggcgagaaagaagtgatcgacctggtcgattacttacttaccagctgctttgtcaccggacgcagtttccctcttgatggcggtcgtcatctgcgttaa

SEQ ID NO: 3978 - protein, 240 aa, Escherichia coli
MGKTQSLPILITGGGRRIGLALAWHFINQKQPVIVSYRTHYPAIDGLIKAGAQCIQADFSTNDGVMAFADEVLKSTHGLRAILHNASAWMAEKPGAPLTDVLACMMQIHVNTPYLLNHALERLLRGHGHAASDIIHFTDYVVERGSDKHIAYAASKAALDNMTRSFARKLAPEVKVNSIAPSLILFNEHDDAEYRQQALNKSLMKTAPGEKEVIDLVDYLLTSCFVTGRSFPLDGGRHLR

SEQ ID NO: 3979 - DNA, 336 bp, Escherichia coli
atggggctggtaatcaaagccgcgctcggtgcgctggtagtgctgttgattggtgttttagcaaaaacgaaaaattattatatcgccgggctgattccacttttcccgacctttgcgcttatcgcgcattatattgttgccagcgaacgcggcattgaagccttacgcgcaaccatcatttttagtatgtggccgattattccctattttgtttacctggcggcgctatggtatttcaccggaatgatgcgcttgcccgctgcttttgttggttctgttgcgtgctggggaataagcgcatgggtgttgattatatgctggataaagctgcattaa

SEQ ID NO: 3980 - protein, 111 aa, Escherichia coli
MGLVIKAALGALVVLLIGVLAKTKNYYIAGLIPLFPTFALIAHYIVASERGIEALRATIIFSMWPIIPYFVYLAALWYFTGMMRLPAAFVGSVACWGISAWVLIICWIKLH

SEQ ID NO: 3981 - DNA, 780 bp, Escherichia coli
ttgatagtaagtaaaaacagtgcggtgtattgtgacgtttttatatctaccgtgaatgttatgaacactatcgtatttgtggaagatgatgcggaagtcggtgcactgattgccgcatacctggcaaaacatgatatgcaggttaccgtagagccgcgcggcgaccgggccgaagaaactattctgcgagaaaatccggatttggtgttactcgacatcatgctaccaggcaaggacggcatgaccatttgtcgtgatttacgcgcaaagtggtccggaccgattgttcttctaacctctctcgatagcgatatgaaccacatcctggcactggaaatgggcgcctgcgactatattctcaaaacgacgccccctgctgttttgctagcgcgtttacgcttgcatttgcgtcagaatgagcaagccacagtgaccaaaggtattcaggaaacgtctctgactccctacaaagccctgcatttcggcacgttgaccatcgatcccatcaaccgcgtagtctccctggctaacactgaaatctcgctctcgacagctgatttcgaattattgtgggaattagctacccatgccgggcaaatcatggaccgcgatgcattgctgaaaaatttacgcggcgtcagttatgacggactggatcgtagcgtggacgtggctatttcgcggttaagaaaaaaactgctcgataacgccgcagaaccttatcgtattaaaaccgtgcgtaacaaaggctatctttttgcgcctcatgcgtgggaataa

SEQ ID NO: 3982 - protein, 259 aa, Escherichia coli
MIVSKNSAVYCDVFISTVNVMNTIVFVEDDAEVGALIAAYLAKHDMQVTVEPRGDRAEETILRENPDLVLLDIMLPGKDGMTICRDLRAKWSGPIVLLTSLDSDMNHILALEMGACDYILKTTPPAVLLARLRLHLRQNEQATVTKGIQETSLTPYKALHFGTLTIDPINRVVSLANTEISLSTADFELLWELATHAGQIMDRDALLKNLRGVSYDGLDRSVDVAISRLRKKLLDNAAEPYRIKTVRNKGYLFAPHAWE

SEQ ID NO: 3983 - DNA, 1302 bp, Escherichia coli
atgaaaaaactgtttatccagttttacctgttattgtttgtctgcttccttgtgatgtctctgctggtcgggctggtgtacaaatttaccgccgaacgcgcaggcaaacagtcgctggatgatttgatgaacagttcgctgtatctgatgcgcagcgaattgcgtgagatccccccacacgactggggtaagacgctgaaagagatggatttaaatctctctttcgatctgcgtgtcgagccactgagtaaataccatcttgatgatatttccatgcaccggctgcgtggcggcgaaattgtcgctctggacgatcagtacacttttttgcaacgtatcccgcgcagccactacgtgctggcagttggtcctgttccttatctttattacctccatcagatgcgattgctggatatcgccctgatcgcttttattgccatttccctcgcctttccggtgtttatctggatgcgtccgcactggcaggatatgttaaaactggaagcagcggcgcaacgatttggcgatgggcatctcagtgagcgtatccactttgatgaaggttcgagctttgaacgacttggcgtcgcatttaaccagatggcggacaatatcaacgccttgattgccagcaaaaaacagcttattgacggtatcgctcacgaactgcgaacaccgttagtgcgcctgcgttatcgactggagatgagcgataacctgagcgccgccgaatcccaggcgttgaatcgcgatatcagtcaacttgaagctttaattgaagagctgctgacttatgcccgactcgaccgcccacaaaatgagcttcatcttagcgaaccagacctgccgttgtggctgtcaacgcatctggcagatattcaggcagtaacgcccgataaaacggtacggataaaaacgctcgcgcaaggccattatgctgcgttggatatgcgcttaatggagcgcgtgctggataatttgctcaataacgccctgcgctactgtcactcaacggttgaaaccagcctgctactgtcggggaatagagcgacattaattgttgaggatgatggcccagggattgccccagaaaaccgcgaacatatctttgaaccttttgttcgcctcgatcccagccgggatcgctcaaccggcggctgcgggctggggctggccattgtccactctatagcactggcaatgggcggtacggttaattgtgacaccagcgaactgggtggtgcccgcttctcgttcagctggccgttatggcataacatcccgcaatttacctctgcctga

SEQ ID NO: 3984 - protein, 433 aa, Escherichia coli
MKKLFIQFYLLLFVCFLVMSLLVGLVYKFTAERAGKQSLDDLMNSSLYLMRSELREIPPHDWGKTLKEMDLNLSFDLRVEPLSKYHLDDISMHRLRGGEIVALDDQYTFLQRIPRSHYVLAVGPVPYLYYLHQMRLLDIALIAFIAISLAFPVFIWMRPHWQDMLKLEAAAQRFGDGHLSERIHFDEGSSFERLGVAFNQMADNINALIASKKQLIDGIAHELRTPLVRLRYRLEMSDNLSAAESQALNRDISQLEALIEELLTYARLDRPQNELHLSEPDLPLWLSTHLADIQAVTPDKTVRIKTLAQGHYAALDMRLMERVLDNLLNNALRYCHSTVETSLLLSGNRATLIVEDDGPGIAPENREHIFEPFVRLDPSRDRSTGGCGLGLAIVHSIALAMGGTVNCDTSELGGARFSFSWPLWHNIPQFTSA

SEQ ID NO: 3985 - DNA, 930 bp, Escherichia coli
atggcgcgttacgatctcgtagaccgactcaacactacttttcgccagatggaacaagagctggctgcatttgccgctcatcttgagcaacacaagctattggttgcccgcgtgttctctttgccggaggtaaaaaaagaggatgagcataatccgcttaatcgtattgaggtaaaacaacatctcggcaacgacgcgcaatcgctggcgttgcgtcattttcgccatttatttattcaacaacagtccgaaaatcgcagcagcaaggccgctgtccgtctgcctggcgtgttgtgttaccaggtcgataacttttcgcaagcagcgttagtcagtcatattcagcacatcaataaactcaagaccacgttcgagcatatcgtcacggttgaatcagaactcccctccgcggcacgttttgaatgggtgcatcgtcatttgccggggctgattacacttaatgcttaccgcacgctcaccgttctgcacgaccccgccactttacgttttggctgggctaataaacatatcattaaaaatttgcatcgtgatgaagtcctggcacagctggaaaaaagcctgaaatcaccacgcagtgtcgcaccgtggacgcgcgaggagtggcaaagaaaactggagcgagaatatcaggatatcgctgccctgccacagaacgcgaagttaaaaatcaaacgtccggtgaaggtgcagccgattgcccgcgtctggtacaaaggagatcaaaaacaagtacaacacgcctgccctacgccgctgattgcactgattaatagggataatggcgcgggcgtgccggacgttggtgagttgttaaattacgatgccgacaatgtgcagcaccgttataaaccacaggcgcagccgcttcgtttaatcattccacggctgcacctgtatgttgcagattaa

SEQ ID NO: 3986 - protein, 309 aa, Escherichia coli
MARYDLVDRLNTTFRQMEQELAAFAAHLEQHKLLVARVFSLPEVKKEDEHNPLNRIEVKQHLGNDAQSLALRHFRHLFIQQQSENRSSKAAVRLPGVLCYQVDNFSQAALVSHIQHINKLKTTFEHIVTVESELPSAARFEWVHRHLPGLITLNAYRTLTVLHDPATLRFGWANKHIIKNLHRDEVLAQLEKSLKSPRSVAPWTREEWQRKLEREYQDIAALPQNAKLKIKRPVKVQPIARVWYKGDQKQVQHACPTPLIALINRDNGAGVPDVGELLNYDADNVQHRYKPQAQPLRLIIPRLHLYVAD

SEQ ID NO: 3987 - DNA, 1404 bp, Escherichia coli
atgaatacagtacgcagcgaaaaagattcgatgggagcgattgatgtcccggcagataagctgtggggcgcacaaactcaacgctcgctggagcatttccgcatttcgacggagaaaatgcccacctcactgattcatgcgctggcgctaaccaagcgcgcagcggcaaaagttaatgaagatttaggcttgttgtctgaagagaaagcgagcgccattcggcaggcggcggatgaagtactggcaggacagcatgacgacgaattcccgctggctatctggcagaccggctccggcacgcaaagtaacatgaacatgaacgaagtgctggctaaccgggccagtgaattactcggcggcgtgcgcgggatggaacgtaaagttcaccctaacgacgacgtgaacaaaagccaaagttccaacgatgtctttccgacggcgatgcacgttgcggcgctgctggcgctgcgcaagcaactcattccacaacttaaaaccctgacccagacgctgagtgaaaaatcccgcgcatttgccgatatcgtcaaaatcggtcgtacccacttgcaggacgccacgccgttaacgctggggcaggagatttccggctgggtagcgatgctggagcataatctcaaacatatcgaatacagcctgcctcacgtagcggaactggctctgggcggtacagcggtgggtactgaactaaatacccatccggaatatgcgcgtcgcgtagcagatgaactggcagtcattacctgtgcaccgtttgttaccgcgccgaacaaatttgaagcgctggcgacctgtgatgccctggttcaggcgcacggcgcattgaaagggttggctgcgtcactgatgaaaattgccaatgatgtccgctggctggcctctggcccgcgctgcggaattggtgaaatctcaatcccggaaaatgagccgggcagctcaatcatgccagggaaagtgaacccgacgcagtgcgaagcattaaccatgctctgctgtcaggtgatggggaacgacgtggcgatcaacatgggtggcgcttccggtaactttgaactgaacgtcttccgtccgatggtgatccataatttcctgcaatcggtgcgcttgctggcagatggcatggaaagtttcaacaaacactgcgcagtgggcattgaaccgaatcgtgagcgaatcaatcaattactcaatgaatcgctgatgctggtgactgcgcttaacacccacattggttatgacaaagccgccgagatcgccaaaaaagcgcataaagaagggctgaccttaaaagctgcggcccttgcgctggggtatcttagcgaagccgagtttgaccgctgggtacggccagaacagatggtcggcagtatgaaagccgggggttaa

SEQ ID NO: 3988 - protein, 467 aa, Escherichia coli
MNTVRSEKDSMGAIDVPADKLWGAQTQRSLEHFRISTEKMPTSLIHALALTKRAAAKVNEDLGLLSEEKASAIRQAADEVLAGQHDDEFPLAIWQTGSGTQSNMNMNEVLANRASELLGGVRGMERKVHPNDDVNKSQSSNDVFPTAMHVAALLALRKQLIPQLKTLTQTLSEKSRAFADIVKIGRTHLQDATPLTLGQEISGWVAMLEHNLKHIEYSLPHVAELALGGTAVGTELNTHPEYARRVADELAVITCAPFVTAPNKFEALATCDALVQAHGALKGLAASLMKIANDVRWLASGPRCGIGEISIPENEPGSSIMPGKVNPTQCEALTMLCCQVMGNDVAINMGGASGNFELNVFRPMVIHNFLQSVRLLADGMESFNKHCAVGIEPNRERINQLLNESLMLVTALNTHIGYDKAAEIAKKAHKEGLTLKAAALALGYLSEAEFDRWVRPEQMVGSMKAGG

SEQ ID NO: 3989 - DNA, 1647 bp, Escherichia coli
atgtcaaacaaaccctttcattatcaggctccttttccactcaaaaaagatgatactgagtattacctgctaaccagcgaacacgttagcgtatctgaatttgaagggcaggagattttgaaagtcgcacccgaagcgttaactctgttggcgcgtcaggcgtttcatgatgcgtcatttatgctgcgtccggctcaccaacaacaggtggccgacattctgcgtgacccggaggccagcgaaaatgataaatatgtggcgctgcaatttctgcgtaactccgacatcgcggcaaaaggcgttctgccaacctgtcaggataccggcaccgcgattattgttggtaaaaaagggcagcgtgtatggaccggtggcggtgatgaagcagcgctggcgcgcggtgtttataacacttatatcgaggataatctgcgctactcgcaaaacgcgccgctggatatgtataaagaggtgaataccggcaccaacttgccagcgcagatcgatctttatgccgttgatggcgacgagtacaaattcctctgtatcgccaaaggtggcggttcggcaaacaagacgtatctctatcaggaaaccaaagcgttactgacgccgggaaaactgaaaaattacctggttgagaagatgcgcacgctgggtacggcggcctgtcctccgtatcatattgcgttcgttattggtggaacttctgcagaaacgaatcttaaaacggtgaaactcgcttccgctaaatactatgatgaactgccaacggaagggaatgagcacggtcaggcgttccgcgatgtggaactggaaaaagaattgctgatcgaagcgcaaaatcttggtctgggtgcgcagtttggtggtaaatacttcgctcatgacatccgcgtgattcgcctgccacgtcacggcgcatcctgcccggtcggtatgggcgtctcctgttctgctgaccgtaatatcaaagcgaagatcaaccgtcaggggatctggatcgaaaaactggaacataatccaggcaaatatatcccggaagagctgcgcaaagcaggagaaggcgaagcggtgcgcgttgacctcaaccgtccgatgaaagagatcctcgcacagttgtcgcagtatcccgtttctacacgcttatcgcttaacggcacgattatcgtcggtcgtgatattgctcacgccaaactgaaagagcggatggataacggtgaagggctgccgcagtacattaaagatcatccgatttactacgcgggtccggccaaaacgccggaaggttatgcctccggttctcttggcccaacgaccgccggacggatggattcttatgtcgatcaactgcaagcgcagggcggaagtatgatcatgctggcgaaaggcaaccgcagccagcaggtgacggatgcctgtaaaaaacacggcggcttctacctcggcagtatcggtggtccggcagctgtattggcgcagggaagtattaagagcctggaatgtgttgaatatccggaactaggaatggaagccatctggaaaattgaagtggaagatttcccggcgtttatccttgtggatgataaaggaaatgacttcttccagcagatacaactcacacaatgcacccgctgtgtgaaataa

SEQ ID NO: 3990 - protein, 548 aa, Escherichia coli
MSNKPFHYQAPFPLKKDDTEYYLLTSEHVSVSEFEGQEILKVAPEALTLLARQAFHDASFMLRPAHQQQVADILRDPEASENDKYVALQFLRNSDIAAKGVLPTCQDTGTAIIVGKKGQRVWTGGGDEAALARGVYNTYIEDNLRYSQNAPLDMYKEVNTGTNLPAQIDLYAVDGDEYKFLCIAKGGGSANKTYLYQETKALLTPGKLKNYLVEKMRTLGTAACPPYHIAFVIGGTSAETNLKTVKLASAKYYDELPTEGNEHGQAFRDVELEKELLIEAQNLGLGAQFGGKYFAHDIRVIRLPRHGASCPVGMGVSCSADRNIKAKINRQGIWIEKLEHNPGKYIPEELRKAGEGEAVRVDLNRPMKEILAQLSQYPVSTRLSLNGTIIVGRDIAHAKLKERMDNGEGLPQYIKDHPIYYAGPAKTPEGYASGSLGPTTAGRMDSYVDQLQAQGGSMIMLAKGNRSQQVTDACKKHGGFYLGSIGGPAAVLAQGSIKSLECVEYPELGMEAIWKIEVEDFPAFILVDDKGNDFFQQIQLTQCTRCVK

SEQ ID NO: 3991 - DNA, 1254 bp, Escherichia coli
ttgcggctccaggttacttcccgtaggattcttgctttaatagcgggattaatttccacattaaaacagggattgatcatgcaaaaactcattaactcagtgcaaaactatgcctggggcagcaaaacggcgttgactgaactttatggtatggaaaatccgtccagccagccgatggccgagttgtggatgggcgcgcatccaaagagcagttcacgtgtgcacgatgccacaggagatatcgtttcactgcgtgatgtgattgagagtgataaagcgactcttttgggagatgccgttgccaaacgctttggcgagttgcctttcctgttcaaagtattatgcgcagcccagccgctctccattcaggttcatccaaacaaacgcaattctgaaatcggttttgccaaagaaaatgctgcaggtattccgatggatgccgctgagcgtaactataaagatcctaatcacaagcctgagctggttttcgccctgacccctttcctcgcgatgaacgcgtttcgtgagttttccgagattgtctccctgctccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgacagccagcagggtgaaccatggcaaacgattcgtttaatttctgaattttacccggaagacagcggtctgttctccccgctgttgctgaatgtggtgaaattgaatcctggcgaagcgatgttcctgttcgctgaaacaccgcacgcttacctgcaaggcgtggcgctggaagtgatggcgaactccgataacgtgctgcgtgcaggtctgacgcctaaatacattgatattccggaactggttgccaacgtgaagttcgaagccaaaccggctaaccagttgttgacccagccggtgaaacaaggtgcagaactggacttcccgattcctgtggatgattttgccttctcgttgcatgaccttagtgataaagaaaccaccatcagccagcagagtgccgccattttgttctgcgtcgaaggcgatgcaacgctgtgtaaaggttctcagcagttacagcttaaaccgggtgaatcagcgtttattgccgccaacgaatcaccggtgactgtcaaaggccacggccgtttagcgcgtgtttacaacaagctgtaa

SEQ ID NO: 3992 - protein, 417 aa, Escherichia coli
MRLQVTSRRILALIAGLISTLKQGLIMQKLINSVQNYAWGSKTALTELYGMENPSSQPMAELWMGAHPKSSSRVHDATGDIVSLRDVIESDKATLLGDAVAKRFGELPFLFKVLCAAQPLSIQVHPNKRNSEIGFAKENAAGIPMDAAERNYKDPNHKPELVFALTPFLAMNAFREFSEIVSLLQPVAGAHPAIAHFLQQPDAERLSELFASLLNMQGEEKSRALAILKSALDSQQGEPWQTIRLISEFYPEDSGLFSPLLLNVVKLNPGEAMFLFAETPHAYLQGVALEVMANSDNVLRAGLTPKYIDIPELVANVKFEAKPANQLLTQPVKQGAELDFPIPVDDFAFSLHDLSDKETTISQQSAAILFCVEGDATLCKGSQQLQLKPGESAFIAANESPVTVKGHGRLARVYNKL

SEQ ID NO: 3993 - DNA, 1509 bp, Escherichia coli
atgaataaatcgctggtagcggtaggcgtcattgttgcgctaggcgtagtctggacaggcggcgcatggtatacaggcaagaagattgaaacccatctcgaagacatggtcgcgcaggcgaacgcgcaactcaaactgacagctcctgaatccaacctggaagtcagttatcaaaactatcatcgcggcgtattcagcagccagttgcaactgttggtgaaacccattgccggaaaagtaaatccgtggattaaaagcggtcagagcgtcatcttcaacgaatcggttgatcatggtcccttcccgcttgcccagcttaaaaaactgaacctgatcccgtcgatggcatcaattcaaaccacgctggttaataacgaagtaagcaaaccactgtttgatatggcaaaaggtgaaacgccttttgagattaactcccgcattggttacagcggagattccagttccgacatttcgctcaagccactgaattacgagcaaaaggatgaaaaagtcgcctttagcggcggcgagttccagttaaatgcagacagagacggcaaagctatctccctttccggggaggcgcaaagtggtcggatagacgcggttaacgaatacaaccagaaagtgcagttaacctttaataatctgaaaaccgacggttccagcacgctggcaagttttggtgagcgcgtaggaaaccaaaaactgtcgctggaaaaaatgaccatttcagtggagggcaaagaactggcactgctggaaggcatggagatcagcggtaaatcggatctggtcaatgacggtaaaacggtcaatagccaactggattactcgctaaacagcctgaaggtacagaatcaggatctgggcagtggcaagctgactttaaaagtcggccaaattgatggcgaagcctggcatcagtttagccagcaatataacgcacaaactcaggcgctgctggcacagccagaaattgccaacaatcccgaactttatcaggagaaagtgacggaagccttctttagcgctctgccgctgatgctgaaaggcgatccggtgattactatcgcgccgctaagctggaaaaacagtcagggtgaaagtgcgctgaatctgtcgctgttcctgaaagatccggcaacgactaaagaagcgccgcaaacgctggcgcaggaagtggaccgctcggttaaatctctggatgcgaaactgaccattccggtggatatggcaactgagttgatgactcaggtagcgaagctggaaggttatcaggaagatcaagcgaaaaaactggcgaaacagcaagttgaaggtgcatcagcaatggggcagatgttccgtctgaccaccttgcaggacaataccatcaccaccagcctgcaatatgctaacggtcagataacgttaaacgggcagaaaatgccactggaagatttcgtgggtatgtttgcgatgccggcattaaacgttccggctgtacccgctattccgcagcagtaa

SEQ ID NO: 3994 - protein, 502 aa, Escherichia coli
MNKSLVAVGVIVALGVVWTGGAWYTGKKIETHLEDMVAQANAQLKLTAPESNLEVSYQNYHRGVFSSQLQLLVKPIAGKVNPWIKSGQSVIFNESVDHGPFPLAQLKKLNLIPSMASIQTTLVNNEVSKPLFDMAKGETPFEINSRIGYSGDSSSDISLKPLNYEQKDEKVAFSGGEFQLNADRDGKAISLSGEAQSGRIDAVNEYNQKVQLTFNNLKTDGSSTLASFGERVGNQKLSLEKMTISVEGKELALLEGMEISGKSDLVNDGKTVNSQLDYSLNSLKVQNQDLGSGKLTLKVGQIDGEAWHQFSQQYNAQTQALLAQPEIANNPELYQEKVTEAFFSALPLMLKGDPVITIAPLSWKNSQGESALNLSLFLKDPATTKEAPQTLAQEVDRSVKSLDAKLTIPVDMATELMTQVAKLEGYQEDQAKKLAKQQVEGASAMGQMFRLTTLQDNTITTSLQYANGQITLNGQKMPLEDFVGMFAMPALNVPAVPAIPQQ

SEQ ID NO: 3995 - DNA, 1266 bp, Escherichia coli
atgagaaaaatagtggccatggccgttatttgcctgacggctgcctctggccttacctctgcttacgcggcgcaaccggctgacgatgaagcgggactacgcatcagactgaaaaacgaattacgcagggctgataagcccagtgctggcacgggaagagatatttacgcatgggtacagggaggattgctcgatttcaatagtggttattattccaatattattggcgttgaaggcggggcgtattatgtttataaattaggtgctcgtgctgatatgagtacccggtggtatcttgatggtgataaaagttttggctttgccctggggacagtaaaaataaaacccagtgaaaatagcctgctaaaattaggtcgcttcgggacggattatagttatggtagcttaccttatcgtattccgttaatggctggcagttcgcaacgtacattaccgactgtttctgaaggagcattaggttattgggctttaacgccaaatattgatctgtggggaatgtggcgttcacgagtatttttatggaccgattcaacaaccggtattcgtgatgaaggggtttataacagccagacgggaaaatacgataaacatcgcgcacgttcttttttagccgccagttggcatgatgataccagtcgctattctctgggggcatcggtacagaaagatgtttccaatcagatacaaagtattctcgagaaaagcataccgcttgacccgaattatacgttgaaaggggagttgctcggcttttacgcgcaacttgaaggtttaagtcgtaataccagccagcccaatgaaacggcgttagttagtggacaattgacctggaatgcgccgtggggaagcgtatttggcagtggtggttatttgcgccatgcaatgaatggtgccgtggtggataccgacattggctatcccttttcattaagtcttgatcgtaaccgtgaaggaatgcagtcctggcaattgggcgtcaactatcgtttaactccgcaatttacgctgacatttgcaccgattgtgacccgcggctatgaatccagtaaacgagatgtgcggattgaaggcgcgggtatcttagggggtatgaactatcgggtcagcgaagggccgttacaagggatgaatttctttcttgctgccgataaagggcgggaaaagcgcgatggcagtacgctgggcgatcgcctgaattactgggatgtgaaaatgagtattcagtatgactttatgctgaagtaa

SEQ ID NO: 3996 - protein, 421 aa, Escherichia coli
MRKIVAMAVICLTAASGLTSAYAAQPADDEAGLRIRLKNELRRADKPSAGTGRDIYAWVQGGLLDFNSGYYSNIIGVEGGAYYVYKLGARADMSTRWYLDGDKSFGFALGTVKIKPSENSLLKLGRFGTDYSYGSLPYRIPLMAGSSQRTLPTVSEGALGYWALTPNIDLWGMWRSRVFLWTDSTTGIRDEGVYNSQTGKYDKHRARSFLAASWHDDTSRYSLGASVQKDVSNQIQSILEKSIPLDPNYTLKGELLGFYAQLEGLSRNTSQPNETALVSGQLTWNAPWGSVFGSGGYLRHAMNGAVVDTDIGYPFSLSLDRNREGMQSWQLGVNYRLTPQFTLTFAPIVTRGYESSKRDVRIEGAGILGGMNYRVSEGPLQGMNFFLAADKGREKRDGSTLGDRLNYWDVKMSIQYDFMLK

SEQ ID NO: 3997 - DNA, 1374 bp, Escherichia coli
atgaatcaacaactctcctggcgcgccatcgtcggctacagcctcggtgacgtcgccaataacttcgccttcgcaatgggggcgctcttcctgttgagttactacaccgacgtcgctggcgtcggtgccgctgcggcgggcaccatgctgttactggtgcgggtattcgatgccttcgccgatgtctttgccggacgagtggtggacagtgtgaatacccgatggggaaaattccgcccgtttttactcttcggtactgcgccgttaatgatcttcagcgtgctggtattctgggtgccgaccgactggagccatagcagcaaagttgtgtatgcatatttgacctacatgggactcgggctttgctacagcctggtgaatattccttatggttcacttgctaccgcgatgacccaacaaccacaatcccgcgcccgtctgggcgcggctcgcgggattgccgcttcattgacttttgtctgcctggcatttctgataggaccgagcattaagaactccagcccggaagagatggtgtcggtatatcatttctggacaattgtgctggcgattgccggaatggtgctttacttcatctgcttcaaatcgacgcgtgagaatgtggtacgtatcgtggcgcagccgtcattgaagatcagtctgcaaaccctgaaacggaatcgcccgctgtttatgttgtgcatcggtgcgctgtgtgtgctgatttcgaccttcgcggtcagcgcctcgtcgttgttctacgtgcgctatgtgttaaatgataccgggctgttcactgtgctggtactggtgcaaaacctggtcggtactgtggcatcggcaccgctggtgccggggatggtcgcgaggatcggtaaaaagaataccttcctgattggcgctttgctgggaacctgcggttatctgctgttcttctgggtttccgtctggtcactgccggtggcgttggttgcgttggccatcgcatcaattggccagggcgttaccatgaccgtgatgtgggcactggaagctgataccgtagaatacggtgaatacctgaccggcgtgcgaattgaagggctcacctattcactattctcatttacccgtaaatgcggtcaggcaatcggaggttcaattcctgcctttattttgggattaagcggatatatcgccaatcaggcgcaaacgccggaagttattatgggcatccgcacatcaattgccttagtaccttgcggatttatgctactggcattcgtcattatctggttttatccgctcacggataaaaaattcaaagaaatcgttgttgaaattgataatcgtaaaaaagttcagcagcaattaatcaacgatatcactagttaa

SEQ ID NO: 3998 - protein, 457 aa, Escherichia coli
MNQQLSWRAIVGYSLGDVANNFAFAMGALFLLSYYTDVAGVGAAAAGTMLLLVRVFDAFADVFAGRVVDSVNTRWGKFRPFLLFGTAPLMIFSVLVFWVPTDWSHSSKVVYAYLTYMGLGLCYSLVNIPYGSLATAMTQQPQSRARLGAARGIAASLTFVCLAFLIGPSIKNSSPEEMVSVYHFWTIVLAIAGMVLYFICFKSTRENVVRIVAQPSLKISLQTLKRNRPLFMLCIGALCVLISTFAVSASSLFYVRYVLNDTGLFTVLVLVQNLVGTVASAPLVPGMVARIGKKNTFLIGALLGTCGYLLFFWVSVWSLPVALVALAIASIGQGVTMTVMWALEADTVEYGEYLTGVRIEGLTYSLFSFTRKCGQAIGGSIPAFILGLSGYIANQAQTPEVIMGIRTSIALVPCGFMLLAFVIIWFYPLTDKKFKEIVVEIDNRKKVQQQLINDITS

SEQ ID NO: 3999 - DNA, 1812 bp, Escherichia coli
atgttacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccgggcagttttaacgatcagttcgccgatgcagatattcgtaattatgtgggcaacgtctggtatcagcgcgaagtctttataccgaaaggttgggcgggccagcgtattgtactgcgtttcgatgcggtcactcattacggcaaagtgtgggtaaataatcaggaagtgatggagcatcagggcggctatacgccatttgaagccgatgtcactccgtatgttattgccgggaaaagtgtacgtatcactgtttgtgtgaacaacgaactgaactggcagactatcccgccgggaatggtgattaccgacgaaaacggcaagaaaaagcagtcttactttcatgatttctttaactacgccgggatccatcgcagcgtaatgctctacaccacgccgaatacctgggtggacgatatcaccgtggtgacgcatgtcgcgcaagactgtaaccacgcatctgttgactggcaggtgggggcaaatggtgatgtcagcgttgaactgcgtgatgcggatcaacaggtggttgcaactggacaaggcaccagcgggactttgcaagtagtgaatccgcacctctggcaaccgggtgaaggttatctctatgaactgtgcgtcacagccaaaagccagacagagtgtgatatctacctgctgcgcgtcggtatccggtcagtggcagtgaagggcgaacagttcctgatcaaccacaaaccgttctactttactggctttggtcgtcatgaagatgcggatttgcgcggcaaaggattcgataacgtgctgatggtgcacgatcacgcactaatggactggattggggccaactcctaccgtacctcgcattacccttacgctgaagagatgctcgactgggcagatgaacatggcatcgtggtgattgatgaaactgcagctgtcggctttaacctctctttaggcattggtttcgaagcgggcaacaagccgaaagaactgtacagcgaagaggcagtcaacggggaaacccagcaggcgcacttacaggcgattaaagagctgattgcgcgtgacaaaaaccacccaagcgtggtgatgtggagtattgccaacgaaccggatacccgtccgcaaggtgcacgggaatattttgcgccactggcggaagcaacgcgtaaactcgacccgacgcgtccgatcacctgtgtcaatgtaatgttctgcgacgctcacaccgataccatcagcgatctctttgatgtgctgtgcctgaaccgttattacggttggtatgtccaaagcggcgatttggaaacggcagagaaggtactggaaaaagaacttctggcctggcaggagaaactgcatcagccgattatcatcaccgaatacggcgtggatacgttagccggcctgcactcaatgtacaccgacatgtggagtgaagagtatcagtgcgcctggctggatatgtatcaccgcgtctttgatcgcgtcagcgctgtcgtcggtgagcaggtatggaatttcgccgattttgcgacctcgcaaggcatattgcgcgttggcggtaacaagaaagggatcttcactcgcgaccgcaaaccgaagtctgcggcttttctgctgcaaaaacgctggaccggcatgaacttcggtgaaaaaccgcagcagggaggcaaacaatga

SEQ ID NO: 4000 - protein, 603 aa, Escherichia coli
MLRPVETPTREIKKLDGLWAFSLDRENCGIDQRWWESALQESRAIAVPGSFNDQFADADIRNYVGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVGANGDVSVELRDADQQVVATGQGTSGTLQVVNPHLWQPGEGYLYELCVTAKSQTECDIYLLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 4001 - DNA, 591 bp, Escherichia coli
atgatggataacatgcagactgaagcacaaccgacacggacccggatcctcaatgctgccagagagattttttcagaaaatggatttcacagtgcctcgatgaaagccatctgtaaatcctgcgccattagtcccgggacgctctatcaccatttcatctccaaagaagccttgattcaggcgattatcttacaggaccaggagagggcgctggcccgtttccgggaaccgattgaagggattcatttcgttgactatatggtcgagtctattgtctctctcacccatgaagcctttgggcaacgagcgctggtggtcgaaattatggcggaagggatgcgtaacccacaggtcgccgccatgcttaaaaataagcatatgacgatcacggaatttgttgcccagcggatgcgtgatgcccagcaaaaaggcgagataagcccagatatcaacacggcaatgacttcacgtttactgctggatctgacctacggtgtactggccgatatcgaagcggaagatctggcgcgtgaagcgtcgtttgctcagggattacgcgcgatgattggcggtatattaaccgcatcctga

SEQ ID NO: 4002 - protein, 196 aa, Escherichia coli
MMDNMQTEAQPTRTRILNAAREIFSENGFHSASMKAICKSCAISPGTLYHHFISKEALIQAIILQDQERALARFREPIEGIHFVDYMVESIVSLTHEAFGQRALVVEIMAEGMRNPQVAAMLKNKHMTITEFVAQRMRDAQQKGEISPDINTAMTSRLLLDLTYGVLADIEAEDLAREASFAQGLRAMIGGILTAS

SEQ ID NO: 4003 - DNA, 768 bp, Escherichia coli
gtgtttaattctgacaacctgagactcgacggaaaatgcgccatcattacaggtgcgggtgcaggtattggtaaagaaatcgccattacattcgcgacagctggcgcatctgtggtggtcagtgatattaacgccgatgcagctaatcatgttgtaaatgaaattcaacaactgggtggtcaggcatttgcctgccgctgcgatattacttccgaacaggaactctctgcactggcagactttgccgtcagtaagttgggtaaagttgatatcctggttaacaacgccggtggcggtgggcctaaaccgtttgatatgccaatggcagattttcgccgcgcttatgaactgaatgtattttcttttttccatctgtcacaacttgttgcgccagaaatggaaaaaaatggcggtggcgttattctgaccattacttctatggcggcagaaaataaaaatataaacatgacctcctatgcatcatctaaagctgcggccagtcatctggtcagaaatatggcgtttgacctgggtgaaaaaaatattcgggtgaatggcattgcaccgggggcaatattaaccgatgccctgaaatccgttattacaccagagattgaacagaaaatgttgcaacacacaccaatcagacgtctgggccaaccgcaagatattgctaacgcggcgctgttcctttgctcgcctgcagccagctgggtaagcggacaaattctcaccgtctccggtggtggggtacaggaactcaattaa

SEQ ID NO: 4004 - protein, 255 aa, Escherichia coli
MFNSDNLRLDGKCAIITGAGAGIGKEIAITFATAGASVVVSDINADAANHVVNEIQQLGGQAFACRCDITSEQELSALADFAVSKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 4005 - DNA, 1029 bp, Escherichia coli
atggctaccgccaaaaaaataaccattcatgatgttgcgctggctgcgggcgtgtcggtaagtaccgtttcgctggtgcttagtggcaaagggcgaatctctaccgccacaggagaacgcgttaacgccgccattgaagagctgggatttgtgcgcaatcgccaggcgtcggcgctgcgcggcgggcaaagcggcgtcattggtttgatcgtccgtgatttatctgcgccgttttacgccgaattgacggccggattgacggaagctctggaagcgcagggacggatggtttttttgcttcacggcggtaaagacggcgagcagctggcacagcggttttcactattactgaatcagggtgtcgatggtgtggtcattgccggggctgcaggaagcagcgatgacctgcgacggatagcagaagaaaaagctatcccggtgattttcgcttcccgtgccagttatcttgatgacgttgatacggttcgcccggacaacatgcaggctgcacagttgttgacggagcatctcattcgcaatgggcatcagcgtatcgcctggctgggaggacaaagttcctcattaacccgggcagaacgggtggggggctattgtgcgactctactaaaatttggcctgccgtttcacagcgattgggtgctggagtgcacttccagccagaagcaagccgcggaagctatcacggcgcttttacgtcataacccgaccatcagcgccgtggtttgctataacgaaactattgcgatgggggcatggtttggtttgctgaaagcaggaaggcaaagcggggaaagcggagtcgatcgttactttgagcaacaggtttcgctggcggcatttaccgatgcaacgccaaccacacttgatgatatacccgttacctgggccagcacgccagcgcgggaacttggtaccacacttgcggatcgcatgatgcaaaaaatcacccatgaagagacgcattctagcaatcttattattcctgcccggctcattgcggagaaataa

SEQ ID NO: 4006 - protein, 342 aa, Escherichia coli
MATAKKITIHDVALAAGVSVSTVSLVLSGKGRISTATGERVNAAIEELGFVRNRQASALRGGQSGVIGLIVRDLSAPFYAELTAGLTEALEAQGRMVFLLHGGKDGEQLAQRFSLLLNQGVDGVVIAGAAGSSDDLRRIAEEKAIPVIFASRASYLDDVDTVRPDNMQAAQLLTEHLIRNGHQRIAWLGGQSSSLTRAERVGGYCATLLKFGLPFHSDWVLECTSSQKQAAEAITALLRHNPTISAVVCYNETIAMGAWFGLLKAGRQSGESGVDRYFEQQVSLAAFTDATPTTLDDIPVTWASTPARELGTTLADRMMQKITHEETHSSNLIIPARLIAEK

SEQ ID NO: 4007 - DNA, 1593 bp, Escherichia coli
atgacggcgaaaacagcaccgaaagtcacgctgtgggagttcttccagcagttaggcaaaaccttcatgttacccgtggcattattgtcgttctgcggcattatgctcggcattggtagttctcttagcagccatgatgtcatcaccctgatcccggtcctgggcaaccccgtgttgcaggctatctttacctggatgagtaagattggctcgtttgcttttagtttcctgccagtcatgttctgtatcgccatcccgctgggtctggcacgcgaaaacaaaggcgtagcggcattcgctggcttcgtcggttatgcggtaatgaacctcgcggtaaacttctggttgaccaataaaggcattctgccaaccacggacgccgcagttctgaaagccaataacatccagagcattcttgggatccagtcgatcgacaccgggatcctcggtgcggtgatcgccggtattatcgtctggatgctgcatgagcgattccataatatccgcctgccggatgcgctggcattcttcggcggtacgcgcttcgtaccaatcatctcctcgctagtgatgggtcttgtcggcctggtgattccattagtctggccgattttcgccatgggtattagcggcttaggccatatgatcaacagcgcgggagatttcggaccgatgctgtttggtaccggtgaacgtctgctgttgccgtttggtctgcatcacattctggtggcattaattcgctttaccgacgcaggcggcacgcaggaagtctgcggtcaaaccgtcagcggtgcactgaccatcttccaggcgcaattgagttgcccaaccactcacggtttttctgaaagcgccacgcgtttcctttcgcaaggtaaaatgcctgcgtttctcggcggtctgccaggtgcagcgttagctatgtatcactgtgcgcgcccggaaaatcgccataaaattaaaggtctgctgatttctggcctgatcgcctgtgtcgttggcggcacgaccgaaccgctggaattcctgttcctgttcgtagcgccagttctgtatgtcatccacgcgctgttaaccggcctcggcttcactgtcatgtctgtgctcggcgtcaccatcggtaataccgacggcaatatcatcgactttgtggtgttcggtattttgcatggtctgtcaaccaagtggtacatggtgccagtagtggcggcaatctggtttgtcgtttactacatcatcttccgtttcgctatcacccgcttcaatctcaaaaccccggggcgcgatagtgaagttgccagttcaatcgaaaaagccgttgccggtgcgccgggtaaatcaggttacaacgttccggcaatcctcgaagccttaggcggtgccgacaatattgtcagcctcgataactgcattacgcgtctgcgtttgtctgtaaaagatatgtcgcttgttaatgtgcaggcactgaaggacaatcgggcaattggcgtagtacaacttaatcaacataacctgcaggttgttatcgggccacaagttcagtcagtaaaagatgaaatggccggtctgatgcatactgtccaggcataa

SEQ ID NO: 4008 - protein, 530 aa, Escherichia coli
MTAKTAPKVTLWEFFQQLGKTFMLPVALLSFCGIMLGIGSSLSSHDVITLIPVLGNPVLQAIFTWMSKIGSFAFSFLPVMFCIAIPLGLARENKGVAAFAGFVGYAVMNLAVNFWLTNKGILPTTDAAVLKANNIQSILGIQSIDTGILGAVIAGIIVWMLHERFHNIRLPDALAFFGGTRFVPIISSLVMGLVGLVIPLVWPIFAMGISGLGHMINSAGDFGPMLFGTGERLLLPFGLHHILVALIRFTDAGGTQEVCGQTVSGALTIFQAQLSCPTTHGFSESATRFLSQGKMPAFLGGLPGAALAMYHCARPENRHKIKGLLISGLIACVVGGTTEPLEFLFLFVAPVLYVIHALLTGLGFTVMSVLGVTIGNTDGNIIDFVVFGILHGLSTKWYMVPVVAAIWFVVYYIIFRFAITRFNLKTPGRDSEVASSIEKAVAGAPGKSGYNVPAILEALGGADNIVSLDNCITRLRLSVKDMSLVNVQALKDNRAIGVVQLNQHNLQVVIGPQVQSVKDEMAGLMHTVQA

SEQ ID NO: 4009 - DNA, 1173 bp, Escherichia coli
atgttcgatttttcaaaggtcgtggatcgtcatggcacatggtgtacgcagtgggattatgtcgctgaccgtttcggcactgctgacctgttaccgttcacgatttcagacatggattttgccactgccccctgcattatcgaggcgctgaatcagcgcctgatacacggcgtgtttggctacagccgctggaaaaacgatgagtttctcgcggctattgcccactggttttccacccagcattacaccgccatcgatcctcagtcggtggtgtatggcccttctgttatctatatggtttcagaactgattcgtcagtggtctgaaacaggtgaaggcgtggtgatccacacacccgcctatgacgcattttacaaggccattgaaggtaaccagcgcacagtaatgcccgttgctttagagaagcagcctgacggctggttttgcgatatgggcaagctggaagccgtgctggcgaaaccagaatgtaaaattatgctcctgtgtagcccacagaatcctaccgggaaagtgtggacgtgcgatgagctggagatcatggctgacctgtgcgagcgtcatggtgtgcgggttatttccgatgaaatccatatggatatggtttggggcgagcagccgcatattccctggagtaatgtggcgcgcggagactgggcgttgctaacgtcgggatcaaaaagtttcaatattcccgccctgaccggtgcttacgggattatagaaaatagcagtagccgcgatgcctatttatcggcactgaaaggacgtgatgggctttcttccccttcggtactggcgttaactgctcatatcgccgcctatcagcaaggcgcaccatggctggatgccttacgcgtctatctgaaagataacctgacgtatatcgcagataaaatgaacgctgcgtttcctgaactcaactggcagatcccgcaatccacttatctggcctggcttgatctacgtccgttgaatattgacgacaacgcgttgcaaaaagcgcttatcgagcaagaaaagatcgcgatcatgccgggatatacctacggtgaagaaggtcgtggttttgtccgactcaatgccggctgcccacgttcgaaactggaaaaaggtgtggctggattaattaacgccatccgcgctgttggttaa

SEQ ID NO: 4010 - protein, 390 aa, Escherichia coli
MFDFSKVVDRHGTWCTQWDYVADRFGTADLLPFTISDMDFATAPCIIEALNQRLIHGVFGYSRWKNDEFLAAIAHWFSTQHYTAIDPQSVVYGPSVIYMVSELIRQWSETGEGVVIHTPAYDAFYKAIEGNQRTVMPVALEKQPDGWFCDMGKLEAVLAKPECKIMLLCSPQNPTGKVWTCDELEIMADLCERHGVRVISDEIHMDMVWGEQPHIPWSNVARGDWALLTSGSKSFNIPALTGAYGIIENSSSRDAYLSALKGRDGLSSPSVLALTAHIAAYQQGAPWLDALRVYLKDNLTYIADKMNAAFPELNWQIPQSTYLAWLDLRPLNIDDNALQKALIEQEKIAIMPGYTYGEEGRGFVRLNAGCPRSKLEKGVAGLINAIRAVG

SEQ ID NO: 4011 - DNA, 1002 bp, Escherichia coli
atgattgataccaccctgccattaactgatatccatcgccaccttgatggcaacattcgtccccagaccattcttgaacttggccgccagtataatatctcgcttcctgcacaatccctggaaacactgattccccacgttcaggtcattgccaacgaacccgatctggtgagctttctgactaaacttgactggggcgttaaagttctcgcctctcttgatgcctgccgccgcgtggcatttgaaaacattgaagatgcagcccgtaacggcctgcactatgtcgagctgcgtttttcaccaggctacatggcaatggcacatcagctgcctgtagcgggtgttgtcgaagcggtgatcgatggcgtacgtgaaggttgccgcacctttggtgtgcaggcgaagcttatcggtattatgagccggaccttcggcgaagccgcctgtcagcaagagctggaggcctttttagcccaccgtgaccagattaccgcacttgatttagccggtgatgaacttggtttcccgggaagtctgttcctttctcatttcaaccgcgcgcgtgatgcgggctggcatattaccgtccatgcaggcgaagctgccggaccggaaagcatctggcaggcgattcgtgaactgggggcggagcgtattggacatggcgtaaaagccattgaagatcgggcgctgatggattttctcgccgagcaacaaattggtattgaatcctgtctgacctccaatattcagaccagcaccgtggcggatctggctgcacatccgctgaaaacgttccttgagcatggcattcgtgccagcattaacactgacgatccaggcgtgcagggagtggatatcattcacgaatataccgttgccgcgccagctgctgggttatcccgcgagcaaatccgccaggcacagattaatggtctggaaatggctttcctcagcgcagaggaaaaacgcgcactgcgagaaaaagtcgccgcgaagtaa

SEQ ID NO: 4012 - protein, 333 aa, Escherichia coli
MIDTTLPLTDIHRHLDGNIRPQTILELGRQYNISLPAQSLETLIPHVQVIANEPDLVSFLTKLDWGVKVLASLDACRRVAFENIEDAARNGLHYVELRFSPGYMAMAHQLPVAGVVEAVIDGVREGCRTFGVQAKLIGIMSRTFGEAACQQELEAFLAHRDQITALDLAGDELGFPGSLFLSHFNRARDAGWHITVHAGEAAGPESIWQAIRELGAERIGHGVKAIEDRALMDFLAEQQIGIESCLTSNIQTSTVADLAAHPLKTFLEHGIRASINTDDPGVQGVDIIHEYTVAAPAAGLSREQIRQAQINGLEMAFLSAEEKRALREKVAAK

SEQ ID NO: 4013 - DNA, 1080 bp, Escherichia coli
gtgtcaaatagccatcatacttcaatgagaggcaatgacatgagcgacaacatccgtgttgggttgattgggtatggttatgcgagcaaaaccttccatgcgcccctgattgcgggcacgcccgggctggagctggcggtaatctccagcagcgatgaaacaaaagtaaaagctgactggccaacggttacggttgtctctgagccgaagcatctgtttaacgatcccaacatagacctgattgtcattcctacacccaacgatacccattttccgttagccaaagcggcgcttgaggcgggtaaacatgtggtcgttgataaaccctttaccgtgacactgtcacaagcgcgagagctggatgcgctggcaaaaagcctggggcgagtgctgtctgtattccataaccgtcgctgggatagcgatttcctgacgcttaaaggtttgctcgcggaaggcgtgctgggtgaaattgcttacgttgagtcccattttgaccgcttccgcccgcaggtgcgcgatcgttggcgtgaacagggcggcccaggcagcggtatctggtacgatttagcaccgcaccttcttgatcaggccattacgttatttggtttaccggttagcatgacggtagatttggcacagttacggcccggagcgcagtcgaccgattatttccacgctatcttgtcctatccgcagcggcgagtgattttacacggcaccatgctggcagcagccgagtcagcacggtatatcgtgcatggatcccgaggcagttatgtgaaatatggcctcgatccacaggaagaacgtctgaaaaatggcgagcgtctgccgcaggaagactggggctacgatatgcgcgatggcgtacttacccgcgtggaaggtgaggaacgtgtcgaagaaacgctgttgacagtgccggggaattatccggcttactatgcggctattcgtgatgcgttaaatggcgatggtgaaaatccggttccggcaagtcaggcaatccaggtaatggagttgattgagctgggcatcgaatccgccaaacatcgcgcgactttgtgccttgcgtga

SEQ ID NO: 4014 - protein, 359 aa, Escherichia coli
MSNSHHTSMRGNDMSDNIRVGLIGYGYASKTFHAPLIAGTPGLELAVISSSDETKVKADWPTVTVVSEPKHLFNDPNIDLIVIPTPNDTHFPLAKAALEAGKHVVVDKPFTVTLSQARELDALAKSLGRVLSVFHNRRWDSDFLTLKGLLAEGVLGEIAYVESHFDRFRPQVRDRWREQGGPGSGIWYDLAPHLLDQAITLFGLPVSMTVDLAQLRPGAQSTDYFHAILSYPQRRVILHGTMLAAAESARYIVHGSRGSYVKYGLDPQEERLKNGERLPQEDWGYDMRDGVLTRVEGEERVEETLLTVPGNYPAYYAAIRDALNGDGENPVPASQAIQVMELIELGIESAKHRATLCLA

SEQ ID NO: 4015 - DNA, 216 bp, Escherichia coli
atgactgttcaggactacttattaaaatttcgcaaaatcagttcactcgaaagtctggaaaaactctacgatcatcttaattacaccctgacggacgatcaggaactgatcaatatgtatcgtgctgccgatcaccgtcgcgcagagctggtttctggcgggcgtttgtttgacctcggccaggtaccgaagtccgtctggcactatgtccagtaa

SEQ ID NO: 4016 - protein, 71 aa, Escherichia coli
MTVQDYLLKFRKISSLESLEKLYDHLNYTLTDDQELINMYRAADHRRAELVSGGRLFDLGQVPKSVWHYVQ

SEQ ID NO: 4017 - DNA, 441 bp, Escherichia coli
atgaccaccacaacgccacaacgtattggaggctggttgcttggcccgttggcctggcttttagtcgctctgttgagtacgacgctggcgttgttgctgtataccgctgcgttatcttctccgcaaacatttcaaacgctcggcggacaagcactgacgacacaaatcttatggggcgtttcttttattaccgctatcgccatgtggtattacacactgtggttgaccatcgctttctttaaacgtcggcgttgtgttcctaaacactatattatctggctgcttatttccgtattgctggcagtaaaagcgttcgctttttcacccgtagaagatggcatagccgttcgccagttgctgtttactttgttggcaaccgcattgatcgtcccctatttcaaacgctcgtcgcgggtgaaagcgacgtttgtgaatccgtaa

SEQ ID NO: 4018 - protein, 146 aa, Escherichia coli
MTTTTPQRIGGWLLGPLAWLLVALLSTTLALLLYTAALSSPQTFQTLGGQALTTQILWGVSFITAIAMWYYTLWLTIAFFKRRRCVPKHYIIWLLISVLLAVKAFAFSPVEDGIAVRQLLFTLLATALIVPYFKRSSRVKATFVNP

SEQ ID NO: 4019 - DNA, 582 bp, Escherichia coli
atgactgactacctgttactgtttgtcggaactgtactggtcaataactttgtactggtcaagtttctcggtctctgtccgtttatgggggtttccaaaaagctggaaaccgcgatgggcatggggctggcaacaacgtttgtgatgacgctggcgtctatttgcgcctggcttatcgatacgtggattttgatcccacttaatctgatatacctgcgcaccatggcgtttattctggtgattgctgtggttgtgcagttcaccgaaatggtggtgcgcaaaaccagcccggtactttaccgtctgctggggatttttttgccgcttatcactaccaactgtgccgtgctcggcgtggcgttgctgaatatcaatctcgggcacaatttcttgcagtcagcgctgtacggtttttccgccgctgtcggtttctcgctggtgatggtgctcttcgccgccatccgcgaacgccttgctgtggctgatgtcccggcaccttttcgcggtaatgccattgcgttaattaccgcaggtcttatgtctctggcctttatgggctttagtggtttggtgaagttgtaa

SEQ ID NO: 4020 - protein, 193 aa, Escherichia coli
MTDYLLLFVGTVLVNNFVLVKFLGLCPFMGVSKKLETAMGMGLATTFVMTLASICAWLIDTWILIPLNLIYLRTMAFILVIAVVVQFTEMVVRKTSPVLYRLLGIFLPLITTNCAVLGVALLNINLGHNFLQSALYGFSAAVGFSLVMVLFAAIRERLAVADVPAPFRGNAIALITAGLMSLAFMGFSGLVKL

SEQ ID NO: 4021 - DNA, 579 bp, Escherichia coli
atgaatgctatctggattgccgttgccgccgtgagcctgctgggcctggcgtttggcgccattctgggttatgcctcccgccgttttgcggtggaagacgatccggtcgttgagaaaattgacgaaatcttaccgcagagccagtgtggtcagtgcggttatcccggctgtcgcccctacgcggaagccatcagctgtaacggtgaaaaaatcaaccgttgcgccccaggtggcgaagctgtgatgctaaaaattgccgagttgcttaatgtcgagccgcagccgctggatggcgaagcgcaagagctaacgccagcgcggatggtggcggtgattgatgaaaataactgtattggctgcactaaatgtattcaggcgtgtccggtagacgccatcgttggcgctacccgcgccatgcatacggtaatgagtgatctctgtacgggctgcaatttatgtgttgatccgtgcccgacgcactgcatctcgttgcaaccggtcgcagaaactcctgactcctggaaatgggatctgaacaccattcccgtgcgtatcattcccgtggaacaccatgcttaa

SEQ ID NO: 4022 - protein, 192 aa, Escherichia coli
MNAIWIAVAAVSLLGLAFGAILGYASRRFAVEDDPVVEKIDEILPQSQCGQCGYPGCRPYAEAISCNGEKINRCAPGGEAVMLKIAELLNVEPQPLDGEAQELTPARMVAVIDENNCIGCTKCIQACPVDAIVGATRAMHTVMSDLCTGCNLCVDPCPTHCISLQPVAETPDSWKWDLNTIPVRIIPVEHHA

SEQ ID NO: 4023 - DNA, 2127 bp, Escherichia coli
atgcttaagttattctctgcattcagaaaaaataaaatctgggatttcaacggcggcatccatccaccggagatgaaaacccagtccaacggtacgcccctgcgccaggtaccactggcgcagcgttttgtcattccactgaaacaacatattggcgctgaaggtgagttgtgcgttagcgtcggcgataaagtattgcgcggccagccgcttacccgtggtcgcggcaaaatgctgccggttcacgcgcccacctcgggtaccgttacggctattgcgccccactctacggctcatccttcagctttagctgaattaagtgtgattattgatgccgatggcgaagactgctggatcccgcgcgacggctgggccgattatcgctctcgcagtcgcgaagagttaatcgagcgcattcatcagtttggtgttgccgggctgggtggtgcgggatttccgacaggcgttaaattgcagggcggcggagataagattgaaacgttgattatcaacgctgctgagtgcgagccgtacattaccgccgatgaccgtttgatgcaggattgtgcggctcaggtcgtagagggtatccgcatccttgcgcatattctgcagccacgcgaaattcttatcggtattgaagataacaaaccgcaggcgatttccatgctgcgcgcggtgctggcagactctcacgatatttctctgcgggtgattcccaccaaatatccttctggcggtgctaaacaattaacctacattctgaccgggaagcaggttccacatggcgggcgttcatccgatatcggcgtattaatgcaaaacgtcggcaccgcttatgcagtgaaacgtgccgttattgatggcgagccgattaccgagcgtgtcgtgaccctgactggcgaagcaatcgctcgcccgggcaacgtctgggcacggctgggtacgccagtgcgtcatttattgaatgatgccggattctgcccctctgccgatcaaatggtgattatgggcggcccgctaatgggctttaccttgccgtggctggatgtcccggtcgtaaagattaccaactgtctgttggctccctctgccaatgaacttggcgaaccacaggaagaacaaagttgcatccgttgtagcgcctgtgctgacgcctgccctgcggatcttttgccgcaacagctgtactggttcagcaaaggtcagcaacacgataaagccaccacgcataacattgccgactgcattgaatgtggagcttgcgcgtgggtttgcccgagcaatatccccctggtgcaatatttccgtcaggaaaaagctgaaattgcggctattcgtcaggaagaaaagcgcgccgcagaagccaaagcgcgtttcgaagcgcgccaggctcgtctggagcgcgaaaaagcggctcgccttgaacgacataagagcgcagccgttcaacctgcagccaaagataaagatgcgattgctgccgctctggcgcgggtgaaagagaaacaggcccaggctacacagcctattgtgattaaagcgggcgaacgcccggataacagtgcaattattgcagcacgggaagcccgtaaagcgcaagccagagcgaaacaggcagaactgcagcaaactaacgacgctgcaaccgttgctgatccacgtaaaactgcagttgaagcggctattgcccgcgccaaagcacgtaagctggaacagcaacaggctaatgcggagccagaagaacagattgatccgcgcaaagccgccgtcgaagctgctattgcccgtgccaaagcacgcaagctggaacagcaacaggctaatgcggagccagaagaacagattgatccgcgcaaagccgccgtcgaagctgctattgcccgtgccaaagcacgcaagctggaacagcaacaggctaatgcggagccagaagaacagattgatccgcgcaaagctgccgtcgaagcggctattgcccgtgccaaagcacgcaagctggaacagcaacaggctaatgcagagccagaagaacagattgatccgcgcaaagcggcagttgctgcggctattgcccgcgttcaggccaaaaaagccgcccagcaaaaggttgtaaacgaggactaa

SEQ ID NO: 4024 - protein, 708 aa, Escherichia coli
MLKLFSAFRKNKIWDFNGGIHPPEMKTQSNGTPLRQVPLAQRFVIPLKQHIGAEGELCVSVGDKVLRGQPLTRGRGKMLPVHAPTSGTVTAIAPHSTAHPSALAELSVIIDADGEDCWIPRDGWADYRSRSREELIERIHQFGVAGLGGAGFPTGVKLQGGGDKIETLIINAAECEPYITADDRLMQDCAAQVVEGIRILAHILQPREILIGIEDNKPQAISMLRAVLADSHDISLRVIPTKYPSGGAKQLTYILTGKQVPHGGRSSDIGVLMQNVGTAYAVKRAVIDGEPITERVVTLTGEAIARPGNVWARLGTPVRHLLNDAGFCPSADQMVIMGGPLMGFTLPWLDVPVVKITNCLLAPSANELGEPQEEQSCIRCSACADACPADLLPQQLYWFSKGQQHDKATTHNIADCIECGACAWVCPSNIPLVQYFRQEKAEIAAIRQEEKRAAEAKARFEARQARLEREKAARLERHKSAAVQPAAKDKDAIAAALARVKEKQAQATQPIVIKAGERPDNSAIIAAREARKAQARAKQAELQQTNDAATVADPRKTAVEAAIARAKARKLEQQQANAEPEEQIDPRKAAVEAAIARAKARKLEQQQANAEPEEQIDPRKAAVEAAIARAKARKLEQQQANAEPEEQIDPRKAAVEAAIARAKARKLEQQQANAEPEEQIDPRKAAVAAAIARVQAKKAAQQKVVNED

SEQ ID NO: 4025 - DNA, 1059 bp, Escherichia coli
atggtattcagaatagctagctccccttatacccataaccagcgccagacatcgcgcattatgctgttggtattgctcgcagccgtgccaggaatcgcagcgcaactgtggttttttggttggggtactctcgttcagatcctgttggcgtcggtcagtgctcttctggccgaagctctcgtcctcaaactacgcaagcagtcggtagctgcaacgttgaaagataactcagcattgctgacaggcttattgctggcggtaagtattccccctctcgcgccatggtggatggtcgtgctgggtacggtgtttgcggtgatcatcgctaaacagttgtatggcggtctggggcaaaacccgtttaatccggcaatgattggttatgtggtcttactgatctccttcccggtgcagatgaccagttggttaccgccacatgaaattgcggtcaacatccctggttttatcgacgccatacaggttattttcagtggtcataccaccagtggtggtgatatgaacacgctacgcttaggtattgatggcattagtcaggcgacaccgctggatacatttaaaacctctgtccgtgccggtcattcggttgaagagattatgcaatatccgatctacagcggtattctggcgggcgctggttggcaatgggtaaatctcgcctggctggctggcggcgtgtggttgctatggcagaaagcgattcgctggcatgttcccctcagcttcttagtaacgctggcgttatgcgcaacgttgggctggttgttctcaccagatactctggcagcaccgcaaattcatctgctgtctggtgcgaccatgctcggcgcattctttattttgactgacccggttaccgcttctacgaccaatcgtggtcgtcttattttcggcgcgctggcgggcttattagtctggatgatccgcagtttcggcggctatcctgacggcgttgcttttgccgtcctgctggcgaacatcacggttcctctgatcgattactacacgcgtccgcgcgtctacggccatcgcaaagggtaa

SEQ ID NO: 4026 - protein, 352 aa, Escherichia coli
MVFRIASSPYTHNQRQTSRIMLLVLLAAVPGIAAQLWFFGWGTLVQILLASVSALLAEALVLKLRKQSVAATLKDNSALLTGLLLAVSIPPLAPWWMVVLGTVFAVIIAKQLYGGLGQNPFNPAMIGYVVLLISFPVQMTSWLPPHEIAVNIPGFIDAIQVIFSGHTTSGGDMNTLRLGIDGISQATPLDTFKTSVRAGHSVEEIMQYPIYSGILAGAGWQWVNLAWLAGGVWLLWQKAIRWHVPLSFLVTLALCATLGWLFSPDTLAAPQIHLLSGATMLGAFFILTDPVTASTTNRGRLIFGALAGLLVWMIRSFGGYPDGVAFAVLLANITVPLIDYYTRPRVYGHRKG

SEQ ID NO: 4027 - DNA, 621 bp, Escherichia coli
atgctgaaaactatccgaaaacacggcattacgttggcgctctttgcagcgggttcaacagggttaactgcggccatcaaccagatgaccaaaacgacaattgctgaacaggccagtctgcaacaaaaggcgttatttgatcaggtgctgccagctgaacgctataacaatgcgctggcacagagttgctatctggtaactgcgccagagttaggtaaaggtgagcatcgggtttacatcgccaaacaggatgacaaaccggtagctgccgttctggaagcaaccgcgccagatggctattccggtgcgattcagctgctggtgggagccgattttaacggcacggtacttggcacgcgcgtgactgagcaccacgaaacgccagggcttggcgataaaatcgaactgcgcctttctgactggatcacccattttgcgggtaaaaaaatcagtggtgcggatgatgcgaactgggcggtgaagaaagatggtggtgatttcgaccagttcaccggcgcgacgattactccccgcgcggtggttaatgcggtaaaacgcgccggattgtacgctcagacgttaccggcacaactttctcaacttcctgcctgtggagaataa

SEQ ID NO: 4028 - protein, 206 aa, Escherichia coli
MLKTIRKHGITLALFAAGSTGLTAAINQMTKTTIAEQASLQQKALFDQVLPAERYNNALAQSCYLVTAPELGKGEHRVYIAKQDDKPVAAVLEATAPDGYSGAIQLLVGADFNGTVLGTRVTEHHETPGLGDKIELRLSDWITHFAGKKISGADDANWAVKKDGGDFDQFTGATITPRAVVNAVKRAGLYAQTLPAQLSQLPACGE

SEQ ID NO: 4029 - DNA, 696 bp, Escherichia coli
gtgagcgaaattaaagacgttattgttcaggggttgtggaaaaacaactctgcgctggtccagttgctcggcctttgtccgctgttggcggtcacgtccactgccactaacgctctgggtttaggacttgcgactacgctggtactgacgctaaccaacctgaccatttcgacgctgcgtcactggacgcccgccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcgccgccaaaaaaggtccggcgctttcggcactggacggcttttcaattggtatgggcgcaacctgcgccatgttcgtgctgggttcactacgcgaaattatcggcaatggcacgttgtttgacggtgcagatgcgctgttaggtagctgggcgaaagtattacgcgtggagattttccgcaccgactcccctttcctgctggcgatgctgccaccaggtgcatttattggcctgggactgatgctggcaggaaaatacctgattgatgaaaaaatgaaaaagcgccgtactgaagcagttgccgaacgtgcattgccaaacggtgaaacagggaatgtctga

SEQ ID NO: 4030 - protein, 231 aa, Escherichia coli
MSEIKDVIVQGLWKNNSALVQLLGLCPLLAVTSTATNALGLGLATTLVLTLTNLTISTLRHWTPAEIRIPIYVMIIASVVSAVQMLINAYAFGLYQSLGIFIPLIVTNCIVVGRAEAFAAKKGPALSALDGFSIGMGATCAMFVLGSLREIIGNGTLFDGADALLGSWAKVLRVEIFRTDSPFLLAMLPPGAFIGLGLMLAGKYLIDEKMKKRRTEAVAERALPNGETGNV

SEQ ID NO: 4031 - DNA, 636 bp, Escherichia coli
atgaacaaagcaaaacgcctggagatcctcactcgcctgcgtgagaacaatcctcatcccaccaccgagcttaatttcagttcgccttttgaattgctgattgccgtactgctttccgctcaggcgaccgatgtcagtgttaataaggcgacggcgaaactctacccggtggctaatacgcctgcagcgatgcttgaactgggcgttgaaggggtgaaaacctatatcaaaacgattggcctttataacagcaaagcagaaaatatcatcaaaacctgccgtatattactggaacaacataatggcgaggttccggaagatcgtgctgcgcttgaagccctgcctggcgtaggtcgtaaaacagccaacgtcgtattaaacactgcattcggctggccgactattgctgtcgacacgcacattttccgcgtttgcaatcgtactcaatttgcgccggggaaaaacgtcgaacaggtagaagaaaagctactgaaagtggttccggcagagtttaaagtcgactgccaccattggttgattctgcacgggcgttatacctgcattgcccgcaagcctcgctgtggctcttgtattattgaagatctttgtgaatacaaagagaaagttgacatctaa

SEQ ID NO: 4032 - protein, 211 aa, Escherichia coli
MNKAKRLEILTRLRENNPHPTTELNFSSPFELLIAVLLSAQATDVSVNKATAKLYPVANTPAAMLELGVEGVKTYIKTIGLYNSKAENIIKTCRILLEQHNGEVPEDRAALEALPGVGRKTANVVLNTAFGWPTIAVDTHIFRVCNRTQFAPGKNVEQVEEKLLKVVPAEFKVDCHHWLILHGRYTCIARKPRCGSCIIEDLCEYKEKVDI

SEQ ID NO: 4033 - DNA, 1503 bp, Escherichia coli
gtgtccactgcaaaccaaaaaccaactgaaagcgtcagtttgaacgcttttaaacaaccgaaggcgttctatctcatcttctcgattgagttatgggaacgttttggttattacggcctacaaggaattatggctgtttacctggttaaacaactgggtatgtctgaagcggattcaatcacccttttctcttcctttagtgccctggtttatggtctggtcgctatcggcggctggttaggtgacaaggtactgggtactaaacgcgtaattatgctcggcgctattgtgctggcgattggttatgctctggttgcctggtctggtcacgacgccggtatcgtttatatgggtatggcggctattgcggtcggtaacggcctgtttaaagctaacccgtcttctctgctttctacatgctatgagaaaaacgacccgcgtctggacggtgcattcaccatgtactacatgtccgtcaacatcggctctttcttctctatgattgctacgccgtggctggccgcgaaatacggctggagtgttgcgtttgcgttgagcgttgtaggcctgctgatcactatcgttaacttcgccttctgccaacgttgggttaaacagtacggttcaaaaccagacttcgagcctatcaactaccgtaacctgctgctgaccattattggtgttgtggcactgatcgctatcgccacctggctgctgcacaatcaggaagttgcgcgtatggcgctgggcgttgttgccttcggtatcgtggttatcttcggtaaagaagccttcgcgatgaaaggtgctgcgcgtcgtaaaatgatcgttgccttcatcctgatgctcgaagccattatcttcttcgtgctttatagccagatgccaacgtcactgaacttctttgcgattcgtaacgttgaacacaccattctgggcctggccgtagaacctgagcagtatcaggcactgaacccgttctggatcatcattggtagcccgattctggccgctatctataacaagatgggcgataccctgccaatgccaaccaagtttgctatcggcatggtgatgtgttctggtgcgttcctgattctgccgctgggtgcgaaattcgcgtctgacgctggtatcgtgtctgtaagctggctggtcgcgagctatggcctgcagagtatcggggaactgatgatctctggcctgggtctggcaatggttgcacaactcgttccgcagcgtctgatgggcttcattatgggtagctggttcctgaccactgccggtgcaaacctgattggtggttatgttgcaggtatgatggctgtgccggataacgttaccgatccgctgatgtcactggaagtctatggtcgcgtattcttgcagattggtgtcgctactgccgttattgcagtactgatgctgtttaccgcgccgaaactgcaccgcatgacgcaggatgacgctgcagacaaagcggcgaaagcagccgtagcgtaa

SEQ ID NO: 4034 - protein, 500 aa, Escherichia coli
MSTANQKPTESVSLNAFKQPKAFYLIFSIELWERFGYYGLQGIMAVYLVKQLGMSEADSITLFSSFSALVYGLVAIGGWLGDKVLGTKRVIMLGAIVLAIGYALVAWSGHDAGIVYMGMAAIAVGNGLFKANPSSLLSTCYEKNDPRLDGAFTMYYMSVNIGSFFSMIATPWLAAKYGWSVAFALSVVGLLITIVNFAFCQRWVKQYGSKPDFEPINYRNLLLTIIGVVALIAIATWLLHNQEVARMALGVVAFGIVVIFGKEAFAMKGAARRKMIVAFILMLEAIIFFVLYSQMPTSLNFFAIRNVEHTILGLAVEPEQYQALNPFWIIIGSPILAAIYNKMGDTLPMPTKFAIGMVMCSGAFLILPLGAKFASDAGIVSVSWLVASYGLQSIGELMISGLGLAMVAQLVPQRLMGFIMGSWFLTTAGANLIGGYVAGMMAVPDNVTDPLMSLEVYGRVFLQIGVATAVIAVLMLFTAPKLHRMTQDDAADKAAKAAVA

SEQ ID NO: 4035 - DNA, 606 bp, Escherichia coli
atgaaattgttctacaaaccgggcgcctgctctctcgcttcccatatcaccctgcgtgagagcggaaaggattttacgctcgtcagtgtggatttaatgaaaaaacgtctcgaaaacggtgacaattactttgccgttaaccctaagggacaagtacctgcattgctgctggacgatggtactttgctgacggaaggcgtagcgattatgcagtatcttgccgacagcgtccccgaccgccagttgctggcaccggtaaacagtatttcccgctataaaaccatcgaatggctgaattacatcgccaccgagctgcataaaggtttcacacctctgtttcgccctgatacaccggaagagtacaaatcgacagttcgcgcgcagctggagaagaagctgcaatatgtgaacgaggcactgaaggatgagcattggatctgcgggcaacgatttacaattgctgatgcctatctgtttacggttctgcgctgggcatacgcggtgaaactgaatctggaagggttagagcacattgcggcatttatgcaacgtatggctgaacgtccggaagtacaagacgcgctgtcagcggaaggcttaaagtaa

SEQ ID NO: 4036 - protein, 201 aa, Escherichia coli
MKLFYKPGACSLASHITLRESGKDFTLVSVDLMKKRLENGDNYFAVNPKGQVPALLLDDGTLLTEGVAIMQYLADSVPDRQLLAPVNSISRYKTIEWLNYIATELHKGFTPLFRPDTPEEYKSTVRAQLEKKLQYVNEALKDEHWICGQRFTIADAYLFTVLRWAYAVKLNLEGLEHIAAFMQRMAERPEVQDALSAEGLK

SEQ ID NO: 4037 - DNA, 864 bp, Escherichia coli
atgatgaaaaatattctcgctatccagtctcacgttgtttatggtcatgcgggtaacagtgcggcagagtttccgatgcgccgcctgggcgcgaacgtctggccgctgaacaccgttcaattttctaatcacacccaatacggcaaatggactggctgtgtgatgccacccagccatttaaccgaaattgtgcaaggcattgccgccattgataaattacacacctgtgatgccgtattaagtggctatctgggatcggcggagcagggtgaacatatcctcggtatcgttcgtcaggtgaaagcagcgaatccacaggcgaaatatttttgcgatccggtaatgggtcatccggaaaaaggctgtatcgttgcaccgggtgtcgcagagtttcatgtgcggcacggtttgcctgccagcgatatcattgcgccgaatctggttgagctggaaatactctgtgagcatccggtaaataacgtcgaagaagcggttctggcagcgcgcgaactcattgcgcaaggaccacaaattgtgttggttaaacacctggcgcgagctggctacagccgtgaccgttttgaaatgctgctagtcaccgccgatgaagcctggcatatcagccgtccgctggtggattttggtatgcgccagccggtaggtgttggtgatgtgacgagcggcttactgctggtgaaactgcttcagggggcaacgctgcaggaggccctggaacatgtgaccgctgcagtatacgaaatcatggtgaccacaaaagcaatgcaggaatatgagctgcaagtggttgctgctcaggatcgtattgccaatccagaacattatttcagcgcaacaaagctctga

SEQ ID NO: 4038 - protein, 287 aa, Escherichia coli
MMKNILAIQSHVVYGHAGNSAAEFPMRRLGANVWPLNTVQFSNHTQYGKWTGCVMPPSHLTEIVQGIAAIDKLHTCDAVLSGYLGSAEQGEHILGIVRQVKAANPQAKYFCDPVMGHPEKGCIVAPGVAEFHVRHGLPASDIIAPNLVELEILCEHPVNNVEEAVLAARELIAQGPQIVLVKHLARAGYSRDRFEMLLVTADEAWHISRPLVDFGMRQPVGVGDVTSGLLLVKLLQGATLQEALEHVTAAVYEIMVTTKAMQEYELQVVAAQDRIANPEHYFSATKL

SEQ ID NO: 4039 - DNA, 1275 bp, Escherichia coli
atggcaagcagtaacttgattaaacaattgcaagagcgggggctggtagcccaggtgacggacgaggaagcgttagcagagcgactggcgcaaggcccgatcgcgctctattgcggcttcgatcctaccgctgacagcttgcatttggggcatcttgttccattgttatgcctgaaacgcttccagcaggcgggccacaagccggttgcgctggtaggcggcgcgacgggtctgattggcgacccgagcttcaaagctgccgagcgtaagctgaacactgaagaaactgttcaggagtgggtggacaaaatccgcaagcaggttgccccgttcctcgatttcgactgtggagaaaactctgctatcgcggcgaacaactatgactggttcggcaatatgaatgtgctgaccttcctgcgcgatattggcaaacacttctccgttaaccagatgatcaacaaagaagcggttaagcagcgtctcaaccgtgaagatcaggggatttcgttcactgagttttcctacaacctgttgcagggttatgacttcgcctgtctgaacaaacagtacggtgtggtgctgcaaatcggtggttctgaccagtggggtaacatcacttctggtatcgacctgacccgtcgtctgcatcagaatcaggtgtttggcttgaccgttccgctgatcaccaaagcagacggcaccaaatttggtaaaactgaaggcggcgcagtctggttggatccgaagaaaaccagcccgtacaaattctaccagttctggatcaacactgcggatgccgacgtttaccgcttcctgaagttcttcaccttcatgagcattgaagagatcaacgccctggaagaagaagataaaaacagcggtaaagcaccgcgcgcccagtatgtgcttgcagaacaggtgacacgtctggtgcatggtgaagacggtttgcaggcggcaaaacgtattaccgaatgcctgttcagcggttccttgagtgcgctgagtgaagcggacttcgaacagctggcgcaggacggcgtaccgatggttgagatggaaaagggcgcagacctgatgcaggcgctggtcgattctgaactgcaaccttcccgtggtcaggcgcgtaaaactatcgcctccaatgccatcaccattaacggtgaaaaacagtccgatcctgaatacttctttaaagaagaagatcgtctgtttggtcgttttaccttactgcgtcgcggcaaaaagaattactgtctgatttgctggaaataa

SEQ ID NO: 4040 - protein, 424 aa, Escherichia coli
MASSNLIKQLQERGLVAQVTDEEALAERLAQGPIALYCGFDPTADSLHLGHLVPLLCLKRFQQAGHKPVALVGGATGLIGDPSFKAAERKLNTEETVQEWVDKIRKQVAPFLDFDCGENSAIAANNYDWFGNMNVLTFLRDIGKHFSVNQMINKEAVKQRLNREDQGISFTEFSYNLLQGYDFACLNKQYGVVLQIGGSDQWGNITSGIDLTRRLHQNQVFGLTVPLITKADGTKFGKTEGGAVWLDPKKTSPYKFYQFWINTADADVYRFLKFFTFMSIEEINALEEEDKNSGKAPRAQYVLAEQVTRLVHGEDGLQAAKRITECLFSGSLSALSEADFEQLAQDGVPMVEMEKGADLMQALVDSELQPSRGQARKTIASNAITINGEKQSDPEYFFKEEDRLFGRFTLLRRGKKNYCLICWK

SEQ ID NO: 4041 - DNA, 657 bp, Escherichia coli
atgtctgataacgacgaattgcagcaaatcgcgcatctgcgccgtgaatacaccaaaggcgggttacgccgccgcgatctacccgccgatccattaaccctttttgaacgttggctctctcaggcttgtgaagccaaactggctgaccctaccgcgatggtggtcgctaccgtggatgaacatgatcagccttatcagcgcatcgttttactcaaacattacgacgaaaaaggcatggtgttttacaccaacctcggcagccgtaaagcacatcaaatcgaaaataatccgcgcgttagcctgctgttcccgtggcatacccttgaacgccaggtgatggtgatcggtaaagcggaacgactttcgactctcgaagtgatgaaatattttcatagccgcccgcgtgatagccagattggtgcatgggtttcgaagcagtccagtcgcatttctgcccgcggtatccttgaaagtaaattcctggagctgaagcagaagtttcaacagggcgaagtgccattgccaagtttttggggcggttttcgcgtcagccttgaacagattgagttctggcagggcggtgagcatcgcctgcatgaccgctttttgtaccagcgtgaaaatgatgcgtggaagattgatcgtcttgcaccctga

SEQ ID NO: 4042 - protein, 218 aa, Escherichia coli
MSDNDELQQIAHLRREYTKGGLRRRDLPADPLTLFERWLSQACEAKLADPTAMVVATVDEHDQPYQRIVLLKHYDEKGMVFYTNLGSRKAHQIENNPRVSLLFPWHTLERQVMVIGKAERLSTLEVMKYFHSRPRDSQIGAWVSKQSSRISARGILESKFLELKQKFQQGEVPLPSFWGGFRVSLEQIEFWQGGEHRLHDRFLYQRENDAWKIDRLAP

SEQ ID NO: 4043 - DNA, 324 bp, Escherichia coli
atgaaaaaactgttactgatctgtttgccggtgcttctcaccggctgtagctcgttcaatcaactggttgagcgcatgcaaaccgatacgcttgaataccagtgtgatgaaaaaccgttgacggtcaaactgaataatccgcgccaggaagtcagttttgtttacgataatcaactgctgcatctcaaacagggcatttcagcatctggtgcacgttacaccgacggaatctatgttttctggtcgaaaggcgaggaagcgactgtctataaacgcgatcgcatcgtcttgagtaactgtcagttacaaaatccgcagcgttga

SEQ ID NO: 4044 - protein, 107 aa, Escherichia coli
MKKLLLICLPVLLTGCSSFNQLVERMQTDTLEYQCDEKPLTVKLNNPRQEVSFVYDNQLLHLKQGISASGARYTDGIYVFWSKGEEATVYKRDRIVLSNCQLQNPQR

SEQ ID NO: 4045 - DNA, 1110 bp, Escherichia coli
atgaaatcgggccgctttattggcgttatgtcaggcaccagccttgatggtgttgatgttgtgttggcgacaattgatgaacaccgggtcgcacagctggcaagtttgagctggccgatcccggtgtctctgaaacaggctgtactggatatttgccagggccagcagcttacactttcgcagtttggacagcttgatactcaactcgggcgactttttgctgatgcggtcaatgccttgcttaaggaacaaaacctgcaggcgagagatatcgttgcgatcggctgtcacggtcaaaccgtctggcatgaaccgacgggcgtggcaccacacactttacagattggcgataacaatcaaattgttgcgcgcaccggaattacggttgtcggtgattttcgccgtcgcgatattgccttgggaggacaaggtgcaccgctggtacctgcgttccatcatgcgctgctggctcacccaaccgagcgacgaatggtgctcaatattggcggcatcgccaatctgtcactgctcattcctggccagccggttgggggctacgataccggtcctggtaacatgctgatggatgcctggatctggcgtcaggccggtaaaccttacgataaagatgccgagtgggcacgggcgggtaaagttattctcccactgctgcaaaatatgctcagcgacccatatttctcgcaacccgcaccgaaaagcaccggacgcgaatactttaactacggctggctggagcgccatttgcgccattttccgggggttgatccccgtgatgtgcaggccacactggcagaactcaccgccgtgaccatttctgaacaagttttgttgagcggtggctgcgaacgattgatggtatgtggtggaggtggtcgtaatccgctactcatggcgcgtctggcggcattactgccaggcacagaagtcaccaccaccgatgccgttggcattagtggcgatgacatggaagcattggcgttcgcctggcttgcctggcgaacgctggcgggattaccaggaaatctgccttccgtcactggcgcaagccaggagacggtactgggggctattttccccgctaacccgtga

SEQ ID NO: 4046 - protein, 369 aa, Escherichia coli
MKSGRFIGVMSGTSLDGVDVVLATIDEHRVAQLASLSWPIPVSLKQAVLDICQGQQLTLSQFGQLDTQLGRLFADAVNALLKEQNLQARDIVAIGCHGQTVWHEPTGVAPHTLQIGDNNQIVARTGITVVGDFRRRDIALGGQGAPLVPAFHHALLAHPTERRMVLNIGGIANLSLLIPGQPVGGYDTGPGNMLMDAWIWRQAGKPYDKDAEWARAGKVILPLLQNMLSDPYFSQPAPKSTGREYFNYGWLERHLRHFPGVDPRDVQATLAELTAVTISEQVLLSGGCERLMVCGGGGRNPLLMARLAALLPGTEVTTTDAVGISGDDMEALAFAWLAWRTLAGLPGNLPSVTGASQETVLGAIFPANP

SEQ ID NO: 4047 - DNA, 441 bp, Escherichia coli
atgaaattggaatcgccactaggttctgatctggcacggttggtgcgcatatggcgtgctctgatagaccatcgcctgaaaccgctggagttaacacaaacccattgggttacgttacacaatatccatcagttacctccagaccagtcgcaaattcaactggcaaaagcgattggcatcgagcagccatcactggtccgtacgctggaccaactggaagaaaaagggttaatttcgcgtcaaacttgtgccagcgatcgtcgggctaaacgtattaaactgacggaaaaggcagagccactgatcagcgaaatggaggctgttattaacaaaacccgcgcggaaattttacatggcatctccgcagaggaactggaacaactgattaagctcatcgcaaaacttgagcataatatcattgagttacaggccaaagggtga

SEQ ID NO: 4048 - protein, 146 aa, Escherichia coli
MKLESPLGSDLARLVRIWRALIDHRLKPLELTQTHWVTLHNIHQLPPDQSQIQLAKAIGIEQPSLVRTLDQLEEKGLISRQTCASDRRAKRIKLTEKAEPLISEMEAVINKTRAEILHGISAEELEQLIKLIAKLEHNIIELQAKG

SEQ ID NO: 4049 - DNA, 900 bp, Escherichia coli
ttgcgtttgccttgctctggcaatactgattgcgtgataactatgtcaattaaaacaattaagtatttctcaacaatcattgtagcggtagttgcggttcttgccggatggtggttgtggaattattacatgcaatctccgtggacacgcgacgggaaaatacgcgcagaacaggtttctatcaccccacaggtgtcgggacgtattattgagctgaatataaaagacaaccagctggttaacgcgggggatcttctgctcacgatcgataaaacgccctttcagatcgccgagctgaacgcacaggctcagctggcgaaagcgcaatctggcctcgcaaaagccaataacgaagcgaatcgtcgtcgtcatctctcacaaaattttatttctgccgaagaactcgataccgctaacctcaatgttaaagcgatgcaggccagcgttgatgccgcacaggcgacgctgaaacaggcacaatggcaactggcgcaaacggaaattcgcgccccggtgagtggatgggtgactaatctcactacccgcatcggcgactacgctgacaccgggaaaccgctgtttgcccttgtcgacagccactcgttttacgtcattggttattttgaagaaaccaagttgcgccatatccgcgaaggtgcaccagcacaaattaccctctatagtgataacaaaacgttacagggtcacgtgtccagtatcggtcgggcgatttatgatcagagcgttgaaagtgactcaagccttattccggatgtgaaacctaacgtcccctgggttcgcctcgcccaacgcgttcccgtccgctttacgctggataaagtcccaggcgatgtcacgctggtgtcgggcaccacctgtagcattgccgtaggtcaataa

SEQ ID NO: 4050 - protein, 299 aa, Escherichia coli
MRLPCSGNTDCVITMSIKTIKYFSTIIVAVVAVLAGWWLWNYYMQSPWTRDGKIRAEQVSITPQVSGRIIELNIKDNQLVNAGDLLLTIDKTPFQIAELNAQAQLAKAQSGLAKANNEANRRRHLSQNFISAEELDTANLNVKAMQASVDAAQATLKQAQWQLAQTEIRAPVSGWVTNLTTRIGDYADTGKPLFALVDSHSFYVIGYFEETKLRHIREGAPAQITLYSDNKTLQGHVSSIGRAIYDQSVESDSSLIPDVKPNVPWVRLAQRVPVRFTLDKVPGDVTLVSGTTCSIAVGQ

SEQ ID NO: 4051 - DNA, 2013 bp, Escherichia coli
atgaacgcatcgtcatggtccttgcgcaatttgccctggttcagggccacgctggcgcaatggcgttatgcgttacgcaataccattgccatgtgtctggcgctgacggttgcctattatttgaatcttgatgagccctattgggcgatgacctcggctgcggtggttagctttcccaccgttggcggtgtcatcagcaaaagcctcggacgcatcgctggcagtttgctcggagccattgcggcactgcttcttgccggacatacgctcaatgagccgtggttttttctattgagcatgtcggcgtggcttggcttttgtacctgggcctgtgcgcacttcacgaataacgtcgcgtatgcatttcaactggcgggctacacggctgccatcatcgcctttccgatggttaatattactgaggccagccagctgtgggatatcgctcaggcgcgtgtttgcgaggtgatagtcggtattttgtgcggcggcatgatgatgatgatcctgccgagcagttccgatgctacagcccttttaaccgcattgaaaaacatgcacgcccgattactggaacatgccagtttactctggcagcctgaaacaaccgatgccattcgtgcagcacatgaaggggtgattgggcagatactgaccatgaatttgctgcgtatccaggctttctggagccactatcgttttcgccagcaaaacgcgcgccttaatgcgctactccaccagcaattacgtatgaccagtgtcatctccagcctgcgacgtatgttgctcaactggccctcaccgccagatgccacgcgagaaattctcgaacagctgctgacggcgctcgccagttcgcaaacagatgtttacaccgtcgcacgtattatctccccgctacgcccgaccaacgtcgccgactaccggcacgtcgccttctggcagcgactacgttatttttgccgcctttatctgcaaagtagtcaggaattacatcgtctgcaaagcggtgtagatgatcgtgccagactcccacggacatccggcctggctcgtcataccgataacgccgaagctatgtggagcgggctgcgtacattttgtacgttgatgatgattggcgcatggagtattgcttcgcaatgggatgccggtgccaatgctttaacgctggcagcaattagctgcgtactctactccgccgtcgcggcaccgtttaagtcgttgtcactgctgatgcgcacgctggtgttactttcgctattcagctttgtggtcaaatttggcctgatggtgcagattagcgatctgtggcaatttttactgtttctctttccactgctggcgacaatgcagcttcttaaattgcagatgcccaaatttgccgcactgtgggggcaactgattgtttttatgggttcgtttatcgctgtcactaatcccccggtgtatgattttgctgattttcttaacgataatctggcaaaaattgttggcgtcgcgttggcgtggttagcgttcgccattctgcgtccaggatcggatgctcgtaaaagccgccgccatattcgcgcgctacgccgggattttgtcgatcaactaagccgccatccaacactgagtgaaagcgaatttgaatcgctcacttatcatcacgtcagtcagttgagtaacagccaggatgcgctggctcgccgttggttattacgctggggtgtagtgttgctgaactgttctcatgttgtctggcaattgcgcgactgggaatcgcgttccgatccgttatcgcgagtacgggataactgtatttcactgttgcggggagtgatgagtgagcgtggcgttcagcaaaaatcactggcggccacacttgaagaattacagcgaatttgcgacagccttgcccgtcatcatcaacctgccgcccgagaactggcggcaattgtctggcggctgtactgctcgctttcgcaacttgagcaagcaccgccgcaaggtacgctggcttcttaa

SEQ ID NO: 4052 - protein, 670 aa, Escherichia coli
MNASSWSLRNLPWFRATLAQWRYALRNTIAMCLALTVAYYLNLDEPYWAMTSAAVVSFPTVGGVISKSLGRIAGSLLGAIAALLLAGHTLNEPWFFLLSMSAWLGFCTWACAHFTNNVAYAFQLAGYTAAIIAFPMVNITEASQLWDIAQARVCEVIVGILCGGMMMMILPSSSDATALLTALKNMHARLLEHASLLWQPETTDAIRAAHEGVIGQILTMNLLRIQAFWSHYRFRQQNARLNALLHQQLRMTSVISSLRRMLLNWPSPPDATREILEQLLTALASSQTDVYTVARIISPLRPTNVADYRHVAFWQRLRYFCRLYLQSSQELHRLQSGVDDRARLPRTSGLARHTDNAEAMWSGLRTFCTLMMIGAWSIASQWDAGANALTLAAISCVLYSAVAAPFKSLSLLMRTLVLLSLFSFVVKFGLMVQISDLWQFLLFLFPLLATMQLLKLQMPKFAALWGQLIVFMGSFIAVTNPPVYDFADFLNDNLAKIVGVALAWLAFAILRPGSDARKSRRHIRALRRDFVDQLSRHPTLSESEFESLTYHHVSQLSNSQDALARRWLLRWGVVLLNCSHVVWQLRDWESRSDPLSRVRDNCISLLRGVMSERGVQQKSLAATLEELQRICDSLARHHQPAARELAAIVWRLYCSLSQLEQAPPQGTLAS

SEQ ID NO: 4053 - DNA, 522 bp, Escherichia coli
atgaaacgttttagtctggccattctggcgctggttgttgcgaccggcgcacaagctgccagtgaaaaagtcgagatgaacctcgtcacgtcgcaaggggttgggcagttaattggtagcgtcaccattactgaaaccgataaaggtctggagttttcgcccgatctgaaagcattacctcccggtgaacatggcttccatattcatgccaaaggaagctgccagccagccaccaaagatggcaaagccagcgccgcagaatccgcaggcgggcatcttgatccacaaaataccggtaaacatgaagggccagaaggtgccgggcatttaggcgatctgcctgcactggtagtcaataatgacggcaaggcgaccgatgccgtcatcgcgcctcgtctgaaatcactggatgaagtcaaagacaaagcgctgatggtccacgttggcggcgataatatgtccgatcaacccaaaccgctgggcggtggcggtgaacgctatgcctgtggtgtaattaagtaa

SEQ ID NO: 4054 - protein, 173 aa, Escherichia coli
MKRFSLAILALVVATGAQAASEKVEMNLVTSQGVGQLIGSVTITETDKGLEFSPDLKALPPGEHGFHIHAKGSCQPATKDGKASAAESAGGHLDPQNTGKHEGPEGAGHLGDLPALVVNNDGKATDAVIAPRLKSLDEVKDKALMVHVGGDNMSDQPKPLGGGGERYACGVIK

SEQ ID NO: 4055 - DNA, 897 bp, Escherichia coli
atggttcagcgtattactattgcgccgcaaggcccggagttttcccgttttgtgatgggctactggcgattgatggactggaatatgtccgcccgccagttggtcagttttattgaagagcatctggatctaggcgtgaccaccgtggaccatgctgatatttatggtggctatcagtgcgaagcggcgtttggtgaggcgctgaaactggcacctcacctgcgtgaacggatggaaatcgtcagtaaatgcggtatcgcgacgaccgcgtgtgaagaaaacgtcattggccattacatcactgaccgcgatcacatcattaagagcgccgaacagtcgctaattaatctcgcgaccgatcatctggatctgctgttaatccaccgaccagacccgttaatggatgccgatgaagtggcggacgcctttaaacatctgcatcagagcggcaaagtgcgtcattttggtgtatcgaactttacacctgcgcaatttgcgctgttgcaatcacgcctgccatttacccttgccactaatcaggtggaaatatccccggtgcatcagccgttactgctggatggcacgctcgaccaactgcaacaactgcgtgttcgtccgatggcgtggtcctgccttggtggtggtcgtctgtttaatgatgattatttccagccgctacgtgatgaactggctgtggtggcagaggagttaaacgcgggctcgattgaacaggtagtttacgcctgggtattacgtttaccgtcgcagccgctgccaattatcggctcaggtaaaattgagcgcgtacgggcagcagtcgaagcagaaacactgaaaatgacccgtcaacaatggttccgtatccgtaaagcggcactaggttacgacgtaccgtaa

SEQ ID NO: 4056 - protein, 298 aa, Escherichia coli
MVQRITIAPQGPEFSRFVMGYWRLMDWNMSARQLVSFIEEHLDLGVTTVDHADIYGGYQCEAAFGEALKLAPHLRERMEIVSKCGIATTACEENVIGHYITDRDHIIKSAEQSLINLATDHLDLLLIHRPDPLMDADEVADAFKHLHQSGKVRHFGVSNFTPAQFALLQSRLPFTLATNQVEISPVHQPLLLDGTLDQLQQLRVRPMAWSCLGGGRLFNDDYFQPLRDELAVVAEELNAGSIEQVVYAWVLRLPSQPLPIIGSGKIERVRAAVEAETLKMTRQQWFRIRKAALGYDVP

SEQ ID NO: 4057 - DNA, 210 bp, Escherichia coli
cagagcccgtgccggggaatttgccagtctgacgaacgcggattttgtcgcggctgttttcgtagccgggatgagcgttttaactggaataagatgagcgatggcgaaaaacaagaagtgttgcgcctttgtcggcagcgattaatgcgcaaattacgtgtaaataagtcagcgccatcagacgaacctgagcaaccatcactcttttga

SEQ ID NO: 4058 - protein, 69 aa, Escherichia coli
QSPCRGICQSDERGFCRGCFRSRDERFNWNKMSDGEKQEVLRLCRQRLMRKLRVNKSAPSDEPEQPSLF

SEQ ID NO: 4059 - DNA, 600 bp, Escherichia coli
atgaacaaacacaccgaacatgatactcgcgaacatctcctggcgacgggcgagcaactttgcctgcaacgtggattcaccgggatggggctaagcgaactcctaaaaaccgctgaagtgccgaaagggtccttctatcactactttcgttctaaagaagcgtttggcgttgctatgcttgagcgccattacgccgcatatcaccagcgactgactgagttgctgcaatccggcgaaggtaactaccgcgaccgcatactggcttattaccagcaaacactgaaccagttttgccaacatggaaccatcagtggttgcctgacagtaaaactctctgccgaagtgtgcgatctgtcagaagatatgcgcagcgcaatggataaaggggctcgcggcgtgatcgccctgctctctcaggcgctggaaaatggccgtgagaaccattgtttaaccttttgtggcgaaccgctgcaacaggcacaagtgctttacgcactgtggcttggcgcgaatctgcaggccaaaatttcgcgcagtttcgagccactggaaaacgcgctggcccatgtaaaaaacattattgcgacgcctgccgtttag

SEQ ID NO: 4060 - protein, 199 aa, Escherichia coli
MNKHTEHDTREHLLATGEQLCLQRGFTGMGLSELLKTAEVPKGSFYHYFRSKEAFGVAMLERHYAAYHQRLTELLQSGEGNYRDRILAYYQQTLNQFCQHGTISGCLTVKLSAEVCDLSEDMRSAMDKGARGVIALLSQALENGRENHCLTFCGEPLQQAQVLYALWLGANLQAKISRSFEPLENALAHVKNIIATPAV

SEQ ID NO: 4061 - DNA, 1098 bp, Escherichia coli
atgtcatctgaaaaactgtattccccactgaaagtgggcgcgatcacggcggcaaatcgtatttttatggcaccgctgacgcgtctgcgcagtatcgaaccgggtgacatccctaccccgttgatggcggaatactatcgccaacgtgccagtgccggtttgattattagcgaagccacgcaaatttctgcccaggcaaaaggatacgcaggtgcacctggcatccatagcccggaacaaattgccgcatggaaaaaaattaccgctggcgttcatgctgaaaatggtcatatggccgtacagctgtggcacaccggacgcatttctcacgccagcctgcaacctggcggtcaggcaccggtagcgccttcagcacttagcgcgggaacacgtacttctctgcgcgatgaaaatggtcaggcgatccgtgttgaaacatccatgccgcgtgcgcttgaactgggagagattccgggtatcgtcaatgatttccgtcaggccattgctaacgcgcgtgaagccggttttgatctggtagagctccactctgctcacggttatttgctgcatcagttcctttccccttcttcaaaccatcgtaccgatcagtacggcggcagcgtggaaaatcgcgcgcgtctggtgctggaagtggtcaatgccgggattgaagaatggggtgccgatcgcattggcattcgcatttcgccaatcggtactttccagaacacggataacggcccgaatgaagaagccgatgcactgtatctgattgaacaactgggtaaacgcggcattgcttatcttcatatgtcagaaccagattgggcgggaggtgaaccatatactgatgcgtttcgcgaaaaagtacgcgcccgtttccacggtccgattatcggcgcaggtgcatacacagtagaaaaagctgaaacgctgatcggcaaagggttaattgatgcggtagcatttggtcgtgactggattgcgaacccggatctggtcgcccgcttgcagcgcaaagctgagcttaacccacagcgtgccgaaagtttttatggtggcggtgctgaaggttacactgattacccgacgctgtaa

SEQ ID NO: 4062 - protein, 365 aa, Escherichia coli
MSSEKLYSPLKVGAITAANRIFMAPLTRLRSIEPGDIPTPLMAEYYRQRASAGLIISEATQISAQAKGYAGAPGIHSPEQIAAWKKITAGVHAENGHMAVQLWHTGRISHASLQPGGQAPVAPSALSAGTRTSLRDENGQAIRVETSMPRALELGEIPGIVNDFRQAIANAREAGFDLVELHSAHGYLLHQFLSPSSNHRTDQYGGSVENRARLVLEVVNAGIEEWGADRIGIRISPIGTFQNTDNGPNEEADALYLIEQLGKRGIAYLHMSEPDWAGGEPYTDAFREKVRARFHGPIIGAGAYTVEKAETLIGKGLIDAVAFGRDWIANPDLVARLQRKAELNPQRAESFYGGGAEGYTDYPTL

SEQ ID NO: 4063 - DNA, 408 bp, Escherichia coli
atgcgtcttcttcataccatgctgcgcgttggcgatctgcaacgctccatcgatttttataccaacgtgctgggcatgaaactgctgcgtaccagcgaaaacccggaatacaaatactcactggcgtttgttggttacggcccggaaaccgaagaagcagtgattgaactgacctacaactggggcgtggataaatacgaactcggcactgcttatggtcacatcgcgcttagcgtagataacgccgctgaagcgtgcgaaaaaatccgtcaaaacgggggtaacgtaacccgtgaagcgggtccggtaaaaggcggtactacggttatcgcatttgtggaagatccggacggttacaaaattgaattaatcgaagagaaagacgccggtcgcggtctgggcaactaa

SEQ ID NO: 4064 - protein, 135 aa, Escherichia coli
MRLLHTMLRVGDLQRSIDFYTNVLGMKLLRTSENPEYKYSLAFVGYGPETEEAVIELTYNWGVDKYELGTAYGHIALSVDNAAEACEKIRQNGGNVTREAGPVKGGTTVIAFVEDPDGYKIELIEEKDAGRGLGN

SEQ ID NO: 4065 - DNA, 648 bp, Escherichia coli
atgtccgataacgctcaacttaccggtctgtgcgaccgttttcgtggtttttatcctgttgtgatcgatgttgaaacagccggatttaacgccaaaaccgatgcgctgcttgagattgccgccatcaccctgaaaatggatgaacaaggctggctgatgccggacaccacattacatttccacgtcgaaccatttgtcggcgcaaatttgcaaccagaggcccttgccttcaatggcattgatccgaacgatcccgatcgcggcgcggtcagcgagtacgaggcgctgcacgaaatttttaaagttgtacgtaaaggtattaaagcgagcggctgtaaccgcgccattatggtggcgcacaacgccaatttcgatcacagctttatgatggccgccgcagaacgcgcctcactgaaacgtaacccgttccaccctttcgccacttttgacactgctgcactggccgggctggcactcggacaaaccgtattgtcaaaggcttgccagaccgctggcatggacttcgacagcacccaggcgcactccgcgctgtacgacaccgaacgcactgctgtgctgttttgtgaaatcgtcaaccgctggaaacgtctgggaggctggccgctgcctgccgccgaagaggtgtaa

SEQ ID NO: 4066 - protein, 215 aa, Escherichia coli
MSDNAQLTGLCDRFRGFYPVVIDVETAGFNAKTDALLEIAAITLKMDEQGWLMPDTTLHFHVEPFVGANLQPEALAFNGIDPNDPDRGAVSEYEALHEIFKVVRKGIKASGCNRAIMVAHNANFDHSFMMAAAERASLKRNPFHPFATFDTAALAGLALGQTVLSKACQTAGMDFDSTQAHSALYDTERTAVLFCEIVNRWKRLGGWPLPAAEEV

SEQ ID NO: 4067 - DNA, 348 bp, Escherichia coli
atgagcaccactatcgaaaaaatccaacgccagattgctgaaaacccgatcctgctgtacatgaaaggttcaccgaaactgccgagctgcggtttctctgcccaggcagttcaggcgcttgccgcatgtggcgaacgttttgcctatgttgatattctgcagaatccggacattcgtgcggaactgccgaaatatgcgaactggccgaccttcccgcaactgtgggttgacggcgagctggtgggcggttgtgatatcgtgatcgaaatgtatcagcgtggtgaactgcagcagctgatcaaagaaactgccgctaaatacaagtctgaagagccggacgcggaataa

SEQ ID NO: 4068 - protein, 115 aa, Escherichia coli
MSTTIEKIQRQIAENPILLYMKGSPKLPSCGFSAQAVQALAACGERFAYVDILQNPDIRAELPKYANWPTFPQLWVDGELVGGCDIVIEMYQRGELQQLIKETAAKYKSEEPDAE

SEQ ID NO: 4069 - DNA, 111 bp, Escherichia coli
ttgttaaaaaatacgtttcgtcggcgagcgcaaaaaaatgcagcagtgaaagctaaaaatggttataaatacgccagtttgccgtgcatcagggaagaaacgaatatttga

SEQ ID NO: 4070 - protein, 36 aa, Escherichia coli
MLKNTFRRRAQKNAAVKAKNGYKYASLPCIREETNI

SEQ ID NO: 4071 - DNA, 735 bp, Escherichia coli
  n 716, 717, 718, 719, 720: n is any nucleotide
gtggcgcggataaaccgtatttcgatcacgctctgtgctttactttttaccaccctgcctttaacgcctatggcccatgcttcaaagcaagccagggagagttctgctactactcatatcaccaaaaaagcagataaaaagaaaagcacggcaaccaccaaaaagacccagaaaacagcgaaaaaagccgccagtaaaagtacgaccaaaagcaaaaccgcttcttccgttaaaaaatcttccattaccgcttctaaaaacgccaaaactcgcagcaaacacaccgtcaataaaacggcctcagccaactttaccgaaaagtgtaccaaacgtaagggctataaatcgcattgtgtgaaagtcaaaaatgccgcgtcaggaacccttgccgacgcgcacaaagcgaaggtgcaaaaagccacaaaagtggcaatgaataaactgatgcagcaaattggtaagccatatcgttggggtggcagttcaccgcgtaccggttttgattgcagcggtctggtttattacgcttataaagatttggtgaaaattcgtattccgcgtacggcgaatgaaatgtatcacctgcgcgatgcagcgccaatcgaacgtagtgaactgaaaacggcgacctggtcttcttccgtactcaggacgcggtacagccgatcatgtcgcgtgtatgtcggcacggcaaatttattcagtcaccgcgcacnnnnncattccattcattaa

SEQ ID NO: 4072 - protein, 244 aa, Escherichia coli
  Xaa 239, 240: Xaa is any amino acid
MARINRISITLCALLFTTLPLTPMAHASKQARESSATTHITKKADKKKSTATTKKTQKTAKKAASKSTTKSKTASSVKKSSITASKNAKTRSKHTVNKTASANFTEKCTKRKGYKSHCVKVKNAASGTLADAHKAKVQKATKVAMNKLMQQIGKPYRWGGSSPRTGFDCSGLVYYAYKDLVKIRIPRTANEMYHLRDAAPIERSELKTATWSSSVLRTRYSRSCRVYVGTANLFSHRAXXHSIH

SEQ ID NO: 4073 - DNA, 102 bp, Escherichia coli
  n 12, 13, 14, 15, 16: n is any nucleotide
atgaatgaatgnnnnnactatcgcaatgcacgtcctggctatctggagcacttctgggcgctggtgaactgggaattcgtagcgaaaaatctcgctgcataa

SEQ ID NO: 4074 - protein, 33 aa, Escherichia coli
  Xaa 4, 5, 6: Xaa is any amino acid
MNEXXXYRNARPGYLEHFWALVNWEFVAKNLAA

SEQ ID NO: 4075 - DNA, 1170 bp, Escherichia coli
atgaaaattaactatccgttgctggcgctggcgattggcgcgtttggtatcgggacaacggagttctcgccaatgggcttgttgcccgtcattgcgcgcggtgtggatgtctcgattcccgctgccggaatgttaatcagtgcttatgcagttggcgtaatggttggcgcgccgctgatgacgcttctactttctcatcgtgcccgccgcagtgcgttgattttcctgatggcgattttcacgcttggcaacgtactttccgccatcgcgccggattatatgaccctgatgctttcacgcattttgaccagcctgaatcacggggcattttttggtttgggttcagtcgtggccgcaagcgtagtgccaaaacataaacaggctagcgcagttgccactatgtttatggggttaaccctggcaaatatcggtggcgtgccggcggcgacctggttgggcgaaaccatcggctggcggatgtcatttctggcaacagcggggctgggcgtgatttcaatggtaagtctgttcttctcattacctaaaggtggcgcaggggcgcgacctgaagtgaaaaaagagctggcggtattaatgcgtccgcaggtgctgtctgcattgctgacgacggtactgggcgctggtgcaatgtttaccctctacacctatatctctccggtactgcaaagtattacccacgtaacgccggtgttcgtcacggcaatgctggtgctgattggtgtcggattttctatcggtaactatctcggcggcaaactggcagatcgttcagttaacggcacgttgaaaggctttttgttgttgctgatggtgattatgctggtaatcccgttcctggcccgcaatgagttcggcgcagctattagcatggtagtgtggggagctgcaacctttgcggtcgtaccgccgttacagatgcgcgtgatgcgtgtcgccagtgaagcgccaggtctgtcttcatcagtcaatattggtgcctttaatcttggaaatgcgctgggagcagctgctggtggtgcggtaatttccgctgggctgggatacagttttgtgccggtgatgggggcgattgtcgcgggactggcattattgctggtgtttatgtcagtcagaaaacaacctgaaacagtttgcgttgccaacagctaa

SEQ ID NO: 4076 - protein, 389 aa, Escherichia coli
MKINYPLLALAIGAFGIGTTEFSPMGLLPVIARGVDVSIPAAGMLISAYAVGVMVGAPLMTLLLSHRARRSALIFLMAIFTLGNVLSAIAPDYMTLMLSRILTSLNHGAFFGLGSVVAASVVPKHKQASAVATMFMGLTLANIGGVPAATWLGETIGWRMSFLATAGLGVISMVSLFFSLPKGGAGARPEVKKELAVLMRPQVLSALLTTVLGAGAMFTLYTYISPVLQSITHVTPVFVTAMLVLIGVGFSIGNYLGGKLADRSVNGTLKGFLLLLMVIMLVIPFLARNEFGAAISMVVWGAATFAVVPPLQMRVMRVASEAPGLSSSVNIGAFNLGNALGAAAGGAVISAGLGYSFVPVMGAIVAGLALLLVFMSVRKQPETVCVANS

SEQ ID NO: 4077 - DNA, 120 bp, Escherichia coli
ttgtgtggtaataaaaaaggagaaaacttgatgagcaccgaccttaaattttcactggtaacaacgattatcgtcctcggtttgatcgtggccgtgggtttgactgccgcgctgcactga

SEQ ID NO: 4078 - protein, 39 aa, Escherichia coli
MCGNKKGENLMSTDLKFSLVTTIIVLGLIVAVGLTAALH

SEQ ID NO: 4079 - DNA, 1026 bp, Escherichia coli
atggcaacaataaaagatgtagcgaaacgagcaaacgtttccactacaactgtgtcacacgtgatcaacaaaacacgtttcgtcgctgaagaaacgcgcaatgccgtgtgggcagcaatcaaagaattacactactcccctagcgcggtggcgcgtagcctgaaggttaaccacaccaagtctatcggtttgctggcgaccagcagcgaagcggcctattttgccgagatcattgaagcggtcgaaaaaaattgcttccagaaaggttacaccctgattctgggcaatgcgtggaacaatcttgagaaacagcgggcttatctgtcgatgatggcgcaaaaacgcgtcgatggtctgctggtgatgtgttctgagtacccagagccgttgctggcgatgctggaagagtatcgccatatcccaatggtggtgatggactggggtgaagcaaaagctgacttcaccgatgcggtcattgataacgcattcgaaggcggctacatggccgggcgttatctgattgaacgcggtcatcgcgaaatcggcgttatccctggcccgctggaacgtaacaccggcgcaggccgccttgccggttttatgaaggcgatggaagaagcgatgatcaaagtgccggaaagctggattgtgcagggtgactttgaacctgaatccggttatcgcgccatgcagcaaatcctgtcgcagtcgcatcgccctactgccgtcttctgtggtggcgatatcatggcaatgggcgcactttgtgctgctgatgaaatgggtctgcgcgtgccgcaggatgtttcgctgatcggttatgataacgtgcgcaacgcccgctattttacgccggcgctgaccacgatccatcagccaaaagattcgctgggcgaaacagcgttcaacatgctgttggatcgtatcgtcaacaaacgtgaagaaccgcagtccattgaagtgcatccgcggttgattgaacgccgctccgtggctgacggcccgttccgcgactatcgtcgttaa

SEQ ID NO: 4080 - protein, 341 aa, Escherichia coli
MATIKDVAKRANVSTTTVSHVINKTRFVAEETRNAVWAAIKELHYSPSAVARSLKVNHTKSIGLLATSSEAAYFAEIIEAVEKNCFQKGYTLILGNAWNNLEKQRAYLSMMAQKRVDGLLVMCSEYPEPLLAMLEEYRHIPMVVMDWGEAKADFTDAVIDNAFEGGYMAGRYLIERGHREIGVIPGPLERNTGAGRLAGFMKAMEEAMIKVPESWIVQGDFEPESGYRAMQQILSQSHRPTAVFCGGDIMAMGALCAADEMGLRVPQDVSLIGYDNVRNARYFTPALTTIHQPKDSLGETAFNMLLDRIVNKREEPQSIEVHPRLIERRSVADGPFRDYRR

SEQ ID NO: 4081 - DNA, 825 bp, Escherichia coli
gtgcgtcagctggaagagtggctggcggtgccgctttttgaacgacgtcaccgtgatgtggaactgaccgctgccggggcgtggtttctcaaagaaggacgctctgttgtcaaaaaaatgcagatcacccgccagcaatgtcagcagatagcgaacggctggcgcggtcagttagctatcgcagtggataatattgtcaggccagagcgaacacggcagatgatcgttgatttttatcgccattttgatgatgtcgaacttcttgtctttcaggaagtgttcaacggtgtctgggatgcactttccgacgggcgcgtggaactggcgattggcgcaacacgcgcgattccggtaggcggtcgttatgccttccgggatatggggatgttaagctggagttgcgttgttgccagccaccacccgctggcgttgatggatggcccgttcagcgatgatacgttgcgcaactggccgtcattggtgcgcgaagacacctcgcgaacgctacctaaacgtattacctggttgctggataaccaaaaaagacttgtcgtgcctgactgggaatcatcggcaacctgtatctcggcaggattatgcatagggatggtgccaacacatttcgccaaaccgtggcttaatgaggggaagtgggtagcactagaactggaaaatcccttcccggattcggcatgttgtctgacatggcagcaaaatgatatgtcgcctgcgttaacctggttgcttgagtatctcggcgatagtgagacgctgaataaggagtggctgcgggagccggaagagactcccgcaacgggtgattaa

SEQ ID NO: 4082 - protein, 274 aa, Escherichia coli
MRQLEEWLAVPLFERRHRDVELTAAGAWFLKEGRSVVKKMQITRQQCQQIANGWRGQLAIAVDNIVRPERTRQMIVDFYRHFDDVELLVFQEVFNGVWDALSDGRVELAIGATRAIPVGGRYAFRDMGMLSWSCVVASHHPLALMDGPFSDDTLRNWPSLVREDTSRTLPKRITWLLDNQKRLVVPDWESSATCISAGLCIGMVPTHFAKPWLNEGKWVALELENPFPDSACCLTWQQNDMSPALTWLLEYLGDSETLNKEWLREPEETPATGD

SEQ ID NO: 4083 - DNA, 1212 bp, Escherichia coli
atgcaacctgggaaaagatttttagtctggctggcgggtttgagcgtactcggttttctggcaaccgatatgtatctgcctgctttcgccgccatacaggccgacctgcaaacgcctgcgtctgctgtcagtgccagccttagtctgttccttgccggttttgccgcagcccagcttctgtgggggccactctccgaccgttatggtcgtaaaccggtgttattcatcggcctgacaatttttgcgttaggtagtctggggatgctgtgggtagaaaacgccgccacgctgctgatattgcgttttgtacaggctgtgggtgtctgcgccgcggcggttatctggcaagcattagtgacagattattatccttcacagaaagttaaccgtatttttgcgaccatcatgccgctggtgggtctgtctccggcactggctcctctgttaggaagctggctgctggtccatttttcctggcaggcgattttcgccaccctgtttgccattaccgtggtgctgattctgcctattttctggctcaaacccacgacgaaggcccgtaacaatagtcaggatggtctgacctttaccgacctgctacgttctaaaacctatcgcggcaacgtgctgatatacgcggcctgttcagccagtttttttgcatggctgaccggttcaccgttcatccttagtgaaatgggttacagcccggcagttattggtttaagttacgtcccgcaaactatcgcgtttctgattggtggttatggctgtcgcgccgcgctgcagaaatggcaaggcaagcagttattaccgtggttgctggtactgtttgctgtcagcgtcattgcgacctgggctgcgggcttcattagccatgtgtcgctggtcgaaatcctgatcccattctgtgtgatggcgattgccaacggtgcgatctacccgattgttgtcgcccaagcgctgcgtcccttcccacatgcaaccggtcgcgccgcagcgttgcagaacactctgcaactgggtctgtgcttcctcgcaagtctggtagtttcctggcttatcagtatcagcacgccattgctcaccaccaccagcatgatgttatcaacagtagtgctggtcgctctgggttacatgatgcaacgttgtgaagaagttggctgccagaatcatggcaatgccgaagtcgctcatagcgaatcacactga

SEQ ID NO: 4084 - protein, 403 aa, Escherichia coli
MQPGKRFLVWLAGLSVLGFLATDMYLPAFAAIQADLQTPASAVSASLSLFLAGFAAAQLLWGPLSDRYGRKPVLFIGLTIFALGSLGMLWVENAATLLILRFVQAVGVCAAAVIWQALVTDYYPSQKVNRIFATIMPLVGLSPALAPLLGSWLLVHFSWQAIFATLFAITVVLILPIFWLKPTTKARNNSQDGLTFTDLLRSKTYRGNVLIYAACSASFFAWLTGSPFILSEMGYSPAVIGLSYVPQTIAFLIGGYGCRAALQKWQGKQLLPWLLVLFAVSVIATWAAGFISHVSLVEILIPFCVMAIANGAIYPIVVAQALRPFPHATGRAAALQNTLQLGLCFLASLVVSWLISISTPLLTTTSMMLSTVVLVALGYMMQRCEEVGCQNHGNAEVAHSESH

SEQ ID NO: 4085 - DNA, 1149 bp, Escherichia coli
atgagttcatcgtgtatagaagaagtcagtgtaccggatgacaactggtaccgtatcgccaacgaattacttagccgtgccggtatagccattaacggttctgccccggcggatattcgtgtcaaaaaccccgatttttttaaacgcgttctgcaggaaggatcgttggggttaggcgaaagttatatggatggctggtgggaatgtgaccgactggatatgttttttagcaaagtcttacgcgcaggtctcgagaaccaactcccccatcatttcaaagacacgctgcgtattgccggcgctcgtctcttcaatctgcagagtaaaaaacgtgcctggatagtcggcaaagagcattacgatttgggtaatgacttgttcagccgcatgcttgatcccttcatgcaatattcctgcgcttactggaaagatgccgataatctggaatctgcccagcaggcgaagctcaaaatgatttgtgaaaaattgcagttaaaaccagggatgcgcgtactggatattggctgcggctggggcggactggcgcactacatggcatctaattatgacgtaagcgtggttggcgtcaccatttctgccgaacagcaaaaaatggctcaggaacgctgtgaaggcctggatgtcaccattttgctgcaagattatcgtgacctgaacgaccagtttgatcgtattgtttctgtggggatgttcgagcacgtcggaccgaaaaattacgatacctattttgcggtggtggatcgtaatttgaaaccggaaggcatattcctgctccatactatcggttcgaaaaaaaccgatctgaatgttgatccctggattaataaatatatttttccgaacggttgcctgccctctgtacgccagattgctcagtccagcgaaccccactttgtgatggaagactggcataacttcggtgctgattacgatactacgttgatggcgtggtatgaacgattcctcgccgcatggccagaaattgcggataactacagtgaacgctttaaacggatgtttacctattatctgaatgcctgtgcaggtgctttccgcgcccgtgatattcagctctggcaggtcgtgttctcacgcggtgttgaaaacggccttcgagtggctcgctaa

SEQ ID NO: 4086 - protein, 382 aa, Escherichia coli
MSSSCIEEVSVPDDNWYRIANELLSRAGIAINGSAPADIRVKNPDFFKRVLQEGSLGLGESYMDGWWECDRLDMFFSKVLRAGLENQLPHHFKDTLRIAGARLFNLQSKKRAWIVGKEHYDLGNDLFSRMLDPFMQYSCAYWKDADNLESAQQAKLKMICEKLQLKPGMRVLDIGCGWGGLAHYMASNYDVSVVGVTISAEQQKMAQERCEGLDVTILLQDYRDLNDQFDRIVSVGMFEHVGPKNYDTYFAVVDRNLKPEGIFLLHTIGSKKTDLNVDPWINKYIFPNGCLPSVRQIAQSSEPHFVMEDWHNFGADYDTTLMAWYERFLAAWPEIADNYSERFKRMFTYYLNACAGAFRARDIQLWQVVFSRGVENGLRVAR

SEQ ID NO: 4087 - DNA, 642 bp, Escherichia coli
atgtttacggggattgtacagggcaccgcaaaactggtgtctattgacgaaaaaccaaattttcgtacgcatgtggtggagttacccgaccacatgctggacggactggaaaccggtgcgtccgtggcgcataacggttgctgcctgaccgtgacggaaattaacggcaaccatgtcagttttgacctgatgaaagaaacgttacgcattactaatcttggcgatttaaaagtgggggattgggtaaacgttgagcgtgcggcgaaattcagcgatgaaattggcggacacttaatgtcaggtcatattatgaccaccgctgaagtcgcgaaaatattaacctcggaaaataatcgccagatctggtttaaagtccaggatagtcagttgatgaaatatatcctgtacaaaggatttattggcatcgacggtattagcctgaccgtcggcgaagtcacgccaacgcgcttttgcgtccatttaattccggaaacactggaacgcacgactcttgggaagaaaaaacttggcgcacgcgtcaacattgaaatcgatccacaaactcaggcagtggtagatacggtagaacgagtgctggcggcacgagaaaatgccatgaatcaaccaggtacagaagcctga

SEQ ID NO: 4088 - protein, 213 aa, Escherichia coli
MFTGIVQGTAKLVSIDEKPNFRTHVVELPDHMLDGLETGASVAHNGCCLTVTEINGNHVSFDLMKETLRITNLGDLKVGDWVNVERAAKFSDEIGGHLMSGHIMTTAEVAKILTSENNRQIWFKVQDSQLMKYILYKGFIGIDGISLTVGEVTPTRFCVHLIPETLERTTLGKKKLGARVNIEIDPQTQAVVDTVERVLAARENAMNQPGTEA

SEQ ID NO: 4089 - DNA, 1374 bp, Escherichia coli
gtgcagaagtatatcagtgaagcgcgtctgttattagcattagcaatcccggtgattctcgcgcaaatcgcccaaactgcgatgggttttgtcgataccgtgatggcgggcggctatagtgccaccgacatggcggcggtcgctatcggtacttctatctggcttccggcgatcctctttggtcacggactgctgctggcattaacgccggttatcgcgcaattaaatggttccggtcgacgtgagcgcattgcgcatcaggtgcgacaaggtttctggctggcgggttttgtttccgttctcattatgctggtgctgtggaatgcgggttacattatccgttccatgcaaaacatcgatccggctctggcggacaaagccgtgggttatctgcgtgcgttgttgtggggcgcgccgggctatctgttcttccaggttgcccgtaaccagtgtgaaggtctggcaaaaaccaagccgggtatggtaatgggctttatcggcctgctggtgaacattccggtgaactatatctttatttatggtcatttcggtatgcctgagctcggtggcgttggttgtggcgtggctactgcggcggtgtattgggtcatgttccttgccatggtttcttacattaaacgcgcccgctccatgcgcgatattcgtaacgaaaaaggcaccgctaagcccgatcctgcggttatgaaacgactgattcaactcggtttgccgattgcgctggcactgttctttgaagtgacactgtttgccgtcgtggctctgttagtgtctccgctcggtattgttgatgtcgcaggacaccagattgccctgaactttagttcactgatgtttgtgcttcccatgtcgctggcggcagcggtaactatccgcgtaggttatcgtctgggtcagggctcaacgctggatgcgcaaaccgctgcgcggaccgggcttatggtgggtgtctgtatggcaaccctgacggccattttcacggtttcactgcgggagcaaatcgccctgttgtacaacgacaatcccgaggttgtaacgctggctgcgcatttgatgttgctggcggcggtatatcagatttctgactctatccaggtgattggcagtgggattttgcgtggttataaagatacacgttccattttctatatcacctttacggcttactgggtgctgggcttgccaagcggctatattctggcactgaccgatctggtcgttgaacctatggggccagcaggcttctggataggctttattattggcctgacgtcggcagccattatgatgatgctgcgtatgcggttcctgcaacgtctgccgtcagccatcattctgcaacgagcagctcgctag

SEQ ID NO: 4090 - protein, 457 aa, Escherichia coli
MQKYISEARLLLALAIPVILAQIAQTAMGFVDTVMAGGYSATDMAAVAIGTSIWLPAILFGHGLLLALTPVIAQLNGSGRRERIAHQVRQGFWLAGFVSVLIMLVLWNAGYIIRSMQNIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRLPSAIILQRAAR

SEQ ID NO: 4091 - DNA, 1257 bp, Escherichia coli
atgggatctgatgcgaaaaacttgatgagcgacgggaacgtgcaaattgttaagaccggcgaggtcattggcgcgacgcaacttactgaaggtgagttaatagttgaagctggcgcaagagccgaaaataccgtggtcacgggggctggctggttgaaagtggcaaccggtgggatcgccaaatgcacacagtacggtaacaatggcacgctatcggtcagcgacggtgccattgccacagatattgttcagtccgagggaggcgcaattagtctctctacgctcgctacggttaatggccgccatcccgaaggtgaattcagcgttgatcagggttatgcctgcggtttgttgctggaaaatggcggtaacctgcgtgtactggaaggacatcgcgcggaaaaaattattctcgatcaagagggtggcctgttggtcaatgggacaacctcagcggtcgtggtagatgaaggtggtgaattgttggtgtatccaggtggggaagccagcaattgtgagattaatcagggcggcgtttttatgctggcggggaaagccaatgatacgttgcttgctggtggcaccatgaataatctcggtggtgaagactctgacactattgttgagaatggagccatctatcgtctgggtacggatggtcttcagctctacagttccggtaagacgcaaaacctgtccgttaatgtgggtggtcgggctgaagtgcatgccggtacgctggaaaatgcggtaatacaaggtgggacagtgatcctgttgtcacccaccagcgcggacgaaaattttgtcgtagaggaagatcgcgcaccggttgaactgaccggtagtgttgcattactggacggcgcttcaatgattattggctatggcgcagatctgcaacaatcaacgattactgtacagcagggcggtgtattgattctcgacggcagtacggtaaaaggtgatagtgtcactttcagtgttggtaacatcaatctcaatggcggaaaactgtggctaatcactggtgcggcaacgcatgtgcaactgaaagtgaaacgcctgcgcggagagggagcgatttgcctgcaaaccagtgcgaaagaaatttcacctgacttcatcaatgtgaaaggggaagttactggtgatatacacgttgagataacagatgccagtcggcaaactctgtgtaacgcactgaaactacagccagacgaagacgggattggcgcaacgctccagcctgcgtaa

SEQ ID NO: 4092 - protein, 418 aa, Escherichia coli
MGSDAKNLMSDGNVQIVKTGEVIGATQLTEGELIVEAGARAENTVVTGAGWLKVATGGIAKCTQYGNNGTLSVSDGAIATDIVQSEGGAISLSTLATVNGRHPEGEFSVDQGYACGLLLENGGNLRVLEGHRAEKIILDQEGGLLVNGTTSAVVVDEGGELLVYPGGEASNCEINQGGVFMLAGKANDTLLAGGTMNNLGGEDSDTIVENGAIYRLGTDGLQLYSSGKTQNLSVNVGGRAEVHAGTLENAVIQGGTVILLSPTSADENFVVEEDRAPVELTGSVALLDGASMIIGYGADLQQSTITVQQGGVLILDGSTVKGDSVTFSVGNINLNGGKLWLITGAATHVQLKVKRLRGEGAICLQTSAKEISPDFINVKGEVTGDIHVEITDASRQTLCNALKLQPDEDGIGATLQPA

SEQ ID NO: 4093 - DNA, 306 bp, Escherichia coli
atggcaactttgttacaacttcattttgcttttaatggcccatttggcgacgcaatggctgagcagcttaaaccgcttgctgagtcgattaatcaggaacctggttttctgtggaaggtatggacagaaagtgaaaagaaccacgaagccggtgggatctacctttttattaatgaaaaaagcgcccttgcctatctggaaaaacatactgcccgactgaaaaatctcggcgttgaggaagtagtcgccaaagttttcgacgtcaatgagccacttagtcaaatcaatcaggcaaaactcgcctga

SEQ ID NO: 4094 - protein, 101 aa, Escherichia coli
MATLLQLHFAFNGPFGDAMAEQLKPLAESINQEPGFLWKVWTESEKNHEAGGIYLFINEKSALAYLEKHTARLKNLGVEEVVAKVFDVNEPLSQINQAKLA

SEQ ID NO: 4095 - DNA, 1605 bp, Escherichia coli
atgaaaaaaattgctattgtgggtgccgggcctacggggatctacaccttattctcgcttctacagcaacaaacgccactttctatttctatcttcgagcaggctgacgaagccggtgtcgggatgccatacagtgatgatgaaaactcaaaactgatgctggcaaacattgccagtattgaaataccgccgatttattgcacgtatctcgaatggctacaaaagcaagaagccagccatctccagcgttatggcgttaaaaaagaaaccttgcacgatcgtcagtttttaccgcgaattctgctgggcgaatatttccgcgatcaatttttacgattagtagaccaggcacgacagcaaaaatttgcagtggctgtttatgaatcatgccaggttaccgatctgcaaattacaaatgctggcgtcatgatcgctacaaatcaggatttacccagcgagacgtttgatttagcggtgattgccacgggtcacgtctggcctgatgaagaagaagcaaccagaacgtattttcccagcccgtggtcaggcctgatggaagcaaaggtcgatgcgtgtaacgtgggtattatgggaacatccttgagcggactggatgcggcaatggcagtggctattcagcatggttcgttcattgaagatgataaacaacacgtcatttttcaccgcgataacgcaagtgaaaagctaaatattacgttaatgtcgcgcacaggtattttacccgaagccgatttctattgccctattccctacgagcccttacacatcgtcactgatcaagcattaaatgctgagattcaaaaaggcgaagagggccttttggatcgggtatttagattgatagtagaggaaatcaaatttgctgatccagactggagccaacgcatagccttagaaagcctgaatgtcgattcctttgctcaagcctggtttgccgagcgcaaacaacgcgacccattcgactgggcagaaaaaaatctccaggaggtcgaacgcaataaacgagaaaatcatactgttccctggcgttatgtcattctgcgcctgcatgaagccgtacaggaaattgttcctcatctgaatgaacacgaccataaacggttcagtaaaggccttgcccgggttttcatcgataattatgcggcaatcccttcagagtctattcgtcgactactggccttacgtgaagcgggaatcattcatattctcgccctcggtgaagactacgaaatggaaattaatgagtcgcgcaccgtcctgaaaacggaagacaatagctactcgtttgacgtttttattgatgcccgtgggcagcgtccgcttaaagtgaaagatattcctttccctagactacgcgaacaattacagaaaacaggggatgaaatccctgatgttggcgaagattatacgttacagcaacccgaagatattcgtgggcgcgtagcgttcggcgcgttgccctggttgatgcacgaccagcctttcgttcagggacttacggcatgtgcagaaattggagaggcgatggctcgggcggtcgtaaaacctgcatcccgtgcgcgtcggcgtctttcgtttgattaa

SEQ ID NO: 4096 - protein, 534 aa, Escherichia coli
MKKIAIVGAGPTGIYTLFSLLQQQTPLSISIFEQADEAGVGMPYSDDENSKLMLANIASIEIPPIYCTYLEWLQKQEASHLQRYGVKKETLHDRQFLPRILLGEYFRDQFLRLVDQARQQKFAVAVYESCQVTDLQITNAGVMIATNQDLPSETFDLAVIATGHVWPDEEEATRTYFPSPWSGLMEAKVDACNVGIMGTSLSGLDAAMAVAIQHGSFIEDDKQHVIFHRDNASEKLNITLMSRTGILPEADFYCPIPYEPLHIVTDQALNAEIQKGEEGLLDRVFRLIVEEIKFADPDWSQRIALESLNVDSFAQAWFAERKQRDPFDWAEKNLQEVERNKRENHTVPWRYVILRLHEAVQEIVPHLNEHDHKRFSKGLARVFIDNYAAIPSESIRRLLALREAGIIHILALGEDYEMEINESRTVLKTEDNSYSFDVFIDARGQRPLKVKDIPFPRLREQLQKTGDEIPDVGEDYTLQQPEDIRGRVAFGALPWLMHDQPFVQGLTACAEIGEAMARAVVKPASRARRRLSFD

SEQ ID NO: 4097 - DNA, 765 bp, Escherichia coli
atgtatcgctggtttctgcgccatttcccacgtggcggtagttatgccgatattcatcatgcactgattgaggaaggatatacggactgggcggagagtctggttgagtatgcgtggaaaaaatggctggcggatgaaaacttcgcgcatcaggaagtttcttctatgcaaaaactggccacagatcccggagaacgactattttgcagtcagtttgcccgcagcgacgatcatgctcgcatcggctgttgtgaggataacgccagaatcgcaaccgctgggtatgccgcgcaaattgccagtatgggttatagcgtgcggattggaagtgtcggctttaacagtcacattggcagctccggtgcacgcgcacgggttgctgtaaccggtaattcttcgcggataagcagcgctggagatagcagtcggattgcgaataccggaatgcgagtacgcgtttgtacattgggtgaacggtgtcatgtcgccagtaatggtgacctggtgcaaatcgccagctttggcgcaaacgccagaattgccaactgcggcgacaatgtacacatcattgccagcggtgaaaattcaacagtagtgagcacgggcgtggtcgactcaattattctcgggccagggggatgcgccgcactcgcatatcatgacggcgaaagagttcgcttcgccgtcgccattgaaggtgaaaacaatattcgagccggagtccgctatcgtcttaatgaacaacatcagtttgttgagtgctga

SEQ ID NO: 4098 - protein, 254 aa, Escherichia coli
MYRWFLRHFPRGGSYADIHHALIEEGYTDWAESLVEYAWKKWLADENFAHQEVSSMQKLATDPGERLFCSQFARSDDHARIGCCEDNARIATAGYAAQIASMGYSVRIGSVGFNSHIGSSGARARVAVTGNSSRISSAGDSSRIANTGMRVRVCTLGERCHVASNGDLVQIASFGANARIANCGDNVHIIASGENSTVVSTGVVDSIILGPGGCAALAYHDGERVRFAVAIEGENNIRAGVRYRLNEQHQFVEC

SEQ ID NO: 4099 - DNA, 786 bp, Escherichia coli
atgaacccgtcgcaacatgctgaacagtttcagagccagttggcgaactatgtgccactgttcactccccaattttggccggtgtggttgatcattgccggactattgctggtagggatgtggttggtgctggggctgcatgccttgcttcgtgctcgtggcgtgaagaaatcagccaccgaccatggtgagaaggtttatctttacagcaaagcggtcagattatggcactggtcgaatgcgttactctttgtattgttgctggcaagtgggctgataaatcactttgcgctggtgggcgcaactgcggttaaaagtctggttgcggtgcatgaagtttgcggatttttgttactggcatgctggctcggctttgttctgatcaatgccgttgggggtaatggtcaccactatcgcattcgtcgtcaggggtggctggagcgagcggcaaaacaaacgcgattctatttgtttggcattatgcagggggaagaacatcctttcccggcaacaacccagtctaaatttaatcccttacagcaggttgcctatgttggtgtcatgtatggattgctgccgttgttactattgacggggctgctgtgtctctatccgcaagccgtgggagatgtgtttcctggcgtaagatactggttattgcaggcgcattttgctctggcatttataagcctcttttttatcttcggtcatctttatctttgcaccacggggcgtacgccacacgaaacctttaaaagcatggtcgatggctatcaccggcactaa

SEQ ID NO: 4100 - protein, 261 aa, Escherichia coli
MNPSQHAEQFQSQLANYVPLFTPQFWPVWLIIAGLLLVGMWLVLGLHALLRARGVKKSATDHGEKVYLYSKAVRLWHWSNALLFVLLLASGLINHFALVGATAVKSLVAVHEVCGFLLLACWLGFVLINAVGGNGHHYRIRRQGWLERAAKQTRFYLFGIMQGEEHPFPATTQSKFNPLQQVAYVGVMYGLLPLLLLTGLLCLYPQAVGDVFPGVRYWLLQAHFALAFISLFFIFGHLYLCTTGRTPHETFKSMVDGYHRH

SEQ ID NO: 4101 - DNA, 669 bp, Escherichia coli
atgtccttcactcgacgcaaatttgttctggggatgggaacagtaatcttttttactggttctgcgtcttctctgttagcgaacacgaggcaagaaaaggaagttcggtatgccatgattcatgacgagtcacggtgcaatggctgtaatatttgcgcccgcgcatgccgtaaaactaaccacgtccccgctcagggaagccgtttatcgatagcacacattccagtcaccgataacgacaacgaaacgcagtatcacttttttcgccagtcatgtcagcactgcgaagatgctccgtgcatcgacgtttgtccgacagcggcatcgtggcgtgatgagcaggggatcgtacgggtagaaaaatcgcagtgcatcggctgcagttattgcattggcgcttgtccttaccaggttcgctaccttaaccctgtcactaaagtggcagataaatgtgatttctgcgctgagtcccgactggcaaaaggctttccgcccatttgcgtcagcgcctgtccggaacacgcattgatctttggtcgcgaagatagcccagaaattcaggcgtggttgcaggaaaataaatactatcaatatcagctacctggtgccgggaaaccgcacctgtatcgccggttcggtcaacatttgattaaaaaggaaaatgtatga

SEQ ID NO: 4102 - protein, 222 aa, Escherichia coli
MSFTRRKFVLGMGTVIFFTGSASSLLANTRQEKEVRYAMIHDESRCNGCNICARACRKTNHVPAQGSRLSIAHIPVTDNDNETQYHFFRQSCQHCEDAPCIDVCPTAASWRDEQGIVRVEKSQCIGCSYCIGACPYQVRYLNPVTKVADKCDFCAESRLAKGFPPICVSACPEHALIFGREDSPEIQAWLQENKYYQYQLPGAGKPHLYRRFGQHLIKKENV

SEQ ID NO: 4103 - DNA, 639 bp, Escherichia coli
atgaaccatcaggatgaattgccgttagcgaaagtcagcgaagttgatgaggcgaagcggcaatggttgcaggggatgcgtcaccccgttgatacggtaaccgaaccagaacctgctgaaatcctggcagagttcattcgtcagcattctgcggctgggcagctggtggcgcgcgccgtgtttctctcgccgccctattcggttgcagaagaggaactgtcagttttgctggaaaacattaagcagaacggagaccacgcggatatcgcttgtttgacgggaagccaggatgattactattactcaacgcaggccatgagtgaaaactacgcggcgatgtctttgcaagttgtggagcaggacatttgtcgcgctattgcacacgccgttcgttttgagtgccagacgtatcctcgtccttacaaagtcgccatgctgatgcaagcgccatattacttccaggaagcgcagattgaagccgcgatcgccgcgatggatgttgcacctgaatatgccgatatacggcaggtggagtcatcgacggcggtgttgtacttgtttagcgagcgatttatgacctatggcaaggcgtatggcttatgcgaatggttcgaggtagagcagtttcagaacccctga

SEQ ID NO: 4104 - protein, 212 aa, Escherichia coli
MNHQDELPLAKVSEVDEAKRQWLQGMRHPVDTVTEPEPAEILAEFIRQHSAAGQLVARAVFLSPPYSVAEEELSVLLENIKQNGDHADIACLTGSQDDYYYSTQAMSENYAAMSLQVVEQDICRAIAHAVRFECQTYPRPYKVAMLMQAPYYFQEAQIEAAIAAMDVAPEYADIRQVESSTAVLYLFSERFMTYGKAYGLCEWFEVEQFQNP

SEQ ID NO: 4105 - DNA, 1797 bp, Escherichia coli
atgaaattcgctggatacgacgtcattattatcgaagggaaagcgaaatcaccggtatggctgaatattaaagatgacaaagttagcctggaaaaagccgatttcttatggggaaaagggacgcgcgcaacgacggaagagatttgtcgattgaccagccctgaaacctgtgtggcggctattggtcaggctggggaaaaccttgttcctctctctggcatgttgaatagccgtaaccacagcggtggtgcgggaactggcgcaataatgggttcgaaaaacctgaaagcgattgcggttgaagggacgaaaggggtcaacattgccgatcgtcaggagatgaagcgtctcaacgattacatgatgactgaacttatcggtgcgaataacaaccatgtcgtgccaagtacgccgcaatcgtgggcagagtattcagatcccaagtcacgttggactgcacgtaaagggttgttttggggcgcggctgaaggtggtccgattgaaacgggtgagattccgccaggcaatcagaacacggtcggctttcgtacctataaatccgtttttgacttaggtccggcggcagagaaatacacagtaaaaatgagtggctgccactcttgcccgatccgttgtatgacccaaatgaatattcctcgggtgaaagagtttggcgtgcccagcacaggtggtaacacttgtgtagcaaactttgtccataccaccatcttcccgaacggtccgaaagattttgaagataaagatgatggtcgtgtgattggtaacctggttggtctgaatctgttcgatgactacggcctatggtgtaactatggtcagcttcatcgcgactttacctattgttacagcaaaggggtgttcaagcgtgttctgcctgctgaagagtatgcggaaattcgctgggatcaactggaagcgggtgacgttaacttcattaaagatttttactaccgtctggcgcatcgcgtgggtgagctgagtcacctggctgatggttcatatgccatcgcagaacgctggaatttgggtgaagagtactggggctacgcgaaaaataaactctggtcgccgtttggctatccagttcaccacgccaatgaagcgtcagcgcaggtcggctccattgttaactgtatgttcaaccgtgactgcatgacgcatacccatatcaactttattggttccggcttgccattgaaactgcaacgtgaagtggcgaaagaactttttggttctgaagatgcttacgatgaaaccaaaaactacacgccaatcaatgacgcaaaaattaaatatgctaagtggtcgctgttgcgggtctgtttgcataacgccgtcaccctgtgcaactgggtctggccaatgaccgtttcgccgctgaaaagccgtaattatcggggcgatctggcgcttgaagccaaattcttcaaagcgatcactggcgaagatatgactcaggaaaaattagatttagctgcagagcgtatctttacgttgcatcgcgcctacacggtaaaactgatgcaaactaaagatatgcgtaatgagcacgatcttatctgttcctgggtattcgataaggatccgcagatcccggtctttactgaaggtactgacaaaatggatcgtgacgatatgcatgcttcgctcacgatgttctacaaagaaatgggctgggacccacagcttggttgtccgacccgtgaaacattgcagcgtctggggctggaagatattgccgccgatctggcagcacacaatctactgcctgcgtaa

SEQ ID NO: 4106 - protein, 598 aa, Escherichia coli
MKFAGYDVIIIEGKAKSPVWLNIKDDKVSLEKADFLWGKGTRATTEEICRLTSPETCVAAIGQAGENLVPLSGMLNSRNHSGGAGTGAIMGSKNLKAIAVEGTKGVNIADRQEMKRLNDYMMTELIGANNNHVVPSTPQSWAEYSDPKSRWTARKGLFWGAAEGGPIETGEIPPGNQNTVGFRTYKSVFDLGPAAEKYTVKMSGCHSCPIRCMTQMNIPRVKEFGVPSTGGNTCVANFVHTTIFPNGPKDFEDKDDGRVIGNLVGLNLFDDYGLWCNYGQLHRDFTYCYSKGVFKRVLPAEEYAEIRWDQLEAGDVNFIKDFYYRLAHRVGELSHLADGSYAIAERWNLGEEYWGYAKNKLWSPFGYPVHHANEASAQVGSIVNCMFNRDCMTHTHINFIGSGLPLKLQREVAKELFGSEDAYDETKNYTPINDAKIKYAKWSLLRVCLHNAVTLCNWVWPMTVSPLKSRNYRGDLALEAKFFKAITGEDMTQEKLDLAAERIFTLHRAYTVKLMQTKDMRNEHDLICSWVFDKDPQIPVFTEGTDKMDRDDMHASLTMFYKEMGWDPQLGCPTRETLQRLGLEDIAADLAAHNLLPA

SEQ ID NO: 4107 - DNA, 222 bp, Escherichia coli
gtggaaagatattactgtgtgaatcttgcaaaggaaaaaatcatggctaacggttggacaggtaatatattaagagtcaatctcacgacaggaaatattaccctcgaagattccagtaagtttaaaagttttgtcggtggcatgggcttcggctacaaaattatgtatgacgaagtaccgccaggcacgaaacctttcgatgaagcgaataaattaaattag

SEQ ID NO: 4108 - protein, 73 aa, Escherichia coli
MERYYCVNLAKEKIMANGWTGNILRVNLTTGNITLEDSSKFKSFVGGMGFGYKIMYDEVPPGTKPFDEANKLN

SEQ ID NO: 4109 - DNA, 627 bp, Escherichia coli
atgaacccggttgatcgtccactattaaatattggcttaacgcgattagaattcttgcgtatatcaggaaaaggccttgctggtttaacaattgcccctgcgttactgtcacttttgggttgcaaacaggaagatattgatagcggcacagtaggcttgataaatacacccaaaggggtgctggtgacccatcgtgcgcgatgcacgggttgccaccgctgtgaaatctcttgtaccaacttcaacgatggctcagtagggacattcttctcccgtatcaaaatccatcgcaattatttctttggcgataacggggttggctctggtggcggcctgtatggcgatctcaactataccgcggacacctgccgtcaatgcaaagaaccgcaatgcatgaatgtctgcccgattggtgcgattacctggcaacaggaagaaggctgtattaccgtcgatcataaacgttgtattggctgtagcgcctgtactacggcgtgcccgtggatgatggccaccgtaaataccgaaagtaaaaaatcctcgaaatgtgtgttatgcggtgaatgcgcaaacgcctgcccaacaggggcgttaaaaattatcgagtggaaagatattactgtgtga

SEQ ID NO: 4110 - protein, 208 aa, Escherichia coli
MNPVDRPLLNIGLTRLEFLRISGKGLAGLTIAPALLSLLGCKQEDIDSGTVGLINTPKGVLVTHRARCTGCHRCEISCTNFNDGSVGTFFSRIKIHRNYFFGDNGVGSGGGLYGDLNYTADTCRQCKEPQCMNVCPIGAITWQQEEGCITVDHKRCIGCSACTTACPWMMATVNTESKKSSKCVLCGECANACPTGALKIIEWKDITV

SEQ ID NO: 4111 - DNA, 210 bp, Escherichia coli
atgggaaatcggacaaaagaggatgaactgtaccgagaaatgtgcagagttgtcggtaaagttgtgctggaaatgcgcgatctggggcaggaaccaaagcatattgttatcgcaggcgtattacgtacagcattagccaataaacgcattcagcgcagtgagctggaaaagcaggcgatggaaaccgtcattaacgcactggtaaaatga

SEQ ID NO: 4112 - protein, 69 aa, Escherichia coli
MGNRTKEDELYREMCRVVGKVVLEMRDLGQEPKHIVIAGVLRTALANKRIQRSELEKQAMETVINALVK

SEQ ID NO: 4113 - DNA, 1419 bp, Escherichia coli
  n 1396, 1397, 1398, 1399, 1400: n is any nucleotide
atggtttcagcactttggactgtagaactcaacgactcaaaaacaggcactcacgttgggctgagacacaagcacacattcctctgcacgctttttcgatgtcacctatccttagagcgaggcacaaccactttcgtaataccggattcgctttccggcagtgcgcccagaaagcaagtttctcccatccttctcaacttaaagactaagactgtcatgaaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccagaaatccgcaccatgaaactggaaggcggtaacgacgtttctctgaaagcgggtcagacctttactttcactactgataaatctgttatcggcaacagcgaaatggttgcggtaacgtatgaaggtttcactactgacctgtctgttggcaacaccgtactggttgacgacggtctgatcggtatggaagttaccgccattgaaggtaacaaagttatctgtaaagtgctgaacaacggcgacctgggcgaaaacaaaggtgtgaacctgcctggcgtttccattgccctgccagcactggctgaaaaagacaaacaggacctgatctttggttgcgaacaaggcgtagactttgttgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagtcgttatcactgcgacccagatgctggattccatgatcaaaaacccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgtattaccgaagcggtatgccgtggtgccgttgaaactgctgaaaaactggatgctccactgatcgtggttgctactcagggcggtaaatctgctcgcgcagtacgtaaatactcccggatgnnnnncattccattcattaattaa

SEQ ID NO: 4114 - protein, 472 aa, Escherichia coli
  Xaa 466, 467: Xaa is any amino acid
MVSALWTVELNDSKTGTHVGLRHKHTFLCTLFRCHLSLERGTTTFVIPDSLSGSAPRKQVSPILLNLKTKTVMKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYSRMXXIPFIN

SEQ ID NO: 4115 - DNA, 237 bp, Escherichia coli
atgaaagctactaaactggtactgggcgcggtaatcctgggttctactctgctggcaggttgctccagcaacgctaaaatcgatcagctgtcttctgacgttcagactctgaacgctaaagttgaccagctgagcaacgacgtgaacgcaatgcgttccgacgttcaggctgctaaagatgacgcagctcgtgctaaccagcgtctggacaacatggctactaaataccgcaagtaa

SEQ ID NO: 4116 - protein, 78 aa, Escherichia coli
MKATKLVLGAVILGSTLLAGCSSNAKIDQLSSDVQTLNAKVDQLSNDVNAMRSDVQAAKDDAARANQRLDNMATKYRK

SEQ ID NO: 4117 - DNA, 1005 bp, Escherichia coli
atgaaacgcgcgtctttgcttacactcacgcttatcggcgcttttagcgccatccaggctgcctgggcggttgattatccgctaccatcaaccggcagtcgactggttgggcaaaatcaaacgtatacggtgcaagaaggggataaaaaccttcaggccatcgcccgacgttttgatactgcggcaatgttgatccttgaagccaataacactatcgccccggtgccaaaacccggtacgacgataactattccttcacaactattattacctgatgcgccgcgtcaggggattattgtaaaccttgcagagctgcgcctttattattatccgccgggagaaaatatcgtgcaggtttatccgataggtattggtttgcaggggctggaaacgccggtgatggaaacgcgtgtggggcagaaaatccctaacccaacctggacgcctacggcgggcattcgtcaacgttcgctggagcgtggcattaaattaccaccagtcgttcctgccgggcccaataacccactaggacgttacgcactgcgcctcgcgcatggtaatggcgaatacctcattcatggcaccagtgcgccggacagcgtcggtttgcgcgtcagttcgggctgtattcgcatgaatgcaccggatattaaagctttattctccagcgtgcggacgggaacgccggtgaaagtgatcaacgaaccggtgaaatattccgtggaacctaacgggatgcgttatgttgaagtacatcgaccactatcggcagaagaacagcagaacgttcagacaatgccgtacacgctgccagcaggctttacgcaatttaaagacaataaggctgtagatcagaagttagtcgataaagcgttgtatcgtcgggcagggtatccggttgcggtgagcagtggagcaactcccgcagccagcaatgcgccttcagtagagtcagcgcagaatggggaaccagagcaagggaatatgttacgcgcgacgcagtag

SEQ ID NO: 4118 - protein, 334 aa, Escherichia coli
MKRASLLTLTLIGAFSAIQAAWAVDYPLPSTGSRLVGQNQTYTVQEGDKNLQAIARRFDTAAMLILEANNTIAPVPKPGTTITIPSQLLLPDAPRQGIIVNLAELRLYYYPPGENIVQVYPIGIGLQGLETPVMETRVGQKIPNPTWTPTAGIRQRSLERGIKLPPVVPAGPNNPLGRYALRLAHGNGEYLIHGTSAPDSVGLRVSSGCIRMNAPDIKALFSSVRTGTPVKVINEPVKYSVEPNGMRYVEVHRPLSAEEQQNVQTMPYTLPAGFTQFKDNKAVDQKLVDKALYRRAGYPVAVSSGATPAASNAPSVESAQNGEPEQGNMLRATQ

SEQ ID NO: 4119 - DNA, 417 bp, Escherichia coli
atggctttattgccggataaagaaaaattgctgcgtaattttttacgctgcgccaactgggaagagaaatatctctacattattgagttgggtcagcgtctgccagaattacgtgacgaagacaaaagcccgcaaaatagcatccagggctgccagagtcaggtgtggattgtaatgcgtcaaaatgcgcagggaattattgaattacatggcgacagcgatgcggccattgtaaaagggcttattgcggtcgtctttattctttacgatcaaatgacgccgcaggatattgtcaatttcgatgtgcgcccgtggtttgaaaaaatggcgctcacccaacatctcaccccatcacgctcacaaggtctggaagcgatgattcgcgcaattcgcgccaaagccgctgcacttagctaa

SEQ ID NO: 4120 - protein, 138 aa, Escherichia coli
MALLPDKEKLLRNFLRCANWEEKYLYIIELGQRLPELRDEDKSPQNSIQGCQSQVWIVMRQNAQGIIELHGDSDAAIVKGLIAVVFILYDQMTPQDIVNFDVRPWFEKMALTQHLTPSRSQGLEAMIRAIRAKAAALS

SEQ ID NO: 4121 - DNA, 1077 bp, Escherichia coli
atgactttttccgtcgacaaagtgcgggccgactttccggtgctttctcgtgaggtaaacggtttgccgctggcttatctcgacagcgccgccagtgcgcagaaaccgagccaggtgattgatgccgaggctgagttttatcgtcatggctacgcggcggtgcatcgcggtattcataccttaagcgcccaggcgaccgagaaaatggagaacgtgcgcaagcgtgcttcgctgtttattaatgcccgttcggcggaagagctggtgttcgtccgcggcacgacggaagggatcaatctggtcgccaatagctggggcaacagcaatgtgcgagcgggcgataacatcatcatcagtcagatggagcaccacgctaacattgtcccctggcagatgctttgtgcacgcgttggcgcagagctgcgtgtgatcccgctcaaccccgacggtactctgcaactggagacgctgcctacgctgtttgatgagaaaactcgtctgctggcaattactcatgtctccaacgtgcttgggacagaaaatccgctggcggagatgatcacacttgcgcatcaacatggcgcaaaagtgctggtggatggcgctcaggcggtgatgcatcatccggtggatgttcaggcgctggattgcgatttttacgtgttctccgggcataaactgtatggccctaccggaattggcattctttatgtcaaagaagccttgttgcaggagatgccgccgtgggaagggggcggttctatgatcgccaccgtcagcctgagtgaaggcactacctggaccaaagcaccatggcggtttgaagccggtacacccaataccggaggcatcattggtcttggcgcggcgctggagtatgtttcggcgctggggcttaataacatagccgagtatgaacagaatctgatgcattacgcgttatcacagttggaatctgtaccggatctcactctctatggcccacaaaacaggcttggcgttattgcttttaatctcggtaaacaccacgcctatgatgttggcagttttctcgataacgcatgctgtgcgtactga

SEQ ID NO: 4122 - protein, 358 aa, Escherichia coli
MTFSVDKVRADFPVLSREVNGLPLAYLDSAASAQKPSQVIDAEAEFYRHGYAAVHRGIHTLSAQATEKMENVRKRASLFINARSAEELVFVRGTTEGINLVANSWGNSNVRAGDNIIISQMEHHANIVPWQMLCARVGAELRVIPLNPDGTLQLETLPTLFDEKTRLLAITHVSNVLGTENPLAEMITLAHQHGAKVLVDGAQAVMHHPVDVQALDCDFYVFSGHKLYGPTGIGILYVKEALLQEMPPWEGGGSMIATVSLSEGTTWTKAPWRFEAGTPNTGGIIGLGAALEYVSALGLNNIAEYEQNLMHYALSQLESVPDLTLYGPQNRLGVIAFNLGKHHAYDVGSFLDNACCAY

SEQ ID NO: 4123 - DNA, 1272 bp, Escherichia coli
atggctggcttaccgaacagcagtaacgcactgcaacagtggcatcatttgtttgaagctgaaggggcgaaacgctccccgcaagcacagcagcatttacaacaattgctgcgtaccggactgccgacacgtaaacatgaaaactggaaatatacgccgctggacgggctgaccaatagccagtttgtcagcattgcgggggagatatccccacagcagcgtgatgccttagcgttaacattagacgccgtgcggctggtgtttgtcgatggacgttacgtgcccgcactgagcgatgcaactgaaggcagcggatatgaagtgagcattaacgacgaccgtcaggggttacccgacgctattcaggcggaagtgtttctgcatttgacggaaagcctggcacaaagcgtgacgcatatcgccgtgaagcgcggtcaacggccggcaaagccattgctgttaatgcatatcacccagggcgtggcaggtgaagaggtgaatactgcccattaccggcatcatctggatctggcggaaggtgccgaagcaacggtgatcgaacattttgtcagccttaatgatgctcgtcacttcaccggcgcacggttcactatcaacgtcgcagcgaacgcccatttgcagcatatcaagctggcgtttgaaaacccgctcagtcaccactttgctcataacgatttgttgctggctgacgatgccaccgcatttagccacagtttcctgctgggtggcgcagtgttacgacacaacaccagtacgcaactcaatggcgaaaacagcacgctgcggatcaatagcctggcgatgccggtgaaaaacgaggtgtgtgatactcgtacctggttggaacacaataaaggtttttgtaacagccgacagttgcacaaaactatcgtcagcgacaaaggccgcgcggtatttaacggtttgatcaacgtcgcgcagcacgccatcaaaacggatggtcagatgaccaacaataatctgctgatgggcaaactggcggaagtggatacgaaaccgcagctggaaatctatgcagatgatgtgaaatgcagccacggcgcgacggtggggcgtattgatgacgaacagatgttttatctgcgctcgcgcgggatcaatcagcaagatgcccagcagatgatcatttacgcctttgctgccgaactgacggaagcactgcgtgatgaggggcttaaacagcaggtgctggcccgaatcggtcaacgactgccaggaggtgcaagatga

SEQ ID NO: 4124 - protein, 423 aa, Escherichia coli
MAGLPNSSNALQQWHHLFEAEGAKRSPQAQQHLQQLLRTGLPTRKHENWKYTPLDGLTNSQFVSIAGEISPQQRDALALTLDAVRLVFVDGRYVPALSDATEGSGYEVSINDDRQGLPDAIQAEVFLHLTESLAQSVTHIAVKRGQRPAKPLLLMHITQGVAGEEVNTAHYRHHLDLAEGAEATVIEHFVSLNDARHFTGARFTINVAANAHLQHIKLAFENPLSHHFAHNDLLLADDATAFSHSFLLGGAVLRHNTSTQLNGENSTLRINSLAMPVKNEVCDTRTWLEHNKGFCNSRQLHKTIVSDKGRAVFNGLINVAQHAIKTDGQMTNNNLLMGKLAEVDTKPQLEIYADDVKCSHGATVGRIDDEQMFYLRSRGINQQDAQQMIIYAFAAELTEALRDEGLKQQVLARIGQRLPGGAR

SEQ ID NO: 4125 - DNA, 747 bp, Escherichia coli
atgttaagtattaaagatttacacgtcagcgtggaagataaagctatcctgcgtggattaagcctcgacgttcgtcccggcgaagttcacgccattatggggcccaatggttcgggcaaaagtaccttatcggcaacgcttgccgggcgagaagattatgaagtgacgagcggcacggttgagtttaaaggcaaagatttgcttgcgctgtcgccggaagatcgtgcaggtgaaggcatctttatggccttccagtatccggtggaaattcccggcgtcagtaaccagtttttcctgcaaacggcacttaatgcggtgcgcagctatcgtgggcaggaaacgctcgaccgctttgattttcaggatttgatggaagagaaaatcgctcccctgaagatgccggaagatttattaacccgttcggtaaacgttggtttttccggcggcgagaaaaagcgcaacgatattttgcaaatggcggtgctggaaccggagttatgcattcttgatgagtcagactccgggctggatattgacgcattaaaagtggttgccgatggcgtgaactcgctgcgtgacggcaagcgttcattcatcattgttacgcactaccaacgcattctcgactacatcaagcctgattacgtccatgtgctgtatcagggacgaattgtgaaatccggcgatttcacgttggtcaaacaactggaggagcagggttatggctggcttaccgaacagcagtaa

SEQ ID NO: 4126 - protein, 248 aa, Escherichia coli
MLSIKDLHVSVEDKAILRGLSLDVRPGEVHAIMGPNGSGKSTLSATLAGREDYEVTSGTVEFKGKDLLALSPEDRAGEGIFMAFQYPVEIPGVSNQFFLQTALNAVRSYRGQETLDRFDFQDLMEEKIAPLKMPEDLLTRSVNVGFSGGEKKRNDILQMAVLEPELCILDESDSGLDIDALKVVADGVNSLRDGKRSFIIVTHYQRILDYIKPDYVHVLYQGRIVKSGDFTLVKQLEEQGYGWLTEQQ

SEQ ID NO: 4127 - DNA, 1488 bp, Escherichia coli
atgtctcgtaatactgaagcaactgacgatgtcaaaacctggaccggcggcccgctgaattataaagaaggattcttcacccagttagccaccgatgagctggcaaaggggataaacgaagaggtggtgcgcgcaatttcggcgaagcgtaatgagccggagtggatgctggagtttcgtctcaacgcctatcacgcatggctggagatggaagaaccgcactggttgaaagcgcactacgacaagctgaattatcaggattacagctactactcggcaccatcgtgcggtaattgtgacgacaactgcgcgtctgaacccggcgcggtgcagcaaactggcgcgaacgcctttttaagtaaagaggtggaggcggcgtttgagcagttgggcgttcccgtgcgggaaggcaaagaggtggcagtggatgccattttcgactctgtttcggttgccactacttatcgcgaaaaactggcggagcagggaattattttttgttcctttggcgaggcgatccacgatcacccggaactggtgcgtaaatatctcggcaccgtggtgccggggaatgacaacttctttgccgcacttaatgcggcggtagcctctgacggtacgtttatttatgtgcctaaaggcgtgcgttgcccgatggaactttccacctattttcgcattaacgcggaaaaaaccgggcagtttgagcgcaccattctggtggccgacgaagacagctacgttagctacattgaaggctgttccgctccggtgcgtgacagctatcagttacacgcggcggtggtggaagtcatcatccataaaaacgccgaggtgaaatattccacggtacaaaactggttccctggcgataacaacaccggcggtattctcaacttcgtcaccaagcgtgctttgtgcgaaggcgaaaacagcaaaatgtcatggacgcaatcagaaaccggctcagcgattacgtggaaatatcccagctgcattttgcgcggcgataactccattggtgagttttactcagtggctctgaccagcggtcatcagcaagcggataccggcaccaagatgatccacatcggtaaaaacaccaaatcgaccattatatcgaaagggatctctgccggacatagtcagaacagttatcgcggcttagtgaaaatcatgccgacggcaaccaatgcgcgcaatttcactcagtgcgactcaatgctgattggcgctaattgtggggcgcataccttcccgtatgtcgaatgtcgcaataacagcgctcagctggagcacgaggcaacgacatcacgtattggtgaagatcaactgttttactgcctgcaacgcgggatcagcgaagaagatgccatctcgatgattgttaacggtttttgcaaagacgtgttctcggaactgccgctggaatttgccgttgaagcacaaaaactcctcgccatcagtcttgaacacagcgtcggataa

SEQ ID NO: 4128 - protein, 495 aa, Escherichia coli
MSRNTEATDDVKTWTGGPLNYKEGFFTQLATDELAKGINEEVVRAISAKRNEPEWMLEFRLNAYHAWLEMEEPHWLKAHYDKLNYQDYSYYSAPSCGNCDDNCASEPGAVQQTGANAFLSKEVEAAFEQLGVPVREGKEVAVDAIFDSVSVATTYREKLAEQGIIFCSFGEAIHDHPELVRKYLGTVVPGNDNFFAALNAAVASDGTFIYVPKGVRCPMELSTYFRINAEKTGQFERTILVADEDSYVSYIEGCSAPVRDSYQLHAAVVEVIIHKNAEVKYSTVQNWFPGDNNTGGILNFVTKRALCEGENSKMSWTQSETGSAITWKYPSCILRGDNSIGEFYSVALTSGHQQADTGTKMIHIGKNTKSTIISKGISAGHSQNSYRGLVKIMPTATNARNFTQCDSMLIGANCGAHTFPYVECRNNSAQLEHEATTSRIGEDQLFYCLQRGISEEDAISMIVNGFCKDVFSELPLEFAVEAQKLLAISLEHSVG

SEQ ID NO: 4129 - DNA, 369 bp, Escherichia coli
atggacatgcattcaggaacctttaatccacaggatttcgcctggcaaggcttaacgctgacacccgcagcggcgatacacatccgcgaactggtggcaaagcagcctggtatgatcggcgtgcgcttaggcgttaagcaaacaggctgcgcgggctttggctatgtgctcgacagtgttagcgagccggacaaagacgatctgctgtttgaacacgacggcgcgaagctgtttgtcccgctgcaagcgatgccttttattgatggcacggaagtcgatttcgttcgcgaaggacttaatcagatattcaaatttcacaaccctaaagcccagaatgaatgtggctgtggcgaaagctttggggtatag

SEQ ID NO: 4130 - protein, 122 aa, Escherichia coli
MDMHSGTFNPQDFAWQGLTLTPAAAIHIRELVAKQPGMIGVRLGVKQTGCAGFGYVLDSVSEPDKDDLLFEHDGAKLFVPLQAMPFIDGTEVDFVREGLNQIFKFHNPKAQNECGCGESFGV

SEQ ID NO: 4131 - DNA, 270 bp, Escherichia coli
gtgacgcatattgcttttggttattatctgcacagtaaacggtggtatactgtgcaggtcttgtctaaaagcgaggatgctatgtctactcaacttgatcccacccaactggccattgaatttttacgccgtgaccaaagcaatctttcacctgcccaatatctcaagcgtctgaaacaattagaacttgaatttgctgacctgcttactctctcttctgctgaattaaaagaagaaatctacttcgcctggcgtctgggcgtgcattga

SEQ ID NO: 4132 - protein, 89 aa, Escherichia coli
MTHIAFGYYLHSKRWYTVQVLSKSEDAMSTQLDPTQLAIEFLRRDQSNLSPAQYLKRLKQLELEFADLLTLSSAELKEEIYFAWRLGVH

SEQ ID NO: 4133 - DNA, 354 bp, Escherichia coli
atggtgggattgctggatattcgctttgaacatattggtgatgacacccttgaagcgacaatgccagtagactcacggacaaagcagcctttcgggttgctgcatggaggtgcatctgtggtactggccgaaagtatcggttccgttgccggttatttatgtaccgaaggtgagcaaaaagtggttggtctggaaatcaatgctaaccacgtccgctcggcacgagaagggcgggtgcgcggcgtatgcaaaccgttgcatctcggttcgcgtcaccaggtctggcagattgaaatcttcgatgagaaagggcgtttgtgctgttcgtcacgattgacgaccgctattttgtga

SEQ ID NO: 4134 - protein, 117 aa, Escherichia coli
MVGLLDIRFEHIGDDTLEATMPVDSRTKQPFGLLHGGASVVLAESIGSVAGYLCTEGEQKVVGLEINANHVRSAREGRVRGVCKPLHLGSRHQVWQIEIFDEKGRLCCSSRLTTAIL

SEQ ID NO: 4135 - DNA, 3057 bp, Escherichia coli
atgattccacagatttcccaggcacccggcgtcgttcaactggtgcttaattttttgcaagagctggagcaacagggttttaccggcgatacggcgacaagttatgccgatcgtctgacaatgtcgactgacaacagtatttaccaacttctccccgatgcggtggtatttccgcgttcaaccgcagatgtagcgctgatcgcccgtcttgccgcgcaggaacgctattcatcgttgatctttaccccccgcggcggcggcaccggcactaacggacaggcgctcaaccaggggattattgttgatatgtcccgccatatgaaccgcatcatcgaaattaaccctgaagagggctgggtgcgcgttgaggccggggtgattaaagaccaactcaatcagtacctgaaaccctttggctacttttttgcgccagaactttcgaccagcaaccgggcaacgctcggcgggatgatcaataccgatgcatccggtcagggatcgctggtctatggcaaaacgtcagatcacgtacttggcgtacgcgcggtgttgttggggggcgatattctcgatacgcaacctttacccgtcgaactggcggaaacgctgggtaaatccaataccacaatcgggcgaatttataacacggtttatcaacgttgccgtcagcaacgccagttaatcatcgacaacttccccaagcttaaccgctttcttaccggttacgatctgcgtcatgtctttaacgatgagatgaccgagttcgacctgacgcgcattctgacgggttcagaagggacgctggcctttattaccgaagcgcgactggatattacgcgcttgcctaaagtacgccgtctggtgaacgtcaaatatgactcttttgactccgcgctgcgtaacgcgccgtttatggttgaggcgcgggcgctttcggtagagacggtggactcaaaagtgctcaaccttgcgcgggaagatattgtctggcattccgtcagcgagttgattaccgatgtgcctgataaagagatgctcgggctgaacattgtggaatttgccggtgatgatgaggcactgattgacgagcgagttaatgcactctgtgtgcggcttgatgagctgattgccagccaacaggcaggagtgatcggctggcaggtgtgccgcgagctggcgggtgttgaacgtatctatgcgatgcgcaaaaaagccgttggtctgcttggcaatgccaaaggtgctgctaagccaattccgtttgctgaggatacctgtgtaccgccggaacacctggcggattatattgctgaatttcgcgcgctgctcgacagccacggcttaagctacggtatgttcggtcacgtcgacgcaggtgtcttgcacgtccgtccagcactggatatgtgcgatccgcaacaggagattttgatgaagcaaatctctgatgatgtagtggcgcttaccgcgaaatacggtggtttgttgtggggcgaacacggcaaaggttttcgcgccgaatacagcccggcgttttttggtgaggaactttttgcagaactgcgtaaagtgaaagcggcgtttgatccgtataaccgactcaaccccgggaagatttgcccgccagaaggtctcgatgcgccgatgatgaaagtggacgcggtgaagcgcggtacattcgatcgacagatccccattgcggtacgccagcagtggcgtggtgcaatggagtgtaacggcaacggtttatgcttcaactttgatgctcgtagtccgatgtgcccgtcgatgaagatcacccagaaccggattcattcaccgaaagggcgcgcaacgctggtacgtgaatggctgcgtttgttggcggatcgcggcgttgacccactcaaactggaacaagaactgcctgaatccggcgtcagtttgcggacgttaattgcccgcacgcgcaatagttggcatgcgaataaaggcgaatatgacttctcacacgaagtcaaagaggcgatgtcgggctgtctggcctgtaaagcttgttcgactcagtgccccatcaaaattgatgtgccggagtttcgctctcgtttcctgcaactctatcacacccgttatttacgcccgctgcgcgaccacctcgtcgctacggttgagagttacgcaccgctgatggcacgcgcgccgaaaacctttaacttcttcattaaccagccgctggtgcgcaaactctcggaaaaacatatcggcatggttgatttgccgctgctgtcggtcccctcgctacaacaacaaatggtggggcatcgctcggcaaacatgacgctggaacagcttgaagctctcaatgcagagcagaaagcgcgcacggtgctggtggtgcaggacccctttaccagctattacgatgctcaagtggtggcggattttgtccgtctggtcgaaaaattaggtttccagcccgtgttactgccattttcgccaaatggaaaagcccagcatatcaaaggttttcttaatcgttttgcgaagacggcgaaaaagacggcggatttcctcaaccgtatggcgaagctgggtatgccaatggtaggcgtcgacccggcgctggtactttgttatcgcgatgaatataaactggctctgggcgaggagcgtggcgagtttaacgtcttactggcaaatgaatggctggcaagcgcacttgactcacagccagtggctacagtcagcggtgaatcatggtatttctttggtcactgtaccgaagttaccgccttgccaggcgcgccagcacaatgggcggcaatatttgcccgttttggcgcgaaactggaaaatgtcagcgtggggtgctgcggcatggcagggacttacggacatgaagcgaaaaaccataaaaattcactcaggatctatgaattatcctggcatcaggctatgcagcgactgccgcgtaaccgctgtctggcgaccggatattcctgccgtagtcaggtaaaacgggttgaaggcacaggggtacgccatcctgtgcaggctttactggagattattaaatga

SEQ ID NO: 4136 - protein, 1018 aa, Escherichia coli
MIPQISQAPGVVQLVLNFLQELEQQGFTGDTATSYADRLTMSTDNSIYQLLPDAVVFPRSTADVALIARLAAQERYSSLIFTPRGGGTGTNGQALNQGIIVDMSRHMNRIIEINPEEGWVRVEAGVIKDQLNQYLKPFGYFFAPELSTSNRATLGGMINTDASGQGSLVYGKTSDHVLGVRAVLLGGDILDTQPLPVELAETLGKSNTTIGRIYNTVYQRCRQQRQLIIDNFPKLNRFLTGYDLRHVFNDEMTEFDLTRILTGSEGTLAFITEARLDITRLPKVRRLVNVKYDSFDSALRNAPFMVEARALSVETVDSKVLNLAREDIVWHSVSELITDVPDKEMLGLNIVEFAGDDEALIDERVNALCVRLDELIASQQAGVIGWQVCRELAGVERIYAMRKKAVGLLGNAKGAAKPIPFAEDTCVPPEHLADYIAEFRALLDSHGLSYGMFGHVDAGVLHVRPALDMCDPQQEILMKQISDDVVALTAKYGGLLWGEHGKGFRAEYSPAFFGEELFAELRKVKAAFDPYNRLNPGKICPPEGLDAPMMKVDAVKRGTFDRQIPIAVRQQWRGAMECNGNGLCFNFDARSPMCPSMKITQNRIHSPKGRATLVREWLRLLADRGVDPLKLEQELPESGVSLRTLIARTRNSWHANKGEYDFSHEVKEAMSGCLACKACSTQCPIKIDVPEFRSRFLQLYHTRYLRPLRDHLVATVESYAPLMARAPKTFNFFINQPLVRKLSEKHIGMVDLPLLSVPSLQQQMVGHRSANMTLEQLEALNAEQKARTVLVVQDPFTSYYDAQVVADFVRLVEKLGFQPVLLPFSPNGKAQHIKGFLNRFAKTAKKTADFLNRMAKLGMPMVGVDPALVLCYRDEYKLALGEERGEFNVLLANEWLASALDSQPVATVSGESWYFFGHCTEVTALPGAPAQWAAIFARFGAKLENVSVGCCGMAGTYGHEAKNHKNSLRIYELSWHQAMQRLPRNRCLATGYSCRSQVKRVEGTGVRHPVQALLEIIK

SEQ ID NO: 4137 - DNA, 1113 bp, Escherichia coli
atggtaaatgttcgtcagcccagggatgtcgcacaaattctgctttcggtgctgtttttagccatcatgattgtggcatgtctgtggattgtacaaccctttattctcggctttgcatgggccggtacagtggttatcgccacctggccggtattgttacgtttgcaaaagatcatgtttggtcgccgctctctcgccgttctggtgatgacgctgttattagtgatggtgtttatcatccctattgctttgctggttaacagtatcgtcgacggcagcggcccgctaattaaagccatttccagtggtgacatgacgttacccgatctggcgtggcttaataccattccggtgattggcgcgaagctatatgcaggctggcacaatttgctggatatgggggggacggcgatcatggcgaaagtccgtccttatattggcaccaccaccacctggttcgttgggcaggcggcgcatatcgggcgctttatggtgcattgtgcgctgatgcttctcttcagcgccctgctgtactggcgcggtgaacaggtggcacaaggcattcgccattttgcaacccgtctggcaggcgttcgcggagatgccgccgtgctgctggcggcacaggctatccgcgcggtggcgctgggtgtggtggtgacggcgttagtacaggcagtgcttggcggtatcggcctcgccgtatccggcgtaccttatgcaactttgctaacggtgttaatgatcctctcctgccttgtccagcttggaccgttgccggtactgattccggcgattatctggctctactggactggcgataccacctggggaacggtattgttagtttggagcggtgtggttggcacgctcgataacgtcatccgcccaatgttaattcgcatgggtgccgatttaccgctgatcctgatcctctctggcgttattggtggtttgattgctttcgggatgatcggtctgtttattggtccggttctgttagccgtttcctggcgtctgtttgccgcgtgggtggaagaagtcccaccgccgacggaccaaccggaagaaattctcgaagaacttggcgaaatcgagaaaccgaataagtaa

SEQ ID NO: 4138 - protein, 370 aa, Escherichia coli
MVNVRQPRDVAQILLSVLFLAIMIVACLWIVQPFILGFAWAGTVVIATWPVLLRLQKIMFGRRSLAVLVMTLLLVMVFIIPIALLVNSIVDGSGPLIKAISSGDMTLPDLAWLNTIPVIGAKLYAGWHNLLDMGGTAIMAKVRPYIGTTTTWFVGQAAHIGRFMVHCALMLLFSALLYWRGEQVAQGIRHFATRLAGVRGDAAVLLAAQAIRAVALGVVVTALVQAVLGGIGLAVSGVPYATLLTVLMILSCLVQLGPLPVLIPAIIWLYWTGDTTWGTVLLVWSGVVGTLDNVIRPMLIRMGADLPLILILSGVIGGLIAFGMIGLFIGPVLLAVSWRLFAAWVEEVPPPTDQPEEILEELGEIEKPNK

SEQ ID NO: 4139 - DNA, 384 bp, Escherichia coli
ttgtttatttcatgcagccattacacgatgaacgcttatgaactccaggcacttcgccatatttttgccatgactattgatgaatgcgcgacctggattgcccagaccggtaacagtgaaagctggcgtcagtgggaaaatggcaaatgcgccattcctgattgtgtagtcgagcaactgttggctatgcgtcagcaacgaaaaaaacatcttcatgccatcatagagaaaataaataaccgcatcggcaacaacaccatgcgttttttccccgacttaaccgcgtttcaacaagtctaccctgatggcaattttattgactggaagatctatcaatcggtagccgctgaattatatgcacacgatctggagcggctttgttaa

SEQ ID NO: 4140 - protein, 127 aa, Escherichia coli
MFISCSHYTMNAYELQALRHIFAMTIDECATWIAQTGNSESWRQWENGKCAIPDCVVEQLLAMRQQRKKHLHAIIEKINNRIGNNTMRFFPDLTAFQQVYPDGNFIDWKIYQSVAAELYAHDLERLC

SEQ ID NO: 4141 - DNA, 1215 bp, Escherichia coli
atgaaaaatccctattaccctaccgcacttgggttgtattttaattacctggtgcatggtatgggcgtcattttgatgagcctgaatatggcctcgctggagacgctttggcagactaatgccgcgggcgtctcgatagttatctcatcactgggcattggtcgattaagtgtcttgctttttgcaggattattatccgatcgctttggtcgccgcccttttatcatgctcgggatgtgctgctatatggccttcttttttggcatcctgcacaccaataacatcattatcgcttatgtttttggctttctggcgggaatggcaaacagttttctcgatgcaggcacctatcccagtttgatggaagcttttccacgctcaccgggtacagccaatattttaattaaagcatttgtttccagcggacaatttttattaccgctaattatcagcctgttagtgtgggctgaactgtggttcggttggtcctttatgattgccgcaggcattatgtttattaacgctctgtttttataccgttgtacgttcccaccccatccgggtcgtcacttacctgtcataaagaaaaccaccagctctacggaacatcgctgttcaattatcgatttagccagttattccctatatggctatatctcaatggcaacgttttatctggttagccagtggctggcacaatacggacaatttgtcgctggcatgtcatacaccatgtcgatcaaattactcagtatctacaccgtgggttcgctgctgtgtgtatttattactgctccactcattcgtaataccgttcgcccaacaacattactgatgctgtacacctttatctcatttatcgccctgctcaccgtctgcctgcatcccacattttatgtggtgataatatttgctttcgtcatcggttttacctccgcaggcggtgttgtacaaattggcctgacgttaatggcggaacgttttccctacgctaaaggaaaagcaacggggatctattacagtgcgggcagcattgcaacatttaccattccgttgattacggctcatctttcgcaaagaagtattgccgatattatgtggttcgataccgccatcgctgctatcggctttatactggcactgtttattggcttacgcagtcgcaaagaaacgcggcatcacacgctaaaggaaaatatcgctccgggtgggtaa

SEQ ID NO: 4142 - protein, 404 aa, Escherichia coli
MKNPYYPTALGLYFNYLVHGMGVILMSLNMASLETLWQTNAAGVSIVISSLGIGRLSVLLFAGLLSDRFGRRPFIMLGMCCYMAFFFGILHTNNIIIAYVFGFLAGMANSFLDAGTYPSLMEAFPRSPGTANILIKAFVSSGQFLLPLIISLLVWAELWFGWSFMIAAGIMFINALFLYRCTFPPHPGRHLPVIKKTTSSTEHRCSIIDLASYSLYGYISMATFYLVSQWLAQYGQFVAGMSYTMSIKLLSIYTVGSLLCVFITAPLIRNTVRPTTLLMLYTFISFIALLTVCLHPTFYVVIIFAFVIGFTSAGGVVQIGLTLMAERFPYAKGKATGIYYSAGSIATFTIPLITAHLSQRSIADIMWFDTAIAAIGFILALFIGLRSRKETRHHTLKENIAPGG

SEQ ID NO: 4143 - DNA, 1266 bp, Escherichia coli
atgtctcaaaataaggctttcagcacgccatttatcctggctgttctttgtatttacttcagctatttcctgcacggcattagtgttattacgcttgcccaaaacatgacatctttggcagaaaagttttccactgacaacgcgggcattgcctatttaatttccggtatcggattggggcgattgatcagtattttattcttcggagtgatctccgataagtttggtcgtcgggcggtgatattaatggcagtaataatgtatctgctattcttctttggtattcctgcttgcccgaatttaactctcgcctactgtctggcagtgtgcgtaggtatcgctaactcagcgctggatacgggtggctaccccgcgctcatggaatgctttccgaaagcctctggttcggcggtcatactggttaaagcgatggtgtcattcgggcaaatgttctacccaatgctggtgagctatatgttgctcaataacatctggtacggctatgggctgattattccgggtattctgtttgtactgatcacgctgatgctgttgaaaagcaaattccccagccagttggtggacgccagcgtagctaatgaattaccgcaaatgaacagcaaaccgttagtctggctggaaggtgtttcatcagtactgttcggtgtagccgcattctcgaccttttatgtgattgtggtgtggatgcccaaatatgcgatggcttttgctggtatgtcagaagctgaggcattaaaaaccatctcttattacagtatgggttcgctggtctgtgtctttatttttgccgcactgctgaaaaaaatggtccggcccatctgggctaatgtatttaactctgcactggcaacaataacagctgccattatctacctgtacccatctccattggtgtgtaatgccggagcctttgttatcggtttctcagcagctggcggcattttacagctcggcgtttcggtcatgtcagagtttttcccaaaaagcaaagccaaagtcaccagtatatatatgatgatgggtggactggctaactttgttattccgctgattaccggttatctgtcgaacatcggcctgcaatatatcattgttctcgattttactttcgcgctgctggccctgattaccgcaattattgtttttatccgctattaccgcgttttcattattcctgaaaatgatgtgcggtttggcgagcataaatttagcacccggttaaacacaattaagcatagaggttaa

SEQ ID NO: 4144 - protein, 421 aa, Escherichia coli
MSQNKAFSTPFILAVLCIYFSYFLHGISVITLAQNMTSLAEKFSTDNAGIAYLISGIGLGRLISILFFGVISDKFGRRAVILMAVIMYLLFFFGIPACPNLTLAYCLAVCVGIANSALDTGGYPALMECFPKASGSAVILVKAMVSFGQMFYPMLVSYMLLNNIWYGYGLIIPGILFVLITLMLLKSKFPSQLVDASVANELPQMNSKPLVWLEGVSSVLFGVAAFSTFYVIVVWMPKYAMAFAGMSEAEALKTISYYSMGSLVCVFIFAALLKKMVRPIWANVFNSALATITAAIIYLYPSPLVCNAGAFVIGFSAAGGILQLGVSVMSEFFPKSKAKVTSIYMMMGGLANFVIPLITGYLSNIGLQYIIVLDFTFALLALITAIIVFIRYYRVFIIPENDVRFGEHKFSTRLNTIKHRG

SEQ ID NO: 4145 - DNA, 867 bp, Escherichia coli
atggatgttaccgcaaaatacgaattgattgggttgatggcctatcccatccgccacagtttatcgcccgaaatgcagaataaagccttagaaaaagcgggattgccatttacctatatggcctttgaagtggataacgatagttttcccgcagcaattgaaggattaaaagccctcaaaatgcgcggaactggtgtatcaatgccgaacaaacaactggcgtgtgaatatgttgatgaattaacgccagcggccaaactggtgggagccatcaacaccatcgttaatgatgatggctatctgcgtggctataacaccgacggcacgggtcatattcgcgccattaaagagagcggttttgatatcaaaggcaaaacgatggtgctattaggggccggtggtgcctcaacggcaattggcgcgcagggggcaattgaaggtttaaaagaaattaaactctttaaccgtcgggatgagttcttcgataaagctctcgccttcgcgcagcgggttaacgaaaacaccgattgcgtcgtgacagtcaccgatctcgccgatcagcaagcctttgcagaagccctggcttccgccgacattttaaccaatggcaccaaagtgggtatgaaaccccttgagaatgaatcattggttaatgatatcagtctgttacatccgggacttctggtcactgaatgcgtgtataacccgcatatgacgaagttattgcagcaggcgcaacaagctggttgcaaaacgattgatggatacggcatgttgttgtggcaaggggctgaacagttcacgttatggactggcaaagatttccctctggaatatgttaaacaggtcatggggttcggtgcctga

SEQ ID NO: 4146 - protein, 288 aa, Escherichia coli
MDVTAKYELIGLMAYPIRHSLSPEMQNKALEKAGLPFTYMAFEVDNDSFPAAIEGLKALKMRGTGVSMPNKQLACEYVDELTPAAKLVGAINTIVNDDGYLRGYNTDGTGHIRAIKESGFDIKGKTMVLLGAGGASTAIGAQGAIEGLKEIKLFNRRDEFFDKALAFAQRVNENTDCVVTVTDLADQQAFAEALASADILTNGTKVGMKPLENESLVNDISLLHPGLLVTECVYNPHMTKLLQQAQQAGCKTIDGYGMLLWQGAEQFTLWTGKDFPLEYVKQVMGFGA

SEQ ID NO: 4147 - DNA, 759 bp, Escherichia coli
atgaaaaccgtaactgtaaaagatctcgtcattggtacgggcgcacctaaaatcatcgtctcgctgatggcgaaagatatcgccagcgtgaaatccgaagctctcgcctatcgtgaagcggactttgatattctggaatggcgtgtggaccactatgccgatctctccaatgtggagtctgtcatagcggcagccaaaattctccgtgaaaccatgccagaaaaaccgctgctgtttaccttccgcagtgccaaagaaggcggcgagcaggcgatttccaccgaggcttatattgcactcaatcgtgcagccatcgacagtggcctggttgatatgatcgatctggagttatttaccggcgatgatcaggttaaagaaaccgtcgcctacgcccacgcgcatgatgtgaaagttgtcatgtccaaccatgacttccataaaacgccggaagccgaagaaatcattgcccgtctgcgcaaaatgcagtccttcgacgccgatattcctaagattgcgctgatgccgcaaagtaccagcgatgtgctgacgttgcttgccgcgaccctggagatgcaggagcagtatgccgatcgtccaatcatcacgatgtcgatggcaaaaactggcgtaatttctcgtctggctggtgaagtatttggctcggcggcaacttttggtgcggtaaaaaaagcctctgcgccagggcaaatctcggtaaatgatttgcgtacggtattaactattttacatcaggcataa

SEQ ID NO: 4148 - protein, 252 aa, Escherichia coli
MKTVTVKDLVIGTGAPKIIVSLMAKDIASVKSEALAYREADFDILEWRVDHYADLSNVESVIAAAKILRETMPEKPLLFTFRSAKEGGEQAISTEAYIALNRAAIDSGLVDMIDLELFTGDDQVKETVAYAHAHDVKVVMSNHDFHKTPEAEEIIARLRKMQSFDADIPKIALMPQSTSDVLTLLAATLEMQEQYADRPIITMSMAKTGVISRLAGEVFGSAATFGAVKKASAPGQISVNDLRTVLTILHQA

SEQ ID NO: 4149 - DNA, 1596 bp, Escherichia coli
atgaaacctgtaaaaccacctcgtattaatggacgagtgccggtcctgtcggcacaggaagcggtgaattatattcccgacgaagcaacactttgtgtgttaggcgctggcggcggtattctggaagccaccacgttaattactgctcttgctgataaatataaacagactcaaacaccacgtaatttatcgattattagtccaacagggcttggcgatcgcgccgaccgtggtattagtccgctggcgcaagaaggtctggtgaaatgggcattatgcggtcactggggacaatcgccgcgtatttctgatctcgcagaacaaaataaaattattgcttataactatccacaaggtgtacttacacaaaccttacgcgccgccgcagcccaccagcctggtattattagtgatattggcatcgggacatttgtcgatccacgccagcaaggcggcaaactgaatgaagtcactaaagaagaactgattaaactggtcgagtttgataacaaagaatatctctattacaaagcgatagcgccagatatcgccttcattcgcgctaccacctgcgacagcgaaggctacgccacttttgaagatgaggtgatgtatctcgacgcattggttattgctcaggcggtgcacaataacggcggtattgtgatgatgcaggtgcagaaaatggttaagaaagccacgctgcatcctaaatctgtccgtattccgggttatctggtggatattgtggtggtcgatccggatcaaacccaactgtatggcggtgcaccggttaaccgctttatttctggtgacttcacccttgatgacagtaccaaacttagcctgcccctaaaccaacgtaaattagttgcacggcgtgcattattcgaaatgcgcaaaggcgcagtggggaatgtcggcgtcggtattgctgacggcattggcctggtcgcccgggaagaaggttgtgctgatgactttattctgacggtagaaacaggtccgattggcggtattacttcacaggggatcgcctttggcgcgaacgtgaatacccgcgccattctggatatgacgtcccagtttgatttttatcacggtggtggtctggatgtttgttatttgagttttgctgaagtcgaccagcacggtaacgtcggcgtgcataaattcaatggtaaaatcatgggcaccggtggatttattgatatcagtgccacttcgaagaaaatcgttttctgcggcacattaactgcgggcagtttaaaaacagaaattaccgacggcaaattaaatatcgtccaggaaggacgggtgaagaaatttattcgggaactaccggaaattactttcagtggaaaaatcgctctcaagcgagggctggatgttcgttatatcactgagcgcgccgtattcacgctaaaagaagacggcctgcatttaatcgaaatcgctcctggcgtcgatttacaaaaagatattctcgacaaaatggatttcaccccagtgctttcaccagaactgaaactgatggacgaaagattatttatcgatgcggcgatgggttttgtcctgcctgaagcggctcattaa

SEQ ID NO: 4150 - protein, 531 aa, Escherichia coli
MKPVKPPRINGRVPVLSAQEAVNYIPDEATLCVLGAGGGILEATTLITALADKYKQTQTPRNLSIISPTGLGDRADRGISPLAQEGLVKWALCGHWGQSPRISDLAEQNKIIAYNYPQGVLTQTLRAAAAHQPGIISDIGIGTFVDPRQQGGKLNEVTKEELIKLVEFDNKEYLYYKAIAPDIAFIRATTCDSEGYATFEDEVMYLDALVIAQAVHNNGGIVMMQVQKMVKKATLHPKSVRIPGYLVDIVVVDPDQTQLYGGAPVNRFISGDFTLDDSTKLSLPLNQRKLVARRALFEMRKGAVGNVGVGIADGIGLVAREEGCADDFILTVETGPIGGITSQGIAFGANVNTRAILDMTSQFDFYHGGGLDVCYLSFAEVDQHGNVGVHKFNGKIMGTGGFIDISATSKKIVFCGTLTAGSLKTEITDGKLNIVQEGRVKKFIRELPEITFSGKIALKRGLDVRYITERAVFTLKEDGLHLIEIAPGVDLQKDILDKMDFTPVLSPELKLMDERLFIDAAMGFVLPEAAH

SEQ ID NO: 4151 - DNA, 1152 bp, Escherichia coli
atggatttctctttaactgaagaacaagaactgctgctggccagtattcgtgaactgattacgactaactttccggaagagtatttccgcacctgcgatcaaaacgggacatacccgcgtgagtttatgcgggcactggcggataacggtatttccatgcttggcgtgccggaagaatttggtggtatccctgcggattacgtcacccaaatgctggcgctgatggaagtgtcaaaatgcggtgctccggcatttttgattaccaacggtcaatgtattcacagtatgcgccgtttcggttctgcagagcagctacgtaaaacggcagagagcaccctggaaacgggtgatcccgcctatgccctggcattgacggagccaggcgcaggctcagacaacaacagtgccactaccacttacacgcgtaaaaacggcaaggtttacatcaacggacagaaaacctttattaccggtgcgaaagagtacccatatatgctggtgttggcgcgcgatccgcaaccgaaagatccgaaaaaggcctttacgctgtggtgggtcgactccagtaagcccggcattaaaatcaatccactgcataaaatcggctggcatatgctcagcacctgcgaagtctatctcgacaacgtggaagttgaagagagcgacatggtgggcgaagaaggaatgggtttcctcaatgtgatgtacaactttgagatggagcgcctgatcaacgccgcgcgcagcaccggctttgccgaatgcgcattcgaagatgccgcccgctatgccaaccagcgtatcgcttttggtaagcccattggtcataaccagatgatccaggaaaaactggcgctgatggcgattaagatcgacaacatgcgcaacatggtgttgaaagtggcatggcaagccgatcagcatcagtcactgcgcaccagcgcggcgctggcaaaactgtactgcgcacgtaccgcaatggaagtcattgatgatgcgattcaaatcatgggcggtctgggctataccgatgaggcgcgcgtctcccgcttctggcgtgatgtccgttgtgaacgtatcggcggcggtacagacgaaattatgatttacgtagcaggtcggcagatcctgaaagattatcagaacaaataa

SEQ ID NO: 4152 - protein, 383 aa, Escherichia coli
MDFSLTEEQELLLASIRELITTNFPEEYFRTCDQNGTYPREFMRALADNGISMLGVPEEFGGIPADYVTQMLALMEVSKCGAPAFLITNGQCIHSMRRFGSAEQLRKTAESTLETGDPAYALALTEPGAGSDNNSATTTYTRKNGKVYINGQKTFITGAKEYPYMLVLARDPQPKDPKKAFTLWWVDSSKPGIKINPLHKIGWHMLSTCEVYLDNVEVEESDMVGEEGMGFLNVMYNFEMERLINAARSTGFAECAFEDAARYANQRIAFGKPIGHNQMIQEKLALMAIKIDNMRNMVLKVAWQADQHQSLRTSAALAKLYCARTAMEVIDDAIQIMGGLGYTDEARVSRFWRDVRCERIGGGTDEIMIYVAGRQILKDYQNK

SEQ ID NO: 4153 - DNA, 912 bp, Escherichia coli
atgtatcaacgctgttttgataatgccagtgaaacgctgtttgtcgccggtaaaacgccacggctttcacgtttcgcatttagcgatgatccaaaatgggagtctggacatcacgttcatgacaatgaaaccgagctgatttacgtcaagaaaggggtagcaaggtttaccatcgattcttcgttatatgtcgcgcatgccgatgacattgtggtgatagaacgtggcaggctgcatgcggtggcctctgacgttaacgatccggcaacgacgtgtacctgtgcgctgtacggctttcagtttcagggggttgaggaaaatcagctactgcaaccgcattcttgcccggtaattgccgcagggcagggaaaagaagtcattaaaaccttatttaatgagctaagtgtgattttgccgcaaagtaaaaatagccaaacatcttcgttatgggacgcatttgcctatacgttagcaattctttactacgaaaactttaaaaatgcttatcgttcggagcagggatatattaaaaaagatgttctgataaaagatattcttttctatctgaataataactatcgcgaaaaaatcactttagagcagttatcgaaaaaatttcgtgccagcgtcagttatatctgccatgaatttaccaaagagtatcgtatttcccctattaactatgttattcaacggcgtatgacggaagcgaaatggtcactcactaatactgaattatcacaggcagagatttcctggcgtgtgggttatgaaaatgtcgatcactttgccaaactgtttttgcgccatgtcggctgttcgcccagcgattaccgcaggcaatttaaaaactgttttgcggaacaagaaatcctatctgaatttcctcaaccggtaagtcttgccggataa

SEQ ID NO: 4154 - protein, 303 aa, Escherichia coli
MYQRCFDNASETLFVAGKTPRLSRFAFSDDPKWESGHHVHDNETELIYVKKGVARFTIDSSLYVAHADDIVVIERGRLHAVASDVNDPATTCTCALYGFQFQGVEENQLLQPHSCPVIAAGQGKEVIKTLFNELSVILPQSKNSQTSSLWDAFAYTLAILYYENFKNAYRSEQGYIKKDVLIKDILFYLNNNYREKITLEQLSKKFRASVSYICHEFTKEYRISPINYVIQRRMTEAKWSLTNTELSQAEISWRVGYENVDHFAKLFLRHVGCSPSDYRRQFKNCFAEQEILSEFPQPVSLAG

SEQ ID NO: 4155 - DNA, 765 bp, Escherichia coli
atgaaaataataacctgctttaagctggtgcctgaagaacaggacattgttgtcactccagaatacaccctgaatttcgacaatgccgacgccaaaatcagccagttcgatctcaatgccattgaagttgcaagccagcttgcaacagatgacgatgagatagccgcgctgaccgtcggcggctctttgttgcagaactcgaaagtgcgcaaagacgtgctatcccgcgggccgcacagcctgtatatggtgcaggatgcacaacttgagcatgcactgcctctcgataccgcaaaggcgctggcgacagcagttgaaaagatcggcttcgatttactgatctttggtgaaggttccggcgacctttatgcccagcaggttggcttgctggtcggagaacttctgcaacttccggtgattaatgcagtgagtgctattcagcgtcagggcaatacactggtgattgaacgcacgcttgaagatgatgttgaagttattgaactctctgttccagccgtgctctgcgtcacctccgatattaacgtaccacgtattccttcgatgaaagccatcctcggcgcgggtaaaaaaccggtaaatcagtggcaggcaagtgatattggctggagccagagcgcaccacttgctgaactgaccggtattcgcgtaccgccgcaaacagaacgtaagcacatcattctcgataacgattcgccggaggccattgccgagctggcggaacatctgaaaaaagccctgaactga

SEQ ID NO: 4156 - protein, 254 aa, Escherichia coli
MKIITCFKLVPEEQDIVVTPEYTLNFDNADAKISQFDLNAIEVASQLATDDDEIAALTVGGSLLQNSKVRKDVLSRGPHSLYMVQDAQLEHALPLDTAKALATAVEKIGFDLLIFGEGSGDLYAQQVGLLVGELLQLPVINAVSAIQRQGNTLVIERTLEDDVEVIELSVPAVLCVTSDINVPRIPSMKAILGAGKKPVNQWQASDIGWSQSAPLAELTGIRVPPQTERKHIILDNDSPEAIAELAEHLKKALN

SEQ ID NO: 4157 - DNA, 939 bp, Escherichia coli
atgagtcaattaaacagcgtctgggtctttagcgataatcctgaacattatgctgaactgtttggcggcgctcagcaatggggccaacaggtgtatgccattgtacaaaataccgagcaggcgcaggcggttatgccttatgggccaaaatgcatttatgttcttgagcaaaacgacgcgctgcaacgtactgaaaattacgccgaaagcattgctgccctgctgaaagataaacaccccgctatgttgctgttggccgcgacgaaacgtggtaaagctctggccgcacggttaagtgtgcaactgaatgcggcgctggtgaacgatgccacggcggtggatattgtcgatggtcacatttgcgccgaacaccggatgtatggcgggttagcgttcgctcaggaaaagatcaacagcccgctggcgatcattacccttgcacccggtgttcaggagccgtgcacccgtgatatctctcatcagtgcccgacagaaacggtaccttatgttgccccgcgtcatgaaattctctgtcgcgaacgccgtgcgaaagcggcaagcagcgtggacctgagcaaagcaaaacgtgtggttggcgtcggtcgtggtctggcggcgcaggatgacctgaaaatggtccacgaactggcggcagtgctgaatgctgaagtcggctgttcacgtccaattgccgaaggcgagaactggatggagcgtgaacgttatatcggtgtctccggcgtgttgctgaaatccgatctctacctgacgctggggatctccgggcagatccagcatatggttggcggcaacggcgcaaaagtgattgtcgccattaataaagataaaaatgcgccaatcttcaactatgccgactacggtctggtgggcgatatctacaaagtcgtccctgccctgattagccagttgaatcgctaa

SEQ ID NO: 4158 - protein, 312 aa, Escherichia coli
MSQLNSVWVFSDNPEHYAELFGGAQQWGQQVYAIVQNTEQAQAVMPYGPKCIYVLEQNDALQRTENYAESIAALLKDKHPAMLLLAATKRGKALAARLSVQLNAALVNDATAVDIVDGHICAEHRMYGGLAFAQEKINSPLAIITLAPGVQEPCTRDISHQCPTETVPYVAPRHEILCRERRAKAASSVDLSKAKRVVGVGRGLAAQDDLKMVHELAAVLNAEVGCSRPIAEGENWMERERYIGVSGVLLKSDLYLTLGISGQIQHMVGGNGAKVIVAINKDKNAPIFNYADYGLVGDIYKVVPALISQLNR

SEQ ID NO: 4159 - DNA, 1290 bp, Escherichia coli
atgtcggatgacaaatttgatgccattgtggtcggtgcgggcgttgccggtagcgttgccgcactggtcatggcgcgagccgggctggatgtcctggtgatagaacgcggcgacagtgccggatgtaaaaacatgaccggcgggcgtctttatgcccacacactcgaagcaattattccaggctttgcagcatcagcgccgatagaacgcaaggtcacacgcgagaaaatctccttcttaaccgaagaaagcgccgttaccctcgattttcaccgcgagcaaccagatgttccgcaacacgcgtcttataccgtattgcgtaatcgtctggacccgtggttgatggaacaagccgagcaggcgggcgcgcagtttatcccgggcgtacgcgtcgatgcgctggttcgtgaaggaaacaaggtcactggcgtccaggccggggatgatattctcgaagcgaatgtggtgattctggctgatggcgttaactcgatgcttggccgctcgctgggaatggtttccgcttccgatccgcatcattacgctgttggtgttaaagaggttataggcctgacaccagaacagatcaacgatcgctttaatgttacgggcgaggaaggtgccgcctggctgtttgccggttccccttctgacggcctgatgggcggcggattcctctataccaacaaggattccgtatcgttggggctggtttgtggattgagtgatatcgcccatgcgcaaaaaagcgtgccgcaaatgctggaagattttaaacaacaccccgccattcgcccgctgattagcggcggcaaactgcttgaatattccgcgcatatggtgccggagggcggtctggcaatggtgccgcagctggttaacgatggcgtgatgatcgttggtgacgccgcaggcttctgcctgaatttgggttttacagttcgcggcatggatttagccattgcatcagctcaggctgccgccacaacggtgatcgccgccaaagaacgcgcggatttctccgccagcagtctggcgcaatacaaacgtgagctggaacaaagttgtgttatgcgcgatatgcagcatttccgcaagatcccggcgctgatggaaaacccgcgcctgtttagccaatacccacgaatggtcgccgacatcatgaacgatatgttcaccattgacggcaaaccaaaccagccggtacgcaaaatgatcatgggacacgcgaagaaaattgggctgatcaacttgctgaaagatggcattaagggagcaaccgcgctatga

SEQ ID NO: 4160 - protein, 429 aa, Escherichia coli
MSDDKFDAIVVGAGVAGSVAALVMARAGLDVLVIERGDSAGCKNMTGGRLYAHTLEAIIPGFAASAPIERKVTREKISFLTEESAVTLDFHREQPDVPQHASYTVLRNRLDPWLMEQAEQAGAQFIPGVRVDALVREGNKVTGVQAGDDILEANVVILADGVNSMLGRSLGMVSASDPHHYAVGVKEVIGLTPEQINDRFNVTGEEGAAWLFAGSPSDGLMGGGFLYTNKDSVSLGLVCGLSDIAHAQKSVPQMLEDFKQHPAIRPLISGGKLLEYSAHMVPEGGLAMVPQLVNDGVMIVGDAAGFCLNLGFTVRGMDLAIASAQAAATTVIAAKERADFSASSLAQYKRELEQSCVMRDMQHFRKIPALMENPRLFSQYPRMVADIMNDMFTIDGKPNQPVRKMIMGHAKKIGLINLLKDGIKGATAL

SEQ ID NO: 4161 - DNA, 294 bp, Escherichia coli
atgagccagaacgctacggttaacgtcgacatcaaattaggcgtcaataaattccatgttgatgagggccacccgcatatcattttggcggcaaatcccgatatcaatgaattccgtaaattaatgaaagcttgccctgccggactttataagcaggatgacgcaggaaacattcatttcgattccgccggttgtctggagtgcggcacctgtcgggtgctgtgcggcaacactattctcgaacagtggcaatatcccgcaggcaccttcggtattgaatttcgctacggctaa

SEQ ID NO: 4162 - protein, 97 aa, Escherichia coli
MSQNATVNVDIKLGVNKFHVDEGHPHIILAANPDINEFRKLMKACPAGLYKQDDAGNIHFDSAGCLECGTCRVLCGNTILEQWQYPAGTFGIEFRYG

SEQ ID NO: 4163 - DNA, 1701 bp, Escherichia coli
atgcatcccacaggcccgcatctcgggcctgatgttctgtttcgagagtccaaaatgaaagtgacattaacgttcaacgaacaacgtcgtgcggcgtatcgtcagcaagggttatggggcgatgcttcgctggccgattactggcagcagaccgctcgtgcgatgccagacaaaattgccgtggtcgacaatcatggtgcaacgtacacctatagcgcgctcgatcacgccgcgagctgtctggcaaactggatgttagcgaagggtattgaatcaggcgatcgcatcgcatttcaactgccaggctggtgtgaatttaccgttatctatcttgcctgcctgaaaaccggtgcggtttccgtgccgctgttaccttcctggcgggaagcagaactggtatgggtgctcaataagtgtcaggcaaaaatgttctttgcaccgacgttgtttaaacaaacgcgtccagtagatttaatcctgccgctgcaaaatcagcttccacaactacaacaaattgtcggcgtggacaaactggctcccgccacctcttccctctcattaagtcagattctcgccgacaatacccctctgaccacggcgataacgacccacggcgatgaattagccgctgtgctatttacctccggaaccgagggtctgccaaagggtgtgatgctaacgcataacaatattctcgccagtgagcgggcttattgcgcgcggctaaatctgacctggcaggatgtctttatgatgcctgcgccacttggtcacgcaacgggctttctgcatggcgtaacagcaccttttttgattggtgctcgcagcgtgttgttagatattttcactcctgatgcgtgtctcgcgctgcttgagcagcagcgttgcacctgtatgctcggcgcaacgccgtttgtctatgatcttttgaatttactagagaaacaacccgcagacctttcagcgctgcgcttctttctttgcggaggtaccacaatccccaaaaaagtggcgcgagaatgccagcagcgcggcattaaattattaagtgtttatggttccacagaaagttcgccgcatgcggtggtgaatctcgacgatcctttgccgcgctttatgcacaccgacggttacgctgccgcaggtgtagagattaaagtggtcgatgacgcacgcaagactttaccgccaggttgcgaaggtgaagaagcctcgcgtggccccaatgtgtttatggggtattttgatgaacctgaattaaccgcccgtgcgctggatgaagaaggctggtattacagcggcgatctctgccgcatggatgaggctggctatataaaaataaccgggcgcaagaaagatattattgtccgcggcggcgaaaatattagcagccgtgaagtagaagatattttattgcagcatcctaaaattcacgatgcctgtgtggttgcgatgcccgatgaacgtttaggtgaacgttcatgcgcttatgtcgtgctgaaagcgccgcatcattcattatcgctggaagaggtggtggctttttttagccgtaaacgggtcgcgaaatataaatatcctgaacatatcgtggtaatcgaaaaactaccgcgcactgtctcaggtaaaatacaaaagtttttgttaaggaaagatattatgcggcgattaactcaggatgtctgtgaagagattgaataa

SEQ ID NO: 4164 - protein, 566 aa, Escherichia coli
MHPTGPHLGPDVLFRESKMKVTLTFNEQRRAAYRQQGLWGDASLADYWQQTARAMPDKIAVVDNHGATYTYSALDHAASCLANWMLAKGIESGDRIAFQLPGWCEFTVIYLACLKTGAVSVPLLPSWREAELVWVLNKCQAKMFFAPTLFKQTRPVDLILPLQNQLPQLQQIVGVDKLAPATSSLSLSQILADNTPLTTAITTHGDELAAVLFTSGTEGLPKGVMLTHNNILASERAYCARLNLTWQDVFMMPAPLGHATGFLHGVTAPFLIGARSVLLDIFTPDACLALLEQQRCTCMLGATPFVYDLLNLLEKQPADLSALRFFLCGGTTIPKKVARECQQRGIKLLSVYGSTESSPHAVVNLDDPLPRFMHTDGYAAAGVEIKVVDDARKTLPPGCEGEEASRGPNVFMGYFDEPELTARALDEEGWYYSGDLCRMDEAGYIKITGRKKDIIVRGGENISSREVEDILLQHPKIHDACVVAMPDERLGERSCAYVVLKAPHHSLSLEEVVAFFSRKRVAKYKYPEHIVVIEKLPRTVSGKIQKFLLRKDIMRRLTQDVCEEIE

SEQ ID NO: 4165 - DNA, 2379 bp, Escherichia coli
atgtccaacaatggctcgtcaccgctggtgctttggtataaccaactcggcatgaatgatgtagacagggttgggggcaaaaatgcctccctgggtgaaatgattactaacctttccggaatgggtgtttccgttccgaatggtttcgccacaaccgccgacgcgtttaaccagtttctggaccaaagcggcgtaaaccagcgcatttatgaactgctggataaaacggatattgacgatgttacccagcttgcgaaagcgggcgcgcaaatccgccagtggattatcgacactcccttccagcctgagctggaaaacgccatccgcgaagcctatggacagctttccgccgatgacgaaaacgcttcgtttgcggtgcgttcctccgctactgcagaagatatgccggacgcttcttttgccggtcagcaggaaactttcctcaacgttcagggttttgacgccgttctcgtggcagtgaagcatgtatttgcttctctgtttaacgatcgcgccatctcttatcgtgtgcaccagggttacgaccatcgtggcgtagcgctctccgccggtgttcagcggatggtgcgctccgacctcgcatcttctggcgtgatgttctccattgataccgaatccggctttgaccaggtggtgtttatcacttccgcatggggccttggtgaaatggtcgtgcagggtgcggttaatccggatgagttttatgtgcataaacagacacttgcggcgaatcgcccggctatcgtgcgccgcaccatggggtcgaaaaaaatccgcatggtttacgcgccgacccaggagcacggcaagcaggttaaaatcgaagacgtaccgcaggaacagcgtgacatcttctcgctgaccaacgaagaagtgcaggaactggcaaaacaggccgtacaaattgagaaacactacggtcgcccgatggatattgagtgggcgaaagatggccacaccggcaaactgttcattgtgcaggcgcgtccggaaaccgtgcgctcacgcggtcaggtcatggagcgttatacgctgcattcacagggtaagattatcgccgaaggccgtgctatcggtcatcgcatcggcgcgggtccggtgaaagtcatccatgacatcagcgaaatgaaccgcatcgaacctggcgacgtgctggttactgacatgaccgacccggactgggaaccgatcatgaagaaagcatctgccatcgtcaccaaccgtggcggtcgtacctgtcacgcggcgatcatcgctcgtgaactcggcattccggcggtagtgggctgtggtgatgcaacagaacggatgaaagacggcgagaacgtcactgtttcttgtgccgaaggtgataccggttacgtctatgcggagttgctggaatttagcgtgaaaagctccagcgtagaaacgatgccggacctgccgttgaaggtgatgatgaacgtcggtaacccggaccgtgctttcgacttcgcctgcctgccgaacgaaggcgtgggccttgcgcgtctggaatttatcatcaaccgtatgattggcgtccacccacgcgcactgcttgagtttgacgatcaggaaccgcagttgcaaaacgaaatccgcgagatgatgaaaggttttgattctccgcgtgaattttacgttggtcgtctgactgaagggatcgcgacgctgggtgccgcgttttatccgaagcgcgtcattgtccgtctttctgattttaaatcgaacgaatatgccaatctggtcggtggtgagcgttacgagccagatgaagagaacccgatgctcggcttccgtggcgcgggccgctatgtttccgacagcttccgcgactgcttcgcgctggagtgtgaagcagtgaaacgtgtgcgcaacgacatggggctgactaacgttgagatcatgatcccgttcgtgcgtaccgttgatcaggcgaaagcggtggttgaggaactggcgcgtcaggggctgaaacgtggtgagaacgggctgaaaatcatcatgatgtgtgaaatcccgtccaacgccttgctggcagagcagttcctggaatatttcgacggcttctcaattggctcaaacgacatgacgcagctggcgctcggtctggatcgtgactccggcgtggtgtctgaactgttcgatgagcgcaacgatgcggtgaaagcactgctgtcgatggcgattcgtgccgcgaagaaacagggcaaatatgtcgggatttgcggtcagggtccatccgaccacgaagactttgctgcatggttgatggaagaggggatcgatagcctgtctctgaacccggacaccgtggtgcaaacctggttaagcctggctgaactgaagaaataa

SEQ ID NO: 4166 - protein, 792 aa, Escherichia coli
MSNNGSSPLVLWYNQLGMNDVDRVGGKNASLGEMITNLSGMGVSVPNGFATTADAFNQFLDQSGVNQRIYELLDKTDIDDVTQLAKAGAQIRQWIIDTPFQPELENAIREAYGQLSADDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKQTLAANRPAIVRRTMGSKKIRMVYAPTQEHGKQVKIEDVPQEQRDIFSLTNEEVQELAKQAVQIEKHYGRPMDIEWAKDGHTGKLFIVQARPETVRSRGQVMERYTLHSQGKIIAEGRAIGHRIGAGPVKVIHDISEMNRIEPGDVLVTDMTDPDWEPIMKKASAIVTNRGGRTCHAAIIARELGIPAVVGCGDATERMKDGENVTVSCAEGDTGYVYAELLEFSVKSSSVETMPDLPLKVMMNVGNPDRAFDFACLPNEGVGLARLEFIINRMIGVHPRALLEFDDQEPQLQNEIREMMKGFDSPREFYVGRLTEGIATLGAAFYPKRVIVRLSDFKSNEYANLVGGERYEPDEENPMLGFRGAGRYVSDSFRDCFALECEAVKRVRNDMGLTNVEIMIPFVRTVDQAKAVVEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 4167 - DNA, 834 bp, Escherichia coli
atggataatgctgttgatcgccacgttttttatatttctgatggtacggcaataactgcggaggtattaggacacgcagtaatgtcacaatttcccgtcactatcagcagcattacgctgccgtttgtcgaaaatgagagccgtgcacgggcagtgaaggatcagattgacgcaatttatcaccagacaggtgtgcgcccgctggtcttctactccatcgtgttgccggagattcgcgctatcatcttgcaaagtgaaggcttttgccaggatatcgttcaggcgctggttgccccgctacaacaagagatgaaactggatccaacgccgattgctcatcgtacccatggccttaaccctaataatctcaataaatatgatgcgcgcattgcggcgattgattacacccttgcccacgatgacggtatttcgttgcgcaatctggaccaggctcaggtgatcctgctcggtgtttctcgctgtggtaaaacccccaccagtctgtatctggcaatgcaatttggtatccgcgcggcaaattacccctttattgccgacgatatggataatctggtgctgcccgcgtcgctcaaaccacttcagcacaaattgttcggcctgactatcgacccggaacgtctggcggcgattcgcgaggaacgtcgggagaacagccgctatgcctcgcttcgtcagtgcaggatggaagtcgcggaagtggaagcgttgtaccgtaaaaatcagatcccgtggattaacagtaccaattattcggtagaagagattgccaccaagatcctcgatatcatgggccttagccgccgaatgtactag

SEQ ID NO: 4168 - protein, 277 aa, Escherichia coli
MDNAVDRHVFYISDGTAITAEVLGHAVMSQFPVTISSITLPFVENESRARAVKDQIDAIYHQTGVRPLVFYSIVLPEIRAIILQSEGFCQDIVQALVAPLQQEMKLDPTPIAHRTHGLNPNNLNKYDARIAAIDYTLAHDDGISLRNLDQAQVILLGVSRCGKTPTSLYLAMQFGIRAANYPFIADDMDNLVLPASLKPLQHKLFGLTIDPERLAAIREERRENSRYASLRQCRMEVAEVEALYRKNQIPWINSTNYSVEEIATKILDIMGLSRRMY

SEQ ID NO: 4169 - DNA, 1047 bp, Escherichia coli
atgaacagaactgacgaactccgtactgcgcgtattgagagcctggtaacgcccgccgaactcgcgctacggtatcccgtaacgcctggcgtcgccacccatgtcaccgactcccgccgtagaattgaaaaaatactgaatggtgaagataagcgactgttggtcattattggcccctgctcgatccacgatctcaccgctgcgatggagtacgccacccgtctgcagtcgctgcgcaaccagtaccagtcacggctggaaatcgtaatgcgcacctattttgaaaaaccacgaacggttgtcggctggaaaggactcatctccgatccagatttaaacggtagctatcgggtaaatcacggtctggagctggcgcgcaaattacttttacaggtaaatgagctgggcgtccctaccgcgactgagttcctcgatatggtgaccggtcagtttattgctgatttaatcagttggggcgcgattggcgcacgtactaccgaaagtcagatccaccgcgaaatggcttcggcactctcctgtccggtgggttttaaaaatggtaccgatggcaacacgcggattgccgtggatgctatccgcgcagcccgcgccagccatatgttcctctcgccagacaaaaatggtcagatgaccatctatcagaccagcggcaacccgtatggccacattattatgcgtggtggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcggtcagccgctcacttacggtcaatccattaccgacccgtgtctgggctgggaagataccgaacgcctggtcgaaaaactcgcctctgcggtagatactcgcttctga

SEQ ID NO: 4170 - protein, 348 aa, Escherichia coli
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRVNHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTAIAGIMAESFLREGTQKIVGGQPLTYGQSITDPCLGWEDTERLVEKLASAVDTRF

SEQ ID NO: 4171 - DNA, 219 bp, Escherichia coli
ttgttatataaattattattaatttttatgcgttatacggatagcagaaaactcacgcctgaaacggatgccagtcacaagaccgcttccccgcagcccatccggcgaattaccagccagacactgttaggtccggatggcaaactgattatcgatcatgacgggcaagaatatctgctccgtaaaactcaggctggcaagctgctgttgaccaagtag

SEQ ID NO: 4172 - protein, 72 aa, Escherichia coli
MLYKLLLIFMRYTDSRKLTPETDASHKTASPQPIRRITSQTLLGPDGKLIIDHDGQEYLLRKTQAGKLLLTK

SEQ ID NO: 4173 - DNA, 1437 bp, Escherichia coli
atgaccctgtcttttattacccgctggcgcgatgaattgccagaaacctatacagcactttcccctacgcctttaaataatgcccggctgatttggcataataccgaactggctaacacgctgagtattccatcgtcgctgtttaaaaatggcgcaggtgtctggggcggcgaaaacctactgccgggtatgtcaccacttgcgcaggtttacagtggtcatcagtttggcgtctgggcgggccaactgggtgatgggcgcggcattttactcggcgaacaactgcttgctgatggcactacaatggactggcatctgaaaggtgctggcctgacgccttattcgcgaatgggggatggacgggcggttttacgttcgacgatacgagaaagtctcgccagtgaggcgatgcattatctgggcattccgacgacccgcgctttaagtatcgtcaccagcgattcgccagtgtatcgggaaacggtggagtcaggcgcgatgctgatgcgtgtggcaccaagtcatctgcgctttggtcatttcgaacatttttactatcgccgcgagccggaaaaggttcgtcagttagctgactttgccattcgtcattactggtcacatcttgatgatgaggaggacaaataccgtctctggtttaccgatgttgtcgcacgtaccgcctcgttaattgcccaatggcagacggtcggctttgctcatggggtgatgaataccgacaacatgtcgctgctggggctgacgcttgattacgggccgtttggttttcttgatgattacgaacccggttttatttgtaatcactcggatcatcaagggcgttacagctttgataatcaacctgccgtcgcgttgtggaatttacagcgtctggcgcagacattgtcaccatttgttgccgttgatgcgctgaatgaggccctggacagctatcagcaggttttgttgacgcattatggacaacggatgcggcagaaactgggcttcatgacggagcaaaaagaggataacgcgctacttaatgaattattcagtctgatggcgcgagagcgcagcgattatacccgcacattccgcatgctgagtctgaccgagcagcacagcgcggcgtcaccgctacgtgatgagtttattgatcgtgcggcatttgatgactggtttgcccgttatcgggggcgtttgcaacaagacgagattaccgatagtgagcgtcagcaactgatgcaaagcgttaacccggctctggtgttgcgcaactggttggcgcaacgggcgattgaagcggcagaaaaggatgatatgacggaattgcaccgcctgcatgaggcgttgcgaaatcctttcagcgacagagatgatgactatgtcagtcgtccacccgactggggtaaacggctggaagtcagctgctcgagttaa

SEQ ID NO: 4174 - protein, 478 aa, Escherichia coli
MTLSFITRWRDELPETYTALSPTPLNNARLIWHNTELANTLSIPSSLFKNGAGVWGGENLLPGMSPLAQVYSGHQFGVWAGQLGDGRGILLGEQLLADGTTMDWHLKGAGLTPYSRMGDGRAVLRSTIRESLASEAMHYLGIPTTRALSIVTSDSPVYRETVESGAMLMRVAPSHLRFGHFEHFYYRREPEKVRQLADFAIRHYWSHLDDEEDKYRLWFTDVVARTASLIAQWQTVGFAHGVMNTDNMSLLGLTLDYGPFGFLDDYEPGFICNHSDHQGRYSFDNQPAVALWNLQRLAQTLSPFVAVDALNEALDSYQQVLLTHYGQRMRQKLGFMTEQKEDNALLNELFSLMARERSDYTRTFRMLSLTEQHSAASPLRDEFIDRAAFDDWFARYRGRLQQDEITDSERQQLMQSVNPALVLRNWLAQRAIEAAEKDDMTELHRLHEALRNPFSDRDDDYVSRPPDWGKRLEVSCSS

SEQ ID NO: 4175 - DNA, 714 bp, Escherichia coli
atgaagatttttttggagaatctttatcattctgattgctatttcctgccgataagagataaccagcaagaccttgtcggcgttgagttaattacccatttctccagtgaagatggtacggttcgtatcccgacgagtcgggttatagcgcaacttaccgaggagcaacattggcaattattttcagagcagttggaattactaaaatcatgccaacacttttttattcaacataaactctttgcctggcttaatttaacgccacacgtggctacattattattagacagggataatttcgcaggcgaactattaaaatatccgtttattgaactgttgattaatgagaattacccgcatttcaatgaaggaaaagataatcgcgatcttttatccttatcgcaaatgtatccccttgtgttaggtaatttgggagcaggtaatagcacaatgaaagcggtttttgatggtcttttcacccgcgtcatgctggataaaagttttattcagcaacaaatcacgcatcgttccttcgaaccgtttattcgtgcgatccaggcgcaaatttccccttgttgcaattgcatcatcgcggggggcattgatacgccagaaatattggcacagattatcccctttgatttccatgctctccagggatgcctgtggcctgcggttcctataaatcagataacgacgttggttcagcgataa

SEQ ID NO: 4176 - protein, 237 aa, Escherichia coli
MKIFLENLYHSDCYFLPIRDNQQDLVGVELITHFSSEDGTVRIPTSRVIAQLTEEQHWQLFSEQLELLKSCQHFFIQHKLFAWLNLTPHVATLLLDRDNFAGELLKYPFIELLINENYPHFNEGKDNRDLLSLSQMYPLVLGNLGAGNSTMKAVFDGLFTRVMLDKSFIQQQITHRSFEPFIRAIQAQISPCCNCIIAGGIDTPEILAQIIPFDFHALQGCLWPAVPINQITTLVQR

SEQ ID NO: 4177 - DNA, 465 bp, Escherichia coli
atgcgtttctgccttattttgatcacagcactgtttctggccgggtgtagccaccataaagcaccgccgccaaatgccagactttctgattcgatcaccgttattgccggtttgaacgaccagctacaaagctggcatggcacgccgtatcgttatggtggcatgacgcggcgcggtgtggactgttcgggatttgtggttgtgacgatgcgtgatcgtttcgatttgcagctgccccgtgaaaccaaacaacaagccgctattggcacgcaaattgataaagacgagttgctgccaggtgacctggtctttttcaaaacgggttccggacaaaatggtttgcatgtaggtatttacgataccaacaaccaatttatccacgcctctaccagcaagggagtgatgcgttcctcacttgataatgtctattggcagaaaaatttctggcaggcgagacgaatctag

SEQ ID NO: 4178 - protein, 154 aa, Escherichia coli
MRFCLILITALFLAGCSHHKAPPPNARLSDSITVIAGLNDQLQSWHGTPYRYGGMTRRGVDCSGFVVVTMRDRFDLQLPRETKQQAAIGTQIDKDELLPGDLVFFKTGSGQNGLHVGIYDTNNQFIHASTSKGVMRSSLDNVYWQKNFWQARRI

SEQ ID NO: 4179 - DNA, 750 bp, Escherichia coli
atgtctattgtgatgcagttacaggatgttgcggaatctacccgcctggggccgctttctggcgaggttcgggctggggagatcctgcacctggtggggccgaatggcgcgggtaagagtaccttactggcgcgaatggccggaatgaccagcggtaagggaagcattcagttcgcggggcaaccactggaagcatggtctgcaacaaagctcgcgctgcatcgcgcctatctttcacaacagcagacgccgccgtttgcaatgccggtctggcactacctgacactgcatcagcacgataaaacgcgtaccgaactactgaatgatgtcgcaggggcgctggctcttgatgacaaactcggacgtagcaccaatcaactttccggcggtgaatggcaacgcgtacgtcttgctgcggtggtgctgcaaatcacaccacaagccaatcccgcaggccaattgctgcttcttgatgagccgatgaacagtcttgatgttgcgcaacaaagtgccttagacaaaattctgagcgcgctgtgtcagcaaggactggcgattgtgatgagcagtcacgatctcaaccacacattgcgtcatgcgcatcgggcgtggttgctaaaaggtggaaaaatgctggccagtggacgcagagaagaggtgctcacgccggcaaatctggcgcaggcctatgggatgaattttcgccgtctggatatcgaaggtcacagaatgctgatttcgaccatctga

SEQ ID NO: 4180 - protein, 249 aa, Escherichia coli
MSIVMQLQDVAESTRLGPLSGEVRAGEILHLVGPNGAGKSTLLARMAGMTSGKGSIQFAGQPLEAWSATKLALHRAYLSQQQTPPFAMPVWHYLTLHQHDKTRTELLNDVAGALALDDKLGRSTNQLSGGEWQRVRLAAVVLQITPQANPAGQLLLLDEPMNSLDVAQQSALDKILSALCQQGLAIVMSSHDLNHTLRHAHRAWLLKGGKMLASGRREEVLTPANLAQAYGMNFRRLDIEGHRMLISTI

SEQ ID NO: 4181 - DNA, 552 bp, Escherichia coli
atgcaagattccattctgacgaccgtagtgaaagatattgacggtaaagtgaccacgctggagaagtacgccggtaatgtgctgttgattgtcaatgtcgcctcaaagtgtggcttaacgccgcaatatgagcagttggagaatattcagaaagcctgggctgatcgtggttttgtggtgctgggattcccgtgtaaccagtttctggagcaagaaccgggtagcgatgaagagattaaaacttattgcaccaccacatggggggtgacgttcccgatgttcagtaagattgaagttaatggcgaaggacgtcatccgctgtatcaaaaattgattgccgcagcgccgactgcagtcgcgccggaagagagcggattctatgcccgaatggtcagcaaaggtcgtgcaccgctgtaccctgatgatattttatggaattttgagaaatttttagttggcagggacggattggtcatccagcgtttttccccggatatgacgccggaagatcccattgtgatggaaagcattaaactggcgttggcaaaataa

SEQ ID NO: 4182 - protein, 183 aa, Escherichia coli
MQDSILTTVVKDIDGKVTTLEKYAGNVLLIVNVASKCGLTPQYEQLENIQKAWADRGFVVLGFPCNQFLEQEPGSDEEIKTYCTTTWGVTFPMFSKIEVNGEGRHPLYQKLIAAAPTAVAPEESGFYARMVSKGRAPLYPDDILWNFEKFLVGRDGLVIQRFSPDMTPEDPIVMESIKLALAK

SEQ ID NO: 4183 - DNA, 981 bp, Escherichia coli
atgctgacacttgcccgccaacaacagcgacaaaatattcgctggttattatgcctgtcagttttgatgctgctggcgcttctcttaagcctttgcgccggtgaacaatggatctcgccaggtgactggtttactcctcgtggcgaactgttcgtctggcaaattcgcctgccacgtacgctggctgtattgctggttggtgcggcgctggctatatccggcgctgtaatgcaggcgttgttcgaaaatcctctggcagaacctggactacttggcgtctctaacggcgcaggcgtggggcttatcgccgcggtattgcttgggcaagggcaactccccaactgggcgctagggctgtgtgcgattgctggcgcgcttatcatcactttaatactcttacgtttcgcccgtcgtcatctttcgaccagtcggttattgctggctggcgttgcattagggattatctgtagcgcactaatgacgtgggctatctacttttccacctctgttgatttacgtcagctgatgtactggatgatgggcggttttggcggcgtagactggcggcaaagctggctgatgctggcattgatccccgtgttgttgtggatctgttgtcagtccaggccaatgaatatgttagcacttggcgagatctcggcgcggcaactgggtttacccctgtggttctggcgcaatgtgttggtggcagcgaccggctggatggttggcgtcagtgtggcgctggcgggtgctatcggctttattggtctggtgatcccacatattctccggctgtgtggtttaaccgatcatcgcgtattacttcccggctgcgcgctggcaggggcgagcgcattgctgctggccgatattgtagcgcgcctggcattagctgccgcagagctgccaattggcgtggtcaccgcaacgttgggtgcgccggtgtttatctggttattgttaaaagcaggacgttag

SEQ ID NO: 4184 - protein, 326 aa, Escherichia coli
MLTLARQQQRQNIRWLLCLSVLMLLALLLSLCAGEQWISPGDWFTPRGELFVWQIRLPRTLAVLLVGAALAISGAVMQALFENPLAEPGLLGVSNGAGVGLIAAVLLGQGQLPNWALGLCAIAGALIITLILLRFARRHLSTSRLLLAGVALGIICSALMTWAIYFSTSVDLRQLMYWMMGGFGGVDWRQSWLMLALIPVLLWICCQSRPMNMLALGEISARQLGLPLWFWRNVLVAATGWMVGVSVALAGAIGFIGLVIPHILRLCGLTDHRVLLPGCALAGASALLLADIVARLALAAAELPIGVVTATLGAPVFIWLLLKAGR

SEQ ID NO: 4185 - DNA, 300 bp, Escherichia coli
atggcgcttacaaaagctgaaatgtcagaatatctgtttgataagcttgggcttagcaagcgggatgccaaagaactggttgaactgtttttcgaagagatccgtcgcgctctggaaaacggcgaacaggtgaaactctctggttttggtaacttcgatctgcgtgataagaatcaacgcccgggacgtaacccgaaaacgggcgaggatattcccattacagcacggcgcgtggtgaccttcagacccgggcagaagttaaaaagccgggtcgaaaacgcttcgcccaaagacgagtaa

SEQ ID NO: 4186 - protein, 99 aa, Escherichia coli
MALTKAEMSEYLFDKLGLSKRDAKELVELFFEEIRRALENGEQVKLSGFGNFDLRDKNQRPGRNPKTGEDIPITARRVVTFRPGQKLKSRVENASPKDE

SEQ ID NO: 4187 - DNA, 2388 bp, Escherichia coli
atgaaattcagtgaactgtggttacgcggatgggtgaacccggcgattgatagcgacgcgctggcaaatcaaatcacgatggcgggcctggaagttgatggtgtagaaccggttgccggtagcttccacggcgtggtcgttggtgaagtggttgagtgtgcgcagcatccgaacgctgacaaactgcgtgtgacaaaagtgaatgtcggcggcgatcgcctgctggacatcgtctgcggtgcgccaaactgccgtcagggcctgcgtgtggcggtagcgaccattggtgctgttctgccgggtgatttcaaaattaaagccgcgaaactgcgtggcgaaccgtctgaagggatgctgtgctccttctctgagctgggaatttctgacgatcataacggcattatcgagctgcctgcggatgcgccgattggcaccgacatccgcgaatacctgaaactcgatgacaacaccatcgaaatcagcgtgacaccaaaccgtgccgactgcttaggtatcattggtgttgcgcgcgacgttgccgtgtcgaaccagctgccgctggttgaaccggaaatcgttccggttggtgcgaccatcgacgacacgctgccgattgcagtagaagcgccggatgcctgcccgcgctatcttggccgtgtggtaaaaggcattaacgttaaagcgccaactccgctgtggatgaaagaaaaactgcgtcgttgcgggatccgttctatcgatgcagttgttgacgtcaccaactatgtgctgctcgaactgggccagccaatgcacgctttcgataaagatcgcattgaaggcggcattgtggtgcggatggcgaaagagggcgaaacgctggtgttgctcgacggcactgaagcgaagctggatgctgacaccctggtcatcgccgaccacaacaaggcgctggcgatgggcggcatatttggtggcgaacactctggcgtgaatgacgaaacgcaaaacgttctgctggaatgcgctttcttcagcccgctgtctatcaccggtcgtgctcgtcgtcatggcctgcatactgatgcgtctcaccgttatgagcgtggcgttgatccggcactgcagcacaaagcgatggaacgtgcgacccgtctgctgatcgacatctgcggtggtgaagcgggtccggtaattgatatcactaacgaagcaacgctgccgaagcgtgcaaccatcactttacgtcgtagcaaactggatcgcctgatcggccatcatattgctgatgagcaggtaacagacattctgcgtcgtctcggctgcgaagtgaccgaaggcaaagacgagtggcaggcagttgcgccgagctggcgtttcgacatggagattgaagaagatctggtcgaagaagtcgcgcgtgtttacggctacaacaacatcccggatgagccggtacaggcaagcctgattatggggactcaccgtgaagctgacctgtcgctcaagcgcgtaaaaacgctgctcaacgacaaaggctatcaggaagtgatcacctacagcttcgttgacccgaaagtgcagcagatgatccatccaggcgttgaagccttactgctgccaagcccgatctctgttgaaatgtcagcaatgcgtctttccctgtggaccggcctgctggcaaccgtggtgtacaaccagaaccgtcagcagaatcgtgtacgcattttcgaaagcggtctgcgtttcgtgccagatactcaggcaccgttgggtattcgtcaggatctgatgttagccggtgtgatttgcggtaaccgttacgaagagcactggaacctggcaaaagagaccgttgatttctatgatttgaaaggcgatcttgaatccgttctcgacctgaccggtaaactgaatgaggttgagttccgtgcagaagcgaatccggcactgcatccggggcaatccgcagcgatttatctgaaaggtgaacgtattggttttgttggggttgttcatcctgaactggaacgtaaactggatcttaacggtcgcactctggtgttcgaactggagtggaataagctcgcagaccgcgtggtgcctcaggcgcgcgagatttctcgcttcccggcgaaccgtcgtgacatcgcggtggtggtcgcagaaaacgttcccgcagcggatattttatccgaatgtaagaaagttggcgtaaatcaggtagttggcgtaaacttatttgacgtgtaccgcggtaagggtgttgcggaggggtataagagcctcgccataagcctgatcctgcaagataccagccgtacactcgaagaagaggagattgccgctaccgtcgccaaatgtgtagaggcattaaaagagcgattccaggcatcattgagggattga

SEQ ID NO: 4188 - protein, 795 aa, Escherichia coli
MKFSELWLRGWVNPAIDSDALANQITMAGLEVDGVEPVAGSFHGVVVGEVVECAQHPNADKLRVTKVNVGGDRLLDIVCGAPNCRQGLRVAVATIGAVLPGDFKIKAAKLRGEPSEGMLCSFSELGISDDHNGIIELPADAPIGTDIREYLKLDDNTIEISVTPNRADCLGIIGVARDVAVSNQLPLVEPEIVPVGATIDDTLPIAVEAPDACPRYLGRVVKGINVKAPTPLWMKEKLRRCGIRSIDAVVDVTNYVLLELGQPMHAFDKDRIEGGIVVRMAKEGETLVLLDGTEAKLDADTLVIADHNKALAMGGIFGGEHSGVNDETQNVLLECAFFSPLSITGRARRHGLHTDASHRYERGVDPALQHKAMERATRLLIDICGGEAGPVIDITNEATLPKRATITLRRSKLDRLIGHHIADEQVTDILRRLGCEVTEGKDEWQAVAPSWRFDMEIEEDLVEEVARVYGYNNIPDEPVQASLIMGTHREADLSLKRVKTLLNDKGYQEVITYSFVDPKVQQMIHPGVEALLLPSPISVEMSAMRLSLWTGLLATVVYNQNRQQNRVRIFESGLRFVPDTQAPLGIRQDLMLAGVICGNRYEEHWNLAKETVDFYDLKGDLESVLDLTGKLNEVEFRAEANPALHPGQSAAIYLKGERIGFVGVVHPELERKLDLNGRTLVFELEWNKLADRVVPQAREISRFPANRRDIAVVVAENVPAADILSECKKVGVNQVVGVNLFDVYRGKGVAEGYKSLAISLILQDTSRTLEEEEIAATVAKCVEALKERFQASLRD

SEQ ID NO: 4189 - DNA, 984 bp, Escherichia coli
atgtcacatctcgcagaactggttgccagtgcgaaggcggccattagccaggcgtcagatgttgccgcgttagataatgtgcgcgtcgaatatttgggtaaaaaagggcacttaacccttcagatgacgaccctgcgtgagctgccgccagaagagcgtccggcagctggtgcggttatcaacgaagcgaaagagcaggttcagcaggcgctgaatgcgcgtaaagcggaactggaaagcgccgcactgaatgcgcgtctggcggcggaaacgattgatgtctccctgccgggtcgtcgcattgaaaacggtgggctgcatccggtgacccgtaccatcgaccgtatcgaaagtttcttcggtgagcttggctttaccgtggcaaccgggccggaaatcgaagacgattatcataacttcgatgctctgaacattcctggtcaccacccggcgcgcgctgaccacgacactttctggtttgacgctacccgcctgctgcgtacccagacctctggcgtacagatccgcaccatgaaagcccagcagccaccgattcgtatcatcgcgcctggccgcgtttatcgtaacgactacgaccagactcacacgccgatgttccatcagatggaaggtctgattgttgataccaacatcagctttaccaacctgaaaggcacgctgcacgacttcctgcgtaacttctttgaggaagatttgcagatccgcttccgtccttcctacttcccgtttaccgaaccttctgcagaagtggacgtcatggggaaaaacggtaaatggctggaagtactgggctgcgggatggtgcatccgaacgtgctgcgtaacgttggcatcgacccggaagtttactctggttttgccttcgggatggggatggagcgtctgaccatgttgcgttacggcgtcaccgacctgcgttcattcttcgaaaacgatctgcgtttcctcaaacagtttaaataa

SEQ ID NO: 4190 - protein, 327 aa, Escherichia coli
MSHLAELVASAKAAISQASDVAALDNVRVEYLGKKGHLTLQMTTLRELPPEERPAAGAVINEAKEQVQQALNARKAELESAALNARLAAETIDVSLPGRRIENGGLHPVTRTIDRIESFFGELGFTVATGPEIEDDYHNFDALNIPGHHPARADHDTFWFDATRLLRTQTSGVQIRTMKAQQPPIRIIAPGRVYRNDYDQTHTPMFHQMEGLIVDTNISFTNLKGTLHDFLRNFFEEDLQIRFRPSYFPFTEPSAEVDVMGKNGKWLEVLGCGMVHPNVLRNVGIDPEVYSGFAFGMGMERLTMLRYGVTDLRSFFENDLRFLKQFK

SEQ ID NO: 4191 - DNA, 357 bp, Escherichia coli
atggctcgcgtaaaacgtggtgttattgcacgcgcacgtcacaagaaaattttgaaacaagctaaaggctactacggtgcgcgttctcgcgtataccgcgttgccttccaggctgttatcaaagctggtcagtatgcttaccgcgaccgtcgtcaacgtaagcgtcagttccgtcaactgtggattgcgcgtatcaacgcagcagcacgtcagaacggtatttcttacagcaaattcatcaatggcctgaaaaaagcctctgttgaaatcgaccgtaagatcctggctgatatcgcagtattcgacaaagtagcgttcaccgctctggttgaaaaagcgaaagcagctctggcataa

SEQ ID NO: 4192 - protein, 118 aa, Escherichia coli [sequence omitted]

SEQ ID NO: 4193 - DNA, 213 bp, Escherichia coli
gtggaagttattaaaatgccaaaaattaagaccgtacgcggtgctgctaagcgcttcaaaaaaaccggtaaaggtggttttaagcacaagcacgctaacctgcgtcacattctgaccaaaaaagcgaccaaacgtaaacgtcacctgcgtccgaaagccatggtttccaaaggcgatctgggcctggtaatcgcgtgcctgccgtacgcataa

SEQ ID NO: 4194 - protein, 70 aa, Escherichia coli
MEVIKMPKIKTVRGAAKRFKKTGKGGFKHKHANLRHILTKKATKRKRHLRPKAMVSKGDLGLVIACLPYA

SEQ ID NO: 4195 - DNA, 435 bp, Escherichia coli
gtgagtctgagagaagctctggagaaagcagaagaagccggagtagacttagtcgagatcagccctaacgccgagccgccggtttgtcgtataatggattacggcaaattcctctatgaaaagagcaagtcttctaaggaacagaagaaaaagcaaaaagttatccaggttaaggaaattaaattccgtcctggtacagatgaaggcgactatcaggtaaaactccgcagcctgattcgctttctcgaagagggtgataaagccaaaatcacgctgcgtttccgcggtcgtgagatggcgcaccagcaaatcggtatggaagtgcttaatcgcgtgaaagacgatttgcaagaactggcagtggtcgaatccttcccaacgaagatcgaaggccgccagatgatcatggtgctcgctcctaagaagaaacagtaa

SEQ ID NO: 4196 - protein, 144 aa, Escherichia coli
MSLREALEKAEEAGVDLVEISPNAEPPVCRIMDYGKFLYEKSKSSKEQKKKQKVIQVKEIKFRPGTDEGDYQVKLRSLIRFLEEGDKAKITLRFRGREMAHQQIGMEVLNRVKDDLQELAVVESFPTKIEGRQMIMVLAPKKKQ

SEQ ID NO: 4197 - DNA, 1929 bp, Escherichia coli
atgcctgttataactcttcctgatggcagccaacgccattacgaccacgctgtaagccccatggatgttgcgctggacattggtccaggtctggcgaaagcctgtatcgcagggcgcgttaatggcgaactggttgatgcttgcgatctgattgaaaacgacgcacaactgtcgatcattactgccaaagacgaagaaggtctggagatcattcgtcactcctgtgcgcacctgttagggcacgcgattaaacaactttggccgcataccaaaatggcaatcggcccggttattgacaacggtttttattacgacgttgatcttgaccgcacgttaacccaggaagatgtcgaagcactcgagaagcggatgcatgagcttgctgagaaaaactacgacgtcattaagaagaaagtcagctggcatgaagcgcgtgaaactttcgccaaccgtggggagagctacaaagtctccattcttgacgaaaacatcgcccatgatgacaagccaggtctgtacttccatgaagaatatgtcgatatgtgccgcggtccgcacgtaccgaacatgcgtttctgccatcatttcaaactaatgaaaacggcaggggcttactggcgtggcgacagcaataacaaaatgttgcaacgtatttacggtacggcgtgggcagacaaaaaagcgcttaacgcttacctgcaacgcctggaagaagccgcgaaacgcgaccaccgtaaaatcggtaaacagctcgacctgtaccatatgcaggaagaagcgccgggtatggtattctggcacaacgacggctggaccatcttccgtgaactggaagtgtttgttcgttctaaactgaaagagtaccagtatcaggaagttaaaggtccgttcatgatggaccgtgtcctgtgggaaaaaaccggtcactgggacaactacaaagatgcaatgttcaccacgtcttctgagaaccgtgaatactgcattaagccgatgaactgcccggggcacgtacaaattttcaaccaggggctgaagtcttatcgcgatctgccgctgcgtatggccgagtttggtagctgccaccgtaacgagccgtcaggttcgctgcatggcctgatgcgcgtgcgtggttttacccaggatgacgcgcatattttctgtactgaagaacaaattcgcgatgaagttaacggatgtatccgtttagtctatgatatgtacagcacttttggcttcgagaagatcgtcgtcaaactctccactcgtcctgaaaaacgtattggcagcgacgaaatgtgggatcgtgctgaggcggacctggcggttgcgctggaagaaaacaacatcccgtttgaatatcaactgggtgaaggcgctttctacggtccgaaaattgaatttaccctgtatgactgcctcgatcgtgcatggcagtgcggtacagtacagctggacttctctttgccttctcgtctgagcgcttcttatgtaggcgaagacaatgaacgtaaagtaccggtaatgattcaccgcgcaattctggggtcgatggaacgtttcatcggtatcctgaccgaagaatttgctggtttcttcccgacttggcttgcgccagttcaggttgttatcatgaatattaccgattctcagtctgaatacgttaacgaactgacgcaaaaactatcaaatgcgggcattcgtgttaaagcagacttgagaaatgagaagattggctttaaaatccgcgagcacactttgcgtcgcgtcccatatatgctggtctgtggtgataaagaggtggaatcaggcaaagttgccgttcgcacccgccgtggtaaagacctgggaagcatggacgtaaatgaagtgatcgagaagctgcaacaagagattcgcagccgcagtcttaaacaattggaggaataa

SEQ ID NO: 4198 - protein, 642 aa, Escherichia coli
MPVITLPDGSQRHYDHAVSPMDVALDIGPGLAKACIAGRVNGELVDACDLIENDAQLSIITAKDEEGLEIIRHSCAHLLGHAIKQLWPHTKMAIGPVIDNGFYYDVDLDRTLTQEDVEALEKRMHELAEKNYDVIKKKVSWHEARETFANRGESYKVSILDENIAHDDKPGLYFHEEYVDMCRGPHVPNMRFCHHFKLMKTAGAYWRGDSNNKMLQRIYGTAWADKKALNAYLQRLEEAAKRDHRKIGKQLDLYHMQEEAPGMVFWHNDGWTIFRELEVFVRSKLKEYQYQEVKGPFMMDRVLWEKTGHWDNYKDAMFTTSSENREYCIKPMNCPGHVQIFNQGLKSYRDLPLRMAEFGSCHRNEPSGSLHGLMRVRGFTQDDAHIFCTEEQIRDEVNGCIRLVYDMYSTFGFEKIVVKLSTRPEKRIGSDEMWDRAEADLAVALEENNIPFEYQLGEGAFYGPKIEFTLYDCLDRAWQCGTVQLDFSLPSRLSASYVGEDNERKVPVMIHRAILGSMERFIGILTEEFAGFFPTWLAPVQVVIMNITDSQSEYVNELTQKLSNAGIRVKADLRNEKIGFKIREHTLRRVPYMLVCGDKEVESGKVAVRTRRGKDLGSMDVNEVIEKLQQEIRSRSLKQLEE

SEQ ID NO: 4199 - DNA, 396 bp, Escherichia coli
gtgattgtctgcgctgaaatggacgaacagtggggctatgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 4200 - protein, 131 aa, Escherichia coli
MIVCAEMDEQWGYVGAKSRQRWLFYAYDRLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 4201 - DNA, 276 bp, Escherichia coli
gtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgtaccagaaaatcattgatatggccatgaatggcgttggatgccgggcaacagcccgcattatgggcgttggcctcaacacgattttacgtcacttaaaaaactcaggccgcagtcggtaa

SEQ ID NO: 4202 - protein, 91 aa, Escherichia coli
MASVSISCPSCSATDGVVRNGKSTAGHQRYLCSHCRKTWQLQFTYTASQPGTYQKIIDMAMNGVGCRATARIMGVGLNTILRHLKNSGRSR

SEQ ID NO: 4203 - DNA, 123 bp, Escherichia coli
atgcaggacactggtatgccgactaaacgctttgataaaaaacactggaagatggtggtggtgctactggcaatctgtggcgctatgttgttgctacgttgggcagcaatgatttggggctga

SEQ ID NO: 4204 - protein, 40 aa, Escherichia coli
MQDTGMPTKRFDKKHWKMVVVLLAICGAMLLLRWAAMIWG

SEQ ID NO: 4205 - DNA, 759 bp, Escherichia coli
atgaagcttttgaagacagttcctgccatcgttatgttggcggggggcatgtttgcgtcactgaatgcagctgccgatgattccgtttttactgtcatggacgatcctgccagcgctaaaaaacctttcgaaggtaatctgaacgcaggatatcttgcacaatcaggcaatacgaaaagctcctcacttacggctgacaccaccatgacctggtatggacaaaccactgcctggtcgctgtgggggaacgccagtaatacttcttctaatgatgagcgttcttcagaaaaatatgcggcgggcgggcgtagccgttttaatttaactgattatgactatttatttgggcaggcaagctggctgacagaccgttataacggctatcgagagcgcgatgtgttgaccgcgggttatggtcgccagtttttgaatggcccagtacacagtttccgctttgaattcggcccaggtgtgcgttacgacaaatataccgacaatgccagtgaaacccagccgctgggctatgcctccggggcttatgcatggcagttgactgacaacgctaaatttacgcagggtgtttcggtcttcggcgcggaagacacaacgctgaactccgaaagcgcattaaatgttgctattaatgaacattttggactgaaggtggcttacaacgtcacatggaactctgaacctccagagtctgcaccggaacataccgatcgtcggacaaccttatcgttgggttacagcatgtaa

SEQ ID NO: 4206 - protein, 252 aa, Escherichia coli
MKLLKTVPAIVMLAGGMFASLNAAADDSVFTVMDDPASAKKPFEGNLNAGYLAQSGNTKSSSLTADTTMTWYGQTTAWSLWGNASNTSSNDERSSEKYAAGGRSRFNLTDYDYLFGQASWLTDRYNGYRERDVLTAGYGRQFLNGPVHSFRFEFGPGVRYDKYTDNASETQPLGYASGAYAWQLTDNAKFTQGVSVFGAEDTTLNSESALNVAINEHFGLKVAYNVTWNSEPPESAPEHTDRRTTLSLGYSM

SEQ ID NO: 4207 - DNA, 930 bp, Escherichia coli
atggtacgtatctatacgttgacacttgcgccctcactcgatagcgcaacaattaccccgcaaatttatcccgaaggaaaactgcgctgtaccgcaccggtattcgaacccggaggcggcggcatcaacgtcgcccgcgccattgcccatcttggaggcagtgccacagcgatcttcccggcgggtggtgcgaccggcgaacatctggtttcactgttggcagatgaaaatgtccccgtcgctactgtagaagccaaagactggacccggcagaatttacacgtacatgtggaagcaagcggtgagcagtatcgttttgttatgccaggcgcggcattaaatgaagatgagtttcgccagcttgaagagcaagttctggaaattgaatccggggccattctggtcataagcggaagcctgccgccaggtgtgaagctggaaaaattaacccaactgatttccgctgcgcaaaaacaagggatccgctgcatcatcgacagttctggcgaagcgttaagtgcagcactggcgattggtaacatcgagttggttaagcctaaccaaaaagaactcagtgcgctggtgaatcgcgaactcacccagccagacgatgtccgcaaagccgcgcaggaaattgttaatagcggcaaggccaaacgggttgtcgtttccctgggtccacaaggggcgttgggcgttgatagtgaaaactgcattcaggtggtgccaccaccggtaaaaagccagagtaccgttggcgctggtgacagcatggtcggcgcgatgacactgaaactggcagaaaatgcctctcttgaagagatggtccgttttggcgtagctgcggggagtgcagccacactcaatcagggaacacgcctgtgctcccatgacgatacgcaaaaaatttacgcttacctttcccgctaa

SEQ ID NO: 4208 - protein, 309 aa, Escherichia coli
MVRIYTLTLAPSLDSATITPQIYPEGKLRCTAPVFEPGGGGINVARAIAHLGGSATAIFPAGGATGEHLVSLLADENVPVATVEAKDWTRQNLHVHVEASGEQYRFVMPGAALNEDEFRQLEEQVLEIESGAILVISGSLPPGVKLEKLTQLISAAQKQGIRCIIDSSGEALSAALAIGNIELVKPNQKELSALVNRELTQPDDVRKAAQEIVNSGKAKRVVVSLGPQGALGVDSENCIQVVPPPVKSQSTVGAGDSMVGAMTLKLAENASLEEMVRFGVAAGSAATLNQGTRLCSHDDTQKIYAYLSR

SEQ ID NO: 4209 - DNA, 291 bp, Escherichia coli
atggccagtggcgatcttgtccgttatgtcataaccgtcatgttgcacgaggatacattgactgaaattaacgagttgaataattacctgactcgcgacggttttttgctcaccatgacggatgatgatggaaatatccatgagctggggactaacacttttggacttatcagtacccaaagtgaagaagaaattagagaactggtttcggggcttacccaaagtgcaaccggtaaagatcctgaaatcaccatcacgacctgggaggaatggaatagcaacagaaaataa

SEQ ID NO: 4210 - protein, 96 aa, Escherichia coli
MASGDLVRYVITVMLHEDTLTEINELNNYLTRDGFLLTMTDDDGNIHELGTNTFGLISTQSEEEIRELVSGLTQSATGKDPEITITTWEEWNSNRK

SEQ ID NO: 4211 - DNA, 861 bp, Escherichia coli
atgtggcaggcaatcagtcgtcttttgagcgagcagttaggtgaaggcgaaatcgaactgcgtaatgaactgcctggcggagaagtccatgccgcatggcatttgcgctatgcaggacgtgactttttcgtcaaatgtgatgaaagggaactgcttcccggttttaccgccgaagccgaccaactggagttactgtcgcgtagtaaaaccgtcaccgtgcctaaggtttgggcagttggcgctgaccgtgactacagttttctggtgatggactatctcccacctcgcccgctggatgcgcatagcgcatttattcttggtcagcaaattgcgcgtttacatcaatggagcgaccaaccgcaatttggcctcgatttcgataacgcgctctccacaactccccagcccaacacctggcaacgtcgctggtcaactttttttgctgaacaacggattggctggcagctggaactggcggcagaaaaagggatcgctttcggcaatatcgatgccatcgtcgagcatattcagcagcgtctggcctcgcatcaaccgcagccttctctgttgcacggcgatttatggtccggcaactgtgcgctgggtccggatggcccgtacattttcgacccggcctgctactggggtgaccgagagtgcgacctggcgatgttaccgctgcatacagaacagccgccacaaatctatgacggctatcagtcagtatccccgctacctgccgatttccttgaacgtcaaccggtttaccaactctacacgctgttaaatcgtgcaaggttatttggcggtcagcatttggttattgctcagcagtcactggatagattattagcagcatga

SEQ ID NO: 4212 - protein, 286 aa, Escherichia coli
MWQAISRLLSEQLGEGEIELRNELPGGEVHAAWHLRYAGRDFFVKCDERELLPGFTAEADQLELLSRSKTVTVPKVWAVGADRDYSFLVMDYLPPRPLDAHSAFILGQQIARLHQWSDQPQFGLDFDNALSTTPQPNTWQRRWSTFFAEQRIGWQLELAAEKGIAFGNIDAIVEHIQQRLASHQPQPSLLHGDLWSGNCALGPDGPYIFDPACYWGDRECDLAMLPLHTEQPPQIYDGYQSVSPLPADFLERQPVYQLYTLLNRARLFGGQHLVIAQQSLDRLLAA

SEQ ID NO: 4213 - DNA, 537 bp, Escherichia coli
atgacgtatcaacaagctggacgcattgctgttttgaaaaggattttgggttgggtgatttttatacctgcattgatctctacattgatttctttgctgaaatttatgaatacccggcaggaaaaccaggaaggcattaatgcggtcatgctcgactttactcatgtcatgatcgatatgatgcaggcgaatacgccttttttgaatgtgttctggtacaactctccgacgccaaattttaatggtggcgtgaacgttatgttctgggtgattttcatcctgatttttgtcggactggcgttgcaggattccggagcccggatgagtcgccaggcgcgcttcttgcgggaaggtgttgaagatcaactcattctggaaaaagccaaaggggaagaggggctaacgcgtgaacaaattgagtcacgtattgttgttccgcaccatactattttcctgcagtttttctcgctgtatatcctgccgcttatttgtattgctgcaggttatgtgttcttttctctgcttgggtttatttaa

SEQ ID NO: 4214 - protein, 178 aa, Escherichia coli
MTYQQAGRIAVLKRILGWVIFIPALISTLISLLKFMNTRQENQEGINAVMLDFTHVMIDMMQANTPFLNVFWYNSPTPNFNGGVNVMFWVIFILIFVGLALQDSGARMSRQARFLREGVEDQLILEKAKGEEGLTREQIESRIVVPHHTIFLQFFSLYILPLICIAAGYVFFSLLGFI

SEQ ID NO: 4215 - DNA, 669 bp, Escherichia coli
atgtcaaccccgcgtcagattcttgctgcaatttttgatatggatggattacttatcgactcagaacctttatgggatcgagccgaactggatgtgatggcaagcttgggggtggatatctcccgtcgtaacgagctgccggacaccttaggtttacgcatcgatatggtggtcgatctttggtacgcccggcaaccatggaatgggccaagccgtcaggaagtagtagaacaagttattgcccgtgccatttcactggttgaagagacacgtccattattgccaggtgtgcgtgaagccgttgcgttatgcaaagaacaaggtttattggtggggctggcctccgcgtcaccgctgcatatgctggaaaaagtattgaccatgtttgatttacgcgacagtttcgatgccctcgcctcggctgaaaaattgccttacagcaagccgcatccgcaagtatatctcgactgcgcagcaaaactgggggttgaccctctgacctgcgtggcactggaagattcggtaaatggcatgatcgcctctaaagcagcccgcatgcgttccatcgtcgttcctgcgccagaagcgcaaaatgatccacgttttgtattagcaaacgtcaaactctcatcgctgacagaactcaccgcaaaagaccttctcggttaa

SEQ ID NO: 4216 - protein, 222 aa, Escherichia coli
MSTPRQILAAIFDMDGLLIDSEPLWDRAELDVMASLGVDISRRNELPDTLGLRIDMVVDLWYARQPWNGPSRQEVVEQVIARAISLVEETRPLLPGVREAVALCKEQGLLVGLASASPLHMLEKVLTMFDLRDSFDALASAEKLPYSKPHPQVYLDCAAKLGVDPLTCVALEDSVNGMIASKAARMRSIVVPAPEAQNDPRFVLANVKLSSLTELTAKDLLG

SEQ ID NO: 4217 - DNA, 591 bp, Escherichia coli
atgacggcggaaggtcaccttctcttttctattgcttgtgcggtatttgccaaaaatgccgagctgacgcccgtgctggcacagggtgactggtggcatattgtcccttccgcaatcctgacgtgtttgttaccggacatcgatcacccaaagtcgtttcttgggcagcgattaaagtggatatcaaaaccgatcgcccgcgcttttgggcatcgtggttttacccacagtctgctggcggtatttgcgctgctggcaaccttttaccttaaggttcctgaaagctggttcattccggctgatgcgttgcagggtatggtgctgggttatttgagccacatacttgccgatatgctgacacccgccggtgttcccctgctctggccatgccgctggcgtttccgcttgcctatcctggttccccaaaagggcaaccaactggaacgttttatctgcatggcattatttgtctggtcggtatggatgccccattcattacccgaaaacagcgctgttcgttggtcatcgcaaatgatcaataccttacagatccagtttcatcggcttattaagcatcaggttgaatactaa

SEQ ID NO: 4218 - protein, 196 aa, Escherichia coli
MTAEGHLLFSIACAVFAKNAELTPVLAQGDWWHIVPSAILTCLLPDIDHPKSFLGQRLKWISKPIARAFGHRGFTHSLLAVFALLATFYLKVPESWFIPADALQGMVLGYLSHILADMLTPAGVPLLWPCRWRFRLPILVPQKGNQLERFICMALFVWSVWMPHSLPENSAVRWSSQMINTLQIQFHRLIKHQVEY

SEQ ID NO: 4219 - DNA, 1392 bp, Escherichia coli
atgaactttccattaattgcgaacatcgtggtgttcgttgtactgctgtttgcgctggctcaaacccgccacaaacagtggagtctggcgaaaaaagtgctggtgggtcttgtgatgggtgtggtttttggccttgccctgcataccatttatggttctgacagccaggtacttaaagattctgtacagtggtttaacattgttggtaacggctatgttcaactgctgcaaatgatcgttatgccgctagtcttcgcctctattctgagcgcggttgcccgtctgcataacgcatctcagttaggcaaaatcagttttctaaccatcggtacgcttttgtttaccacgctgattgcagcgctggtcggtgtgctggtcaccaacctgtttggtttgacggctgaaggtctggttcagggtggtgcagaaactgcacgtctgaacgccatcgaaagtaactatgttggtaaagtctctgacctgagcgttccgcagctggtcttgtcctttatcccgaaaaacccgtttgccgatctgaccggagccaatccgacgtcaattatcagcgtggtaatttttgccgcattcctcggcgtagctgcgctgaagctgctgaaggatgatgcgccgaaaggtgaacgcgtcttaaccgctatcgataccctgcaaagctgggtgatgaaactggttcgcctggtcatgcagttgaccccttacggtgttctggcgctgatgaccaaagtggttgcaggttctaacctgcaagacatcatcaaactgggaagtttcgttgttgcgtcctacctcggtctgctgattatgtttgcagtgcatggccttctgctgggcattaatggcgtgagcccgctgaagtacttccgtaaggtatggccagtactgacgtttgcctttaccagccgttccagtgctgcgtctatcccactgaatgtggaagcacaaacgcgtcgtctgggtgttcctgaatccatcgccagtttcgccgcctctttcggtgcgaccattggtcagaacggttgtgccggtttgtatccggcaatgctggcggtgatggttgcgcctacggtgggcattaacccactggacccgatgtggattgcgacgctggtcggtattgtcaccgttagttccgcaggcgttgccggtgtcggtggtggtgcaactttcgccgcactgattgtgctgcctgcgatgggcctgccggtaacgctgctggcattgttaatctccgttgaaccgcttatcgacatgggtcgtacggcgctaaacgttagtggctcaatgaccgctggcacgctgaccagccagtggctgaagcaaaccgataaagccattctggatagcgaagacgacgccgaactggcacaccgttaa

SEQ ID NO: 4220 - protein, 463 aa, Escherichia coli
MNFPLIANIVVFVVLLFALAQTRHKQWSLAKKVLVGLVMGVVFGLALHTIYGSDSQVLKDSVQWFNIVGNGYVQLLQMIVMPLVFASILSAVARLHNASQLGKISFLTIGTLLFTTLIAALVGVLVTNLFGLTAEGLVQGGAETARLNAIESNYVGKVSDLSVPQLVLSFIPKNPFADLTGANPTSIISVVIFAAFLGVAALKLLKDDAPKGERVLTAIDTLQSWVMKLVRLVMQLTPYGVLALMTKVVAGSNLQDIIKLGSFVVASYLGLLIMFAVHGLLLGINGVSPLKYFRKVWPVLTFAFTSRSSAASIPLNVEAQTRRLGVPESIASFAASFGATIGQNGCAGLYPAMLAVMVAPTVGINPLDPMWIATLVGIVTVSSAGVAGVGGGATFAALIVLPAMGLPVTLLALLISVEPLIDMGRTALNVSGSMTAGTLTSQWLKQTDKAILDSEDDAELAHR

SEQ ID NO: 4221 - DNA, 264 bp, Escherichia coli
atgcgtttagtgaagccagtaatgaagaaaccgctccgtcagcaaaaccgccagattattagctatgtcccacgcacggaacccgcgccgccagaacatgcgataaagatggattcgtttcgtgatgtctggatgctgcgtggcaaatatgttgcgtttgtactgatgggggagtcatttctgcgctcaccggcgtttactgtgcctgaatccgcccagcgttgggcaaatcagattcgtcaggaaaatgaggtcgaagaataa

SEQ ID NO: 4222 - protein, 87 aa, Escherichia coli
MRLVKPVMKKPLRQQNRQIISYVPRTEPAPPEHAIKMDSFRDVWMLRGKYVAFVLMGESFLRSPAFTVPESAQRWANQIRQENEVEE

SEQ ID NO: 4223 - DNA, 159 bp, Escherichia coli
gtgcaccaggcggtgttggttcagccgctggacgatgagatccgtcttcaggtgccagtgagtccatccccggtttcgcttcgctggaatcgtgtagtggtgactggtgctgatgtgggttcttttcgttatgttgcgacattgaactcgtctccttaa

SEQ ID NO: 4224 - protein, 52 aa, Escherichia coli
MHQAVLVQPLDDEIRLQVPVSPSPVSLRWNRVVVTGADVGSFRYVATLNSSP

SEQ ID NO: 4225 - DNA, 2007 bp, Escherichia coli
gtgcgcatcgccgacgatcaaaactcactgcgtgccggtagccgtggtccaactctgctggaagattttattctgcgcgagaaaatcactcactttgaccatgagcgcatcccggaacgtattgttcatgcacgcggatcagcagctcacggttatttccagccatataaaagcttaagcgatatcaccaaagcggatttcctctcagatacgaacaaaatcaccccagtatttgttaggttctctaccgttcagggcggcgctggctctgccgataccgtacgtgatatccgtggctttgccaccaagttctatactgaagagggtatttttgacctcgttggcaataacacgccaatcttctttatccaggatgcgcataaattccccgattttgttcatgcggtaaaaccagaaccgcactgggcaattccacaagggcaaagcgcccacgatactttctgggattatgtttctctgcaacctgaaactctgcacaacgtgatgtgggcaatgtcggatcgcggtatcccgcgcagttaccgcactatggaaggcttcggtattcataccttccgcctgattaatgccgaagggaaggcaacgttcgtacgtttccactggaaaccactggcaggtaaagcctcactcgtttgggatgaagcacaaaaactaaccggacgtgacccggacttccaccgccgcgagttgtgggaagcgattgaagcaggcgattttcctgaatacgaactgggcttccagttgattcctgaagaagacgaattcaagttcgacttcgatcttctcgatccaaccaaacttatcccggaagaattggtgcctgttcagcgtgtcggcaaaatggtgctcaatcgtaatccggataacttctttgctgaaaacgaacaggtggctttccatccagggcatattgtccccggtctggatttcaccaacgacccgttattgcaggggcgtttgttctcttataccgatacacaaatcagtcgtcttggtgggccgaatttccatgaaattccgattaaccgcccgacctgcccttaccataatttccagcgtgacggcatgcatcgtatggggatcgacactaacccggcgaattacgaaccgaactcgatcaacgataactggccgcgcgaaacaccgccggggccgaaacgcggcggttttgaatcataccaggaacgcgtggaaggaaataaagttcgcgagcgcagtccatcgtttggcgaatattattcccatccgcgtctgttctggctaagtcagacgccattcgagcagcgccatattgtcgatggtttcagttttgagttaagcaaagtagttcgtccgtatattcgtgagcgcgttgttgaccagctggcgcatattgatctcactctggcccaggcggtggcgaaaaatctcggtatcgaactgactgatgaccagctgaatatcaccccacctccggacgtcaacggtctgaaaaaggatccatccttaagtctgtactccattcctgacggtgatgtgaaaggtcgcgtggtagcaattttgcttaatgatgaagtgagatcggcagaccttctggccattctcaaggcgctgaaggccaaaggcgttcatgccaaactgctctactcccgaatgggggaagtgactgcggatgacggtacggtgttgcctatagctgctacctttgccggtgcgccttcgctgacggtcgatgcagtcattgtcccttgcggcaatattgcggatatcgctgacaacggcgatgccaactactatctgatggaagcctacaaacaccttaaaccgattgcgctggcaggagacgcgcgcaagtttaaagcaacaatcaaggtcgctgaccagggtgaagaagggattgcggaagctgacagcgccgatggtagttttatggatgaactgttaacgctgatgacagcacaccgcgtgtggtcacgcattcctaagattgacaaaatcccggcgtaa

SEQ ID NO: 4226 - protein, 668 aa, Escherichia coli
MRIADDQNSLRAGSRGPTLLEDFILREKITHFDHERIPERIVHARGSAAHGYFQPYKSLSDITKADFLSDTNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQVAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYSIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKVADQGEEGIAEADSADGSFMDELLTLMTAHRVWSRIPKIDKIPA

SEQ ID NO: 4227 - DNA, 759 bp, Escherichia coli
atggaacgcttactgattgttaatgccgatgattttggcttaagcaaaggtcagaactacggcattatcgaggcctgtcgcaatgggattgtcacgtcgacgacggcgctggtgaatgggcaggctattgaccatgcggtgcagttgagccgtgatgaaccgagtctggccatagggatgcactttgtccttactatgggcaagcctctgacagctatgccggggttaacccgcgatggtgtgctgggaaaatggatctggcagttggcagaagaaggtgctttaccgctggaagaaattactcaggagctcgccagtcagtatttgcgtttcattgagctatttggacgcaaacctacgcatcttgatagccatcatcatgtgcatatgttcccgcagattttcccgattgtggcaaagtttgcggctgaagaggggattgcgttgcgcatcgaccgtcagccgttatctaacgatggtgatttaccggctaatctgcgcagttcgcagggattcagtagcgcgttttatggtgaagagattagcgagacactgttcctgcaagtgcttgatgattccagccatcgcggggaacgctcgttggaagttatgtgccatccggcgtttgtcgataatacgattcgccagagtgcttattgcttccctcggttaacggaactggatgtgctgacttcagcgtcgttgaaatatgcgattgctgagcgtggttatctgttgggtagttatcatgatgtgtaa

SEQ ID NO: 4228 - protein, 252 aa, Escherichia coli
MERLLIVNADDFGLSKGQNYGIIEACRNGIVTSTTALVNGQAIDHAVQLSRDEPSLAIGMHFVLTMGKPLTAMPGLTRDGVLGKWIWQLAEEGALPLEEITQELASQYLRFIELFGRKPTHLDSHHHVHMFPQIFPIVAKFAAEEGIALRIDRQPLSNDGDLPANLRSSQGFSSAFYGEEISETLFLQVLDDSSHRGERSLEVMCHPAFVDNTIRQSAYCFPRLTELDVLTSASLKYAIAERGYLLGSYHDV

SEQ ID NO: 4229 - DNA, 1353 bp, Escherichia coli
atgagccagaaattaaaagtcgtcactattggtggcgggagcagctataccccggagttactggaaggatttattaagcgttatcacgaattgccggtcagcgaattatggctggtggatgtcgaaggtggtaaagcgaaactggatattatttttgatctctgccaacggatgattgataacgctggcgtcccgatgaagctttataaaacgctggatcgccgcgaagcattgaaagatgctgatttcgttactacccaactgcgcgttggccaattaccggcgcgcgaattggatgaacgtattccattaagtcatggttatcttggtcaggaaactaacggcgcgggcggtctgtttaaaggtctgcgtaccattccggtgatttttgacatcgtaaaagatgtcgaagaactatgtccgaatgcatgggtgattaacttcactaacccggcgggaatggtcactgaagccgtttatcgtcataccggatttaaacgctttatcggcgtgtgtaatattccgatcggcatgaagatgtttattcgcgatgttctgatgctgaaagacagcgatgatttatctatcgatctgttcggcctcaaccatatggtgttcattaaggatgtgctggtaaatggcaaatcacgctttgccgaattgcttgatggtgtggcatccgggcagttaaaagcatctggcgttaaaaatattttcgatctgccatttagcgaaggcttaattcgttctctgaatctgttgccgtgttcttatttgctttattacttcaagcaaaaagagatgctggctattgaaatgggcgaatactacaaaggcggcgcacgagcgcaggtcgtacagaaagtcgagaaacaactttttgagctatataaaaacccggagttgaacgttaagccgaaagaactggaacagcgcggtggggcttattattctgatgctgcgtgcgaagtgatcaacgctatctataacgacaagcaagcagaacattacgttaatatcccgcatcatgggcatattgataatattccggcagactgggcggtagaaatgacctgtacgctggggcgcgatggcgcgacgccacatccgcgcattacgcatttcgatgataaagtgatggggctgattcacaccatcaaaggcttcgagattgctgccagcaacgccgcacttagtggagaatttaacgatgtcttactggcgctaaaccttagtccgttggtgcattccgatcgcgatgctgagctgctggcacgcgagatgattctggcgcacgagaaatggctgccaaattttgccgactgcatcgcagagcttaaaaaagcacattaa

SEQ ID NO: 4230 - protein, 450 aa, Escherichia coli
MSQKLKVVTIGGGSSYTPELLEGFIKRYHELPVSELWLVDVEGGKAKLDIIFDLCQRMIDNAGVPMKLYKTLDRREALKDADFVTTQLRVGQLPARELDERIPLSHGYLGQETNGAGGLFKGLRTIPVIFDIVKDVEELCPNAWVINFTNPAGMVTEAVYRHTGFKRFIGVCNIPIGMKMFIRDVLMLKDSDDLSIDLFGLNHMVFIKDVLVNGKSRFAELLDGVASGQLKASGVKNIFDLPFSEGLIRSLNLLPCSYLLYYFKQKEMLAIEMGEYYKGGARAQVVQKVEKQLFELYKNPELNVKPKELEQRGGAYYSDAACEVINAIYNDKQAEHYVNIPHHGHIDNIPADWAVEMTCTLGRDGATPHPRITHFDDKVMGLIHTIKGFEIAASNAALSGEFNDVLLALNLSPLVHSDRDAELLAREMILAHEKWLPNFADCIAELKKAH

SEQ ID NO: 4231 - DNA, 840 bp, Escherichia coli
atgcagccagtgattaacgcgccggaaattgccactgcccgagaacagcagttgtttaatggcaaaaacttccatgtgtttatctacaataaaactgagagtatcagcggactgcatcagcacgactattatgaatttactctggtattaaccgggcgttatttccaggagattaacggtaagcgcgtgttactggaacggggcgattttgtttttattccgttaggttcgcaccatcaaagtttttatgaatttggtgccacgcgtatattgaacgttgggatcagtaaacgcttttttgagcagcattacctgccgttgttgccttattgctttgtagcttcgcaggtataccggaccaataacgcgtttctcacctatgtggaaacagtgatttcttcattgaatttccgcgaaacagggctggaagagtttgttgagatggttactttttatgtcattaaccgtttacgtcattaccgcgaagaacaggtgattgatgatataccgcagtggctgaaaagtacggtagaaaagatgcatgataaagagcagtttagtgaatcggcgctggagaatatggtgacgttgtcagccaaatcacaggaatatttgacgcgagcgactcaacgatactatggtaaaacgccaatgcagattattaatgaaatccgtattaattttgccaaaaaacaactggaaatgaccaactattcagtgacggatattgcgtttggggccggttatagtagcccgagcttgtttattaaaacgtttaagaaattaacatcctttacgcctaagagctatcgtaagaaattgactgaatttaatcagtaa

SEQ ID NO: 4232 - protein, 279 aa, Escherichia coli
MQPVINAPEIATAREQQLFNGKNFHVFIYNKTESISGLHQHDYYEFTLVLTGRYFQEINGKRVLLERGDFVFIPLGSHHQSFYEFGATRILNVGISKRFFEQHYLPLLPYCFVASQVYRTNNAFLTYVETVISSLNFRETGLEEFVEMVTFYVINRLRHYREEQVIDDIPQWLKSTVEKMHDKEQFSESALENMVTLSAKSQEYLTRATQRYYGKTPMQIINEIRINFAKKQLEMTNYSVTDIAFGAGYSSPSLFIKTFKKLTSFTPKSYRKKLTEFNQ

SEQ ID NO: 4233 - DNA, 351 bp, Escherichia coli
atgatggatctcgataatattcccgatacgcaaacggaagctgaagagctggaagaagtggtgatggggcttatcatcaactccggacaagcgcgtagcctggcgtatgcggcactgaaacaggcgaagcagggcgattttgccgcagcaaaaaccatgatggatcagtcacggatggcattgaatgaagcgcatctggtacagacgaaactgattgaaggcgatgctggcgaaggtaagatgaaagtgagtctggtgctagtccacgctcaggatcatttaatgacgtccatgcttgcgcgtgaactgattactgaattaattgagcttcatgaaaaactgaaggcataa

SEQ ID NO: 4234 - protein, 116 aa, Escherichia coli
MMDLDNIPDTQTEAEELEEVVMGLIINSGQARSLAYAALKQAKQGDFAAAKTMMDQSRMALNEAHLVQTKLIEGDAGEGKMKVSLVLVHAQDHLMTSMLARELITELIELHEKLKA

SEQ ID NO: 4235 - DNA, 1359 bp, Escherichia coli
atgagtaatgttattgcatcgcttgaaaaggtactcctcccttttgcagttaaaataggaaagcagccacacgttaatgcaatcaaaaatggctttattcgcttaatgccgttaacccttgcgggggccatgtttgtattaattaacaacgtttttctaagctttggggaggggtcgtttttttattccttaggtattcgcctggatgcctcaaccattgaaacacttaatggtctgaaaggtattggcggcaacgtatataacggaacattagggataatgtctttaatggccccgttctttattggcatggcgctggcagaagagcgtaaagtcgatgcgctggcggccgggttgttatccgttgcagcatttatgaccgtcaccccatatagtgtcggtgaggcctatgcggttggcgcaaactggttaggtggggcgaatatcatctccgggattattattggcctggtggtggcagaaatgtttacctttattgttcatcgtaactgggtcattaagttacctgatagcgttccgacatcggtttcgcgctctttctcagcattaattcccggttttattattctttccgtgatggggattattgcctgggcgttgaatacctggggcaccaacttccatcagatcattatggataccatctcaaccccactggcatcgttgggtagcgtggtaggctgggcctatgtgatctttgttccactgctctggttcttcggtattcatggcgcgctggcgctgaccgcactggacaacggcattatgacgccgtgggcgctggaaaatatcgcgacctatcagcaatatggttccgtcgaagcggcgctggcagccggtaagaccttccatatctgggccaagccgatgctggactcctttattttccttggtggcagtggtgcgactttaggcctgatcctggctatctttatcgcttctcgccgtgctgattatcgtcaggtggcaaaactggcgctgccgtccggcatcttccagattaacgaaccgattctgtttggtctgccaattatcatgaacccggtgatgtttatcccgtttgtactggtacaaccgattctggcggcaatcaccctggcagcgtactacatgggcattattccaccggtgaccaatattgcaccgtggaccatgccaaccggtctgggagccttctttaacaccaacggtagcgtcgccgcattgctggtcgcactcttcaaccttggtatcgcaacgttaatttatctgccctttgttgtggtcgctaacaaagcacaaaacgcgattgataaagaagagagcgaagaagatatcgccaacgccctgaaattttaa

SEQ ID NO: 4236 - protein, 452 aa, Escherichia coli
MSNVIASLEKVLLPFAVKIGKQPHVNAIKNGFIRLMPLTLAGAMFVLINNVFLSFGEGSFFYSLGIRLDASTIETLNGLKGIGGNVYNGTLGIMSLMAPFFIGMALAEERKVDALAAGLLSVAAFMTVTPYSVGEAYAVGANWLGGANIISGIIIGLVVAEMFTFIVHRNWVIKLPDSVPTSVSRSFSALIPGFIILSVMGIIAWALNTWGTNFHQIIMDTISTPLASLGSVVGWAYVIFVPLLWFFGIHGALALTALDNGIMTPWALENIATYQQYGSVEAALAAGKTFHIWAKPMLDSFIFLGGSGATLGLILAIFIASRRADYRQVAKLALPSGIFQINEPILFGLPIIMNPVMFIPFVLVQPILAAITLAAYYMGIIPPVTNIAPWTMPTGLGAFFNTNGSVAALLVALFNLGIATLIYLPFVVVANKAQNAIDKEESEEDIANALKF

SEQ ID NO: 4237 - DNA, 321 bp, Escherichia coli
atggaaaagaaacacatttatctgttttgttctgcgggcatgtctacctctttactggtatcaaaaatgcgcgcacaggcagaaaaatatgaagttccggtcattattgaagcatttccggaaacactggctggtgaaaaaggtcagaatgccgatgtcgtgttattagggccgcagattgcttatatgttgcccgaaatccagcgtttgttacccaacaaaccggttgaagtaattgactcgctgctttatggcaaagtcgatggtttaggcgtgcttaaggctgcggttgcagcgattaaaaaagccgcagcaaattaa

SEQ ID NO: 4238 - protein, 106 aa, Escherichia coli
MEKKHIYLFCSAGMSTSLLVSKMRAQAEKYEVPVIIEAFPETLAGEKGQNADVVLLGPQIAYMLPEIQRLLPNKPVEVIDSLLYGKVDGLGVLKAAVAAIKKAAAN

SEQ ID NO: 4239 - DNA, 339 bp, Escherichia coli
atgaacaagaatatggcaggaattctgagtgcagcggcggtattaaccatgctggcgggttgtacggcttatgatcgtaccaaagaccagtttgtacagcctgtggtgaaagacgtcaaaaaaggcatgagccgggcgcaggttgcacaaattgcgggtaaaccttcgtctgaagtgagcatgatccatgctcgtggtacttgccagacctacatcctgggtcaacgtgatggtaaagcagaaacctactttgtcgcgttagatgataccggacatgtcatcaactccggttatcagacctgtgctgaatacgacactgatccacaggctacgaagtaa

SEQ ID NO: 4240 - protein, 112 aa, Escherichia coli
MNKNMAGILSAAAVLTMLAGCTAYDRTKDQFVQPVVKDVKKGMSRAQVAQIAGKPSSEVSMIHARGTCQTYILGQRDGKAETYFVALDDTGHVINSGYQTCAEYDTDPQATK

SEQ ID NO: 4241 - DNA, 828 bp, Escherichia coli
atgacattgcaacaacaaataataaaggtgctgggcgcaaaaccgcagattaatgctgaagaggaaattcgtcgtagtatcgattttctgaaaagctacctgcaaacttatccgttcattaaatcactggtgctcgggatcagcggtggtcaggactccacgcttgccggtaagctgtgccagatggcgattaatgagctgcgccaggaaaccggcaacgaatcactgcaatttattgccgtacgcctgccctatggtgtccaggccgacgaacaagattgccaggatgccatcgcctttattcaaccggatcgcgtattaaccgttaatatcaagggcgcggtactcgccagcgagcaggcattgcgggaagcaggcattgaactgagcgattttgtccgtggcaatgaaaaagcgcgtgagcggatgaaagcacaatatagcattgcgggtatgaccagcggtgtcgtggtgggcaccgatcatgctgcagaagctattaccggattcttcactaaatatggtgacggcggtacggacattaatccgctgtatcgtctcaacaaacgtcagggtaaacagttactggcggcattaggttgcccggaacacctttataagaaagcgccaacggccgatcttgaagatgatcgcccttctctgccggatgaagtggcactcggcgtgacctatgacaatatcgacgactatctggaagggaaaaacgtacctgaacaggtcgccagaacaatagagaactggtatctgaaaaccgaacataaacgccgtccgccaattaccgttttcgatgatttctggaaaaagtaa

SEQ ID NO: 4242 - protein, 275 aa, Escherichia coli
MTLQQQIIKVLGAKPQINAEEEIRRSIDFLKSYLQTYPFIKSLVLGISGGQDSTLAGKLCQMAINELRQETGNESLQFIAVRLPYGVQADEQDCQDAIAFIQPDRVLTVNIKGAVLASEQALREAGIELSDFVRGNEKARERMKAQYSIAGMTSGVVVGTDHAAEAITGFFTKYGDGGTDINPLYRLNKRQGKQLLAALGCPEHLYKKAPTADLEDDRPSLPDEVALGVTYDNIDDYLEGKNVPEQVARTIENWYLKTEHKRRPPITVFDDFWKK

SEQ ID NO: 4243 - DNA, 576 bp, Escherichia coli
atggaatactttgatatgcgtaaaatgtcggtgaatctgtggcgaaacgctgccggtgaaacgcgcgaaatttgcactttcccaccggcaaaacgtgatttttactggcgtgccagcattacatccatcgcggcgaatggggagttttctttgtttcccggtatggaaaggatagtgacgttgctggaaggcggcgagatgttccttgaaagcgcagaccgctttaaccataccttaaaaccgttacaacctttttcctttgcagcggacctggtggtaaaagcgaaactgacggcagggcagatgtcgatggatttcaacatcatgacacgcctggatgtctgtaaggcgaaagtcagaattgccgaacgtacgtttactacctttggttcacgcggcggggtggtgtttgtaataaacggggcgtggcaattgggcgacaaactgctcactaccgaccagggcgcgtgctggttcgatggcaggcacaccctgcggcttttgcaaccgcaaggtaaactgttgttcagtgaaatcaactggcttgctggtcattcaccggatcaagttcagtaa

SEQ ID NO: 4244 - protein, 191 aa, Escherichia coli
MEYFDMRKMSVNLWRNAAGETREICTFPPAKRDFYWRASITSIAANGEFSLFPGMERIVTLLEGGEMFLESADRFNHTLKPLQPFSFAADLVVKAKLTAGQMSMDFNIMTRLDVCKAKVRIAERTFTTFGSRGGVVFVINGAWQLGDKLLTTDQGACWFDGRHTLRLLQPQGKLLFSEINWLAGHSPDQVQ

SEQ ID NO: 4245 - DNA, 888 bp, Escherichia coli
gtggtacggcgtttaacttctccgcggctcgaatttgaagctgcggcaatttatgaatatcccgaacatttacgttcattccttaatgacttacccacccgacctggggtgtatctgtttcatggcgaaagtgacaccatgccgctctatatcggcaaaagcattaacatccgcagccgcgtcctttctcatttacgtaccccggatgaagccgccatgctacggcaatcccgacgcatcagctggatatgtaccgccggtgaaatcggcgctctgctccttgaagcgcgattaatcaaagaacaacagccactgtttaataaacgcttgcggcgcaatcgccagctctgtgccctgcaattaaatgaaaagcgcgtcgatgtggtgtatgccaaagaggtggatttttcacgagcccccaacctgtttggcctgtttgccaataggcgcgcagctttgcaagcattacagaccatcgctgatgaacaaaaactttgttatggcctgttgggactggagccgttaagtcgcggtcgtgcatgttttcgttcagcgctaaaacgttgcgccggagcatgctgcggtaaagagagccatgacgatcatgcgctacgtttgcgccagtctctggaacgtttacgagtcgtttgttggccgtggaaaggtgcggtagcgctgaaagaacagcacccggaaatgactcaatatcatattattcaaaactggctgtggctgggggcggttaattcgctgaaagaagcgacaacgttaattcgggcacccgccgggtttgatcacgacggttataaaattctttgtaagccgctgctttccggtaactatgaaattactgaacttgatccggtgaatgaccagcaagccagttga

SEQ ID NO: 4246 - protein, 295 aa, Escherichia coli
MVRRLTSPRLEFEAAAIYEYPEHLRSFLNDLPTRPGVYLFHGESDTMPLYIGKSINIRSRVLSHLRTPDEAAMLRQSRRISWICTAGEIGALLLEARLIKEQQPLFNKRLRRNRQLCALQLNEKRVDVVYAKEVDFSRAPNLFGLFANRRAALQALQTIADEQKLCYGLLGLEPLSRGRACFRSALKRCAGACCGKESHDDHALRLRQSLERLRVVCWPWKGAVALKEQHPEMTQYHIIQNWLWLGAVNSLKEATTLIRAPAGFDHDGYKILCKPLLSGNYEITELDPVNDQQAS

SEQ ID NO: 4247 - DNA, 486 bp, Escherichia coli
atgcgtaaattaactgcactgtttgttgcctctaccctggctcttggcgcggctaacctggcccatgccgcagacaccactaccgcagcaccggctgacgcgaagccgatgatgcaccataaaggcaagttcggtccgcatgaggacatgatgttcaaagacctgaacctgaccgacgcgcagaaacagcagatccgcgaaatcatcaaaggccagcgtgaccagatgaaacgtccgccgctggaagaacgccgcgcaatgcatgacatcattgccagcgataccttcgataaagcaaaagctgaagcgcagatcgcaaaaatggaagaacagcgcaaagctaacatgctggcgcacatggaaacccagaacaagatttacaacatcctgacgccggaacagaaaaagcaatttaatgctaattttgagaagcgtctgacagaacgtccagcggcaaaaggtaaaatgcctgcaactgctgaataa

SEQ ID NO: 4248 - protein, 161 aa, Escherichia coli
MRKLTALFVASTLALGAANLAHAADTTTAAPADAKPMMHHKGKFGPHEDMMFKDLNLTDAQKQQIREIIKGQRDQMKRPPLEERRAMHDIIASDTFDKAKAEAQIAKMEEQRKANMLAHMETQNKIYNILTPEQKKQFNANFEKRLTERPAAKGKMPATAE

SEQ ID NO: 4249 - DNA, 489 bp, Escherichia coli
ttggctgaaagattattcagcagttgcaggcattttaccttttgccgctggacgttctgtcagacgcttctcaaaattagcattaaattgctttttctgttccggcgtcaggatgttgtaaatcttgttctgggtttccatgtgcgccagcatgttagctttgcgctgttcttccatttttgcgatctgcgcttcagcttttgctttatcgaaggtatcgctggcaatgatgtcatgcattgcgcggcgttcttccagcggcggacgtttcatctggtcacgctggcctttgatgatttcgcggatctgctgtttctgcgcgtcggtcaggttcaggtctttgaacatcatgtcctcatgcggaccgaacttgcctttatggtgcatcatcggcttcgcgtcagccggtgctgcggtagtggtgtctgcggcatgggccaggttagccgcgccaagagccagggtagaggcaacaaacagtgcagttaa

SEQ ID NO: 4250 - protein, 162 aa, Escherichia coli
MAERLFSSCRHFTFCRWTFCQTLLKISIKLLFLFRRQDVVNLVLGFHVRQHVSFALFFHFCDLRFSFCFIEGIAGNDVMHCAAFFQRRTFHLVTLAFDDFADLLFLRVGQVQVFEHHVLMRTELAFMVHHRLRVSRCCGSGVCGMGQVSRAKSQGRGNKQCS

SEQ ID NO: 4251 - DNA, 969 bp, Escherichia coli
atggataattttcttgctctaaccttaacgggtaaaaaaccggtcatcaccgagcgagaaatcaacggcgttcgctggcgctggctgggcgatggtgtgctggaactgacgccattaacgccaccgcaaggcgtgctggtgatttcagcggggatccacggtaatgagacggcacctgtggaaatgctggacgcgttgcttggcgcgatatctcacggtgagatcccgttacgttggcggttactggtgatcctcgggaatcctcctgcgctgaagcaagggaaacgttattgccatagcgatatgaatcgaatgtttggcggtcgttggcaactgtttgctgaaagcggggaaacctgtcgggcgcgcgaactggagcagtgcctggaagatttttatgaccagggcaaagaatctgtgcgctggcaccttgatctacataccgcaattcgtggctccttgcatccgcagttcggtgtattaccgcaacgcgacattccctgggacgagaaatttctgacgtggctgggtgcggcggggctggaggcgctggtgttccatcaggagcctggtggtacgtttacccatttcagcgccagacattttggcgcgctggcctgtacgctggaacttggcaaagcgttgccctttgggcaaaacgatcttcgccagtttgcagtaactgccagcgcaattgctgcgctgctatctggtgagagtgtcggtatcgtgagaacaccgccgctccgttatcgggtggtttcgcaaattactcgccactcgccgtccttcgaaatgcatatggcaaatgacacgctgaattttatgccgtttgagaaaggaacattgctggcgcaggacggggaggaacgttttaccgtaacccatgatgtagagtatgtgttattccctaatccgttggtagcgttgggattacgtgcgggattaatgctcgaaaaaataagctaa

SEQ ID NO: 4252 - protein, 322 aa, Escherichia coli
MDNFLALTLTGKKPVITEREINGVRWRWLGDGVLELTPLTPPQGVLVISAGIHGNETAPVEMLDALLGAISHGEIPLRWRLLVILGNPPALKQGKRYCHSDMNRMFGGRWQLFAESGETCRARELEQCLEDFYDQGKESVRWHLDLHTAIRGSLHPQFGVLPQRDIPWDEKFLTWLGAAGLEALVFHQEPGGTFTHFSARHFGALACTLELGKALPFGQNDLRQFAVTASAIAALLSGESVGIVRTPPLRYRVVSQITRHSPSFEMHMANDTLNFMPFEKGTLLAQDGEERFTVTHDVEYVLFPNPLVALGLRAGLMLEKIS

SEQ ID NO: 4253 - DNA, 1344 bp, Escherichia coli
atgaacgcctgggaagtcaatttcgacgggctggtagggctgacgcaccattacgcgggcctgtcgtttggtaatgaagcctctacccgtcaccgttttcaggtgtctaacccgcgactggcggcaaaacagggcttactgaaaatgaaaaaacttgccgatgcgggattcccccaggccgtgatcccgccgcacgagcgtccgtttattccggtgctgcgtcagttgggattcaggggtagcgatgagcaggtactggaaaaagttgcacgccaggcaccgcactggctttccagcgtcagttccgcttcgccaatgtgggtagccaatgcggcaacgatcgcgccatccgccgatacgctggatggcaaagtgcatctcactgttgctaacctgaacaataaatttcaccgttcgctggaagcccccgtcaccgaatcgctgttaaaagcgatttttaacgacgaagagaaatttagcgtccattcggcgttgccgcaggtagccttgctcggtgatgagggggcggcaaaccacaatcgtctcggcggtcattacggtgaaccgggtatgcaactttttgtctacgggcgagaagagggcaatgatacccggccttcccgttatccggcgcggcagacccgtgaagccagcgaggcggtggcaaggctgaatcaggtgaatccacagcaggtgattttcgcccagcaaaaccccgacgttatcgaccagggcgtttttcataatgatgtgattgccgtgagtaaccgccaggtgctgttttgccatcaacaggcgttcgctcgccagtcacagttactggcaaacctgcgtgcgcgggtcaatggttttatggcgatagaagttccggcgactcaggttttcgtgtcggatgcggtatctacgtatctgtttaacagccaactgctgagccgcgatgatggttccatggtgttggtgctgccgcaggagtgtcgggaacacgccggagtatggcgttatctcaacgaattgcttgctgctgacaacccgattagcgaactaaaagtctttgatttacgtgaaagcatggcgaatggtggtggcccggcgtgcctgcggttgcgcgtggtgttgacagaagaagaacgccgggcggtgaatccggcagtgatgatgaacgatacgctgtttaatgcgctcaatgactgggtggatcgttactaccgcgatcgtcttactgcggcggatcttgccgatccacaattgctgcgcgaaggaagggaagcgctggatacactgactcaattattggatcttggttcggtttatccattccagcgcgagggagggggcaatggataa

SEQ ID NO: 4254 - protein, 447 aa, Escherichia coli
MNAWEVNFDGLVGLTHHYAGLSFGNEASTRHRFQVSNPRLAAKQGLLKMKKLADAGFPQAVIPPHERPFIPVLRQLGFRGSDEQVLEKVARQAPHWLSSVSSASPMWVANAATIAPSADTLDGKVHLTVANLNNKFHRSLEAPVTESLLKAIFNDEEKFSVHSALPQVALLGDEGAANHNRLGGHYGEPGMQLFVYGREEGNDTRPSRYPARQTREASEAVARLNQVNPQQVIFAQQNPDVIDQGVFHNDVIAVSNRQVLFCHQQAFARQSQLLANLRARVNGFMAIEVPATQVFVSDAVSTYLFNSQLLSRDDGSMVLVLPQECREHAGVWRYLNELLAADNPISELKVFDLRESMANGGGPACLRLRVVLTEEERRAVNPAVMMNDTLFNALNDWVDRYYRDRLTAADLADPQLLREGREALDTLTQLLDLGSVYPFQREGGGNG

SEQ ID NO: 4255 - DNA, 1479 bp, Escherichia coli
atgactttatggatcaacggtgactgggtaacgggccagggcgcattgcgtgtgaagcgtaatccggtatcgggcgaggtgttatggcagggcaatgatgccgatgccgctcaggtcgggcaggcttgtcgggctgcccgtgcggcgtttccgcgctgggctcggctctcatttggcgatcgtcaggtaagagttgaacgctttgctggattgctggaaagcaataaagccgaattaaccgcgattattgccagagaaaccggcaagccgcgctgggaagcggcaaccgaagtgacggcgatgatcaataaaatcgcgatatcaattaaggcgtatcacgttcgtaccggtgagcagcgtagcgaaatgccggacggcgcggcgagcctgcgacatcgcccgcacggcgtgctggcggtgtttgggccgtataatttccctggtcatttgccgaacggacatatcgttccggcattgctggcaggtaacaccattatctttaaacccagcgaactgacaccgtggagtggcgacgcggtaatgcgtttatggcagcaggctggcttgccgccgggcgtgctgaacctggtgcagggcgggcgtgaaacgggtcaggcgctgagtgcgctggaggatctcgacggcttgctgtttaccggcagcgccaataccggctaccagctgcatcgccagctttccggtcagccggagaaaattctcgcccttgagatgggcggtaataacccgctaattatcgatgaggtggcggatatcgatgccgctgtccatctgaccattcagtcggcgtttgtcactgccgggcaacgctgcacctgcgcccgccgtttatttctgaaaagtggaacgcagggcgatgcatttcttgctcgcctggttgccgtcagccagcggttaacgccgggcacttgggatgacgaaccgcagccatttattggtgggctgatttctgagcaggccgcacagcaggtggttactgcctggcaggaactggaggcgatgggcggacggaccctgcttgcgccgcgcttattacaagcagggacatcgttgctgacgccggggatcattgaaatgacaggcgttactggcttgccggatgaagaagtgtttgggccgttattgcgcgtctggcgttatgacaatttcgatgaagcgattcgaatggcgaataacactcgctttggcctctcttgcggtctggtttcccccgagcgggaaaaattcgatcaactgttgctggaggcacgggcggggattgttaactggaacaaaccgcttaccggtgctgccagtaccgcgccattcggcggcattggcgcttccggcaatcatcgccccagcgcctggtatgccgcagattattgtgcctggccgatggcaagtctggagtcggactcgttaacgttgcccgcaacgcttaaccccgggctggatttttccgatgaggtggtgcgatga

SEQ ID NO: 4256 - protein, 492 aa, Escherichia coli
MTLWINGDWVTGQGALRVKRNPVSGEVLWQGNDADAAQVGQACRAARAAFPRWARLSFGDRQVRVERFAGLLESNKAELTAIIARETGKPRWEAATEVTAMINKIAISIKAYHVRTGEQRSEMPDGAASLRHRPHGVLAVFGPYNFPGHLPNGHIVPALLAGNTIIFKPSELTPWSGDAVMRLWQQAGLPPGVLNLVQGGRETGQALSALEDLDGLLFTGSANTGYQLHRQLSGQPEKILALEMGGNNPLIIDEVADIDAAVHLTIQSAFVTAGQRCTCARRLFLKSGTQGDAFLARLVAVSQRLTPGTWDDEPQPFIGGLISEQAAQQVVTAWQELEAMGGRTLLAPRLLQAGTSLLTPGIIEMTGVTGLPDEEVFGPLLRVWRYDNFDEAIRMANNTRFGLSCGLVSPEREKFDQLLLEARAGIVNWNKPLTGAASTAPFGGIGASGNHRPSAWYAADYCAWPMASLESDSLTLPATLNPGLDFSDEVVR

SEQ ID NO: 4257 - DNA, 1035 bp, Escherichia coli
atgatggtcattcgtcccgttgagcgctcagatgtctcggcgctgatgcagcttgccagcaaaacgggcggcggcctgacgtcgcttcccgccaatgaagccacgctttcggtgcgtattgaaagggcaatcaaaacctggcaaggcgaactgcccaaaagtgagcagggttatgtgtttgtactggaagatagtgagacaggcactgtggcggggatttgcgccattgaggtggcggttgggctgaacgatccctggtacaactatcgcgtcggcacgctggttcacgcttcgaaagagctgaatgtctataacgcattgccgacgctgtttctcagtaacgatcacaccggcagcagcgagctgtgcacgctgtttctcgacccgaagtggcgcaaagagggcaacggctatttgctgtcgaaatcgcgctttatgtttatggcggcttttcgcgacaagtttaatgacaaagtggtcgccgaaatgcgcggggtgattgacgaacacggctattcaccgttctggcaaagcctcggtaaacgcttcttttcgatggattttagccgcgctgattttctctgcggcaccgggcaaaaggcatttattgcagaactgatgccgaaacatccgatctatacctactttttatcccaggaagcccaggacgtcatcggtcaggtacatccgcaaaccgcgcctgcccgtgcggtgctggagaaagaaggttttcgctaccgtaactatatcgacatctttgacggcgggccgacacttgaatgtgatatcgaccgcgtgcgcgccatccgtaaaagtcggctggtggaagtggccgaagggcagcctgcgcagggcgattttccggcctgcctggtcgccaatgaaaattatcaccatttccgcgtggtgctggtgcgtaccgatccagcgaccgagcgtttgattttaaccgccgcacaactggatgtcctcaaatgccacgcaggggatcgcgttcgtctggtgcgcctgtgcgcagaggagaaaacagcatga

SEQ ID NO: 4258 - protein, 344 aa, Escherichia coli
MMVIRPVERSDVSALMQLASKTGGGLTSLPANEATLSVRIERAIKTWQGELPKSEQGYVFVLEDSETGTVAGICAIEVAVGLNDPWYNYRVGTLVHASKELNVYNALPTLFLSNDHTGSSELCTLFLDPKWRKEGNGYLLSKSRFMFMAAFRDKFNDKVVAEMRGVIDEHGYSPFWQSLGKRFFSMDFSRADFLCGTGQKAFIAELMPKHPIYTYFLSQEAQDVIGQVHPQTAPARAVLEKEGFRYRNYIDIFDGGPTLECDIDRVRAIRKSRLVEVAEGQPAQGDFPACLVANENYHHFRVVLVRTDPATERLILTAAQLDVLKCHAGDRVRLVRLCAEEKTA

SEQ ID NO: 4259 - DNA, 1221 bp, Escherichia coli
atgtctcagccaattacgcgtgaaaactttgatgaatggatgatacctgtttacgctccggcaccgtttataccggtacgtggcgaaggttcacgcttgtgggatcagcaggggaaagagtatatcgacttcgcgggtggcattgcggtgaacgcgctgggccatgcgcatccggaactgcgtgaggcgctgaacgaacaggcgagtaagttctggcataccggcaacggttacaccaacgagccggtactgcgactggcgaaaaaattgatcgacgccacgtttgccgatcgcgtcttcttttgtaactccggtgcggaagccaacgaagcggcactaaaactggcgcgtaaattcgctcacgaccgctacggcagccataagagcggcatcgtggcgttcaaaaatgcgtttcatggtcgcacgctgtttactgtcagtgcgggtgggcagccagcctattcacaggattttgcgccactgccgccggatattcgtcatgctgcatataacgatattaactctgccagtgcgctgattgacgacgccacctgtgcggtgattgtcgaacccatccagggggaaggcggtgtggtgccagccagcaacgcatttttacaaggtctgcgtgaattgtgtgaccgccacaatgcgttgctgatctttgatgaagtacaaaccggtgtcgggcgcaccggggaactgtatgcctgtatgcactacggcgtgacgcctgatctgttaactaccgccaaagcgctgggcggcggtttcccggttggtgcgttgttggcaaccgaagagtgcgccagcgtgatgaccgttggcactcacggcaccacctatggcggcaatccgctggcctcggcggtggcaggcaaagtgctggatctcatcaacacgccagagatgcttaacggggttaaacagcgtcacgactggtttgttgagcgtctaaattccattaatcaccactacagtttgttcagtgaagttcgcggcttaggtcttttgattggctgtgtactgaatgccgattacgccgggcaagcgaaacagatctctcaggaagcggtgaaagcaggcgtgatggtgctgattgcgggtggcaacgtggtgcgctttgcgcctgcgctcaatgtcagcgaagaagaggtgacgaccggactggatcgctttgcagctgcttgcgaacactttgttagccgaggttcatcatga

SEQ ID NO: 4260 - protein, 406 aa, Escherichia coli
MSQPITRENFDEWMIPVYAPAPFIPVRGEGSRLWDQQGKEYIDFAGGIAVNALGHAHPELREALNEQASKFWHTGNGYTNEPVLRLAKKLIDATFADRVFFCNSGAEANEAALKLARKFAHDRYGSHKSGIVAFKNAFHGRTLFTVSAGGQPAYSQDFAPLPPDIRHAAYNDINSASALIDDATCAVIVEPIQGEGGVVPASNAFLQGLRELCDRHNALLIFDEVQTGVGRTGELYACMHYGVTPDLLTTAKALGGGFPVGALLATEECASVMTVGTHGTTYGGNPLASAVAGKVLDLINTPEMLNGVKQRHDWFVERLNSINHHYSLFSEVRGLGLLIGCVLNADYAGQAKQISQEAVKAGVMVLIAGGNVVRFAPALNVSEEEVTTGLDRFAAACEHFVSRGSS

SEQ ID NO: 4261 - DNA, 807 bp, Escherichia coli
atgaaatttgtctcttttaatatcaacggcctgcgcgccagacctcaccagcttgaagccatcgtcgaaaagcaccaaccggatgtgattggcctgcaggagacaaaagttcatgacgatatgtttccgctcgaagaggtggcgaagctcggctacaacgtgttttatcacgggcagaaaggccattatggcgtggcgctgctgaccaaagagacgccgattgccgtgcgtcgcggctttcctggtgacgacgaagaagcgcaacggcggattattatggcggaaatcccctcgccgctgggcaatgtcaccgtgatcaacggttacttcccgcagggtgaaagccgcgaccatccgataaaattcccggcaaaggcgcagttttatcagaatctgcaaaactacctggaaaccgaactcaagcgtgaaaatccggtgctgattatgggcgatatgaatatcagtcctggcgacctggatattggcattggcgaagagaaccgtaagcgctggctgcgtaccggaaaatgttctttccttccggaggaacgcgaatggatggagaggctgatgagctgggggttggtcgataccttccgccatgcgaatccgcaaacagcagatcgtttctcatggtttgattaccgctcaaaaggttttgacgataatcgcggtctgcgcatcgacctgctgctcgccagccaaccgctggcagaatgttgcgtagaaaccggcatcgactatgaaattcgcagcatggaaaaaccgtccgatcacgcccccgtctgggcgaccttccgccgctaa

SEQ ID NO: 4262 - protein, 268 aa, Escherichia coli
MKFVSFNINGLRARPHQLEAIVEKHQPDVIGLQETKVHDDMFPLEEVAKLGYNVFYHGQKGHYGVALLTKETPIAVRRGFPGDDEEAQRRIIMAEIPSPLGNVTVINGYFPQGESRDHPIKFPAKAQFYQNLQNYLETELKRENPVLIMGDMNISPGDLDIGIGEENRKRWLRTGKCSFLPEEREWMERLMSWGLVDTFRHANPQTADRFSWFDYRSKGFDDNRGLRIDLLLASQPLAECCVETGIDYEIRSMEKPSDHAPVWATFRR

SEQ ID NO: 4263 - DNA, 711 bp, Escherichia coli
atgaacgctgagcgtaaatttcttttagcctgtcttatttttgcgctggtcatttacgctatccacgctttcggtttattcgatctgctcaccgatttaccccacttacagacactcattcgccagagcggattgttcggctatagcctctatattctgttattcatcattgccaccctctttctgttaccaggaagcatactggtgatcgcgggaggaatagtttttggcccgctcttagggacactactatcattaattgccgccacgctggcctcctcgtgctcattcctgctggcgcgctggctgggacgtgatttactgctgaaatacgttggccatagccataccttccaggccattgaaaaaggcattgcgcgtaacggtattgattttcttattctgacccgcttaatcccgttgtttccttacaatattcaaaattacgcttacggattaaccacaatcgccttctggccttatacccttatttcggcactcacgaccctacccggtattgttatttataccgtgatggcaagcgatctcgccaatgaaggcattacgctgcgctttattttacaactctgtctggcgggcctggcgctgtttattctcgtccagctcgcaaaactctacgcccgacacaaacatgtggatctgtctgcttctcgccgcagcccactttctcacccaaaaaatgaaggatag

SEQ ID NO: 4264 - protein, 236 aa, Escherichia coli
MNAERKFLLACLIFALVIYAIHAFGLFDLLTDLPHLQTLIRQSGLFGYSLYILLFIIATLFLLPGSILVIAGGIVFGPLLGTLLSLIAATLASSCSFLLARWLGRDLLLKYVGHSHTFQAIEKGIARNGIDFLILTRLIPLFPYNIQNYAYGLTTIAFWPYTLISALTTLPGIVIYTVMASDLANEGITLRFILQLCLAGLALFILVQLAKLYARHKHVDLSASRRSPLSHPKNEG

SEQ ID NO: 4265 - DNA, 741 bp, Escherichia coli
atgtggatctgtctgcttctcgccgcagcccactttctcacccaaaaaatgaaggatagaacgatgttgcaacattattcagtgtcatggaaaaaaggactggctgcactctgcttactggctgttgctgggcttagcggctgcgatcaaaaagagaatgcggctgcaaaagtggaatacgacggactttcgaacagccaaccgctgcgtgtcgatgccaataaccatacggtaaccatgctggtgcaaattaatggtcgtttcctcaccgatgacactcgtcacggtattgtgtttaaagatggctccaacggacataaatcgctgtttatgggttatgcgaccccgaaagcattttatgaagccctgaaagaggcaggtggtacgccgggcgaaaacatgacgatggataataaagaaacgactcatgtcacaggcagcaaactggatatttcggtcaactggcaaggggcggcaaaagcgtattccttcgatgaagtgattgttgacagtaatggcaagaaactggacatgcgctttggcggtaatttaacggcagcagaagagaagaaaacgggttgcctggtgtgtctggatagctgcccggtcggcatcgtcagcaatgcaacatacacttatggtgcggtggaaaaacgcggcgaagtgaaattcaaaggcaatgcctcagttctcccggcggataacacgccggcaacggttacctttaaaatcaccgaataa

SEQ ID NO: 4266 - protein, 246 aa, Escherichia coli
MWICLLLAAAHFLTQKMKDRTMLQHYSVSWKKGLAALCLLAVAGLSGCDQKENAAAKVEYDGLSNSQPLRVDANNHTVTMLVQINGRFLTDDTRHGIVFKDGSNGHKSLFMGYATPKAFYEALKEAGGTPGENMTMDNKETTHVTGSKLDISVNWQGAAKAYSFDEVIVDSNGKKLDMRFGGNLTAAEEKKTGCLVCLDSCPVGIVSNATYTYGAVEKRGEVKFKGNASVLPADNTPATVTFKITE

SEQ ID NO: 4267 - DNA, 708 bp, Escherichia coli
atgatgaagatgcaatcgcgtaaaatctggtactaccgtataaccctcatcatcctgttgttcgctgtgctgctggcatgggcgctgcttcccggcgtccatgagtttatcaatcgcagcgttgcggcgtttgccgccgtggaccaacagggtatagaacgctttattcagtcttacggcgcactagcggcagttgtctcgttcttgttgatgattttacaggccattgctgcaccgctacctgcgtttttgatcacctttgccaatgcgtcgctgtttggtgcgttctggggcggcttactgtcgtggaccagttcgatggccggcgcggcactgtgcttttttatcgccagagtgatgggccgcgaagtggtggaaaaattaaccggcaaaaccgtacttgacagtatggacggctttttcactcgctacggcaaacacaccatcctggtatgtcggttattgccttttgtccctttcgatccaatcagctatgctgccggtttgacttcaatacgttttcgctcgttttttatcgccaccgggcttggtcaattaccggcgactattgtttattcctgggcgggcagcatgttaacaggcggtactttctggtttgtcaccggactgtttattctgtttgccctgaccgtggtgatttttatggcgaagaaaatatggcttgagcgccagaagaggaatgcctga

SEQ ID NO: 4268 - protein, 235 aa, Escherichia coli
MMKMQSRKIWYYRITLIILLFAVLLAWALLPGVHEFINRSVAAFAAVDQQGIERFIQSYGALAAVVSFLLMILQAIAAPLPAFLITFANASLFGAFWGGLLSWTSSMAGAALCFFIARVMGREVVEKLTGKTVLDSMDGFFTRYGKHTILVCRLLPFVPFDPISYAAGLTSIRFRSFFIATGLGQLPATIVYSWAGSMLTGGTFWFVTGLFILFALTVVIFMAKKIWLERQKRNA

SEQ ID NO: 4269 - DNA, 549 bp, Escherichia coli
atgggtttaccgccgcttagcaaaattcctttcattttacgtccgcagacgtggctgcatcgtcgccattacggcgaggtgctaagcccgattcgctggtgggggcggatcccgtttatcttttatctggtgtcgatgtttgtcggctggctggagcgcaaacgctcaccgctcgatccggtagtacgatcgcttgtcagcgcgcgcattgcgcaaatgtgcctgtgtgagttttgcgtggatatcaccagtatgaaagtcgccgagcgtaccggcagcaccgataaactgctggcagtggctgactggcggcaaagcccgctctttagcgatgaagaacggctggcgctggagtacgccgaagccgcaagcgtaacgccgccaacggtcgatgatgccctgcgcgcccgactggctacgcattttgacgctcaggcgctcaccgaactgacggcattgataggcctgcaaaatctgtcagcccgttttaattctgccatggacattcccgctcaggggctgtgccgtattcctgaaaaacgttcttaa

SEQ ID NO: 4270 - protein, 182 aa, Escherichia coli
MGLPPLSKIPFILRPQTWLHRRHYGEVLSPIRWWGRIPFIFYLVSMFVGWLERKRSPLDPVVRSLVSARIAQMCLCEFCVDITSMKVAERTGSTDKLLAVADWRQSPLFSDEERLALEYAEAASVTPPTVDDALRARLATHFDAQALTELTALIGLQNLSARFNSAMDIPAQGLCRIPEKRS

SEQ ID NO: 4271 - DNA, 1167 bp, Escherichia coli
atgcgccattgtgggtggttgctgggattgttatcgctgttttctttggcaacacatgccagtgactggcaggaaataaaaaatgaggccaaaggacaaaccgtatggtttaacgcctggggcggcgataccgcaattaaccgctatctcgactgggttagcggcgagatgaaaacccattacgctataaacctgaagattgttcgtctcgcggatgccgcagacgcggtgaaacgcattcagaccgaagttgctgccggacgtaaaacgggcggttcggtggatctgctctgggtgaacggcgaaaacttccgcaccttaaaagaggccaatttattacaaacgggctgggcggagactctgcccaactggcgctatgtcgacacacagcttccggtgcgggaagatttttcagtgcctacagaaggggctgaatcgccctggggcggcgcacaactgacgtttatcgcccgccgcgatgttacgccacagccaccacaaacgccgcaagccttactggagtttgctaaagccaatcccggcacggttacctatccccgcccaccggactttaccggcacggcgtttcttgaacagttgctgattatgctaacgccagatcccacagcattaaaagaagcgccggacgatgcgactttcgcccgcgtcactgcgcccttgtggcaatatcttgatgcactgcatccgtatttatggcgcgaaggaaaggatttcccgccttcgcccgcgcggatggatgctctgctgaaagctaacacattgcgcctgtcgctgacctttaaccctgcacatgcgcagcaaaaaatcgccagcggcgatttgcctgcaagcagttacagttttggttttcgcgaggggatgattggcaacgtccatttcgtcaccattcctgccaacgcgaatgccagtgctgcggcgaaggtagttgccaatttcctgctctcacccgatgcgcaactgcgtaaagcagatcccgctgtctggggcgatccttctgttctcgatccgcaaaaactgcctgacgggcagcgcgaatcattgcaatcgagaatgccgcaggatctgccgcctgtactggctgaaccgcacgcaggttgggtaaatgcgctggaacaagaatggctacaccgttacagtacgcattaa

SEQ ID NO: 4272 - protein, 388 aa, Escherichia coli
MRHCGWLLGLLSLFSLATHASDWQEIKNEAKGQTVWFNAWGGDTAINRYLDWVSGEMKTHYAINLKIVRLADAADAVKRIQTEVAAGRKTGGSVDLLWVNGENFRTLKEANLLQTGWAETLPNWRYVDTQLPVREDFSVPTEGAESPWGGAQLTFIARRDVTPQPPQTPQALLEFAKANPGTVTYPRPPDFTGTAFLEQLLIMLTPDPTALKEAPDDATFARVTAPLWQYLDALHPYLWREGKDFPPSPARMDALLKANTLRLSLTFNPAHAQQKIASGDLPASSYSFGFREGMIGNVHFVTIPANANASAAAKVVANFLLSPDAQLRKADPAVWGDPSVLDPQKLPDGQRESLQSRMPQDLPPVLAEPHAGWVNALEQEWLHRYSTH

SEQ ID NO: 4273 - DNA, 1560 bp, Escherichia coli
ttgggtaaatgcgctggaacaagaatggctacaccgttacagtacgcattaatctttttgctgtgggcgatgatggcggtgatttatgcaccgctgatcccggcagctctgacgctgatatcgcctgctttgtcgttgacgcactggcaggcgttatttgccgatccacagttaccgcaggcattactggcaacgctggtgtcgacaaccattgcggcggtcggggcgttgttgattgccctgctggtgattgtggcgctgtggccagggccgaaatggcagcgtatgtgcgcccgtctgccgtggctgctcgccattccccatgtggcttttgccaccagcgcccttctgatctttgctgacggagggctgctttatgactatttcccgtatttcactccgccaatggacaaattgggtattgggctgggcctcaccctggcggtaaaagaaagcgcatttctgctgtggatcttagcggcagtattgagcgaaaaacggctgttgcagcaactcattgtgctggattcgctgggctacagccgctggcaatgcctgaactggctgctgttgccctccgtcgcgtctgcgttagcaatggcgatgctggcgattgtcgcctggtcgctgtcggtcgtggatgtggcgattattcttgggccaggtaatcccccgacgctggcggtaattagctggcagtggttaactcagggcgacgccgatcaacaaacgaaaggtgcactcgccagcctgctgctgatgctgttactcgccgcctacgttttgctgggctatctgctatggcgtggctggcgacgtactattccccgcgtagatggcgttcgtaagcctgccacgcctttattgccaggcaatacgctggcgagttttttacccttaaccggtgtgctgtgtgtggttctgctggcgatcctcgcggatcagtcgacgatcaatagtgaagcgctcatcaacagcctgacaatggggctggtggcggcattcatctctttgctcctgttactgctgtggctggaatgggggccacagcgtcgccagttgtggctatggttgcccattttattacccgctctgccgctggtggcgggccagtacacgctggcgctatggctgaacctggatggaagctggacggcggtggtctgggggcatctgctgtgggtaatgccgtggatgctgtttatcctgcaacccgcctggcagcgcattgattcacggttaattttgattgcgcaaacactgggctggtcgcgggccaaaatcttcttttacgtaaaatgtccacttatgttgcgccctgcgctgattgccttcgcggtgggattttcagtcagtattgcgcagtatatgccgacgctgtggctgggcgcggggcgttttccgacgctcaccactgaagcggtggcattaagcagcggcggcagcaacggtattctcgccgcccaggctttatggcaactgctgttaccgcttattatttttgccctgaccgcgttagtcgcaaaatgggtaggttatgtcagacaaggactccgctaa

SEQ ID NO: 4274 - protein, 519 aa, Escherichia coli
MGKCAGTRMATPLQYALIFLLWAMMAVIYAPLIPAALTLISPALSLTHWQALFADPQLPQALLATLVSTTIAAVGALLIALLVIVALWPGPKWQRMCARLPWLLAIPHVAFATSALLIFADGGLLYDYFPYFTPPMDKLGIGLGLTLAVKESAFLLWILAAVLSEKRLLQQLIVLDSLGYSRWQCLNWLLLPSVASALAMAMLAIVAWSLSVVDVAIILGPGNPPTLAVISWQWLTQGDADQQTKGALASLLLMLLLAAYVLLGYLLWRGWRRTIPRVDGVRKPATPLLPGNTLASFLPLTGVLCVVLLAILADQSTINSEALINSLTMGLVAAFISLLLLLLWLEWGPQRRQLWLWLPILLPALPLVAGQYTLALWLNLDGSWTAVVWGHLLWVMPWMLFILQPAWQRIDSRLILIAQTLGWSRAKIFFYVKCPLMLRPALIAFAVGFSVSIAQYMPTLWLGAGRFPTLTTEAVALSSGGSNGILAAQALWQLLLPLIIFALTALVAKWVGYVRQGLR

SEQ ID NO: 4275 - DNA, 687 bp, Escherichia coli
atgggtaggttatgtcagacaaggactccgctaatgctctgcgtgaaaaatgtttcgctacgtttaccagaaagccgcttgctgacaaacgttaactttacagtagataaaggtgacattgtcacgttaatgggaccatccggctgcgggaaatccactctgttttcgtggatgattggtgcgctggccggacagttttcttgtacaggggagctatggcttaatgagcaacggattgacatgctacccaccgcacagcgtcagattggcattcttttccaggatgcactgttatttgaccagttcagcgtcgggcaaaatttactgctggcgctaccggcgacacttaaggggaatgcccgacgtaatgccgtgaatgatgcacttgagcgttcaggccttgacggagcgttccatcaggatcctgccactttgtctggcggtcagcgagcgcgcgttgctctgctgcgcgcccttctcgctcagccaaaagcgttgctactggatgagcccttcagccgtcttgatgtggccctgcgcgataattttcgccattgggtgttcagcgaaattcgcgccatggcgatccctgttgtgcaggtgacgcacgatcttcaggatgttcctcctgatagccccgttctggatatggcgcagtggtcagaaaattacaacaaactgcgataa

SEQ ID NO: 4276 - protein, 228 aa, Escherichia coli
MGRLCQTRTPLMLCVKNVSLRLPESRLLTNVNFTVDKGDIVTLMGPSGCGKSTLFSWMIGALAGQFSCTGELWLNEQRIDMLPTAQRQIGILFQDALLFDQFSVGQNLLLALPATLKGNARRNAVNDALERSGLDGAFHQDPATLSGGQRARVALLRALLAQPKALLLDEPFSRLDVALRDNFRHWVFSEIRAMAIPVVQVTHDLQDVPPDSPVLDMAQWSENYNKLR

SEQ ID NO: 4277 - DNA, 1308 bp, Escherichia coli
atgaaacgtgtttctcaaatgaccgcgctggcaatggctttagggctggcttgcgcttcttcgtgggccgctgaactggcgaagcctcttacacttgaccagcttcaacaacaaaatggcaaagcgattgatactcgccccagcgcgttttataacggctggccacaaaccttaaatggcccttccggtcatgaacctgccgccttaaacctctctgctagctggctcgacaaaatgagcaccgaacagctcaacgagtggatcaagcaacataacctgaaagccgatgccccggtggcgctgtacggtaatgacaaagatgtcgacgccgtcaaaacgcgactgcaaaaagcaggttttacgcatatctccatcctgagtgacgcgctaagcgaaccttcccgtttgcaaaaactgccgcactttgaacagctggtatatccgcagtggctgcatgacctgcaacaaggtaaagaggttacggcgaaacctgccggtgactggaaagtcattgaagcggcctggggcgctccaaaattttaccttatcagccatattcccggcgctgactacatcgacaccaacgaagtggaaagcgaaccgctgtggaacaaagtttctgatgaacaactgaaagcgatgctggcaaaacacggtattcgccatgacaccacggtcattctgtacgggcgtgacgtatacgctgcagcgcgtgtggcgcaaattatgctttatgccggcgtgaaagatgtgcgcctgctggacggaggctggcaaacctggtccgacgcgggtctgcccgttgagcgcggaacgccaccgaaagtgaaagcggaaccggatttcggcgtgaagatcccggcacaaccgcaactgatgcttgatatggaacaagcgcgtggactgctgcatcgccaggatgcatcgctggtgagcattcgttcgtggccagaatttatcggtacgaccagcggttacagctatattaaaccaaaaggtgaaatagccggagcacgttggggacacgcaggtagcgactcgacgcatatggaagatttccataacccggatggcaccatgcgcagcgccgatgatattaccgccatgtggaaagcatggaatatcaaaccagatcagcaagtttcattctactgcggtactggctggcgcgcgtccgaaacctttatgtacgcacgcgcaatgggctggaataacgtctccgtttacgacggcggctggtacgaatggagcagcgatccaaaaaatccggtagcaaccggtgaacgcggcccggacagcagcaaataa

SEQ ID NO: 4278 - protein, 435 aa, Escherichia coli
MKRVSQMTALAMALGLACASSWAAELAKPLTLDQLQQQNGKAIDTRPSAFYNGWPQTLNGPSGHEPAALNLSASWLDKMSTEQLNEWIKQHNLKADAPVALYGNDKDVDAVKTRLQKAGFTHISILSDALSEPSRLQKLPHFEQLVYPQWLHDLQQGKEVTAKPAGDWKVIEAAWGAPKFYLISHIPGADYIDTNEVESEPLWNKVSDEQLKAMLAKHGIRHDTTVILYGRDVYAAARVAQIMLYAGVKDVRLLDGGWQTWSDAGLPVERGTPPKVKAEPDFGVKIPAQPQLMLDMEQARGLLHRQDASLVSIRSWPEFIGTTSGYSYIKPKGEIAGARWGHAGSDSTHMEDFHNPDGTMRSADDITAMWKAWNIKPDQQVSFYCGTGWRASETFMYARAMGWNNVSVYDGGWYEWSSDPKNPVATGERGPDSSK

SEQ ID NO: 4279 - DNA, 621 bp, Escherichia coli
gtgctagaccgccatcttcatccccggattaaaccgttgttgtatcagtgcgtgcgggttcttgataaaccgggcattacgccagatggtttaacattagtgggatttgctatcggcgtgctggcactgccgtttctggcgctgggctggtatctggcggcgctaatcgtcattttgttaaacaggctgcttgatggtctggacggtgcgctggcgcggcgcagagggcttaccgacgcgggcggctttctcgatatttctctcgattttcttttttacgcgctggtgccttttgggtttatcctcgccgcaccggagcaaaacgccctggcaggcggctggctgctgtttgcgtttatcggcacgggcagcagttttctcgcttttgctgcgctggcggcgaaacatcagattgataatcccggttatgcgcataaatcgttttattatctgggcgggttaaccgaaggcagcgagacgattttgctgtttgttctgagttgcctctttccgggctgttttccgtggtttgcgtgggtatttggtgcgttgtgctggatgacgacctttacgcgggtgtggagtgggtatctgacgctgaagtcgctccagcgtcagtaa

SEQ ID NO: 4280 - protein, 206 aa, Escherichia coli
MLDRHLHPRIKPLLYQCVRVLDKPGITPDGLTLVGFAIGVLALPFLALGWYLAALIVILLNRLLDGLDGALARRRGLTDAGGFLDISLDFLFYALVPFGFILAAPEQNALAGGWLLFAFIGTGSSFLAFAALAAKHQIDNPGYAHKSFYYLGGLTEGSETILLFVLSCLFPGCFPWFAWVFGALCWMTTFTRVWSGYLTLKSLQRQ

SEQ ID NO: 4281 - DNA, 273 bp, Escherichia coli
gtgagtcgagcattgatcgccgtagtattagcatttccattaattacactggctaacccgcattatcatccggacgtggaggtaaacgtaccgccagaagtgttcagttcaggcgggcagtcagcgcagccctgtactcagtgctgcgtttatcaggatcaaaattattctgaaggggcagtaattaaagccgaaggaatactgctgcaatgccaacgggatgacaaaaccctaagcactaatccgctggtctggcggcgcgtgaagccataa

SEQ ID NO: 4282 - protein, 90 aa, Escherichia coli
MSRALIAVVLAFPLITLANPHYHPDVEVNVPPEVFSSGGQSAQPCTQCCVYQDQNYSEGAVIKAEGILLQCQRDDKTLSTNPLVWRRVKP

SEQ ID NO: 4283 - DNA, 408 bp, Escherichia coli
atgaaaatgattgaagttgttgccgccatcatcgaacgtgatggcaaaattttactcgcgcaacgccctgcccagagcgatcaggcgggattatgggagtttgccggtggtaaagtcgagccggatgaaagccagcggcaggcgctggtgcgtgagttaaacgaagaactgggcatcgaagcaactgttggtgactatgttgccagccatcagcgagaagtttcggggcggattatccatcttcatgcctggcacgtacccgacttccacgggacgttacaggcacatgaacatcaggcgctggtctggtgctcacctgaagaggcgctgcgatatccgctggcccctgctgacattccattattagaggcgtttatggcttcacgcgccgccagaccagcggattag

SEQ ID NO: 4284 - protein, 135 aa, Escherichia coli
MKMIEVVAAIIERDGKILLAQRPAQSDQAGLWEFAGGKVEPDESQRQALVRELNEELGIEATVGDYVASHQREVSGRIIHLHAWHVPDFHGTLQAHEHQALVWCSPEEALRYPLAPADIPLLEAFMASRAARPAD

SEQ ID NO: 4285 - DNA, 1344 bp, Escherichia coli
atggatcagacatattctctggagtcattcctcaaccatgtccaaaagcgcgacccgaatcaaaccgagttcgcgcaagccgttcgtgaagtaatgaccacactctggccttttcttgaacaaaatcccaaatatcgtcagatgtcattactggagcgtctggttgaaccggagcgcgtgatccagtttcgcgtagtatgggttgatgatcgcaaccaggtgcaggtcaaccgtgcatggcgtgtgcagttcagctctgccatcggcccgtacaaaggcggtatgcgcttccatccgtcagttaacctctccattctcaaattcctcggcttcgaacaaaccttcaaaaatgccctgactactctaccgatgggcggtggtaaaggcggcagcgatttcgacccgaaaggaaaaagcgaaggcgaagttatgcgtttctgccaggcgctgatgactgaactgtatcgccacctgggcgcggatactgacgttccggcaggtgatatcggcgttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaaggaatgcgcgtttccgtttctggctccggcaacgtcgcccagtacgctatcgaaaaagcgatggaatttggtgctcgagtgatcactgcgtcagactccagcggcactgtagttgatgaaagcggattcacgaaagaaaaactggcgcgtcttatcgaaatcaaagccagccgcgatggtcgagtggcagattacgccaaagaatttggtctggtctatctcgaaggccaacaaccgtggtctgtaccggttgatatcgccctgccttgcgcaacccagaacgaactggatgttgacgccgcgcatcagcttatcgccaatggcgttaaagccgtcgccgaaggggcaaatatgccgaccaccatcgaagcgactgaactgttccagcaggcaggcgtactgtttgcaccgggtaaagcggctaatgctggcggtgtagcaacatcgggcctggaaatggcgcaaaacgctgcgcgcctgggctggaaagccgagaaagttgacgcacgtttgcatcacatcatgctggatatccaccatgcctgtgttgagcatggtggtgaaggtgagcaaaccaactacgtgcagggcgcgaacattgccggttttgtgaaggttgcggatgcgatgttaagccagggcgtgatttaa

SEQ ID NO: 4286 - protein, 447 aa, Escherichia coli
MDQTYSLESFLNHVQKRDPNQTEFAQAVREVMTTLWPFLEQNPKYRQMSLLERLVEPERVIQFRVVWVDDRNQVQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLSQGVI

SEQ ID NO: 4287 - DNA, 2034 bp, Escherichia coli
ttggtattgaactgtcggctattggtgaacttgtttccgcccgtggtggtcgtgccatggttgagattcgttaagtcgatgcggttgtttattgccgaaaaaccgagtctggcgcgcgccattgctgatgtcctgcctaaaccgcaccggaaaggcgatggctttatcgagtgcggtaatggtcaggtggtgacctggtgtatcggtcacctgcttgagcaggcgcagccagacgcctacgacagccgctatgcgcgctggaatcttgcggatttgccgattgtcccggaaaagtggcaattacagccccgaccctccgtgactaaacaacttaatgtcatcaaacgcttcctgcatgaagccagcgaaatcgttcacgccggagacccggatcgcgaagggcaactgctggtggatgaagtgctggactacctgcaactggcaccggaaaagcgccagcagatacagcgttgtttgataaacgacctgaacccgcaggcggttgagcgggcgatcgatcgtcttcgctccaatagcgagtttgtaccgctgtgcgtttctgcactggcgcgggcgcgggctgactggctgtacggcattaatatgacccgtgcgtataccattctcggtcgcaatgccggttatcagggcgtgctttccgtgggacgcgtgcagacgcccgtactcggactggtggtgcgccgcgacgaagagattgaaaacttcgtggcgaaagacttctttgaagtcaaagcacatatcgtgacacctgccgatgagcggtttaccgctatctggcaaccgagcgaagcgtgtgaaccgtaccaggatgaagaagggcgcttgttacatcgtccactggcggagcatgtggttaaccgcattagtggtcaaccagctattgtcaccagctataacgataaacgggaatcagaatccgcgccgctgcctttttcgctttcggcgttgcagattgaagcggctaaacgttttggtctgagcgcgcagaacgtgcttgatatctgccagaagctgtacgaaacgcacaagctaatcacttatccgcgttccgattgccgctatttgccagaagaacattttgccggacgccacgcggtgatgaatgctatcagcgttcatgcaccggatctgttgccgcagccagtggtagatccagatatacgcaaccgctgttgggatgacaaaaaggtcgatgcgcaccacgccatcattccgaccgcacggagttctgcgatcaacctgacggagaacgaagcgaaggtctataacctgattgcccgtcagtacttgatgcagttctgcccggatgcggtgttccgcaagtgtgttatcgaactggacattgccaaaggcaaatttgtcgctaaagcccgttttcttgctgaagcaggctggcgcacgctgttaggcagcaaagagcgcgatgaagaaaacgacggcacgccgctgcctgtggtggcgaaaggcgatgaattgttgtgcgaaaaaggcgaagtggtagagcggcaaacccagccgccacgccattttaccgatgcaacactgctttcggcgatgaccgggatcgcacgctttgtgcaggacaaagatctgaaaaagatccttcgtgcgaccgatggtctggggacagaagcaacgcgtgccgggattattgaattgttgttcaagcggggtttcctgaccaaaaaagggcgctatatccactccaccgacgccggaaaagcgctattccattcgctgccagaaatggcgacgcgaccggacatgaccgcgcactgggaatcggtgctgacgcaaatcagcgaaaagcagtgtcgctatcaggactttatgcagccgctggtggggacattgtaccagttgattgatcaggcaaagcgcacgtcggtaaggcagtttcggggaataatggctcccggcggtagagaagggaagaaaaaggattcgccacgcaagagagcgccgaaaaaaagcccgccatcagaagaggcgggcaatggagtgataacataa

SEQ ID NO: 4288 - protein, 677 aa, Escherichia coli
MVLNCRLLVNLFPPVVVVPWLRFVKSMRLFIAEKPSLARAIADVLPKPHRKGDGFIECGNGQVVTWCIGHLLEQAQPDAYDSRYARWNLADLPIVPEKWQLQPRPSVTKQLNVIKRFLHEASEIVHAGDPDREGQLLVDEVLDYLQLAPEKRQQIQRCLINDLNPQAVERAIDRLRSNSEFVPLCVSALARARADWLYGINMTRAYTILGRNAGYQGVLSVGRVQTPVLGLVVRRDEEIENFVAKDFFEVKAHIVTPADERFTAIWQPSEACEPYQDEEGRLLHRPLAEHVVNRISGQPAIVTSYNDKRESESAPLPFSLSALQIEAAKRFGLSAQNVLDICQKLYETHKLITYPRSDCRYLPEEHFAGRHAVMNAISVHAPDLLPQPVVDPDIRNRCWDDKKVDAHHAIIPTARSSAINLTENEAKVYNLIARQYLMQFCPDAVFRKCVIELDIAKGKFVAKARFLAEAGWRTLLGSKERDEENDGTPLPVVAKGDELLCEKGEVVERQTQPPRHFTDATLLSAMTGIARFVQDKDLKKILRATDGLGTEATRAGIIELLFKRGFLTKKGRYIHSTDAGKALFHSLPEMATRPDMTAHWESVLTQISEKQCRYQDFMQPLVGTLYQLIDQAKRTSVRQFRGIMAPGGREGKKKDSPRKRAPKKSPPSEEAGNGVIT

SEQ ID NO: 4289 - DNA, 1044 bp, Escherichia coli
atgagcgagaactcgattcgtttgacccaatacagccacggcgctggttgcggctgtaaaatttccccaaaagtgttggaaaccatcctgcacagtgagcaggcgaagtttgttgatccgaatttgcttgtgggtaatgaaacccgcgatgatgcggcggtgtacgatctgggcaatggcaccagtgtcatcagcaccaccgacttctttatgccgatcgttgataatcctttcgattttggccgcattgcggcgactaacgccatcagcgatatctttgcgatgggtggcaaaccgattatggcgattgcgatcctcggctggccgatcaacaaactttccccggaaattgcccgcgaagtgaccgagggtggacgctatgcatgccgtcaggcgggtatagcgctggctggcggtcactccatcgatgcaccggaaccgatttttggtctggcggtgacggggatcgtaccgaccgagagggtgaagaaaaacagtactgcacaagccggatgcaaactgttcctgacgaaaccgctggggataggcgttctcaccacagccgagaaaaaatcgctgctgaaaccggaacatcagggactggcgacggaagtgatgtgccggatgaatattgcaggcgcgtcctttgccaatatcgaaggcgtaaaagcgatgaccgacgttactggttttggtctgctgggccatttgagcgaaatgtgtcagggtgctggtgtgcaggcgcgcgtcgattatgaggcgatcccgaaactgccgggtgttgaagagtatattaagctgggcgcagtacctggcggcaccgaacgcaactttgccagctatggtcatctgatgggtgaaatgccgcgtgaagtgcgcgatctactgtgcgatccgcaaacttctggcggtctgctgctggctgttactcctgaagctgaagacgaagtgaaagccactgccgctgagtttggtattgaactgtcggctattggtgaacttgtttccgcccgtggtggtcgtgccatggttgagattcgttaa

SEQ ID NO: 4290 - protein, 347 aa, Escherichia coli
MSENSIRLTQYSHGAGCGCKISPKVLETILHSEQAKFVDPNLLVGNETRDDAAVYDLGNGTSVISTTDFFMPIVDNPFDFGRIAATNAISDIFAMGGKPIMAIAILGWPINKLSPEIAREVTEGGRYACRQAGIALAGGHSIDAPEPIFGLAVTGIVPTERVKKNSTAQAGCKLFLTKPLGIGVLTTAEKKSLLKPEHQGLATEVMCRMNIAGASFANIEGVKAMTDVTGFGLLGHLSEMCQGAGVQARVDYEAIPKLPGVEEYIKLGAVPGGTERNFASYGHLMGEMPREVRDLLCDPQTSGGLLLAVTPEAEDEVKATAAEFGIELSAIGELVSARGGRAMVEIR

SEQ ID NO: 4291 - DNA, 552 bp, Escherichia coli
atggatgcactcgaactattgatcaatcgccgtagcgcctcccgcctggctgaacccgcgccaacgggtgaacaactgcaaaacatcctgcgtgcgggtatgcgtgcgccggaccataagtccatgcaaccgtggcatttctttgtgattgaaggggaagggcgcgagcgtttcagcgctgtactggagcagggggcgattgctgccggtagtgataacaaagcaatcgacaaagcgcgtaatgcgccgttccgcgcaccgctcatcataacggtggtggcgaaatgcgaagaaaatcataaagtcccgcgctgggaacaggaaatgtctgcgggatgcgcggtcatggcgatgcaaatggcagcagttgcccaggggtttggcggcatctggcgcagtggtgcattaactgaaagtccggtagtgcgtgaagcattcggttgccgtgagcaggataaaattgtcggttttctctacctcggtacgccgcagttgaaagcatctacgtcgataaacgtcccggacccgacgccgtttgtgacttatttctga

SEQ ID NO: 4292 - protein, 183 aa, Escherichia coli
MDALELLINRRSASRLAEPAPTGEQLQNILRAGMRAPDHKSMQPWHFFVIEGEGRERFSAVLEQGAIAAGSDNKAIDKARNAPFRAPLIITVVAKCEENHKVPRWEQEMSAGCAVMAMQMAAVAQGFGGIWRSGALTESPVVREAFGCREQDKIVGFLYLGTPQLKASTSINVPDPTPFVTYF

SEQ ID NO: 4293 - DNA, 111 bp, Escherichia coli
gtggttatcgtaatgacccaaccggcacttgtcagcaggaattgcggactgggctgtaacaaaatccactctcgtgttaattttgtgaataaatatcatgacaggagttaa

SEQ ID NO: 4294 - protein, 36 aa, Escherichia coli
MVIVMTQPALVSRNCGLGCNKIHSRVNFVNKYHDRS

SEQ ID NO: 4295 - DNA, 1857 bp, Escherichia coli
atgcgaaccctttggcgatttattgccggattttttaaatggacgtggcgtctgctgaatttcgtccgtgaaatggtacttaacctgttctttatttttctcgtgctggttggtgtggggatctggatgcaggtcagtggtggtgattcgaaagaaacggccagtcgtggcgcactgctgctggacatttctggtgtgatcgtcgataaacccgacagttctcagcggtttagtaaattaagccgccagctgcttggtgccagttccgatcgtctgcaggaaaactcactgtttgatatcgtcaacaccattcgccaggcgaaggacgaccgcaatatcaccggtattgtgatggatctgaaaaacttcgcaggcggcgaccagccgtctatgcagtacatcggcaaagctctgaaagagtttcgtgatagcgggaaaccggtttatgccgttggcgagaactacagccaggggcaatattatctcgccagtttcgccaataaaatttggctgtctccgcaaggcgtggttgatctgcacggctttgccaccaacggtctgtactacaaatcgttactggataagctgaaagtttccacccatgtgttccgcgtgggtacgtataaatctgccgttgaaccgtttattcgtgatgatatgtcgccggcagcccgcgaagctgacagccgctggattggtgagctgtggcaaaactatctgaatactgttgccgctaaccgccagatccctgctcagcaggtattccctggcgcgcaagggttgcttgagggtttaaccaaaaccggtggcgataccgcgaaatatgcgctggaaaacaagctggtcgatgcactggcatcgagtgccgaaatcgaaaaaactctgaccaaagagttcggctggagtaaaactgataaaaattatcgcgccatcagttattacgattacgcattgaaaacgccggcagataccggtgacagtatcggtgtcgtcttcgctaatggcgcaattatggatggcgaggaaactcaggggaatgttggcggtgataccactgcggcacaaatccgcgacgctcgccttgacccgaaagtgaaagcgattgttctgcgtgttaatagtcccggcggcagcgttaccgcgtctgaagtgattcgcgctgaactggcagcagcccgggcagcgggtaagcctgtggttgtatcgatgggcggcatggcggcatctggtggttactggatttccacaccagctaattacattgtggctaaccccagcaccctgaccggttctatcggtatcttcggcgtgatcaccaccgtagaaaatagtctggattcgattggtgttcatactgatggtgtctcaacttcaccgctggcagatgtttctatcaccagggcactgccgccggaagcgcagcagatgatgcagttaagcattgagaatggctataaacgctttatcacgctggttgctgatgcgcgtcattcaacgccggagcagattgataaaatcgcccagggtcacgtctggaccggtcaggatgcaaaagctaacgggctggtcgatagtctcggggatttcgatgatgcggtcgccaaagcagcagagctggcaaaagtgaaacagtggcatctggaatactacgttgatgaaccgaccttcttcgacaaagtgatggacaacatgtctggttctgtccgggcaatgttgccagatgcgttccaggccatgttacctgcaccgctggcctcggtagcctctaccgttaaaagtgaaagcgacaagctggccgcgtttaacgacccacaaaaccgttatgcgttttgcctgacctgcgccaacgtgcgttaa

SEQ ID NO: 4296 - protein, 618 aa, Escherichia coli
MRTLWRFIAGFFKWTWRLLNFVREMVLNLFFIFLVLVGVGIWMQVSGGDSKETASRGALLLDISGVIVDKPDSSQRFSKLSRQLLGASSDRLQENSLFDIVNTIRQAKDDRNITGIVMDLKNFAGGDQPSMQYIGKALKEFRDSGKPVYAVGENYSQGQYYLASFANKIWLSPQGVVDLHGFATNGLYYKSLLDKLKVSTHVFRVGTYKSAVEPFIRDDMSPAAREADSRWIGELWQNYLNTVAANRQIPAQQVFPGAQGLLEGLTKTGGDTAKYALENKLVDALASSAEIEKTLTKEFGWSKTDKNYRAISYYDYALKTPADTGDSIGVVFANGAIMDGEETQGNVGGDTTAAQIRDARLDPKVKAIVLRVNSPGGSVTASEVIRAELAAARAAGKPVVVSMGGMAASGGYWISTPANYIVANPSTLTGSIGIFGVITTVENSLDSIGVHTDGVSTSPLADVSITRALPPEAQQMMQLSIENGYKRFITLVADARHSTPEQIDKIAQGHVWTGQDAKANGLVDSLGDFDDAVAKAAELAKVKQWHLEYYVDEPTFFDKVMDNMSGSVRAMLPDAFQAMLPAPLASVASTVKSESDKLAAFNDPQNRYAFCLTCANVR

SEQ ID NO: 4297 - DNA, 1017 bp, Escherichia coli
atgcaaaagaaatcaatttacgtcgcctacacgggcgggaccatcgggatgcagcgttccgagcagggttatattccggtgtcaggtcatctacagcgccaactggcgctgatgccggaattccatcgcccggagatgccagatttcaccattcatgaatatacgccattgatggattcttctgatatgacgccagaagactggcagcatattgctgaagatattaaagcgcactatgacgattatgatggttttgtcattctgcacggtacagacacgatggcgtataccgcctctgcactgtcgttcatgctcgagaatctcggtaaaccggtcattgtgacagggtcacaaatcccgctggctgagttacgctctgacggacaaattaatctgctgaatgcgttgtacgttgcggcgaattatcctatcaacgaagtaactctcttttttaataatcgactgtatcgtggcaacagaaccaccaaagcccatgccgatggttttgatgcgtttgcctctccaaaccttcctccgttactggaagcaggtatccatattcgccgtttgaatacgccacccgccccgcacggtgaaggggcattgatcgttcatccaatcacgccgcaaccaattggcgtagtaacgatttatccggggatttctgctgacgtcgtgcgcaattttctgcgccaacctgtgaaagcattgattctgcgctcatatggcgtgggtaatgcgccacaaaacaaagccttcctgcaggaattacaagaagccagcgatcgcggtattgtggtggtcaacctgacacaatgtatgtccggtaaagtgaacatgggtggttatgccactggtaacgccctcgcccatgccggcgttattggcggtgcagatatgactgtagaagccacgctaaccaaactgcattacctgcttagccaggaacttgatactgaaaccattcgcaaggccatgagccaaaacctgcgtggcgaactgacgccggatgattaa

SEQ ID NO: 4298 - protein, 338 aa, Escherichia coli
MQKKSIYVAYTGGTIGMQRSEQGYIPVSGHLQRQLALMPEFHRPEMPDFTIHEYTPLMDSSDMTPEDWQHIAEDIKAHYDDYDGFVILHGTDTMAYTASALSFMLENLGKPVIVTGSQIPLAELRSDGQINLLNALYVAANYPINEVTLFFNNRLYRGNRTTKAHADGFDAFASPNLPPLLEAGIHIRRLNTPPAPHGEGALIVHPITPQPIGVVTIYPGISADVVRNFLRQPVKALILRSYGVGNAPQNKAFLQELQEASDRGIVVVNLTQCMSGKVNMGGYATGNALAHAGVIGGADMTVEATLTKLHYLLSQELDTETIRKAMSQNLRGELTPDD

SEQ ID NO: 4299 - DNA, 642 bp, Escherichia coli
atgccccctcgcgccctgttactggtcgatttacaaaatgatttctgtgctggtggcgcgctcgccgtgccggaaggtgacagtacggtggatgtcgctaaccgcctgattgactggtgccagtcgcgcggtgaagcggttatcgccagtcaggactggcacccggcgaatcacggcagttttgccagtcagcacggtgtagagccttatacgccgggccaactcgacggtttgccacaaaccttctggcccgatcactgtgtgcagaacagtgaaggcgcacaattacatccgttactgaagcaaaaagcgatcgcagcggtgttccataaaggcgaaaatcctttagttgacagttacagtgccttttttgataacggccgtcggcagaaaactgcgctcgatgactggttgcgcgctcatgtaatcaatgaattgatcgttatgggtctggctactgactattgcgttaagtttaccgtgctggacgcgttacagttaggttataaggtgaacgtgattaccgatggttgtcgtggcgtgaatatccagccacaggacagtgcgcacgcgtttatggagatgtcagcagctggggcaacgctatatacgctggcagactgggaagaaacgcaggagtaa

SEQ ID NO: 4300 - protein, 213 aa, Escherichia coli
MPPRALLLVDLQNDFCAGGALAVPEGDSTVDVANRLIDWCQSRGEAVIASQDWHPANHGSFASQHGVEPYTPGQLDGLPQTFWPDHCVQNSEGAQLHPLLKQKAIAAVFHKGENPLVDSYSAFFDNGRRQKTALDDWLRAHVINELIVMGLATDYCVKFTVLDALQLGYKVNVITDGCRGVNIQPQDSAHAFMEMSAAGATLYTLADWEETQE

SEQ ID NO: 4301 - DNA, 1464 bp, Escherichia coli
ttgtcaatattatttgttcctgcgcctggaaataaaatgatgataaagatgcggcaagtgaatttgccgcaattgctaccttttttagcaaatccgaggcacccaatggaacaatatgatcaaattggcgcaagactggaccgcttgcctttggcccggtttcattatcgtatatttggtataataagctttagtctgttattaacggggtttttgagttactccggtaatgtcgtcttagcaaagctggtaagcaatggatggtcaaataatttcctcaatgccgcctttacctcggcattaatgtttggttatttcatcggctctcttaccggtgggtttattggtgactactttgggcggcgcagggcgtttcgcataaatcttctcatcgtcggtattgcggcaacaggggccgcttttgtccctgatatgtactggctcatcttctttcgcttcctgatgggaacaggaatgggggcgctgattatggttggctatgcctcatttacggagtttatccccgcgacggtgcgtggaaaatggtccgcgcggctctcatttgttggtaactggtcgcccatgctgtctgcggcgataggcgtggtggttatcgctttttttagttggcggataatgtttctgctgggcggtattggcatactgttagcctggtttctctcaggtaaatactttattgagtcgccacgatggctggcagggaaagggcaaatcgcaggtgcagaaagccaacttcgtgaagtagagcagcaaattgaaagagagaagaggattcgtttacccccgcttactttgaaccagagcaacagcaaggttaaggtaatcaagggtaccttctggctgctgtttaaaggggaaatgttacgacgtacattagtcgcgattactgttttaattgcaatgaacatttcgctttataccatcaccgtatggataccgaccatatttgttaactccggcattgatgttgataaatcaatattaatgaccgctgttattatgattggcgctccggtagggatatttattgcggcattaattattgatcattttcctcgtcgattatttggctctgccttacttattattattgctgtgttaggctatatctattcaattcagactacagagtgggcgattttaatctatggcctggtgatgatcttctttttatacatgtatgtgtgcttcgcgtcggcggtttatatcccggaactttggccaacgcatttacgcctgcgtggttcgggtttcgttaatgccgtcggacggatcgtcgcagtcttcacgccctatggcgttgcggcattattaacacattatgggtcgatcacggtgtttatggtgcttggtgtcatgttagtgctctgtgcgctggttctctccatttttggcatcgaaacgcggaaggtgtcgctggaagagatttctgaggtgaattaa

SEQ ID NO: 4302 - protein, 487 aa, Escherichia coli
MSILFVPAPGNKMMIKMRQVNLPQLLPFLANPRHPMEQYDQIGARLDRLPLARFHYRIFGIISFSLLLTGFLSYSGNVVLAKLVSNGWSNNFLNAAFTSALMFGYFIGSLTGGFIGDYFGRRRAFRINLLIVGIAATGAAFVPDMYWLIFFRFLMGTGMGALIMVGYASFTEFIPATVRGKWSARLSFVGNWSPMLSAAIGVVVIAFFSWRIMFLLGGIGILLAWFLSGKYFIESPRWLAGKGQIAGAESQLREVEQQIEREKRIRLPPLTLNQSNSKVKVIKGTFWLLFKGEMLRRTLVAITVLIAMNISLYTITVWIPTIFVNSGIDVDKSILMTAVIMIGAPVGIFIAALIIDHFPRRLFGSALLIIIAVLGYIYSIQTTEWAILIYGLVMIFFLYMYVCFASAVYIPELWPTHLRLRGSGFVNAVGRIVAVFTPYGVAALLTHYGSITVFMVLGVMLVLCALVLSIFGIETRKVSLEEISEVN

SEQ ID NO: 4303 - DNA, 723 bp, Escherichia coli
atggttgccaacgataaaaaggtgacagtctcaaatttgagtgggatttttcaggtaaccgaagaaaccattcgccgcgatcttgagaagttggaagatgaaggctttttgaccagaacctatggtggtgctgttttaaatacagcgatgttgacggagaatatccatttttataagcgcgcttcatcgttttatgaagagaagcagcttattgcacgcaaggcactcccctttatcgacaataaaaccaccatggcagccgattccagtagtaccgtaatggaattgctcaaattgttacaggaccgtagtgacctgacgttgctaaccaactcggcggaagcgattcatgttctggctcagtcagaaattaaagtcgtttcaacgggtggggaactaaacaaaaatacactttcactgcaaggaagaattactaaagagatcatcagccgctaccatgtcgatatcatggtaatgagttgtaaaggtcttgatattaacagcggcgcgctggactctaatgaagcggaagctgaaatcaaaaagacaatgatccgtcaggcgacagaagttgcgttattggttgatcactctaagtttgatcgcaaagcttttgtccagttagctgactttagtcatattaattacataataactgataaatcaccgggtgcagagtggatagcattttgcaaagacaataatatccagctggtgtggtaa

SEQ ID NO: 4304 - protein, 240 aa, Escherichia coli
MVANDKKVTVSNLSGIFQVTEETIRRDLEKLEDEGFLTRTYGGAVLNTAMLTENIHFYKRASSFYEEKQLIARKALPFIDNKTTMAADSSSTVMELLKLLQDRSDLTLLTNSAEAIHVLAQSEIKVVSTGGELNKNTLSLQGRITKEIISRYHVDIMVMSCKGLDINSGALDSNEAEAEIKKTMIRQATEVALLVDHSKFDRKAFVQLADFSHINYIITDKSPGAEWIAFCKDNNIQLVW

SEQ ID NO: 4305 - DNA, 981 bp, Escherichia coli
atgaaaaagatacctttaggcacaacggatataacgctttcgcgaatggggttggggacatgggccattggcggcggtcctgcatggaatggcgatctcgatcgacaaatatgcattgatacgattcttgaagcccatcgttgcggcattaacctgattgatactgcgccaggatataactttggcaatagtgaagttatcgttggtcaggcgttaaaaaaactgccccgtgaacaggttgtagtagaaaccaaatgcggcattgtctgggaacgaaaagggagtttattcaacaaagttggcgatcggcagttgtataaaaacctttctccggaatctatccgcgaagaggtaaaagccagcttgcaacgtctgggtattgattacatcgatatctacatgacgcactggcagtcggtgccgccattttttacgccgatagctgaaactgtcgcagtgcttaatgcgttaaaggccgaagggaaaattcgcgctataggcgctgctaacgtcgatgctgaccatatccgcgagtatctgcaacatggtgaactggatattattcaggcgaaatacagtatcctcgaccgggcaatggaaaacgaactgctgccgctatgtcgtgataatggcattgtggtacaggtctactctccgctagagcagggattgttgaccgggaccatcacgcgtgattacgttccgggcggcgctcgggcaaataaagtctggttccagcgtgaaaacatgctgaaagtgattgatatgcttgaacagtggcagccactctgtgctcgttatcagtgcacaattcccactctggcactggcgtggatattaaaacagagtgatttaatctccattcttagtggggctactgcgccggaacaggtacgtgaaaatgtcgcggcactgaatatcaacttatcggatgcagacgcaacattgatgagggaaatggcagaggccctggagcgttaa

SEQ ID NO: 4306 - protein, 326 aa, Escherichia coli
MKKIPLGTTDITLSRMGLGTWAIGGGPAWNGDLDRQICIDTILEAHRCGINLIDTAPGYNFGNSEVIVGQALKKLPREQVVVETKCGIVWERKGSLFNKVGDRQLYKNLSPESIREEVKASLQRLGIDYIDIYMTHWQSVPPFFTPIAETVAVLNALKAEGKIRAIGAANVDADHIREYLQHGELDIIQAKYSILDRAMENELLPLCRDNGIVVQVYSPLEQGLLTGTITRDYVPGGARANKVWFQRENMLKVIDMLEQWQPLCARYQCTIPTLALAWILKQSDLISILSGATAPEQVRENVAALNINLSDADATLMREMAEALER

SEQ ID NO: 4307 - DNA, 969 bp, Escherichia coli
atggcaaagcggaataataatatggataatctcgacgttatttgtataggtgccgctattgttgatattccattgcaaccggtcagtaaaaatatctttgatgtggattcttatcctcttgaaagaatcgcaatgaccaccgggggggatgcaataaatgaagcaacaattatttctcgtctgggccatcgcacagcattaatgagtcgtattggtaaagatgccgcagggcaatttattctcgaccattgccgcaaagagaatattgatattcaaagcctgaagcaggacgtcagcatagatacctctattaacgttggactggtgacggaggatggcgagcggacctttgtcacaaaccgtaacggcagtctgtggaaattgaatattgacgatgttgattttgcgcggttttctcaggcgaaattattatcactggccagtattttcaacagtcctctattggatggtagagcgctaacagaaatttttacgcaagctaaagcccggcagatgattatctgtgccgatatgatcaaaccgcggttgaatgaaacgctgaatgatatttgcgaagcattgagttatgtcgattatctgtttcctaattttgccgaggcaaaattactcaccgggaaagagacactggatgaaattgctgactgctttcttgcgtgcggcgtaaaaacggtggtgattaaaacgggtaaagacggctgctttatcaagcgtggtgacatgacgatgaaggtgccggcggtcgcaggaataaccgccatcgacaccattggtgcgggcgataactttgcttcaggttttattgcagcactgttagaaggtaaaaatctgcgtgaatgcgcacgctttgccaatgcaacggcggctatctcggttctaagcatcggcgccaccaccggtgtaaaaaacagaaagctggtcgaacaattgctggaagaatacgaaggataa

SEQ ID NO: 4308 - protein, 322 aa, Escherichia coli
MAKRNNNMDNLDVICIGAAIVDIPLQPVSKNIFDVDSYPLERIAMTTGGDAINEATIISRLGHRTALMSRIGKDAAGQFILDHCRKENIDIQSLKQDVSIDTSINVGLVTEDGERTFVTNRNGSLWKLNIDDVDFARFSQAKLLSLASIFNSPLLDGRALTEIFTQAKARQMIICADMIKPRLNETLNDICEALSYVDYLFPNFAEAKLLTGKETLDEIADCFLACGVKTVVIKTGKDGCFIKRGDMTMKVPAVAGITAIDTIGAGDNFASGFIAALLEGKNLRECARFANATAAISVLSIGATTGVKNRKLVEQLLEEYEG

SEQ ID NO: 4309 - DNA, 837 bp, Escherichia coli
atgctcgcagatatcagatattgggaaaacgatgccacaaataaacattatgcaattgcccattttaacgtatggaatgcagaaatgttgatgggcgttatcgacgcagccgaagaagcgaaatcaccgattattatttcttttggcacaggttttgtcggcaacacctcatttgaagatttctctcacatgatggtatcaatggcacaaaaagcaacggtgccggtaataactcattgggatcatggtcggagtatggagattattcataacgcctggactcatggtatgaattcattaatgcgtgatgcttctgcatttgatttcgaagaaaatattcgtttaaccaaagaggctgttgatttcttccatccgctgggtattccggtagaggcggaattagggcatgtcggtaatgaaaccgtttatgaggaagcgctggcaggctatcactataccgatcctgaccaggcggctgaatttgttgaacgtacgggctgtgactcattggctgtcgccatcggcaaccagcatggggtttatacgtcagagccacaattgaactttgaggtcgtcaaacgcgtacgcgatgctgtttctgttccgctggttttgcatggcgcatcagggatcagtgatgccgacattaaaactgcaatttcgttgggtattgcgaaaatcaacattcatacggagctctgtcaggccgcaatggtagcagtgaaagaaaaccaggatcagcctttcctgcatttagaacgtgaagtgcgtaaagctataaaagaacgggcattggataaaattaaactgttcggttctgatggcaaagcggaataa

SEQ ID NO: 4310 - protein, 278 aa, Escherichia coli
MLADIRYWENDATNKHYAIAHFNVWNAEMLMGVIDAAEEAKSPIIISFGTGFVGNTSFEDFSHMMVSMAQKATVPVITHWDHGRSMEIIHNAWTHGMNSLMRDASAFDFEENIRLTKEAVDFFHPLGIPVEAELGHVGNETVYEEALAGYHYTDPDQAAEFVERTGCDSLAVAIGNQHGVYTSEPQLNFEVVKRVRDAVSVPLVLHGASGISDADIKTAISLGIAKINIHTELCQAAMVAVKENQDQPFLHLEREVRKAIKERALDKIKLFGSDGKAE

SEQ ID NO: 4311 - DNA, 1005 bp, Escherichia coli
atgaaaattatttcagcagaaatacctgtgcctaaagaagatgaagttttgattaaagtggaatatgtcggtatttgtggttcagatgtacatggttttgaatcaggcccgtttattcctcctaaagacccaaatcaagaaattggcctgggtcatgaatgcgccgggacggttgtggctgtgggaagccgcgtgcgcaaatttaaaccgggggatcgggtaaatatcgaacctggcgttccttgcggtcactgtcgttactgtctggaaggcaaatataacatttgcccggacgttgattttatggcgacacaacccaactaccgcggtgcattaacgcactatctgtgtcatccggagagctttacttacaaactgccagacaatatggacacgatggaaggggcgctggtggagcctgccgcagtcgggatgcatgccgcgatgctggcagatgttaaacctggtaagaagataattattctgggagcgggttgtattggtttgatgacgttgcaagcgtgcaaatgcctgggagcaacggaaattgccgtcgttgatgtgctggaaaaacgtctgacaatggcggaacagctcggcgcgacagtggttattaacggcgcaaaagaagacactattgcacgctgtcagcaatttaccgaagacatgggcgcagatattgtttttgaaacagcgggttctgcggtcaccgttaaacaggcaccttatctggtcatgcgcggcggtaaaattatgattgttggtactgtacccggcgattcggcaatcaatttcctcaaaatcaatcgcgaagtcactatccagacggtattccgctatgccaatcgttatccggtcacgattgaagctatttcttcagggcgattcgatgtgaaatcgatggtgacgcatatttacgattatcgggatgtacaacaggcatttgaagagtcagttaacaacaaacgcgacattattaaaggcgttattaaaattagcgattaa

SEQ ID NO: 4312 - protein, 334 aa, Escherichia coli
MKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLTMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 4313 - DNA, 1380 bp, Escherichia coli
atggaacagataacaaaaccgcattgtggtgcacggctggatcgcttaccggattgccgctggcattcgtcaatgtttgccatcgtcgcgtttggcttgcttgtctgctggagtaatgccgttggtggcttgatcctcgcgcagctgaaagcgttgggctggacagataattccaccactgccacattctcagcaatcacgaccgccggaatgtttctcggtgcgctggtgggcggcatcatcggtgacaaaaccggtcgcagaaatgcgtttatcctctatgaggccattcatattgcttcgatggttgtcggtgctttctcaccgaatatggatttccttattgcctgccgttttgtgatgggcgttgggctgggagctttactggttacactgtttgctggtttcaccgaatatatgcccggaagaaatcgcggaacgtggtccagtcgggtttcctttattggtaactggtcatatccgctctgttcattgattgcgatgggactcacgccgctgattagtgcagagtggaactggcgggtacaactgcttatccctgcaatattgtcacttatcgctacggcgctggcctggcgctactttcctgaatccccgcgctggctggaatcgcgcggacgttatcaggaagccgagaaagtcatgcggagtatagaagaaggcgtcatacgccagacgggtaaacctttgccgcctgtggttattgctgatgacggtaaagcaccacaagcggtgccgtattcagccttactgacaggagtattactgaaacgcgtgatattaggctcttgtgtgctgattgccatgaacgttgtgcagtacacactaattaactggttgccaacgatattcatgacccagggaattaatttaaaagactcgattgttttaaataccatgagtatgtttggcgcgccatttggtatttttattgccatgctggtgatggataaaattccgcgtaaaacaatggggatggggctattaatcctgattgcggtgctcggatatatctattcactgcaaaccagtatgttgctcataacgctgattggtttcttcctgattactttcgtctatatgtacgtttgctatgcctcggcagtgtatgtccctgagatctggccaacagaggccaaactccgtggctccggtctggcgaatgcggtagggcgaatcagtggtattgccgcgccttatgccgttgcagtgctgctcagtagttatggcgtaacgggagtctttattcttctgggggctgtttcaattattgtcgcaattgctatcgccaccattggaattgaaaccaaaggtgtctccgttgaaagtttaagtattgatgcagtagccaataaataa

SEQ ID NO: 4314 - protein, 459 aa, Escherichia coli
MEQITKPHCGARLDRLPDCRWHSSMFAIVAFGLLVCWSNAVGGLILAQLKALGWTDNSTTATFSAITTAGMFLGALVGGIIGDKTGRRNAFILYEAIHIASMVVGAFSPNMDFLIACRFVMGVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRQTGKPLPPVVIADDGKAPQAVPYSALLTGVLLKRVILGSCVLIAMNVVQYTLINWLPTIFMTQGINLKDSIVLNTMSMFGAPFGIFIAMLVMDKIPRKTMGMGLLILIAVLGYIYSLQTSMLLITLIGFFLITFVYMYVCYASAVYVPEIWPTEAKLRGSGLANAVGRISGIAAPYAVAVLLSSYGVTGVFILLGAVSIIVAIAIATIGIETKGVSVESLSIDAVANK

SEQ ID NO: 4315 - DNA, 1077 bp, Escherichia coli
atgaaagcactggctcggtttggcaaggcctttggcggctacaagatgattgatgtcccacaacccatttgtggcccggaagatgtcgtgattgaaattaaagccgcggcaatctgcggcgcagacatgaagcactacaatgtcgatagcggttctgatgagtttaactctatccgcggccatgagttcgcaggttgtattgcgcaggttggtgaaaaagtcaaagactggaaagtggggcaacgcgtcgtgtcggataacagcggtcacgtttgcggtgtttgcccggcctgtgaacaaggtgattttctgtgttgtacagaaaaagtaaaccttggtctggataacaatacctggggcggtggtttttccaaatattgtcttgttcctggtgaaattctcaaaattcatcgtcatgcgttgtgggaaatccctgatggtgttgattatgaggacgcagccgtacttgaccctatttgtaatgcctacaaatccatcgcgcagcaagcgaaattcctccctggtcaggatgtggtcgtcatcggcactggcccactcgggctgttctccgtacaaatggcgcggattatgggggcggtaaatatcgtcgtcgttggtctacaagaagatgtggcggtccgcttcccggttgcaaaagaactgggtgcgacggcagtagtaaatggttctaccgaagatgtggtggcgcgctgccagcaaatttgtggcaaagacaatctgggactggtgattgaatgctccggtgccaatatcgcactgaaacaagccatcgaaatgctccgtccgaacggggaagtggtacgcgttggaatgggcttcaaacctcttgatttctcgattaatgacattaccgcctggaacaaaagcatcattgggcatatggcctatgactccacctcatggcgtaacgctatcaggctattagccagcggcgcgatcaaagtcaaaccgatgatcacgcatcgtatcggcctgtcgcaatggcgcgaagggtttgatgcgatggtcgataaaactgcaatcaaagtgatcatgacttacgactttgatgaataa

SEQ ID NO: 4316 - protein, 358 aa, Escherichia coli
MKALARFGKAFGGYKMIDVPQPICGPEDVVIEIKAAAICGADMKHYNVDSGSDEFNSIRGHEFAGCIAQVGEKVKDWKVGQRVVSDNSGHVCGVCPACEQGDFLCCTEKVNLGLDNNTWGGGFSKYCLVPGEILKIHRHALWEIPDGVDYEDAAVLDPICNAYKSIAQQAKFLPGQDVVVIGTGPLGLFSVQMARIMGAVNIVVVGLQEDVAVRFPVAKELGATAVVNGSTEDVVARCQQICGKDNLGLVIECSGANIALKQAIEMLRPNGEVVRVGMGFKPLDFSINDITAWNKSIIGHMAYDSTSWRNAIRLLASGAIKVKPMITHRIGLSQWREGFDAMVDKTAIKVIMTYDFDE

SEQ ID NO: 4317 - DNA, 273 bp, Escherichia coli
atgaatcttgatgacattatcaacagcatgacgcctgaggtataccagcgtttgtcgaccgccgttgaactggggaaatggcctgatggcgttacgttgaccgaggaacaaaaagagaactgcctgcaactggtgatgctgtggcaagcccgccataataccgaagcacagcatatgacaattgacacaaatggtcagatggtcatgaagagcaaacagcagttaaaagaagattttggtatctcagcaaagcctattgccatgtttaagtaa

SEQ ID NO: 4318 - protein, 90 aa, Escherichia coli
MNLDDIINSMTPEVYQRLSTAVELGKWPDGVTLTEEQKENCLQLVMLWQARHNTEAQHMTIDTNGQMVMKSKQQLKEDFGISAKPIAMFK

SEQ ID NO: 4319 - DNA, 444 bp, Escherichia coli
gtgagcacgattaaagtgagatgtgagcaaatggctaataaaccttcggcagaagaactgaaaaaaaatttgtccgagatgcagttctacgtgacgcagaatcatgggacagaaccgccatttacgggtcgtttactgcataacaagcgtgacggcgtatatcactgtttgatctgcgatgccccgctgtttcattcccaaaccaagtatgattccggctgtggctggcccagcttctacgaaccgttgagtgaagaatctattcgttatatcaaagacttgtcgcatggaatgcagcgcatagaaattcgttgcggtaactgcgatgcccatctgggccatgtctttcctgacgggccgcagccaacgggcgaacgttattgtgttaactctgcttctttacgcttcactgatggcgaaaacggcgaagaaatcaacggttga

SEQ ID NO: 4320 - protein, 147 aa, Escherichia coli
MSTIKVRCEQMANKPSAEELKKNLSEMQFYVTQNHGTEPPFTGRLLHNKRDGVYHCLICDAPLFHSQTKYDSGCGWPSFYEPLSEESIRYIKDLSHGMQRIEIRCGNCDAHLGHVFPDGPQPTGERYCVNSASLRFTDGENGEEING

SEQ ID NO: 4321 - DNA, 1005 bp, Escherichia coli
gtggaatatatgactatcaaagtaggtatcaacggttttggccgtatcggtcgcattgttttccgtgctgctcagaaacgttctgacatcgagatcgttgcaatcaacgacctgttagacgctgattacatggcatacatgctgaaatatgactccactcacggccgtttcgacggtaccgttgaagtgaaagacggtcatctgatcgttaacggtaaaaaaatccgtgttaccgctgaacgtgatccggctaacctgaaatgggacgaagttggtgttgacgttgtcgctgaagcaactggtctgttcctgactgacgaaactgctcgtaaacacatcaccgctggtgcgaagaaagtggttatgactggtccgtctaaagacaacactccgatgttcgttaaaggcgctaacttcgacaaatatgctggccaggacatcgtttccaacgcttcctgcaccaccaactgcctggctccgctggctaaagttatcaacgataacttcggcatcatcgaaggtctgatgaccaccgttcacgctactaccgctactcagaaaaccgttgatggcccgtctcacaaagactggcgcggcggccgcggcgcttcccagaacatcatcccgtcttctaccggtgctgctaaagctgtaggtaaagtactgccagaactgaatggcaaactgactggtatggcgttccgcgttccgaccccgaacgtatccgtagttgacctgaccgttcgtctggaaaaagctgcaacttacgagcagatcaaagctgccgttaaagctgctgctgaaggcgaaatgaaaggcgttctgggctacaccgaagatgacgtagtatctaccgatttcaacggcgaagtttgcacttccgtgttcgatgctaaagcgggtatcgctctgaacgacaacttcgtgaaactggtatcctggtacgacaacgaaaccggttactccaacaaagttctggacctgatcgctcacatctccaaataa

SEQ ID NO: 4322 - protein, 334 aa, Escherichia coli
MEYMTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 4323 - DNA, 885 bp, Escherichia coli
atgattaagaaaatttttgcccttccggtcatcgaacaaatctcccctgtcctctcccgtcgtaaactggatgaactggacctcattgtggtcgatcatccccaggtaaaagcctcttttgcattacagggcgcacaccttctctcgtggaaacctgcgggtgaagaagaagttctgtggttgagtaacaacacaccgttcaaaaatggcgtcgccattcgcggtggcataccggtttgctggccgtggtttggtccggctgcacaacaaggtctgcctgcgcacggttttgcccgcaacctgccgtgggcgctgaaatcacatcgtgaagatgctgatggcgtagcgctgacttttgaattgacacaaagcgaagagacgaaaaaattctggccgcacgactttacgctgttagcgcatttccacgtgggtaaaacctgtgaaatcgatcttgaagcacacggcgaatttgaaactacctctgctctgcatacctactttaacgtgggtgatatcgctaaggtaagcgtcagtggactaggcgatcgcttcattgataaagtaaatgacgcgaaagaagatgtactgaccgacggtattcagaccttccctgaccgtaccgatcgcgtgtatctgaatccgcaagattgcagcgtaattaatgacgaagcgctgaatcgtattatcgccgtaggccaccagcatcatctgaacgttgtaggctggaacccaggaccggcgctttcagttagcatgggcgatatgccggatgatggctacaagacctttgtttgtgtagaaacggcttacgcttcagaaacgcaaaaagtcaccaaagagaaacctgcacatctggcgcaatccattcgcgttgcgaaacgttaa

SEQ ID NO: 4324 - protein, 294 aa, Escherichia coli
MIKKIFALPVIEQISPVLSRRKLDELDLIVVDHPQVKASFALQGAHLLSWKPAGEEEVLWLSNNTPFKNGVAIRGGIPVCWPWFGPAAQQGLPAHGFARNLPWALKSHREDADGVALTFELTQSEETKKFWPHDFTLLAHFHVGKTCEIDLEAHGEFETTSALHTYFNVGDIAKVSVSGLGDRFIDKVNDAKEDVLTDGIQTFPDRTDRVYLNPQDCSVINDEALNRIIAVGHQHHLNVVGWNPGPALSVSMGDMPDDGYKTFVCVETAYASETQKVTKEKPAHLAQSIRVAKR

SEQ ID NO: 4325 - DNA, 855 bp, Escherichia coli
atgcaacaaaaaatgattcaatttagtggcgatgtctcactgccagccatagggcagggaacatggtatatgggcgaagatgccagtcagcgtaaaacagaagttgctgcactacgcgcgggcattgaactcggtttaaccctcattgataccgccgaaatgtatgccgatggcggtgccgaaaaagtggttggggaagcattaatcggtctgcgtgataacgtctttctcgtctctaaagtctatccgtggaatgctggcgggcaaaaagcgataaatgcatgcgaagccagtttacgccgtctcaatactgattatctcgatctctacttattacactggtctggcagtttcgctctcgaagagactgtcgcagcgatggaaaaattgatcgcccagggaaaaatccgccgctggggcgtttctaaccttgattatgccgatatgcaggaactctggcagctgccggggggaaatcagtgtgccactaatcaggtgctttaccatctcggttcacgagggattgagtacgatctacttccctggtgccagaaacagcagatgccggtgatggcttacagtccattagcccaggccgggcggttgcgcaatggactgttaaaaaacgcggtagtcaacgaaattgcacatgctcacaatatcagtgcggcacaagtattgttggcgtgggtaatcagccatcagggtgtgatggcgattccaaaagcggcaactgtcgcacatgtccaacaaaatgcggctgtgcttgaggttgaactttcgtcagcggaattagctatgctggataaagcgtatccggcaccaaaaggaaaaactgcgctggatatggtgtga

SEQ ID NO: 4326 - protein, 284 aa, Escherichia coli
MQQKMIQFSGDVSLPAIGQGTWYMGEDASQRKTEVAALRAGIELGLTLIDTAEMYADGGAEKVVGEALIGLRDNVFLVSKVYPWNAGGQKAINACEASLRRLNTDYLDLYLLHWSGSFALEETVAAMEKLIAQGKIRRWGVSNLDYADMQELWQLPGGNQCATNQVLYHLGSRGIEYDLLPWCQKQQMPVMAYSPLAQAGRLRNGLLKNAVVNEIAHAHNISAAQVLLAWVISHQGVMAIPKAATVAHVQQNAAVLEVELSSAELAMLDKAYPAPKGKTALDMV

SEQ ID NO: 4327 - DNA, 747 bp, Escherichia coli
gtgaccaaactcaaacttctggcacttggagtgcttatcgcaacgtctgcaggcgtagcgcacgctgaaggtaaattttccctgggcgcaggcgtaggtgtcgttgaacacccatataaagattacgataccgatgtttacccagtaccggtaatcaactatgaaggcgataacttctggttccgtggcttaggtggtggttactacctgtggaatgacgcaacggacaaactttcaattaccgcttactggtcgccgctttacttcaaagctaaagacagtggcgatcaccaaatgcgtcacctggatgaccgtaagagcaccatgatggctggtctgtcttatgctcactttacccagtacggttacctgcgtaccaccctggctggcgataccctggataacagcaacggcatcgtctgggatatggcctggttgtatcgttacaccaacggtggcctgaccgtgactccgggtattggtgtgcagtggaacagcgaaaaccagaacgaatactattatggcgtatcgcgcaaagagtccgctcgcagcggtctgcgtggctataacccgaacgacagctggagcccttacctggagctgagcgccagctacaacttcctcggtgactggagtgtttacggtaccgcgcgctacacccgtctgtctgatgaagttactgacagcccaatggtggataaatcctggactggcctgatttctaccgggatcacctacaaattctga

SEQ ID NO: 4328 - protein, 248 aa, Escherichia coli
MTKLKLLALGVLIATSAGVAHAEGKFSLGAGVGVVEHPYKDYDTDVYPVPVINYEGDNFWFRGLGGGYYLWNDATDKLSITAYWSPLYFKAKDSGDHQMRHLDDRKSTMMAGLSYAHFTQYGYLRTTLAGDTLDNSNGIVWDMAWLYRYTNGGLTVTPGIGVQWNSENQNEYYYGVSRKESARSGLRGYNPNDSWSPYLELSASYNFLGDWSVYGTARYTRLSDEVTDSPMVDKSWTGLISTGITYKF

SEQ ID NO: 4329 - DNA, 102 bp, Escherichia coli
atgacaccacgcttacagccaaatgaatttagcgttaccggcgaccctattatttacattaattatgcaaaatttatggatgagttgttgatatgccattga

SEQ ID NO: 4330 - protein, 33 aa, Escherichia coli
MTPRLQPNEFSVTGDPIIYINYAKFMDELLICH

SEQ ID NO: 4331 - DNA, 1935 bp, Escherichia coli
atgaatatattcgatcactatcgccagcgatatgaagctgccaaggacgaagagttcacactgcaggagtttcttaccacttgtcggcaagatcgcagtgcttatgccaacgcggctgagcggctattgatggctattggtgagcctgtcatggtcgatacagcccaggaacccagactttctcgactcttttctaaccgggtcattgcacgttatccggcgtttgaagagttttacggcatggaagacgcgattgaacagattgtctcttatctgaaacacgcggctcaggggctggaagagaagaaacaaatcctgtatctgctggggcctgtgggtgggggtaaatcatcgcttgctgagcgactgaaatcattaatgcagctcgtaccgatttatgtattgagcgccaacggtgagcgtagcccggtcaacgatcatccgttctgtcttttcaatccgcaggaagatgcgcagattctggaaaaagagtatggcattcctcgccgttatctcggcaccatcatgtcgccgtgggcggcaaagcgcctgcatgaatttggtggcgatatcactaagttccgggtagtgaaggtctggccgtcaattctgcaacaaattgccatcgccaaaacggaacccggcgatgagaacaaccaggacatctccgccctggtagggaaagtcgatattcgtaaactcgaacactacgcgcagaatgacccggacgcctacggctattccggtgcgctgtgccgcgccaatcaggggatcatggaatttgtcgagatgtttaaagcaccgataaaagtgctgcatcccttgttaaccgccacccaggaaggtaactacaacgggacggaaggtatctccgccctgccgttcaacgggattattctcgcccactcgaacgaatccgaatgggtcactttccgtaataacaaaaacaacgaagccttcctcgaccgtgtttacatcgtgaaggtgccgtattgcttgcgcatttccgaagagatcaaaatctacgagaaattgcttaatcacagtgaattgactcacgccccctgcgcccctggcacgctggaaacgctgtcacgtttttctattctttcgcgtctgaaagagccagaaaactccagcatttattcaaagatgcgggtttatgatggtgaaagtttgaaagacactgatcccaaagccaagtcgtatcaggaatatcgtgactacgccggtgtcgatgaagggatgaacggtctgtcgacgcgttttgcgtttaagatcctctcccgcgtgttcaacttcgatcatgtagaagtggcggcaaacccggtccatctgttctacgtcctggaacagcagatcgagcgcgagcagttcccgcaagagcaggcagaacgctatctggagttcctgaaaggttatctgatcccgaaatatgccgagtttatcggcaaagagatccagacggcctaccttgaatcctattcagaatatgggcagaacatttttgaccgttatgttacctacgcggatttctggattcaggatcaggagtatcgcgatccggataccgggcagttgtttgaccgcgagtctcttaacgccgagctggagaaaatcgagaaaccggcggggatcagtaatccaaaagatttccgcaacgagattgttaacttcgtactgcgagccagagcgaataacagcggacgtaatccgaactggaccagctatgaaaaactgcgcacggttatcgagaagaaaatgttctccaataccgaagagctgttgccggttatttcgtttaacgccaaaacgtcaaccgacgagcagaagaaacacgacgactttgtcgaccgtatgatggaaaaaggctacacccgtaaacaggtgcgtttactgtgcgaatggtatttgcgcgtacgtaaatcgtcttaa

SEQ ID NO: 4332 - protein, 644 aa, Escherichia coli
MNIFDHYRQRYEAAKDEEFTLQEFLTTCRQDRSAYANAAERLLMAIGEPVMVDTAQEPRLSRLFSNRVIARYPAFEEFYGMEDAIEQIVSYLKHAAQGLEEKKQILYLLGPVGGGKSSLAERLKSLMQLVPIYVLSANGERSPVNDHPFCLFNPQEDAQILEKEYGIPRRYLGTIMSPWAAKRLHEFGGDITKFRVVKVWPSILQQIAIAKTEPGDENNQDISALVGKVDIRKLEHYAQNDPDAYGYSGALCRANQGIMEFVEMFKAPIKVLHPLLTATQEGNYNGTEGISALPFNGIILAHSNESEWVTFRNNKNNEAFLDRVYIVKVPYCLRISEEIKIYEKLLNHSELTHAPCAPGTLETLSRFSILSRLKEPENSSIYSKMRVYDGESLKDTDPKAKSYQEYRDYAGVDEGMNGLSTRFAFKILSRVFNFDHVEVAANPVHLFYVLEQQIEREQFPQEQAERYLEFLKGYLIPKYAEFIGKEIQTAYLESYSEYGQNIFDRYVTYADFWIQDQEYRDPDTGQLFDRESLNAELEKIEKPAGISNPKDFRNEIVNFVLRARANNSGRNPNWTSYEKLRTVIEKKMFSNTEELLPVISFNAKTSTDEQKKHDDFVDRMMEKGYTRKQVRLLCEWYLRVRKSS

SEQ ID NO: 4333 - DNA, 1284 bp, Escherichia coli
atgacctggtttattgaccggcgtctgaacggcaaaaataaaagcatggtgaatcgccagcgtttcttacgccgttataaagcgcaaattaaacagtcgatctccgaggccataaataagcgttcggtgactgacgtcgacagcggcgagtccgtatccattcccacggaagatattagcgaaccgatgtttcatcaggggcgtggaggcctgcgccaccgcgtgcatccgggcaatgaccatttcgtccagaacgaccgaattgagcgtccccagggtggtggcggaggttccggcagtggtcagggccaggccagccaggatggtgaaggtcaggatgaatttgtctttcagatttcgaaagatgagtatcttgatctgctctttgaagatttggccttaccgaatctgaaacaaaaccaacaacgccagctgaccgaatataaaacgcatcgggcgggttataccgctaacggcgttccggccaatatcagcgttgtacgttcattgcagaactcactggcgcggcgcacagccatgacggcgggcaagcggcgggaacttcatgcactggaagagaatttggccatcatcagcaacagtgaacctgcgcaactgctggaagaggaacggctgcgcaaagagattgctgaattgcgcgccaaaattgaacgcgttcctttcattgacactttcgatttacgttacaagaactacgaaaaacggcccgatccctccagccaggcagtgatgttttgcctgatggacgtttccggttcaatggatcagtccactaaagatatggctaaacgtttttatattctgctgtatctgttcctcagcagaacgtataagaacgtggaagtcgtatacatccgccatcatacccaggcgaaagaagtcgatgaacatgagtttttctactcgcaggaaactggcggcaccattgtttccagcgccctaaaactgatggatgaggtagtgaaagagcgttataacccggcacagtggaatatttacgcagcccaagcatcagacggcgataactgggccgatgactctccgctttgccatgaaattctggcgaaaaaaatattacccgttgttcgttattacagctatatcgaaattacacgtcgcgcgcatcagacactgtggcgagaatatgagcatctgcaatctactttcgacaactttgcgatgcagcatatccgcgaccaggatgatatttatccggtgttccgtgaactgtttcataaacaaaatgcaacagctaaagactaa

SEQ ID NO: 4334 - protein, 427 aa, Escherichia coli
MTWFIDRRLNGKNKSMVNRQRFLRRYKAQIKQSISEAINKRSVTDVDSGESVSIPTEDISEPMFHQGRGGLRHRVHPGNDHFVQNDRIERPQGGGGGSGSGQGQASQDGEGQDEFVFQISKDEYLDLLFEDLALPNLKQNQQRQLTEYKTHRAGYTANGVPANISVVRSLQNSLARRTAMTAGKRRELHALEENLAIISNSEPAQLLEEERLRKEIAELRAKIERVPFIDTFDLRYKNYEKRPDPSSQAVMFCLMDVSGSMDQSTKDMAKRFYILLYLFLSRTYKNVEVVYIRHHTQAKEVDEHEFFYSQETGGTIVSSALKLMDEVVKERYNPAQWNIYAAQASDGDNWADDSPLCHEILAKKILPVVRYYSYIEITRRAHQTLWREYEHLQSTFDNFAMQHIRDQDDIYPVFRELFHKQNATAKD

SEQ ID NO: 4335 - DNA, 1476 bp, Escherichia coli
atgattcggtcaacacgtatttccctggggttattctttaattattttttatcgttaacgaaaattgatcctggtcaaaactatatatctctgccatcaataaaatccagcactcacattgctctcctttttatggtttctatgggtacacaaaaattaaaagctcaaggcttttttattttcagcttattgctgacgttaattttattttgcatcactaccttatataacgaaaatacaaatgtaaaactcatcccacagatgaattacctgatggttgttgtggctttgtttttccttaacgccgtcattttccttttcatgttaatgaagtatttcactaacaaacaaattttaccaacactcattttaagccttgcatttttaagtggccttatctatttagttgaaaccattgtaattatccataaaccaatcaacggcagtacactgatccagacaaagtcgaatgatgtttctattttctatattttccgccaactcagtttcatttgtttaacctcgctggcgctcttttgttatgggaaagacaacatccttgacaacaataagaagaaaactggcattctgttgctggcgctgattccttttttagtttttccccttctggcacacaatctgagcagttataacgctgactattctttgtatgtcgtcgattactgtccggacaaccatactgcgacctggggaatcaactatacaaaaatattggtttgtttgtgggcatttttactgttctttattatcatgcgtacacgattagccagcgaactatggccgttaatagcattattatgtctggcatcgctatgctgcaacttacttctactgactctggatgagtataattacaccatctggtatatcagtcgcgggattgaagtttccagtaaactgtttgttgtgtcttttctgatttataacatttttcaggaactgcaactctccagcaaactggcagttcatgatgtgctgaccaatatttataatcggcgctactttttcaacagcgtagagtcattattgtcgcgacctgttgttaaggacttctgtgtcatgctggttgatattaatcagttcaaacgcatcaatgcccaatggggacatcgtgtgggtgataaagtgctggtttcaattgtcgatattatccagcaaagcatccgccccgatgatattttagcgcgactggagggtgaggtatttggcttgctatttaccgaactcaatagtgcccaggcaaaaatcattgcggaacgtatgcgtaaaaatgtcgaactcctgaccggctttagtaacagatatgatgttcctgaacaaatgaccatcagtattggcacggttttttcaacgggtgacacgcataatatctcgcttgtcatgacggaagcagataaagccttacgcgaagcgaaaagcgaagggggcaacaaagtgattattcatcatatttaa

SEQ ID NO: 4336 - protein, 491 aa, Escherichia coli
MIRSTRISLGLFFNYFLSLTKIDPGQNYISLPSIKSSTHIALLFMVSMGTQKLKAQGFFIFSLLLTLILFCITTLYNENTNVKLIPQMNYLMVVVALFFLNAVIFLFMLMKYFTNKQILPTLILSLAFLSGLIYLVETIVIIHKPINGSTLIQTKSNDVSIFYIFRQLSFICLTSLALFCYGKDNILDNNKKKTGILLLALIPFLVFPLLAHNLSSYNADYSLYVVDYCPDNHTATWGINYTKILVCLWAFLLFFIIMRTRLASELWPLIALLCLASLCCNLLLLTLDEYNYTIWYISRGIEVSSKLFVVSFLIYNIFQELQLSSKLAVHDVLTNIYNRRYFFNSVESLLSRPVVKDFCVMLVDINQFKRINAQWGHRVGDKVLVSIVDIIQQSIRPDDILARLEGEVFGLLFTELNSAQAKIIAERMRKNVELLTGFSNRYDVPEQMTISIGTVFSTGDTHNISLVMTEADKALREAKSEGGNKVIIHHI

SEQ ID NO: 4337 - DNA, 1671 bp, Escherichia coli
gtgcaaaaatattcagagccatgctttttgcgtggcttttgcatacaatttattactattacccctaaatttcccctccccagcggcgcagagatgagtataattagcgcccctgtgccaggccgcaatcgaactttatctggttttctcgtttcactaaccgaaggagtgccatttatcatgaaattgcaccatagaatgctccggcattttatcgccgcaagtgtcattgtgctgacatcttccttccttatttttgaacttgtcgccagtgacagagcaatgagtgcctatctgcgctatatcgtgcagagagcagactcctcctttctttatgataagtatcagaatcagagtattgccgcgcatgtgatgcgcgctctcgctgctgagcagtcggaagtgtcgccagaacagcggcgcgccatctgcgaggcttttgagtctgccaataatacccatggcttaaacctgactgcccataaataccctggcttacgcggcacactacaaaccgcatccactgactgtgacacaattgtggaagctgctgcactattacccgcttttgatcaggcagtggaaggcaaccgccaccaggatgattacggttcaggtcttgggatggccgaagagaaatttcactattatctcgatctcaatgaccgctatgtctatttttatgagccggttaatgttgagtactttgcgatgaataactggtccttcctgcagtcaggaagtattggcatcgatcgcaaagatattgaaaaggtatttaccgggcgtaccgtattatcgagcatttaccaggatcagcgtactaaacagaacgtgatgagtttactgacgccggtatatgtcgcagggcagctaaaagggattgtgctgctggatattaacaaaaacaatctgcggaatatcttttacactcatgaccgccctctcctctggcgttttctcaatgtcacgctaactgatacagattcggggcgcgacattatcatcaaccagagcgaagataatctgttccagtatgtcagttacgtccatgacttaccgggcggcattcgtgtctcgttatccattgatattctttactttatcacgtcttcgtggaaaagcgttctgttctggattttgacggcgttaattttgctgaatatggtgcggatgcacttccgtttataccaaaatgtgtcgcgagaaaatattagtgatgcgatgactggactgtataatcgcaaaattttaacccctgaactggagcagcggttgcagaaactggtgcaatccggttcttcggtgatgtttattgcaattgacatggacaagttaaagcaaataaatgacacccttggtcatcaggagggggatttagcgattacgttattagctcaggcgattaaacaatcgattcgtaaaagtgattatgccatccgactcggtggcgatgaattctgcatcattcttgtcgattcgacgccgcaaattgcagcacaactgcctgaacgtatcgaaaaacgtctgcaacatatcgcgccgcagaaagagatcggcttctcttccggtatttacgcgatgaaagaaaacgatacgttacatgatgcgtataaagcttccgatgagcgtttatatgtcaataagcagaacaaaaacagccgttcatga

SEQ ID NO: 4338 - protein, 556 aa, Escherichia coli
MQKYSEPCFLRGFCIQFITITPKFPLPSGAEMSIISAPVPGRNRTLSGFLVSLTEGVPFIMKLHHRMLRHFIAASVIVLTSSFLIFELVASDRAMSAYLRYIVQRADSSFLYDKYQNQSIAAHVMRALAAEQSEVSPEQRRAICEAFESANNTHGLNLTAHKYPGLRGTLQTASTDCDTIVEAAALLPAFDQAVEGNRHQDDYGSGLGMAEEKFHYYLDLNDRYVYFYEPVNVEYFAMNNWSFLQSGSIGIDRKDIEKVFTGRTVLSSIYQDQRTKQNVMSLLTPVYVAGQLKGIVLLDINKNNLRNIFYTHDRPLLWRFLNVTLTDTDSGRDIIINQSEDNLFQYVSYVHDLPGGIRVSLSIDILYFITSSWKSVLFWILTALILLNMVRMHFRLYQNVSRENISDAMTGLYNRKILTPELEQRLQKLVQSGSSVMFIAIDMDKLKQINDTLGHQEGDLAITLLAQAIKQSIRKSDYAIRLGGDEFCIILVDSTPQIAAQLPERIEKRLQHIAPQKEIGFSSGIYAMKENDTLHDAYKASDERLYVNKQNKNSRS

SEQ ID NO: 4339 - DNA, 504 bp, Escherichia coli
atgactgaaatggctaaaggaagcgtgacgcatcagcggttaatcgctttattatcgcaagaaggtgctaacttccgcgtcgttacccatgaagcggtaggtaaatgtgaagcggtgtcagaaattcgtggcaccgctttaggccagggggctaaggcactggtatgcaaagtcaaaggcaatggcgtaaatcaacatgttctggcgatcctcgctgccgatcaacaggccgatctgagccaactcgccagccatataggcggattacgcgcttcgttggccagcccggcggaagtcgatgaactcacaggctgtgtcttcggcgcgatcccccctttcagcttccatccaaaactcaaactggttgccgaccccctactcttcgaacgatttgatgaaatcgccttcaatgcaggcatgctggataaatccgttattttgaaaaccgcggattatttgcgtattgcgcaaccagaactggtcaatttccgccgcactgcgtaa

SEQ ID NO: 4340 - protein, 167 aa, Escherichia coli
MTEMAKGSVTHQRLIALLSQEGANFRVVTHEAVGKCEAVSEIRGTALGQGAKALVCKVKGNGVNQHVLAILAADQQADLSQLASHIGGLRASLASPAEVDELTGCVFGAIPPFSFHPKLKLVADPLLFERFDEIAFNAGMLDKSVILKTADYLRIAQPELVNFRRTA

SEQ ID NO: 4341 - DNA, 822 bp, Escherichia coli
atgatgcacaggttgaatctcaatggctatgaacccgaccgacaccatgaagccgcggtcgcattttgtattcacgccggaacggatgagttaaccagtcctgtacatcagcaccgcaaagggcagttgatactggcgctacatggtgcaattacctgtacggtggaaaatgctttgtggatggtgccgccacaatatgcggtttggataccgggcggggtgaaacatagcaatcaagtgacagctaacgctgaactctgttttctgtttatcgagcccagcgcagtgacaatgccgacaacatgttgcacattgaaaatatcgcccttatgccgggaattaattttaaccctggcaaacaggacgacgactcagcgtgctgagccgatgacccgcagattaattcaggtcctgtttgatgaactccctcagcagccacaacaacagctgcacctgcccgtttcttctcatcttaaaatccgcacgatggtggagatgatggcgaaagagcccgtcgagtggggctcattggggcaatgggctggcttttttgcgatgagtgaacgcaatcttgcccggctgatagtgaaagagacggggttgagttttcgccagtggcgtcagcagttacagctgattatggcgcttcagggattagtgaaaggcgatactgtacagaaagttgctcatacgctggggtatgattcaacaacggcctttattactatgtttaagaaaggcctggggcaaacgccaggccgatatattgcgggattaactactgtttccccacaatcagcgaaaccagacccgcggcaataa

SEQ ID NO: 4342 - protein, 273 aa, Escherichia coli
MMHRLNLNGYEPDRHHEAAVAFCIHAGTDELTSPVHQHRKGQLILALHGAITCTVENALWMVPPQYAVWIPGGVKHSNQVTANAELCFLFIEPSAVTMPTTCCTLKISPLCRELILTLANRTTTQRAEPMTRRLIQVLFDELPQQPQQQLHLPVSSHLKIRTMVEMMAKEPVEWGSLGQWAGFFAMSERNLARLIVKETGLSFRQWRQQLQLIMALQGLVKGDTVQKVAHTLGYDSTTAFITMFKKGLGQTPGRYIAGLTTVSPQSAKPDPRQ

SEQ ID NO: 4343 - DNA, 447 bp, Escherichia coli
atgtttgatgtcactttgctgatcctgctcgggttagctgcgctgggctttatcagtcataacaccactgtcgccgtttcaattctggtgttgatcattgtccgcgtcacaccgttaagcacctttttcccgtggattgaaaaacaggggctaagtatcgggataatcattctgacgattggcgttatggctcccatcgccagcgggacgctaccgccctcaaccctgattcactcgtttctgaactggaaatcgctggtggcaattgcagtcggcgttattgtctcctggctgggggggcgcggcgtgacgttaatgggcagccagccgcaactggtcgccgggctgctggtgggcactgttttaggcgtggcgctgtttcgcggcgtaccggttggcccgcttattgccgcgggtctggtttcgctgattgtggggaaacagtag

SEQ ID NO: 4344 - protein, 148 aa, Escherichia coli
MFDVTLLILLGLAALGFISHNTTVAVSILVLIIVRVTPLSTFFPWIEKQGLSIGIIILTIGVMAPIASGTLPPSTLIHSFLNWKSLVAIAVGVIVSWLGGRGVTLMGSQPQLVAGLLVGTVLGVALFRGVPVGPLIAAGLVSLIVGKQ

SEQ ID NO: 4345 - DNA, 1182 bp, Escherichia coli
atgacctgttcaacttcattaagcggcaaaaacaggattgtccttatcgctggcattctgatgattgccacaacattacgcgtcacctttaccggcgcagcaccgttactggatacgattcgttccgcttactcgctaacgacggcgcaaaccggcttattgaccaccctgccattattagcctttgcgctaatctcaccgctggccgccccggtggcgcgacgttttggtatggaacgtagcctgtttgccgcgttacttttgatctgtgcaggtatcgcaattcgctctctcccttcgccttacttattatttggcggtacagcggtcattggcggtgggattgcattaggcaatgtcttactgccaggattaattaaacgcgatttccctcattccgtcgccagacttaccggcgcatattccctgacaatgggagctgcggcggcactgggatcggcgatggtagcgccgctggctttgaacggttttggctggcaaggcgcgttgctcatgctgatgtgttttcctctgctggctctttttttatggctgccacagtggcgaagtcaacaacatgcaaatttgagtacctcacgcgccttacatactcggggtatctggcgttcgccgcttgcctggcaggtaacattgtttcttgggatcaactcactggtctattacgtgattattggctggcttccggcgattctcatcagtcacggctatagcgaagcacaggcgggttcactgcatggtttgctgcaactagccacagcagctcccggtttgctgatcccacttttcttacatcatgtgaaagatcagcgtggtattgcagcgttcgttgccttgatgtgcgcagtgggcgcggctgggctctgctttatgccagcacacgcgatcacctggactctgcttttcggttttggttccggcgcaacaatgatactggggttgacgttcattggtctgcgggcaagttctgcgcatcaggcggcggcactctcggggatggcacaatccgtcgggtatttgctggcagcctgtgggccgccgctgatgggtaaaatacacgatgctaacggtgactggtccgtaccactgctgggtgttgcaatactttcactactgatggcgattttcggactttgcgccgggagagacaaagaaattcgctaa

SEQ ID NO: 4346 - protein, 393 aa, Escherichia coli
MTCSTSLSGKNRIVLIAGILMIATTLRVTFTGAAPLLDTIRSAYSLTTAQTGLLTTLPLLAFALISPLAAPVARRFGMERSLFAALLLICAGIAIRSLPSPYLLFGGTAVIGGGIALGNVLLPGLIKRDFPHSVARLTGAYSLTMGAAAALGSAMVAPLALNGFGWQGALLMLMCFPLLALFLWLPQWRSQQHANLSTSRALHTRGIWRSPLAWQVTLFLGINSLVYYVIIGWLPAILISHGYSEAQAGSLHGLLQLATAAPGLLIPLFLHHVKDQRGIAAFVALMCAVGAAGLCFMPAHAITWTLLFGFGSGATMILGLTFIGLRASSAHQAAALSGMAQSVGYLLAACGPPLMGKIHDANGDWSVPLLGVAILSLLMAIFGLCAGRDKEIR

SEQ ID NO: 4347 - DNA, 348 bp, Escherichia coli
atgaatattcagtgcaaacgcgtttatgatccggctgaacagagcgatggttatcgcgtactggtcgaccgcctctggccacgcggtattaaaaaaaccgatttagcccttgatgaatgggataaagaaatcacgccgtcaacggagctgcgcaaagcctttcacggcgaagtcgtcgattttgcaacctttcgcgagcaatatcttgcagaactggcgcaacacgagcaagaaggaaagcggctggcagacatcgccaaaaaacagccgctgaccctgctctactcagcaaaaaacaccacgcagaaccatgcgctggtgctggcagactggctacgtagcttgtga

SEQ ID NO: 4348 - protein, 115 aa, Escherichia coli
MNIQCKRVYDPAEQSDGYRVLVDRLWPRGIKKTDLALDEWDKEITPSTELRKAFHGEVVDFATFREQYLAELAQHEQEGKRLADIAKKQPLTLLYSAKNTTQNHALVLADWLRSL

SEQ ID NO: 4349 - DNA, 255 bp, Escherichia coli
atgaaaattatcagttttgttctgccttgcttgctggtcctggctggttgttcaaccccttctcagccagaagcacctaaaccgccgcagattggtatggcaaatccggcgtcggtctattgccagcagaagggcgggacgctcattcctgtgcagacagcgcaaggggtcagcaacaattgcaaattaccgggcggtgaaacgattgatgaatgggcattgtggcgacgggaccatccggctggtgaaaaataa

SEQ ID NO: 4350 - protein, 84 aa, Escherichia coli
MKIISFVLPCLLVLAGCSTPSQPEAPKPPQIGMANPASVYCQQKGGTLIPVQTAQGVSNNCKLPGGETIDEWALWRRDHPAGEK

SEQ ID NO: 4351 - DNA, 1155 bp, Escherichia coli
ttgcagcactatttttattacattcactcaaaacatattacgccttgtttcatctttgttgatgatgttttatcatgcctgcaaagattaaataatcagcatttacccgccgtatcctggagttgtttcgtgtcagatcagattatcgcccgcgtctcgcaatcccttgccaaagaacagtcactggaaagtctggttcgacagcttctggagatgctggaaatggtcactgatatggagtcaacctacctgaccaaagtggatgtcgaagcgcgcctgcagcatataatgtttgcccgtaatagccagaaaatgcacatcccggagaattttaccgtctcgtgggattactcgttatgcaaacgcgccattgatgaaaactgttttttcagcgatgaagtccccgaccgttggggcgactgtgttgcggcacgcaatcttggcatcaccacatttctgagcacgccaattcacttaccggatggatcattctatggcacgctttgcgccgccagcagtgagaagcgccagtggagtgaacgcgcggaacaggtcttacagttgttcgccggactgattgcacaatatattcaaaaagaggcactggttgaacagctgcgcgaagctaatgctgcgctgattgcgcaatcgtataccgactcgttaactgggctaccgaatcggcgggcgatttttgaaaatctgacgacgctgttttctctcgcccggcatcttaaccataagataatgatcgcgtttatcgatctggataacttcaaattaatcaatgatcgttttggtcataatagtggcgatctgtttctcattcaggttggcgagcgccttaatacgctccagcaaaatggcgaagttattggtcgtctcggcggtgatgagtttttggttgtttcactgaacaacgagaatgcggatatttcgtcgctgcgagaacgtattcaacaacaaatacgcggagaatatcacttaggtgatgttgatttgtattatcctggtgccagtcttggcatagtagaagtcgatcctgaaacgaccgatgcagacagtgccctgcatgctgccgatatcgcgatgtatcaggagaaaaaacataaacagaaaacaccttttgtcacgcattcagcgctacattcctga

SEQ ID NO: 4352 - protein, 384 aa, Escherichia coli
MQHYFYYIHSKHITPCFIFVDDVLSCLQRLNNQHLPAVSWSCFVSDQIIARVSQSLAKEQSLESLVRQLLEMLEMVTDMESTYLTKVDVEARLQHIMFARNSQKMHIPENFTVSWDYSLCKRAIDENCFFSDEVPDRWGDCVAARNLGITTFLSTPIHLPDGSFYGTLCAASSEKRQWSERAEQVLQLFAGLIAQYIQKEALVEQLREANAALIAQSYTDSLTGLPNRRAIFENLTTLFSLARHLNHKIMIAFIDLDNFKLINDRFGHNSGDLFLIQVGERLNTLQQNGEVIGRLGGDEFLVVSLNNENADISSLRERIQQQIRGEYHLGDVDLYYPGASLGIVEVDPETTDADSALHAADIAMYQEKKHKQKTPFVTHSALHS

SEQ ID NO: 4353 - DNA, 114 bp, Escherichia coli
ttgattggtgataacatgcgaatcggtattatttttccggttgtaatctttattacagcggtcgtatttttagcatggttttttattggcggctatgctgccccgggagcataa

SEQ ID NO: 4354 - protein, 37 aa, Escherichia coli
MIGDNMRIGIIFPVVIFITAVVFLAWFFIGGYAAPGA

SEQ ID NO: 4355 - DNA, 249 bp, Escherichia coli
atgggcattctgtcatggattatttttgggcttattgccggtattctggcgaagtggatcatgccaggtaaagatggtggtggattctttatgactatcctgctggggatagtcggtgccgtagtcggcggatggatcagcacgctgtttggctttggtaaagtcgatggcttcaattttggcagcttcgtggttgccgttattggtgcgattgttgtgctatttatctacaggaagattaaaagttaa

SEQ ID NO: 4356 - protein, 82 aa, Escherichia coli
MGILSWIIFGLIAGILAKWIMPGKDGGGFFMTILLGIVGAVVGGWISTLFGFGKVDGFNFGSFVVAVIGAIVVLFIYRKIKS

SEQ ID NO: 4357 - DNA, 183 bp, Escherichia coli
atgggcaaagcaacgtataccgtgaccgtcaccaataacagcaatggcgtttctgtcgattatgaaacagagacgccgatgactttgctggtgccagaagtggcggctgaagtgataaaagatctggtgaataccgtgcgttcttatgacacggaaaacgaacatgatgtttgtggttggtaa

SEQ ID NO: 4358 - protein, 60 aa, Escherichia coli
MGKATYTVTVTNNSNGVSVDYETETPMTLLVPEVAAEVIKDLVNTVRSYDTENEHDVCGW

SEQ ID NO: 4359 - DNA, 360 bp, Escherichia coli
atgctgcaaatcccacagaattatattcatacgcgctcaacgcctttctggaataaacaaactgcgcctgccggaatattcgaacgtcatcttgataaaggaacgcgcccgggggtttacccacgcctttccgttatgcatggggcggtcaaatatctcggctacgctgatgaacacagtgcagagcctgatcaggtgatccttatcgaagcggggcagtttgcggtgttccctccagaaaagtggcacaacattgaagccatgactgacgatacttatttcaacattgacttcttcgttgctcctgaagtcctgatggaaggcgcgcaacaacggaaagtcattcataacgggaaatga

SEQ ID NO: 4360 - protein, 119 aa, Escherichia coli
MLQIPQNYIHTRSTPFWNKQTAPAGIFERHLDKGTRPGVYPRLSVMHGAVKYLGYADEHSAEPDQVILIEAGQFAVFPPEKWHNIEAMTDDTYFNIDFFVAPEVLMEGAQQRKVIHNGK

SEQ ID NO: 4361 - DNA, 114 bp, Escherichia coli
ttgcagcatccttttccctccttcggtgaatgcgctgaaaacggtttattccagccgtttcagggtacgcctgataatttgcattttaaataccatttattggttactttttag

SEQ ID NO: 4362 - protein, 37 aa, Escherichia coli
MQHPFPSFGECAENGLFQPFQGTPDNLHFKYHLLVTF

SEQ ID NO: 4363 - DNA, 639 bp, Escherichia coli
gtgttcgctgaatacggggttctgaattactggacctatctggttggggccatttttattgtgttggtgccagggccaaataccctgtttgtactcaaaaatagcgtcagtagcggtatgaaaggcggttatcttgcggcctgtggtgtatttattggcgatgcggtattgatgtttctggcatgggctggagtggcgacattaattaagaccaccccgatattattcaacatcgtacgttatcttggtgcgttttatttgctctatctggggagtaaaattctctacgcgaccctgaaaggtaaaaatagcgagaccaaatccgatgagccccaatacggtgccatttttaaacgcgcgttaattttgagcctgactaatccgaaagccattttgttctatgtgtcgtttttcgtacagtttatcgatgttaatgccccacatacgggaatttcattctttattctggcgacgacgctggaactggtgagtttctgctatttgagcttcctgattatttctggggcttttgtcacgcagtacatacgtaccaaaaagaaactggctaaagtgggcaactcactgattggtttgatgttcgtgggtttcgccgcccgactggcgacgctgcaatcctga

SEQ ID NO: 4364 - protein, 212 aa, Escherichia coli
MFAEYGVLNYWTYLVGAIFIVLVPGPNTLFVLKNSVSSGMKGGYLAACGVFIGDAVLMFLAWAGVATLIKTTPILFNIVRYLGAFYLLYLGSKILYATLKGKNSETKSDEPQYGAIFKRALILSLTNPKAILFYVSFFVQFIDVNAPHTGISFFILATTLELVSFCYLSFLIISGAFVTQYIRTKKKLAKVGNSLIGLMFVGFAARLATLQS

SEQ ID NO: 4365 - DNA, 333 bp, Escherichia coli
ttgagcttaacgcaaaatgcgctcgacaccacgacgagtaaataccgattcctgaatgacgacttcattctctgttccttcatttactctaccgcctggcgaggaatattcgccttcggtgtttttccggaccacgtaaaaatcgatgtcgccaggctgtttcccgccagtggtcatttagtacaagtgctaccggaatattaccagccagcgaatgtctgggccgtttatgtttcaaagctgtcgacgtcagcgaaagtgcggataacggtagaatttttacgccagtattttgccgagcactacccgaatttttcactggagcaggcctga

SEQ ID NO: 4366 - protein, 110 aa, Escherichia coli
MSLTQNALDTTTSKYRFLNDDFILCSFIYSTAWRGIFAFGVFPDHVKIDVARLFPASGHLVQVLPEYYQPANVWAVYVSKLSTSAKVRITVEFLRQYFAEHYPNFSLEQA

SEQ ID NO: 4367 - DNA, 171 bp, Escherichia coli
atgaccactggcgggaaacagcctggcgacatcgatttttacgtggtccggaaaaacaccgaaggcgaatattcctcgccaggcggtagagtaaatgaaggaacagagaatgaagtcgtcattcaggaatcggtatttactcgtcgtggtgtcgagcgcattttgcgttaa

SEQ ID NO: 4368 - protein, 56 aa, Escherichia coli
MTTGGKQPGDIDFYVVRKNTEGEYSSPGGRVNEGTENEVVIQESVFTRRGVERILR

SEQ ID NO: 4369 - DNA, 1128 bp, Escherichia coli
ttgaattaccaaatgattaccacggacgatgcgctggcttctttgtgtgaagccgtccgtgcctttccggcgatagccctggatactgaatttgttcgtacgcgcacttattacccgcagctgggtttaattcaactttttgatggtgagcatctggcgctaattgatcctctcgggatcaccgactggtcaccgctgaaagcgatcctgcgcgatccgtccatcacaaaatttcttcatgcaggcagtgaagatctggaagtgttcctcaatgtctttggcgaattaccacaacccttgattgacacgcaaatccttgctgccttctgcggacgcccgatgtcatggggtttcgcttccatggtggaagagtattccggcgttacgctggacaagagtgaatcgcgcaccgactggctggccagaccgctgaccgaacgtcagtgtgaatacgcagcggcggatgtctggtatctgttaccgatcaccgcaaagcttatggtagaaacggaggcctccggctggctacctgcggcgctggatgaatgccgcctgatgcaaatgcgtcgtcaggaagtcgttgcgccggaagacgcctggcgtgatatcaccaatgcctggcaattacgcacacgccaactggcctgtctgcaactgttagccgactggcgattgcgcaaggcgcgagagcgcgatctggcggtgaactttgtcgtgcgtgaagagcatttgtggtcggtagcgcgttatatgccgggaagtctgggcgaactggacagcctgggcttatccggtagcgaaatccgcttccacggtaaaacgttgctggcgctggtggaaaaagcgcaggcattgccggaagaggccttaccgcagccgatgcttaacctgatggacatgccgggttatcgtaaagcgtttaaagcgattaagtcgctgattactgacgtcagcgaaacgcacaagatcagcgccgaattgctggcatcgcgtcggcaaatcaaccaactgctgaactggcactggaaactgaaaccgcagaacaatttgccggagctgatttccggctggcgtggtgagctgatggcggaagcattacacaatttattgcaggaatatccacagtaa

SEQ ID NO: 4370 - protein, 375 aa, Escherichia coli
MNYQMITTDDALASLCEAVRAFPAIALDTEFVRTRTYYPQLGLIQLFDGEHLALIDPLGITDWSPLKAILRDPSITKFLHAGSEDLEVFLNVFGELPQPLIDTQILAAFCGRPMSWGFASMVEEYSGVTLDKSESRTDWLARPLTERQCEYAAADVWYLLPITAKLMVETEASGWLPAALDECRLMQMRRQEVVAPEDAWRDITNAWQLRTRQLACLQLLADWRLRKARERDLAVNFVVREEHLWSVARYMPGSLGELDSLGLSGSEIRFHGKTLLALVEKAQALPEEALPQPMLNLMDMPGYRKAFKAIKSLITDVSETHKISAELLASRRQINQLLNWHWKLKPQNNLPELISGWRGELMAEALHNLLQEYPQ

SEQ ID NO: 4371 - DNA, 1752 bp, Escherichia coli
atgttaacgatatgtttattgcttggggttgcgatgacgacgaacacgcattttagaggtgaagaattgaagaaggtttggcttaaccgttatcccgcggacgttccgacggagatcaaccctgaccgttatcaatctctggtagatatgtttgagcagtcggtcgcgcgctacgccgatcaacccgcgtttgtgaatatgggggaggtgatgaccttccgcaaactggaagaacgcagtcgcgcgtttgccgcttatttgcaacaagggttggggctgaagaaaggcgatcgcgttgcgttgatgatgcctaacttattgcaatatccggtggcgctgtttggcattttgcgtgccgggatgatcgtcgtaaacgttaacccgttgtataccccgcgtgagcttgagcatcagcttaacgatagcggcgcatcggcgattgttatcgtgtctaactttgcccacactctggaaaaagtggttgataaaaccgccgttcagcacgttattctgacccgtatgggcgatcagctatctacggcaaaaggcacggtagtcaatttcgttgttaaatacatcaagcgtctggtgccgaaataccatctgccagatgccatttcatttcgtagcgccctgcacaacggctaccggatgcagtatgtcaaaccagaactggtgccggaagatttagctttcctgcaatacaccggcggcaccactggtgtggcgaaaggcgcgatgctgactcaccgcaatatgctggcgaacctggaacaggttaacgcgacctatggtccgctgttgcatccgggcaaagagctggtggtgacggcgctgccgctgtatcacatttttgccctgaccattaactgcctgctgtttatcgaactgggtgggcagaacctgcttatcactaacccgcgcgatattccagggttggtaaaagagttagcgaaatatccgtttaccgctatcactggcgttaacaccttgttcaatgcgttgctgaacaataaagagttccagcagctggatttctccagtctgcatctttccgcaggcggagggatgcctgttcagcaagtggtggcagaacgttgggtgaaactgactggacagtatctgctggaaggttatggcctgaccgagtgtgcgccgctggtcagcgttaacccgtatgatattgattatcatagtggtagcatcggtttaccggtgccgtcgacggaagccaaactggtggatgatgatgataatgaagtaccaccgggtcaaccaggtgagctttgtgtcaaaggaccgcaggtgatgctgggttactggcagcgtccggatgctaccgatgaaatcatcaaaaatggctggttacacaccggcgacatcgcggtgatggatgaagaaggattcctgcgcattgtcgatcgcaaaaaagacatgattctggtttccggttttaacgtctatcccaacgagattgaagatgtcgtcatgcagcatcctggcgtacaggaagtcgcggctgttggcgtaccttctggctccagtggtgaagcggtgaaaatcttcgtagtgaaaaaagatccatcgcttaccgaagagtcactggtgactttttgccgccgtcagctcacgggctacaaagtaccgaagctggtggagtttcgtgatgagttaccgaaatctaacgtcggaaaaattttgcgacgagaattacgtgacgaagcgcgcggcaaagtggacaataaagcctga

SEQ ID NO: 4372 - protein, 583 aa, Escherichia coli
MLTICLLLGVAMTTNTHFRGEELKKVWLNRYPADVPTEINPDRYQSLVDMFEQSVARYADQPAFVNMGEVMTFRKLEERSRAFAAYLQQGLGLKKGDRVALMMPNLLQYPVALFGILRAGMIVVNVNPLYTPRELEHQLNDSGASAIVIVSNFAHTLEKVVDKTAVQHVILTRMGDQLSTAKGTVVNFVVKYIKRLVPKYHLPDAISFRSALHNGYRMQYVKPELVPEDLAFLQYTGGTTGVAKGAMLTHRNMLANLEQVNATYGPLLHPGKELVVTALPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFLRIVDRKKDMILVSGFNVYPNEIEDVVMQHPGVQEVAAVGVPSGSSGEAVKIFVVKKDPSLTEESLVTFCRRQLTGYKVPKLVEFRDELPKSNVGKILRRELRDEARGKVDNKA

SEQ ID NO: 4373 - DNA, 582 bp, Escherichia coli
atggcggttcaaaagaatgttatcaaaggcatactggcaggtacgtttgcgctaatgctgagcggttgtgtcactgtgccggacgccattaaaggcagcagtcccacgccgcaacaagatttagttcgggtgatgagtgcgccgcagctgtacgttggtcaggaggcacgctttggcggcaaagtggttgcggtacaaaaccagcaagggaaaacccgcctggaaattgccaccgtaccactggacagcggagccagaccgacgctgggagaaccttctcgcggtcgcatttatgccgatgtgaacggttttctggacccggtggatttccgcggacaactggtgacggtagtcgggccaatcaccggtgcggttgacggcaaaatcggtaatacgccctataaatttatggtgatgcaagtaacgggttacaaacgttggcatttaacccagcaggtgattatgccgcctcagccgattgatccatggttttatggcggtcgtggctggccctatggctacggcggatggggctggtataatcccggccccgcgagagtacaaacagttgtaactgaataa

SEQ ID NO: 4374 - protein, 193 aa, Escherichia coli
MAVQKNVIKGILAGTFALMLSGCVTVPDAIKGSSPTPQQDLVRVMSAPQLYVGQEARFGGKVVAVQNQQGKTRLEIATVPLDSGARPTLGEPSRGRIYADVNGFLDPVDFRGQLVTVVGPITGAVDGKIGNTPYKFMVMQVTGYKRWHLTQQVIMPPQPIDPWFYGGRGWPYGYGGWGWYNPGPARVQTVVTE

SEQ ID NO: 4375 - DNA, 696 bp, Escherichia coli
atgcgaattctggctatcgataccgcgacagaggcctgctctgtcgccctgtggaacgacggtactgtcaacgctcattttgagctttgccctcgtgaacatactcaacgaatcttaccgatggtgcaggatatcctgaccaccagcggaacttccctgactgacataaacgctctggcttacgggcgcggccccggtagcttcaccggcgtgcgcattggtattggcattgcgcaaggactggcacttggcgcggagttaccaatgattggcgtctccacgctaatgacgatggcgcaaggggcgtggcgcaaaaacggcgcaacccgcgtgctggcagctattgacgcgcgaatgggcgaagtttactgggccgaatatcagcgtgatgaaaacggtatctggcacggtgaagaaaccgaagccgtactcaaacccgaactcgttcatgaacgaatgcaacagctttccggcgaatgggtgacagtagggacgggctggcaagcctggccggatctcggtaaagagagcgggctggttttgcgcgatggcgaagagttactgcccgctgcagaagatatgctgccgattgcgtgccagatgtttgccgagggtaaaacggtggcggtggaacatgctgaaccagtttatttacgtaacaacgtcgcatggaagaaacttccgggcaaagaatga

SEQ ID NO: 4376 - protein, 231 aa, Escherichia coli
MRILAIDTATEACSVALWNDGTVNAHFELCPREHTQRILPMVQDILTTSGTSLTDINALAYGRGPGSFTGVRIGIGIAQGLALGAELPMIGVSTLMTMAQGAWRKNGATRVLAAIDARMGEVYWAEYQRDENGIWHGEETEAVLKPELVHERMQQLSGEWVTVGTGWQAWPDLGKESGLVLRDGEELLPAAEDMLPIACQMFAEGKTVAVEHAEPVYLRNNVAWKKLPGKE

SEQ ID NO: 4377 - DNA, 1911 bp, Escherichia coli
gtgacggacgattttgcaccagacggtcagttggcgaaagcgataccaggctttaagccgcgagaaccacagcgacagatggcggtagccgtcacccaggcgatagaaaaaggccagccgctggtggtggaagccggaaccggtacgggcaaaacctacgcttacctggcccctgcgctgcgggcgaaaaagaaagtcattatctcgaccggttcaaaagcgttgcaggatcagctctacagccgcgatttgccaacggtttcaaaggcgttgaaatatacgggcaacgtggcgttgctgaaagggcgctcaaactacctctgcctcgaacgtctcgaacaacaggcgctagcgggcggcgatctgccggtacaaatattaagcgatgtgatcctgctgcgctcctggtctaatcaaacagtcgatggtgatatcagcacctgcgtcagcgtggcggaagattcacaggcgtggccgctggtcaccagcaccaacgataactgccttggcagcgactgcccgatgtataaagattgctttgtagtcaaagcacgcaaaaaagcgatggacgccgatgtggtggtggtaaaccatcatctctttctggcggatatggtggtgaaagagagtggatttggcgaactgatcccggaagctgacgtcatgatcttcgacgaagcccaccagctgcccgacattgccagccagtattttggtcagtcactctccagtcgacaactgctcgacctggcaaaagacatcaccatcgcctaccgcaccgaattaaaagacacccagcagttacaaaagtgcgctgaccgtcttgcccagagtgcgcaggattttcgcctgcaactcggtgagccaggttatcgcggtaacctgcgtgagctgttagctaatccgcaaattcagcgggcatttttactgctcgatgacactctggaactttgttatgacgtggcgaaactgtcgctggggcgttccgccttgctggatgcggcatttgaacgcgccacgttatatcgcacacggctgaaacggctaaaagagatcaatcagccgggctacagctactggtacgaatgcacttcgcgccattttactctggctctcacgccgctcagcgtggcggataaattcaaagagttaatggcgcaaaaacccggtagctggatctttacctcagcaacgctgtcggtgaacgacgatctgcatcatttcacctcgcggcttggcattgaactggcagagtcgttgctgttacccagcccctttgattacagccgccaggcgttactctgtgtgccgcgcaacctgccgcaaactaatcaaccgggttccgcacggcaactggcggcaatgctgcgaccgatcatcgaagctaacaacggtcgttgttttatgctttgtacctcgcacgccatgatgcgcgatctggccgagcagttccgcgctaccatgacgcttcccgttttgttgcagggggaaaccagcaaagggcaactgttgcagcaatttgtcagcgccggtaacgcgcttcttgtggcaaccagcagtttctgggaaggggtggacgtgcgtggcgatacattgtcattggtgattatcgacaaattgccgtttacctcgccggatgatccactattaaaagcacgcatggaagattgccgtttgcgcggtggtgatccgttcgatgaagtacaactgccggatgcggtcattactctcaagcagggggtagggcgattgattcgcgacgccgacgatcgcggcgtgttagtgatttgcgacaatcggctggtgatgcgcccttacggcgcgacgtttctcgccagtctgccgccagcgccgcgcacccgtgacattgcccgtgcggttcgtttccttgcgataccatcctccaggtaa

SEQ ID NO: 4378 - protein, 636 aa, Escherichia coli
MTDDFAPDGQLAKAIPGFKPREPQRQMAVAVTQAIEKGQPLVVEAGTGTGKTYAYLAPALRAKKKVIISTGSKALQDQLYSRDLPTVSKALKYTGNVALLKGRSNYLCLERLEQQALAGGDLPVQILSDVILLRSWSNQTVDGDISTCVSVAEDSQAWPLVTSTNDNCLGSDCPMYKDCFVVKARKKAMDADVVVVNHHLFLADMVVKESGFGELIPEADVMIFDEAHQLPDIASQYFGQSLSSRQLLDLAKDITIAYRTELKDTQQLQKCADRLAQSAQDFRLQLGEPGYRGNLRELLANPQIQRAFLLLDDTLELCYDVAKLSLGRSALLDAAFERATLYRTRLKRLKEINQPGYSYWYECTSRHFTLALTPLSVADKFKELMAQKPGSWIFTSATLSVNDDLHHFTSRLGIELAESLLLPSPFDYSRQALLCVPRNLPQTNQPGSARQLAAMLRPIIEANNGRCFMLCTSHAMMRDLAEQFRATMTLPVLLQGETSKGQLLQQFVSAGNALLVATSSFWEGVDVRGDTLSLVIIDKLPFTSPDDPLLKARMEDCRLRGGDPFDEVQLPDAVITLKQGVGRLIRDADDRGVLVICDNRLVMRPYGATFLASLPPAPRTRDIARAVRFLAIPSSR

SEQ ID NO: 4379 - DNA, 393 bp, Escherichia coli
gtggcagtctttgcagcacgaaaatggaaggataatgaggacaaaatgatgactatcgttcgtatcgatgctgaagcccgctggtctgatgtggtgatccacaacaacacgctctactacactggtgtaccggaaaacctcgacgccgatgcttttgaccaaaccgccaacacgctggcgcagattgacgccgtgctggaaaaacagggcagcaataaatcgagcattctggatgccaccattttcctggctgataaaaacgacttcgcggcgatgaataaagcgtgggatgcctgggttgtcgcgggtcatgcgccggtgcgctgcacggtacaagcgggtttgatgaacccgaagtataaagttgaaattaagattgtggctgcggtgtaa

SEQ ID NO: 4380 - protein, 130 aa, Escherichia coli
MAVFAARKWKDNEDKMMTIVRIDAEARWSDVVIHNNTLYYTGVPENLDADAFDQTANTLAQIDAVLEKQGSNKSSILDATIFLADKNDFAAMNKAWDAWVVAGHAPVRCTVQAGLMNPKYKVEIKIVAAV

SEQ ID NO: 4381 - DNA, 360 bp, Escherichia coli
atgcaaattaaggtcatatatagccttatcgataacatggttaattttaaggataagaatatgcctgctgtaatagataaagccctggatttcattggtgccatggatgtatcagcaccaacaccaagttcgatgaatgaaagtacggcgaagggaatctttaaatatttaaaagaactgggagtacccgcgagtgccgctgatattacgacgcgagctgacctggaaggctggaacccggggttcacggaaaaaatggttggatgggcaaaaaaaatggagtctggtgaacgcattgtgattaaaaatcctgaatacttttcaacatatatgcaggaagaactaaaagcactggtctaa

SEQ ID NO: 4382 - protein, 119 aa, Escherichia coli
MQIKVIYSLIDNMVNFKDKNMPAVIDKALDFIGAMDVSAPTPSSMNESTAKGIFKYLKELGVPASAADITTRADLEGWNPGFTEKMVGWAKKMESGERIVIKNPEYFSTYMQEELKALV

SEQ ID NO: 4383 - DNA, 180 bp, Escherichia coli
atgtttgcaggtttaccttcactcacccatgaacagcagcaaaaagctgtcgagcggatccaggaactgatggctcaagggatgagcagcggccaggcaatcgcgctggtggcagaagagctgcgtgccaaccattccggcgagcgaatcgtggcgcgttttgaggatgaagacgagtaa

SEQ ID NO: 4384 - protein, 59 aa, Escherichia coli
MFAGLPSLTHEQQQKAVERIQELMAQGMSSGQAIALVAEELRANHSGERIVARFEDEDE

SEQ ID NO: 4385 - DNA, 1362 bp, Escherichia coli
atgaagacgttatctcccgctgtgattactttaccctggcgtcaggacgccgctgaattttatttctcacgcttaagccacctgccgtgggcgatgcttttacactccggctatgccgatcatccatatagccgctttgatattgtggtcgccgagccgatttgcactttaaccactttcggtaaagaaaccgttgttagtgaaagcgaaaaacgcacaacgaccactgatgacccgctacaggtgctccagcaggtgctggatcgcgcagacattcgcccagcgcataacgaagatttgccatttcagggcggcgcgctggggttgtttggctacgatctgggccgccgttttgagtcactgccagaaattgcgcagcaagatatcgttctgccggatatggcagtgggtatctacgactgggcgctggttgtcgaccaccagcgtcaaacagtttctttgctgagtcataatgatgtcaatgcccgtcgggcctggctggaaagccagcaattctcgccgcaggaagatttcacgctcacttccgactggcaatccaatatgacccgcgagcagtacggcgaaaaatttcgccaggtacaggaatatctgcacagcggtgattgctatcaggtgaatctcgcccagcgttttcatgcgacctattctggcgatgaatggcaggcattccttcagcttaatcaggccaaccgcgcgccgtttagcgcttttttacgccttgagcagggcgcgattttaagcctttcaccagagcggtttatcctttgtgataatagtgaaatccagacccgcccgattaaaggcacgctaccacgcctgcccgatcctcaggaagatagcaaacaagcagagaaactggcgaactcagcgaaagatcgtgccgaaaatctgatgattgtcgatttaatgcgtaatgatatcggtcgtgttgccgtagcaggttcggtaaaagtaccagagctcttcgtggtggaacccttccctgccgtgcatcatctggtcagcaccataacggcgcaactaccagaacagttacacgccagcgatctgttgcgcgcggcttttcctggtggctcaataaccggggcaccgaaagtacgggctatggaaattatcgacgaactggaaccgcaccgacgcaatgcctggtgcggcagcattggctatttgagcttttgcggcaacatggacaccagcattactatccgcacgctgactgccattaacggacaaatttactgctctgcgggcggtggaattgtcgccgatagccaggaagaagcggaatatcaggaaacttttgataaagttaataagatattacgccaactggagaagtaa

SEQ ID NO: 4386 - protein, 453 aa, Escherichia coli
MKTLSPAVITLPWRQDAAEFYFSRLSHLPWAMLLHSGYADHPYSRFDIVVAEPICTLTTFGKETVVSESEKRTTTTDDPLQVLQQVLDRADIRPAHNEDLPFQGGALGLFGYDLGRRFESLPEIAQQDIVLPDMAVGIYDWALVVDHQRQTVSLLSHNDVNARRAWLESQQFSPQEDFTLTSDWQSNMTREQYGEKFRQVQEYLHSGDCYQVNLAQRFHATYSGDEWQAFLQLNQANRAPFSAFLRLEQGAILSLSPERFILCDNSEIQTRPIKGTLPRLPDPQEDSKQAEKLANSAKDRAENLMIVDLMRNDIGRVAVAGSVKVPELFVVEPFPAVHHLVSTITAQLPEQLHASDLLRAAFPGGSITGAPKVRAMEIIDELEPHRRNAWCGSIGYLSFCGNMDTSITIRTLTAINGQIYCSAGGGIVADSQEEAEYQETFDKVNKILRQLEK

SEQ ID NO: 4387 - DNA, 579 bp, Escherichia coli
gtggaataccgtagcctgacgcttgatgattttttatcgcgctttcaacttttgcgcccgcaaattaaccgggaaaccctaaatcatcgtcaggctgccgtgttaatccccatcgtccgtcgaccgcaaccggggttgttgctgactcagcgttcgattcatctgcgtaaacacgctggacaagtggcattccctggaggcgcagtcgatgacacggacgcatcagttatcgccgctgcgctgcgcgaagctgaagaagaggtcgctataccgccttccgccgttgaggttatcggcgtgctgccgcccgtcgatagcgtcactggctatcaggtaaccccagtggtcggtattatcccgcccgatctgccgtatcgcgccagtgaagatgaagtctccgccgtctttgaaatgccgctcgcccaggcattacatctgggtcgttatcatcctttagatatctaccgccgtggcgattcacatcgggtatggctgtcctggtacgaacagtattttgtatggggaatgaccgcaggcataattcgtgagctggcgctgcaaattggtgtgaaaccctga

SEQ ID NO: 4388 - protein, 192 aa, Escherichia coli
MEYRSLTLDDFLSRFQLLRPQINRETLNHRQAAVLIPIVRRPQPGLLLTQRSIHLRKHAGQVAFPGGAVDDTDASVIAAALREAEEEVAIPPSAVEVIGVLPPVDSVTGYQVTPVVGIIPPDLPYRASEDEVSAVFEMPLAQALHLGRYHPLDIYRRGDSHRVWLSWYEQYFVWGMTAGIIRELALQIGVKP

SEQ ID NO: 4389 - DNA, 1347 bp, Escherichia coli
atgtttaaggtggggattggtccctcatcttcccataccgtagggcctatgaaggcgggtaaacagttcgtcgatgatctggtcgaaaaaggcttactggatagcgttactcgcgttgccgtggacgtttatggttcactgtcgctgacgggtaaaggccaccacaccgatatcgccattattatgggtcttgcaggtaacgaacctgccaccgtggatatcgacagtattcccggttttattcgcgacgtagaagagcgcgaacgtctgctgctggcacagggacggcatgaagtggatttcccgcgcgacaacgggatgcgttttcataacggtaacctgccgctgcatgaaaacggtatgcaaatccacgcctataacggcgatgaagtcgtctacagcaaaacttattattccatcggcggcggttttatcgtcgatgaagaacactttggtcaggatgctgccaacgaagtgagcgtgccgtatccgttcaaatctgccaccgaactgctcgcgtactgtaatgaaaccggcttttcgctgtctggtctcgctatgcaaaacgaactggcgctgcacagcaagaaagagatcgacgagtatttcgcgcatgtctggcaaaccatgcaggcatgtatcgatcgcgggatgaataccgaaggcgtactgccaggcccgttgcgcgtgccacgtcgtgcgtcggccctgcgccggatgctggtttccagcgataaactgtctaacgatccgatgaatgtcattgactgggtaaacatgtttgcgctggcagttaacgaagaaaacgccgccggtggccgtgtggtaactgcgccaactaacggtgcctgcggtatcgttccggcagtgctggcttactatgaccactttattgaatcagttagcccagacatctatacccgttactttatggcagcgggcgcgattggtgcactgtataaaatgaacgcgtctatttccggtgcggaagtcggttgccagggcgaagtaggtgttgcctgttcaatggctgctgcgggccttgccgagctgttgggcggtagcccggaacaggtttgtgtggcagcggaaattggcatggaacacaacctcggtctgacctgcgaccccgttgcagggcaagttcaggtgccgtgcattgaacgtaatgccattgcctctgtgaaggcgattaacgccgcgcggatggccctgcgtcgcaccagtgcaccgcgcgtctcgctggataaggtcatcgaaacgatgtacgaaaccggtaaggacatgaacgctaaataccgcgaaacctcacgcggtggtctggcaatcaaagtccagtgtgactaa

SEQ ID NO: 4390 - protein, 448 aa, Escherichia coli
MFKVGIGPSSSHTVGPMKAGKQFVDDLVEKGLLDSVTRVAVDVYGSLSLTGKGHHTDIAIIMGLAGNEPATVDIDSIPGFIRDVEERERLLLAQGRHEVDFPRDNGMRFHNGNLPLHENGMQIHAYNGDEVVYSKTYYSIGGGFIVDEEHFGQDAANEVSVPYPFKSATELLAYCNETGFSLSGLAMQNELALHSKKEIDEYFAHVWQTMQACIDRGMNTEGVLPGPLRVPRRASALRRMLVSSDKLSNDPMNVIDWVNMFALAVNEENAAGGRVVTAPTNGACGIVPAVLAYYDHFIESVSPDIYTRYFMAAGAIGALYKMNASISGAEVGCQGEVGVACSMAAAGLAELLGGSPEQVCVAAEIGMEHNLGLTCDPVAGQVQVPCIERNAIASVKAINAARMALRRTSAPRVSLDKVIETMYETGKDMNAKYRETSRGGLAIKVQCD

SEQ ID NO: 4391 - DNA, 1599 bp, Escherichia coli
atgcaaaaagcacaacggatcattaaaacctatcgccgtaatcgaatgattgtttgtacgatttgcgcactcgttacgctcgcttcgaccctgagcgtgcgatttatttcacagcgtaacttaaatcaacaacgggtagtacaattcgccaatcacgctgtagaggaattagataaagtactgcttcccctacaggcaggtagcgaagtcttgcttccgctgattggtctgccctgctctgtcgcccatttgccattacgtaaacaggcggcaaaactccaaactgtgcgatccattggcctggtgcaagacggcacactttattgctccagcatttttggttatcgcaatgtgcccgtcgtggacattctggctgaacttcctgcaccgcaaccacttttacgactgacgaccgaccgtgccctgataaaaggcagtccggttttgattcaatggacgcctgcagcgggcagtagcaatgctggggtcatggagatgattaacatcgacttactgacggcaatgctccttgaaccacaactgccgcaaatcagtagcgccagcctgacggtggacagtcggcatttgctctatggtaatgggctggtagattcccttccgcaacctgaaaacaatgaaaactatcaggtttcttcgcaacgctttccttttaccattaacgttaatggtccgggggctacggcgctggcatggcactatcttccaacacaattaccgctggcggtgctgctaagtttacttgtgggctatatcgcctggctggcgaccgcttaccgaatgagtttttcccgcgaaatcaatctgggcctggcgcaacatgagttcgaattgttctgccagcctttgcttaatgcgcgcagccagcaatgtattggcgtagagattttgctgcgctggaacaatccgcgtcagggctggatttcgccggatgtgtttattcctatcgcggaagaacatcatttaattgtgccactgacccgctatgtgatggcagaaaccattcgtcagcgccatgttttcccgatgagtagtcagtttcatgttggcattaacgtcgcacccagccattttcgccgtggtgtgctgataaaagatctcaatcagtactggtttagcgctcacccgattcagcaactgatcctcgaaatcaccgaacgcgatgccttactggatgttgattatcggattgcccgcgagctacatcgtaaaaacgtcaaactggcgattgatgacttcggcaccggcaatagttcattttcctggcttgaaacattacgtcctgacgtgctgaaaattgataagtcatttaccgcagctataggttctgacgcggttaactcgacggtgaccgatatcatcatcgcactggggcaaagactgaatattgaactggtggcggagggtgtggaaacgcaagaacaggcgaaatatttgcgccgtcatggcgtccatattttgcaagggtatttgtacgcacagccgatgccactatgtgattttcccaaatggctggcgggcagccaaccgccgcccgcccggcataatggacatatcacccccattatgccgttacgttaa

SEQ ID NO: 4392 - protein, 532 aa, Escherichia coli
MQKAQRIIKTYRRNRMIVCTICALVTLASTLSVRFISQRNLNQQRVVQFANHAVEELDKVLLPLQAGSEVLLPLIGLPCSVAHLPLRKQAAKLQTVRSIGLVQDGTLYCSSIFGYRNVPVVDILAELPAPQPLLRLTTDRALIKGSPVLIQWTPAAGSSNAGVMEMINIDLLTAMLLEPQLPQISSASLTVDSRHLLYGNGLVDSLPQPENNENYQVSSQRFPFTINVNGPGATALAWHYLPTQLPLAVLLSLLVGYIAWLATAYRMSFSREINLGLAQHEFELFCQPLLNARSQQCIGVEILLRWNNPRQGWISPDVFIPIAEEHHLIVPLTRYVMAETIRQRHVFPMSSQFHVGINVAPSHFRRGVLIKDLNQYWFSAHPIQQLILEITERDALLDVDYRIARELHRKNVKLAIDDFGTGNSSFSWLETLRPDVLKIDKSFTAAIGSDAVNSTVTDIIIALGQRLNIELVAEGVETQEQAKYLRRHGVHILQGYLYAQPMPLCDFPKWLAGSQPPPARHNGHITPIMPLR

SEQ ID NO: 4393 - DNA, 1557 bp, Escherichia coli
atggaattcttaatggacccctcgatttgggcggggctactcacgcttgttgttctcgaaattgtgctgggtatcgataacctggtcttcatcgccattcttgctgacaaactgccgccaaaacaacgcgataaagcgcgtttgctgggattatcactggcgctgattatgcgtctggggctgctgtcgctgatttcatggatggtcacgctgaccaaaccgctatttaccgtcatggatttctccttctccggacgcgacctgattatgttgttcgggggcatattcttgctgttcaaagcaacaactgaactgcatgaacggctggaaaaccgcgatcatgattccggccacggtaaaggctacgccagtttctgggtggtcgtcacacagattgtcatccttgacgccgtcttctcgttggatgcggtaattactgcagtagggatggttaaccatttgccggtgatgatggcggcggtagtgattgcgatggcggttatgctgctggcatcaaaaccgctgacgcgattcgttaaccagcaccccacggtggtggtgctctgtctgagcttcctgttaatgattggtctgagtctggtggcagaaggtttcggtttccacattccgaaaggttacctgtatgccgcgattggcttctcgatcatcatcgaagtgtttaaccagattgcgcgtcgcaactttattcgtcaccagtcgactttgccgctgcgagcgcgtactgccgatgccatcctgcgtttgatgggcgggaaacgtcaggccaatgttcagcacgatgccgataacccgatgccgatgccgatcccggaaggtgcgtttgccgaagaagaacgttacatgattaacggcgtactgacgctggcgtcgcgttctctgcgcgggatcatgacgccgcgcggtgaaataagctgggttgatgctaatctcggggtcgatgaaatccgcgagcaactgctctcctcaccgcacagtttgttcccggtatgtcgcggtgaactggatgaaattatcggcatcgtacgtgctaaagaactgctggtggcgctggaagagggagttgatgtggcggcgatagcttcggcgtctccggcgattatcgtcccggaaaccctcgatccgatcaacctgctgggcgtgctgcgtcgtgctcgcgggagctttgttatcgtgaccaacgagtttggtgtggtacaaggtctggtcacgccgctggatgtgctggaagccattgcgggtgaattcccggacgctgacgaaacgccggaaatcattaccgacggtgacggctggctggtaaaaggcggtacagatttgcatgccttgcagcaggcgcttgatgttgagcaccttgccgatgacgatgatatcgcgacggtcgcgggcctcgtgatctcggcaaatggtcacattccccgtgtgggcgatgtgattgatgtagggccactgcatatcaccatcattgaagccaatgattatcgtgttgatctggttcgcattgttaaagagcaaccggcgcacgatgaagatgagtaa

SEQ ID NO: 4394 - protein, 518 aa, Escherichia coli
MEFLMDPSIWAGLLTLVVLEIVLGIDNLVFIAILADKLPPKQRDKARLLGLSLALIMRLGLLSLISWMVTLTKPLFTVMDFSFSGRDLIMLFGGIFLLFKATTELHERLENRDHDSGHGKGYASFWVVVTQIVILDAVFSLDAVITAVGMVNHLPVMMAAVVIAMAVMLLASKPLTRFVNQHPTVVVLCLSFLLMIGLSLVAEGFGFHIPKGYLYAAIGFSIIIEVFNQIARRNFIRHQSTLPLRARTADAILRLMGGKRQANVQHDADNPMPMPIPEGAFAEEERYMINGVLTLASRSLRGIMTPRGEISWVDANLGVDEIREQLLSSPHSLFPVCRGELDEIIGIVRAKELLVALEEGVDVAAIASASPAIIVPETLDPINLLGVLRRARGSFVIVTNEFGVVQGLVTPLDVLEAIAGEFPDADETPEIITDGDGWLVKGGTDLHALQQALDVEHLADDDDIATVAGLVISANGHIPRVGDVIDVGPLHITIIEANDYRVDLVRIVKEQPAHDEDE

SEQ ID NO: 4395 - DNA, 972 bp, Escherichia coli
gtgaccattgctattgttataggcacacatggttgggctgcagagcagttgcttaaaacggcagaaatgctgttaggcgagcaggaaaacgtcggctggatcgatttcgttccaggtgaaaatgccgaaacgctgattgaaaagtacaacgctcagttggcaaaactcgacaccactaaaggcgtgctgtttctcgttgatacatggggaggcagcccgttcaatgctgccagccgcattgtcgtcgacaaagagcattatgaagtcattgcaggcgttaacattccaatgctcgtggaaacgttaatggcccgtgatgatgacccaagctttgatgaactggtggcgctggcagtagaaacaggccgtgaaggcgtgaaagcactgaaagccaaaccggttgaaaaagccgcgccagcacccgctaccgcagcaccaaaagcggctccaactccggcaaaaccaatgggaccaaacgactacatggttattggccttgctcgtatcgacgaccgtctgattcacggtcaggtcgccacccgctggaccaaagaaaccaatgtctcccgtattattgttgttagtgatgaagtggctgcagataccgttcgtaagacactgctcacccaggttgcacctccgggcgtaacagcacacgtagttgatgttgccaaaatgattcgcgtctacaacaacccgaaatatgctggcgaacgcgtaatgctgttatttaccaacccaacagatgtagagcgtctcgttgaaggcggcgtgaaaatcacctctgttaacgtcggtggtatggcattccgtcagggtaaaacccaggtgaataacgcggtttcggttgatgaaaaagatatcgaggcgttcaagaaactgaatgcgcgcggtattgagctggaagtccgtaaggtttccaccgatccgaaactgaaaatgatggatctgatcagcaaaatcgataagtaa

SEQ ID NO: 4396 - protein, 323 aa, Escherichia coli
MTIAIVIGTHGWAAEQLLKTAEMLLGEQENVGWIDFVPGENAETLIEKYNAQLAKLDTTKGVLFLVDTWGGSPFNAASRIVVDKEHYEVIAGVNIPMLVETLMARDDDPSFDELVALAVETGREGVKALKAKPVEKAAPAPATAAPKAAPTPAKPMGPNDYMVIGLARIDDRLIHGQVATRWTKETNVSRIIVVSDEVAADTVRKTLLTQVAPPGVTAHVVDVAKMIRVYNNPKYAGERVMLLFTNPTDVERLVEGGVKITSVNVGGMAFRQGKTQVNNAVSVDEKDIEAFKKLNARGIELEVRKVSTDPKLKMMDLISKIDK

SEQ ID NO: 4397 - DNA, 801 bp, Escherichia coli
atggagattaccactcttcaaattgtgctggtatttatcgtagcctgtatcgcaggtatgggatcaatcctcgatgaatttcagtttcaccgtccgctaatcgcgtgtaccctggtgggtatcgttcttggggatatgaaaaccggtattattatcggtggtacgctggaaatgatcgcgctgggctggatgaacatcggtgctgccgttgcgcctgacgccgccctggcttctatcatttctaccattctggttatcgcaggtcatcagagcattggtgcaggtatcgcactggcaatccctctggccgctgcaggccaggtactgaccatcatcgttcgtactattaccgttgctttccagcacgctgcggataaggcagctgataacggcaacctgacagcaatttcctggatccacgtttcttctctgttcctgcaagcaatgcgtgtggctattccggccgtcatcgttgcgctgtctgttggtaccagcgaagtacagaacatgctgaatgcgattccggaagtggtgaccaatggtctgaatatcgccggtggcatgatcgtggtggttggttatgcgatggttatcaacatgatgcgtgctggctacctgatgccgttcttctacctcggcttcgtaaccgcagcattcaccaactttaacctggttgctctgggtgtgattggtactgttatggcagtgctctacatccaacttagcccgaaatacaaccgcgtagccggtgcgcctgctcaggctgctggtaacaacgatctcgataacgaactggactaa

SEQ ID NO: 4398 - protein, 266 aa, Escherichia coli
MEITTLQIVLVFIVACIAGMGSILDEFQFHRPLIACTLVGIVLGDMKTGIIIGGTLEMIALGWMNIGAAVAPDAALASIISTILVIAGHQSIGAGIALAIPLAAAGQVLTIIVRTITVAFQHAADKAADNGNLTAISWIHVSSLFLQAMRVAIPAVIVALSVGTSEVQNMLNAIPEVVTNGLNIAGGMIVVVGYAMVINMMRAGYLMPFFYLGFVTAAFTNFNLVALGVIGTVMAVLYIQLSPKYNRVAGAPAQAAGNNDLDNELD

SEQ ID NO: 4399 - DNA, 852 bp, Escherichia coli
atggttgatacaactcaaactaccaccgagaaaaaactcactcaaagtgatattcgtggcgtcttcctgcgttctaacctctttcagggttcatggaacttcgaacgtatgcaggcactgggtttctgcttctctatggtaccggcaattcgtcgcctctaccctgagaacaacgaagctcgtaaacaggctattcgccgtcacctggagttctttaacacccagccattcgtggctgcgccgattctcggcgtaaccctggcactggaagaacagcgtgctaatggcgcagagatcgatgacggtgctatcaacggcatcaaagtcggtttgatggggccgctggctggtgtaggcgacccgatcttctggggaacggtacgtccggtatttgcagcgctgggggctggtatcgcgatgagcggcagcctgttaggtccgctgctgttcttcatcctgtttaacctggtgcgtctggcaacccgttactacggcgtagcgtatggttactccaaaggtatcgatatcgttaaagatatgggtggtggcttcctgcaaaaactgacggaaggggcgtctatcctcggcctgtttgtcatgggggcgttggttaataagtggacacatgtcaacatcccactggtggtctctcgcattactgaccagacgggcaaagaacacgttaccactgtccagactattctggaccagttaatgccgggcctggtaccactgctgctgacctttgcttgtatgtggctgttgcgcaaaaaagttaacccgctgtggatcatcgttggcttcttcgtcatcggtatcgctggttacgcttgcggcctgctgggactgtaa

SEQ ID NO: 4400 - protein, 283 aa, Escherichia coli
MVDTTQTTTEKKLTQSDIRGVFLRSNLFQGSWNFERMQALGFCFSMVPAIRRLYPENNEARKQAIRRHLEFFNTQPFVAAPILGVTLALEEQRANGAEIDDGAINGIKVGLMGPLAGVGDPIFWGTVRPVFAALGAGIAMSGSLLGPLLFFILFNLVRLATRYYGVAYGYSKGIDIVKDMGGGFLQKLTEGASILGLFVMGALVNKWTHVNIPLVVSRITDQTGKEHVTTVQTILDQLMPGLVPLLLTFACMWLLRKKVNPLWIIVGFFVIGIAGYACGLLGL

SEQ ID NO: 4401 - DNA, 459 bp, Escherichia coli
atgacaatcacggacctggtactgattcttttcatcgccgcacttctggccttcgcgatctacgatcagttcatcatgccccgccgtaacggccccaccctgctggcaattcctttgctccggcgtggtcgcatcgatagtgttatcttcgtcggattgattgtcattcttatctataacaacgtcacgaatcatggcgcgctaataacaacatggttattaagtgcactggctctgatgggtttttatatattctggatccgcgttccgaagatcatctttaaacaaaaaggttttttcttcgccaatgtctggattgaatatagccgaatcaaagcgatgaacttgtcggaagatggcgtgttggtgatgcaattagaacagcgccggctgttaatccgcgttcgaaatatcgacgatttggaaaaagtttataagcttctcgtttcaactcaataa

SEQ ID NO: 4402 - protein, 152 aa, Escherichia coli
MTITDLVLILFIAALLAFAIYDQFIMPRRNGPTLLAIPLLRRGRIDSVIFVGLIVILIYNNVTNHGALITTWLLSALALMGFYIFWIRVPKIIFKQKGFFFANVWIEYSRIKAMNLSEDGVLVMQLEQRRLLIRVRNIDDLEKVYKLLVSTQ

SEQ ID NO: 4403 - DNA, 600 bp, Escherichia coli
gtgttttatggataccccggtcaggacgttgtcatgaatatcactgctactgttcttcttgcgtttggtatgtcgatggatgcctttgctgcatcaatcggtaaaggtgccaccctccataaaccgaaattttctgaagcattgcgaaccggccttatttttggtgccgtcgaaaccctgacgccgctgatcggctggggaatgggcatgttagccagtcggtttgtccttgaatggaaccactggattgcgtttgtgctgctgatatttctcggcgggcgaatgattattgagggttttcgtggcgcagatgatgaagatgaagaaccgcgccgtcgacacggtttctggctactggtaaccaccgcgattgccaccagcctggatgccatggctgtgggtgttggtcttgctttcctgcaggttaacattatcgcgaccgcattggccattggttgtgcaaccttgattatgtcgacattagggatgatggttggtcgctttatcggctcaattattgggaaaaaagcggaaattctcggcgggctggtactgatcggtattggcgtccagatcctctggacgcacttccacggttaa

SEQ ID NO: 4404 - protein, 199 aa, Escherichia coli
MFYGYPGQDVVMNITATVLLAFGMSMDAFAASIGKGATLHKPKFSEALRTGLIFGAVETLTPLIGWGMGMLASRFVLEWNHWIAFVLLIFLGGRMIIEGFRGADDEDEEPRRRHGFWLLVTTAIATSLDAMAVGVGLAFLQVNIIATALAIGCATLIMSTLGMMVGRFIGSIIGKKAEILGGLVLIGIGVQILWTHFHG

SEQ ID NO: 4405 - DNA, 810 bp, Escherichia coli
atgtcgttttcctgtccactttgccatcagcctctttcgcgtgaaaaaaacagctatatctgtccccagcgacatcagtttgatatggcgaaagaagggtatgtcaatctgctgcccgttcagcataaacggtctcgtgatccgggcgacagcgcggaaatgatgcaagcacgccgcgcattcttagatgccggacattatcagccgctgcgtgatgcaattgtcggccaattgcgggaacggcttgatgaaaaggccgcggcggtgctggatattggctgtggtgaagggtattacacacacgcatttgctgatgcgttgcccgaaatcaccacgtttggcctggatgtctcgaaggtagcgataaaagcggcggcgaaacgctatccgcaggtcactttttgtgtcgcttccagccaccgtttgccgttctccgataccagtatggacgccataatacgtatttacgcgccgtgtaaagcagaagaattagtgcgagtagtgaagcccggcggttgggtcattactgccacgccgggaccgagacacttaattgagctgaaggggctgatttacaatgaagtacatcttcatgcacctcatgcagaacaactgaaaggttttacattacagcagagtgatgagttgtgttatctgatgcgtcttcgcggtgatgaagccgtcgcattattgcagatgacgccgtttgcctggcgtgcgaagcctgaagtctggcaagcactggcagcaaaagaagtgttcgactgccagacggactttaatattcacctctggcagcgttcttattaa

SEQ ID NO: 4406 - protein, 269 aa, Escherichia coli
MSFSCPLCHQPLSREKNSYICPQRHQFDMAKEGYVNLLPVQHKRSRDPGDSAEMMQARRAFLDAGHYQPLRDAIVGQLRERLDEKAAAVLDIGCGEGYYTHAFADALPEITTFGLDVSKVAIKAAAKRYPQVTFCVASSHRLPFSDTSMDAIIRIYAPCKAEELVRVVKPGGWVITATPGPRHLIELKGLIYNEVHLHAPHAEQLKGFTLQQSDELCYLMRLRGDEAVALLQMTPFAWRAKPEVWQALAAKEVFDCQTDFNIHLWQRSY

SEQ ID NO: 4407 - DNA, 210 bp, Escherichia coli
atggcaaagattaaaggtcaggttaagtggttcaacgagtctaaaggttttggcttcattactccggctgatggcagcaaagatgtgttcgtacacttctccgctatccagggtaatggtttcaaaactctggctgaaggtcagaacgttgagttcgaaattcaggacggtcagaaaggtccggcagctgttaacgtaacagctatctga

SEQ ID NO: 4408 - protein, 69 aa, Escherichia coli
MAKIKGQVKWFNESKGFGFITPADGSKDVFVHFSAIQGNGFKTLAEGQNVEFEIQDGQKGPAAVNVTAI

SEQ ID NO: 4409 - DNA, 288 bp, Escherichia coli
atgaacgaagttgtaaattcaggcgtgatgaacattgcgtctttggttgtatcggtggtggttcttcttatcgggctcatcttgtggttttttatcaatcgtgccagttcacggactaacgaacagattgaactgcttgaggcgttgctggatcagcaaaaacgtcaaaatgcactgttacgtcgtttgtgcgaagcaaacgaacctgagaaagcagataaaaagacagttgagagtcaaaaatcggttgaagacgaagatattattcgtctggtcgccgaacgataa

SEQ ID NO: 4410 - protein, 95 aa, Escherichia coli
MNEVVNSGVMNIASLVVSVVVLLIGLILWFFINRASSRTNEQIELLEALLDQQKRQNALLRRLCEANEPEKADKKTVESQKSVEDEDIIRLVAER

SEQ ID NO: 4411 - DNA, 144 bp, Escherichia coli
gtgaaaaagtttcgatgggtcgctctggttgtcgtggtgttggcttgcttgctgctttgggcgcaggtattcaacatgatgtgcgatcaggatgtgcaatttttcagcggaatttgtgcccttaaccagtttatcccgtggtga

SEQ ID NO: 4412 - protein, 47 aa, Escherichia coli
MKKFRWVALVVVVLACLLLWAQVFNMMCDQDVQFFSGICALNQFIPW

SEQ ID NO: 4413 - DNA, 240 bp, Escherichia coli
atgcgattcatcattcgcacagttatgctgatagcgctggtatggataggattattactcagcggatatggcgttttgattggaagcaaagagaatgccgcgggattaggtttacaatgtacctatctgaccgccagaggcaccagcacggtacaatacctgcacactaaaagtggttttctggggataacagattgcccgttgttacgtaaaagcaatattgtggtcgataatggttaa

SEQ ID NO: 4414 - protein, 79 aa, Escherichia coli
MRFIIRTVMLIALVWIGLLLSGYGVLIGSKENAAGLGLQCTYLTARGTSTVQYLHTKSGFLGITDCPLLRKSNIVVDNG

SEQ ID NO: 4415 - DNA, 792 bp, Escherichia coli
atggctaacgcagatctggataaacagcctgattctgtatcttccgtgctaaaagtttttggcattttgcaggcgctgggtgaagagcgcgaaatagggataaccgagttgtcgcagcgcgtcatgatgtcaaaaagcaccgtttatcgctttttacagaccatgaaaactttaggttatgtggcgcaggaaggggagtcggagaaatattcgctgaccctgaaattgttcgaactgggcgctcgcgcgttgcaaaacgtcgatttaattcgtagcgcagatatccagatgcgtgagatctcccgcctgaccaaagaaactatccacctcggcgcactggacgaagacagtattgtttacatccacaaaattgactcaatgtacaatttgcgcatgtattcacggattgggcgtcgtaatccgctgtacagcaccgcgattggtaaggtactgctggcatggcgcgatcgcgatgaagtgatgcaaattcttgagggcgtggagtataaacgcagtaccgagcggaccatcaccagtacagaagcgttattacccgttctggaccaggtgcgcgagcaggggtatggcgaagataatgaagagcaggaagaagggctgcgatgcattgcggttccggtatttgatcgctttggcgtggtcattgctggtttgagcatctccttcccgacgttacgtttctctgaagagcgtttacaggaatatgtcgcaatgttgcataccgcggcgcgcaaaatttctgcccaaatgggttatcacgactatccgttctga

SEQ ID NO: 4416 - protein, 263 aa, Escherichia coli
MANADLDKQPDSVSSVLKVFGILQALGEEREIGITELSQRVMMSKSTVYRFLQTMKTLGYVAQEGESEKYSLTLKLFELGARALQNVDLIRSADIQMREISRLTKETIHLGALDEDSIVYIHKIDSMYNLRMYSRIGRRNPLYSTAIGKVLLAWRDRDEVMQILEGVEYKRSTERTITSTEALLPVLDQVREQGYGEDNEEQEEGLRCIAVPVFDRFGVVIAGLSISFPTLRFSEERLQEYVAMLHTAARKISAQMGYHDYPF

SEQ ID NO: 4417 - DNA, 1485 bp, Escherichia coli
gtggtcgcaatccatcttttgccggttagttacaattctgcgacatccaccgtgaatatcagtgctagaatcatacccctgttgattattcaccaaagatataaaattcctatgccaaaagttcaggccgacggcctgccattgcccctgcgatacggtgcgatattaaccattgtgattggtatttcgatggctgtccttgacggcgcaatcgccaacgtcgccttgccaacaatcgctacggaccttcatgccacgccggccagttccatctgggtagtgaacgcctatcaaatcgccattgtcatctccctgctctcgttttcgtttctgggcgatatgtttggctatcgacgtatttataaatgcggtctggtcgtttttctgttgtcttcactgttctgcgccctttctgattcgctgcaaatgctcacccttgcgcgtgtcatacaaggtttcggcggtgcagcgttgatgagcgttaataccgcacttatccgcctgatctatccacaacgttttctgggtagagggatgggcataaactcgtttattgttgccgtctcttctgctgccgggccgacaattgctgcagcaatcctctccatcgcatcctggaaatggttatttttaatcaacgtaccgttgggaattatcgccctgcttctggcaatgcgttttctgccacccaatggttctcgcgccagtaaaccccgtttcgacctgcccagcgccgtgatgaacgcgttaaccttcggcctgcttatcactgcgttgagtggtttcgctcaggggcaatcgctgacattgattggtgcggaactggtggtaatggttgtcgttggtattttctttattcgccgccagctttctcttcccgtaccgctgctaccggtggatttactgcgtatcccgctgttttcactttctatttgcacatctgtttgctctttctgcgcacaaatgctggcaatggtttccctgcccttttacctgcaaaccgtgctcgggcgtagtgaagtcgaaacaggtttacttctgacaccgtggccgttagcaacgatggtgatggctccactggcaggctatttgattgaacgcgtacatgcaggattgctgggtgctttagggttattcatcatggctgcggggcttttttccctggttctgctgccagcgtcacctgcggatatcaatattatctggccgatgatcttatgtggtgctggatttggcttgttccagtcacccaataaccacaccattattacctccgctcctcgcgaacgtagcggtggagccagtggcatgttagggacggctcgtcttctgggtcagagtagcggcgcggctctggtagcgctgatgctaaatcagtttggtgataatggtacgcacgtctcgctgatagctgcggctattctggcagtgattgctgcctgtgtcagtggtttacgtatcactcagccacgatccagggcataa

SEQ ID NO: 4418 - protein, 494 aa, Escherichia coli
MVAIHLLPVSYNSATSTVNISARIIPLLIIHQRYKIPMPKVQADGLPLPLRYGAILTIVIGISMAVLDGAIANVALPTIATDLHATPASSIWVVNAYQIAIVISLLSFSFLGDMFGYRRIYKCGLVVFLLSSLFCALSDSLQMLTLARVIQGFGGAALMSVNTALIRLIYPQRFLGRGMGINSFIVAVSSAAGPTIAAAILSIASWKWLFLINVPLGIIALLLAMRFLPPNGSRASKPRFDLPSAVMNALTFGLLITALSGFAQGQSLTLIGAELVVMVVVGIFFIRRQLSLPVPLLPVDLLRIPLFSLSICTSVCSFCAQMLAMVSLPFYLQTVLGRSEVETGLLLTPWPLATMVMAPLAGYLIERVHAGLLGALGLFIMAAGLFSLVLLPASPADINIIWPMILCGAGFGLFQSPNNHTIITSAPRERSGGASGMLGTARLLGQSSGAALVALMLNQFGDNGTHVSLIAAAILAVIAACVSGLRITQPRSRA

SEQ ID NO: 4419 - DNA, 771 bp, Escherichia coli
atggccttgctgttcggttttggtggttccttcgtttcgcttctgatgtccaaatggatggcattacgatctgttggcggggaagtgatcgagcaaccgcgtaacgaaagggaacgttggctggtcaatactgtagcaacccaggctcgtcaggcggggatcgctatgccgcaagtggctatctaccatgcgccggacatcaatgcttttgcaaccggtgcgcgccgtgatgcctctctggttgctgtcagcaccggtttgctgcagaacatgagcccggatgaagccgaggcggtaattgctcacgaaatcagccacatcgccaatggtgatatggtcaccatgacgctgattcagggcgtggtgaacaccttcgttatctttatttcccgtattctggcgcagcttgccgcgggttttatgggcggaaaccgtgatgaaggtgaagagagcaacggcaacccgctgatctactttgcggttgcaacggttctggaactggtgtttggtattctggcgagcattatcaccatgtggttctcgcgtcatcgtgaattccacgccgatgcgggttcagcaaaactggttggtcgcgagaaaatgattgctgcattgcagcgcctgaaaaccagctatgaaccgcaagaagcaaccagcatgatggctttctgcattaacgggaagtcgaaatcgctcagtgagttgttcatgactcacccgccgctggataaacgtattgaagctctgcgtacgggtgaatacctgaagtaa

SEQ ID NO: 4420 - protein, 256 aa, Escherichia coli
MALLFGFGGSFVSLLMSKWMALRSVGGEVIEQPRNERERWLVNTVATQARQAGIAMPQVAIYHAPDINAFATGARRDASLVAVSTGLLQNMSPDEAEAVIAHEISHIANGDMVTMTLIQGVVNTFVIFISRILAQLAAGFMGGNRDEGEESNGNPLIYFAVATVLELVFGILASIITMWFSRHREFHADAGSAKLVGREKMIAALQRLKTSYEPQEATSMMAFCINGKSKSLSELFMTHPPLDKRIEALRTGEYLK

SEQ ID NO: 4421 - DNA, 258 bp, Escherichia coli
atgaaggacaagcgcaatatcgtttctctgaattacgctgtgcgtgagaaagagaataatgaagatgatgcgacgcgtctggcgcgtttgaacgaacgctttaaacgcgaaggtaaaccggagttgaagaaactggatgatctaccgaaagattaccaggagccagatccttatctggatgagacggtgaatatcgcactcgatctggcgaagcttgaaaaagccagacccgcggaacaacccgctcccgtcaagtaa

SEQ ID NO: 4422 - protein, 85 aa, Escherichia coli
MKDKRNIVSLNYAVREKENNEDDATRLARLNERFKREGKPELKKLDDLPKDYQEPDPYLDETVNIALDLAKLEKARPAEQPAPVK

SEQ ID NO: 4423 - DNA, 1383 bp, Escherichia coli
  n 1365, 1366, 1367, 1368, 1369: n is any nucleotide
ttgtgcgcgcagaacacctggtgttctgaaacggaggccgggccaggcatgaacatgttttttaggcttaccgcgttagctggcctgcttgcaatagcaggccagaccttcgctgtagaagatatcacgcgtgctgatcaaattccggtattaaaggaagagacgcagcatgcgacggtgagtgagcgcgtaacgtcgcgcttcacccgttctcattatcgccagttcgacctcgatcaggcattttcggccaaaatctttgaccgctacctgaatctgctcgattacagccacaatgtgctgctggaaagcgatgttgaacagttcgcgaaaaagaaaactgagttaggcgatgaactgcgttcaggtaaactcgacgttttctacgatctctacaatctggcgcaaaagcgccgttttgaacgttaccagtacgctttgtcggtactggaaaagccgatggatttcaccggcaacgacacttataaccttgaccgcagcaaagcgccctggccgaaaaacgaggctgagttgaacgcgctgtgggacagtaaagtcaaattcgacgagttaagcctgaagctgacaggaaaaacggataaggaaattcgtgaaaccctgactcgccgctacaaatttgccattcgtcgtctggcgcaaaccaacagcgaagatgttttctcgctggcaatgacggcgtttgcgcgtgaaatcgacccgcataccaactatctttccccgcgtaataccgaacagttcaacactgaaatgagtttgtcgctggaaggtattggcgcagtgctgcaaatggatgatgactacaccgttatcaattcgatggtggcaggaggtccggcagcgaagagcaaagctatcagcgttggtgacaaaattgtcggtgttggtcaaacaggcaagccgatggttgacgtgattggctggcgtcttgatgatgtggtggccttaattaaagggcctaagggcagtaaagttcgtctggaaattttacctgctggtaaagggaccaagacccgtacggtaacgttgacccgtgaacgtattcgtctcgaagaccgcgcggttaaaatgtcggtgaagaccgtcggtaaagagaaagtcggcgtgctggatattccgggcttctatgtgggtttgacagacgatgtcaaagtgcaactgcagaaactggaaaaacagaatgtcagcagtgtgattatcgacctgcgtagcaatggtggtggggcgttgactgaagccgtatcgctctccggtctgttcattccatccggcccgattgttcacgtccgcgataacaacggcaaggttcgtgaagacagcgacaccgacggacaggtcttctataannnnncattcattcattaa

SEQ ID NO: 4424 - protein, 460 aa, Escherichia coli
  Xaa 455, 456, 457: Xaa is any amino acid
MCAQNTWCSETEAGPGMNMFFRLTALAGLLAIAGQTFAVEDITRADQIPVLKEETQHATVSERVTSRFTRSHYRQFDLDQAFSAKIFDRYLNLLDYSHNVLLESDVEQFAKKKTELGDELRSGKLDVFYDLYNLAQKRRFERYQYALSVLEKPMDFTGNDTYNLDRSKAPWPKNEAELNALWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPSGPIVHVRDNNGKVREDSDTDGQVFYXXXFIH

SEQ ID NO: 4425 - DNA, 699 bp, Escherichia coli
atggaaaatcaacctaagttgaatagcagtaaagaagtaatcgcgtttctggccgaacgttttccccactgtttcagtgcggaaggtgaagcgcgtccgctgaaaatcggtatttttcaggatttggtcgatcgtgttgccggggaaatgaacctgagcaaaacgcaattgcgatccgctttacgtctctacacttcgagctggcgttatctttacggtgttaaacccggcgcaacacgtgtcgatcttgacggcaacccatgcggtgagctggacgagcaacatgtcgagcatgctcgcaagcagcttgaagaagcgaaagcgcgtgttcaggcacagcgtgctgaacagcaagcgaaaaaacgcgaagctgccgcagctgctggtgagaaagaagacgcaccgcgccgcgaacgcaagccacgtccgaccacgccacgccgcaaagaaggcgctgaacgtaaacctcgttcgcaaaagccggtagagaaagcgccaaaaacagtaaaagcacctcgcgaagaacagcacaccccggtttctgacatttcagctctgactgtcggacaagccctgaaggtgaaagcgggtcaaaacgcgatggatgccaccgtattagaaatcaccaaagacggcgtccgcgtccagctgaattcgggtatgtctttgattgtgcgcgcagaacacctggtgttctga

SEQ ID NO: 4426 - protein, 232 aa, Escherichia coli
MENQPKLNSSKEVIAFLAERFPHCFSAEGEARPLKIGIFQDLVDRVAGEMNLSKTQLRSALRLYTSSWRYLYGVKPGATRVDLDGNPCGELDEQHVEHARKQLEEAKARVQAQRAEQQAKKREAAAAAGEKEDAPRRERKPRPTTPRRKEGAERKPRSQKPVEKAPKTVKAPREEQHTPVSDISALTVGQALKVKAGQNAMDATVLEITKDGVRVQLNSGMSLIVRAEHLVF

SEQ ID NO: 4427 - DNA, 552 bp, Escherichia coli
atgcttattttaataggctggcagttccaggtaagacaaccaagtgattatataatgaacaaagcagaattttacgcggatttaaatcgcgactttaacgcgctgatggtgggagaaactagttttctggcaacgcttgcgaacaccagtgcgttgttatatgagcgtctcactgacgtaaactgggcaggtttttatttgcttgaggacgatacactggtgctcggaccatttcagggcaaaattgcctgtgtccggatacccgttgggcgcggcgtatgcggcactgcggttgcccgcaatcaagtgcagcgtatcgaggatgttcacgcgtttgacgggcatattgcctgtgatgcggcgagtaattctgaaattgttctgccactggtggtgaaaaatcagattattggtgttctcgacatcgatagtaccgtcttcggtcgctttacagacgaggacgagcaaggcttacgtcagcttgtggcacagcttgaaaaagtgcttgcaacgacggattacaaaaaattctttgcgagcgtcgcaggataa

SEQ ID NO: 4428 - protein, 183 aa, Escherichia coli
MLILIGWQFQVRQPSDYIMNKAEFYADLNRDFNALMVGETSFLATLANTSALLYERLTDVNWAGFYLLEDDTLVLGPFQGKIACVRIPVGRGVCGTAVARNQVQRIEDVHAFDGHIACDAASNSEIVLPLVVKNQIIGVLDIDSTVFGRFTDEDEQGLRQLVAQLEKVLATTDYKKFFASVAG

SEQ ID NO: 4429 - DNA, 741 bp, Escherichia coli
  n 714, 715, 716, 717, 718: n is any nucleotide
gtgagggctatcggcgaggaactgccgcgtggtgattaccaacgttgcccgcaatgtgacatgctgtttagcctgcccgagataaattctcatcaaagtgcctattgtccgcgctgtcaggcaaaaattcgtgacgggcgcgactggtcgctaacgcgcctggcggcaatggccttcaccatgctgttgcttatgccgtttgcctggggcgaaccgctgttgcatatctggctgttaggcattcgtattgacgccaacgttatgcaaggcatctggcaaatgaccaaacagggcgatgcgataacgggggcgatggtctttttctgcgttatcggtgcccccctcattctggtgacctccatagcttatttatggtttggtaaccaattgggaatgaatttacgcccggtactgctgatgcttgagcggctgaaagagtgggtgatgctggatatctacctggtcggcattggcgttgcttctataaaggtacaggattatgcccatatccaggcgggtgtcggcttgttctcttttgtggcgttggtgattttaacgacggtgacgttgtcacatcttaatgttgaagaactgtgggagcgattttatccacagcgccccgctacccgtagggacgagaaactccgtgtctgtcttggtgccattttaccggctatcctgatcagcgtgtcgctgcccgcgttgccatatccnnnnncattccattcattaattaattaa

SEQ ID NO: 4430 - protein, 246 aa, Escherichia coli
  Xaa 239, 240: Xaa is any amino acid
MRAIGEELPRGDYQRCPQCDMLFSLPEINSHQSAYCPRCQAKIRDGRDWSLTRLAAMAFTMLLLMPFAWGEPLLHIWLLGIRIDANVMQGIWQMTKQGDAITGAMVFFCVIGAPLILVTSIAYLWFGNQLGMNLRPVLLMLERLKEWVMLDIYLVGIGVASIKVQDYAHIQAGVGLFSFVALVILTTVTLSHLNVEELWERFYPQRPATRRDEKLRVCLGAILPAILISVSLPALPYPXXFHSLIN

SEQ ID NO: 4431 - DNA, 504 bp, Escherichia coli
  n 12, 13, 14, 15, 16: n is any nucleotide
atgaatgaatgnnnnngctgggcggcgctgttagcgtcaatcgttttgttgttacctgccaacctgttgcctatctctatcatttatctgaatggtggtcggcaggaagatacgattctttccggaattatgtcgctggcaagtagcaacattgcagttgcgggaatcgtgtttatcgccagtattctggtaccgtttactaaagtgattgttatgttcactttactgttgagtattcattttaaatgccagcaaggtttacgcacacgcattctgttactgcggatggtgacctggattggtcgctggtcgatgctcgacctgtttgtcatatctttaaccatgtcgctgattaatcgcgatcaaatcctcgcttttactatggggccggctgcgttttatttcggcgcagcggtaattttgactattcttgctgtggaatggctggacagccgcttactttgggatgcacatgagtcaggaaacgcccgcttcgacgactga

SEQ ID NO: 4432 - protein, 167 aa, Escherichia coli
  Xaa 4, 5, 6: Xaa is any amino acid
MNEXXXWAALLASIVLLLPANLLPISIIYLNGGRQEDTILSGIMSLASSNIAVAGIVFIASILVPFTKVIVMFTLLLSIHFKCQQGLRTRILLLRMVTWIGRWSMLDLFVISLTMSLINRDQILAFTMGPAAFYFGAAVILTILAVEWLDSRLLWDAHESGNARFDD

SEQ ID NO: 4433 - DNA, 2640 bp, Escherichia coli
atgcacatgagtcaggaaacgcccgcttcgacgactgaagcgcagattaaaaataaacgccgtatctcacctttctggctgctgccgttcatcgcgctaatgattgctggttggctgatttgggacagttatcaggaccggggtaataccgtcaccatcgactttatgtcggcggatggtattgttccaggccgtacgcctgttcgttatcagggcgttgaagttggaacagtgcaggatatcagcctcagcgacgatcttcgtaagattgaagtcaaggtcagcatcaagtccgatatgaaagatgcgctgcgcgaagagacacagttctggctggtgacgccaaaggcctcgttggcaggtgtctccgggctggacgccctcgtcggtggtaattatatcggcatgatgccgggtaaaggtaaagagcaggatcactttgtcgcactcgacacccaaccgaaatatcggctggacaatggcgatctgatgatccacctgcaagcccccgatctcggttcactgagcagtggttcattggtctatttccgcaagatcccggtgggtaaagtctacgactatgccatcaatcccaacaagcaaggcgtggtgattgatgtcctgatcgagcggcgttttaccgatctggtgaaaaaaggtagccgtttctggaacgtttccggcgttgatgccaacgtcagtatcagtggcgcgaaggtgaaactggaaagtctggcggcactggttaacggtgcgattgccttcgattcacctgaagagtcgaaacctgccgaagcggaagatacctttggtctgtatgaagacctggcccatagccaacgtggcgtaataataaaactggaactgccaggcggtgccggattaaccgccgactcgacgccgttaatgtatcaggggctggaagtcggacagctgactaaactggatttaaatcctggtggtaaagtcactggggaaatgaccgttgatcccagcgtcgtcaccctgcttcgtaaaaatacccgcatcgaattacgtaatccgaaattatcccttagcgatgctaatctcagtgccctgctgaccggcaaaaccttcgaactggtgcccggcgatggcgagccacgtaaagagttcgtggttgtgccaggcgaaaaagccctgctgcaagagccggatgttctgacactgaccctgacagcaccagaaagttacggtattgatgctggtcagccgctcattcttcacggcgtgcaggtaggccaggttatcgatcgtaaactcaccagcaaaggcgtcacctttaccgtcgccatcgagcctcagcatcgcgaactggtaaaaggcgatagcaaatttgtcgtcaacagccgcgtcgacgtgaaggtagggctggatggcgttgagtttctcggtgccagcgcctcagaatggatcaatggcggaatacgtattctgccgggcgataaaggcgagatgaaagccagctatccactgtatgccaatctggaaaaagcgctggagaacagccttagcgatttacccaccacaaccgtgagtttgagtgcagagacgctgccggatgtgcaggcaggatcggtagtgctgtaccgtaaatttgaagttggtgaagttattactgtgcgtccgcgagctaacgcgtttgatatcgatctgcatattaagccggagtatcgcaaccttctgaccagcaacagcgtgttctgggcagaaggtggggcgaaagttcagctgaatggtagtggtctgactgtacaggcatccccgctctccagagcattaaagggggctattagcttcgataacctcagcggtgccagcgccagtcagcgtaaaggcgacaagcgtattctgtatgcttccgaaacagcggcccgtgcggttggcggacaaattacgcttcacgctttcgatgcgggaaaactggcggtcgggatgccaattcgctatctcggtattgatatcgggcaaatccagacgctggatctgattaccgcacgcaatgaagtacaggcaaaggcggtgctctatccggaatatgtccagacctttgctcgcggtggtacgcgcttctcagtggtcacaccgcaaatttcggcagctggcgttgagcatcttgatactatcctccagccgtatatcaacgtcgaaccaggccggggcaatcctcgccgcgactttgaattacaagaggccaccattactgattcgcgttacctggatggcttaagcattattgttgaagcgccggaagccggttcgttaggtatcggtacacctgtgctgttccgtggtctggaagtaggtacggttaccggaatgacgctggggacattgtcagatcgcgtgatgattgcgatgcgcatcagtaaacgctatcaacacctggtgcgtaacaattccgtcttctggttggcatcgggttacagtctggactttggtctgacgggcggcgtagtgaaaaccggcacctttaaccagtttatccgtggcggcatcgccttcgccacgcctccgggtacgccactggcaccgaaagcccaggaaggcaagcacttcctgttgcaggaaagtgaaccgaaagagtggcgtgaatggggaactgcgcttcccaaataa

SEQ ID NO: 4434 - protein, 879 aa, Escherichia coli
MHMSQETPASTTEAQIKNKRRISPFWLLPFIALMIAGWLIWDSYQDRGNTVTIDFMSADGIVPGRTPVRYQGVEVGTVQDISLSDDLRKIEVKVSIKSDMKDALREETQFWLVTPKASLAGVSGLDALVGGNYIGMMPGKGKEQDHFVALDTQPKYRLDNGDLMIHLQAPDLGSLSSGSLVYFRKIPVGKVYDYAINPNKQGVVIDVLIERRFTDLVKKGSRFWNVSGVDANVSISGAKVKLESLAALVNGAIAFDSPEESKPAEAEDTFGLYEDLAHSQRGVIIKLELPGGAGLTADSTPLMYQGLEVGQLTKLDLNPGGKVTGEMTVDPSVVTLLRKNTRIELRNPKLSLSDANLSALLTGKTFELVPGDGEPRKEFVVVPGEKALLQEPDVLTLTLTAPESYGIDAGQPLILHGVQVGQVIDRKLTSKGVTFTVAIEPQHRELVKGDSKFVVNSRVDVKVGLDGVEFLGASASEWINGGIRILPGDKGEMKASYPLYANLEKALENSLSDLPTTTVSLSAETLPDVQAGSVVLYRKFEVGEVITVRPRANAFDIDLHIKPEYRNLLTSNSVFWAEGGAKVQLNGSGLTVQASPLSRALKGAISFDNLSGASASQRKGDKRILYASETAARAVGGQITLHAFDAGKLAVGMPIRYLGIDIGQIQTLDLITARNEVQAKAVLYPEYVQTFARGGTRFSVVTPQISAAGVEHLDTILQPYINVEPGRGNPRRDFELQEATITDSRYLDGLSIIVEAPEAGSLGIGTPVLFRGLEVGTVTGMTLGTLSDRVMIAMRISKRYQHLVRNNSVFWLASGYSLDFGLTGGVVKTGTFNQFIRGGIAFATPPGTPLAPKAQEGKHFLLQESEPKEWREWGTALPK

SEQ ID NO: 4435 - DNA, 1446 bp, Escherichia coli
atgctcgtggcccaacacaccgtttatttcccggacgcctttctgacacaaatgcgcgaagcgatgccttcgacgctctcttttgatgattttcttgccgcctgtcagcgcccgttgcgccgcagcattcgcgttaatacgctgaaaacctccgttgctgatttcctgcaattaactgctccttatggctggacgcttacgccaattccgtggtgtgaagaaggtttctggattgaacgcgacagtgaagatgcattgccgttgggtagtaccgccgagcatttaagcggcctgttttatattcaggaagccagttcaatgttgcctgttgccgccttgtttgctgacggtaatgcaccacagcgggtgatggatgtcgctgctgcaccaggttccaaaacgacgcaaattgctgcgcggatgaataacaaaggggcaatccttgccaatgagttttccgccagtcgggtaaaagtgttacatgccaatatcagccgctgtggcatcagtaatgttgcgctcacgcattttgatggccgcgtgtttggtgcggcagtgccagaaatgttcgatgccattttgctggacgctccctgctccggcgaaggcgtggtgcgtaaagatcccgatgcgctaaaaaactggtcaccagaaagcaatcaggaaatcgcagcgacccaacgggagctgatcgacagcgcctttcatgcattacgtcttggcggtacgctggtttactcgacctgtaccttaaaccgggaagaaaacgaagccgtttgcctgtggctgaaagagacttaccacgacgcagtagagtttttaccgcttggcgatctcttccctggtgcaaataaggcgctgaccgaagacggctttttgcatgttttcccacaaatttacgactgcgaaggcttcttcgttgctcgtctgcgtaaaactcaggcgatccccgtcttacccgccccaaaatacaaagtgggcaatttcccgtttagcccggtgaaagatcgcgaagccggtcaaattcgtcaggcggctgcaagtgttggcttaaactgggatgaaaacctgcgactctggcagcgtgacaaagaactgtggttgttcccggtaggcattgaagccctgatcggtaaagtccgattttctcgcttggggattaaacttgccgaaacgcacaacaaaggttatcgctggcagcatgaagccgttattgcccttgcctcccccgacaatgtgaacgcttttgaactgacaccgcaggaagcggaagagtggtatcgcgggcgcgatgtttacccgcaagccgcgccagtggcggatgatgtattggttactttccagcatcagccgattggtttagccaaacggattggttcacgactgaaaaacagctacccgcgtgaactggtgcgcgacgggaaactttttaccggtaacgcctga

SEQ ID NO: 4436 - protein, 481 aa, Escherichia coli
MLVAQHTVYFPDAFLTQMREAMPSTLSFDDFLAACQRPLRRSIRVNTLKTSVADFLQLTAPYGWTLTPIPWCEEGFWIERDSEDALPLGSTAEHLSGLFYIQEASSMLPVAALFADGNAPQRVMDVAAAPGSKTTQIAARMNNKGAILANEFSASRVKVLHANISRCGISNVALTHFDGRVFGAAVPEMFDAILLDAPCSGEGVVRKDPDALKNWSPESNQEIAATQRELIDSAFHALRLGGTLVYSTCTLNREENEAVCLWLKETYHDAVEFLPLGDLFPGANKALTEDGFLHVFPQIYDCEGFFVARLRKTQAIPVLPAPKYKVGNFPFSPVKDREAGQIRQAAASVGLNWDENLRLWQRDKELWLFPVGIEALIGKVRFSRLGIKLAETHNKGYRWQHEAVIALASPDNVNAFELTPQEAEEWYRGRDVYPQAAPVADDVLVTFQHQPIGLAKRIGSRLKNSYPRELVRDGKLFTGNA

SEQ ID NO: 4437 - DNA, 252 bp, Escherichia coli
atggagagcacgaagatgaaaaccagtgtgcgcataggcgcttttgaaatcgacgacggcgaattacacggcgaatcgccgggtgatcgaacgttaaccattccttgtaaatcagaccccgatttatgtatgcaactggatgcctgggatgctgaaaccagtatccctgccctgctaaatggcgaacactctgtcctttaccgtacccgttacgatcaacaatctgatgcctggattatgcgtcttgcctga

SEQ ID NO: 4438 - protein, 83 aa, Escherichia coli
MESTKMKTSVRIGAFEIDDGELHGESPGDRTLTIPCKSDPDLCMQLDAWDAETSIPALLNGEHSVLYRTRYDQQSDAWIMRLA

SEQ ID NO: 4439 - DNA, 276 bp, Escherichia coli
atggcgggttatttgtccgggttattcccccgttgtaaaatctctcctaaacttaacggtacggcaccacacttcggggatgaaatgttcgcgctggtactttttgtttgctacctggatggcggttgtgaagatattgttgtggatgtctacaacacggaacagcagtgtctttattctatgagcgatcaacggatccgccatggcggttgttttccgattgaggattttatagatggtttctggcgacctgcacaggagtacggtgatttttaa

SEQ ID NO: 4440 - protein, 91 aa, Escherichia coli
MAGYLSGLFPRCKISPKLNGTAPHFGDEMFALVLFVCYLDGGCEDIVVDVYNTEQQCLYSMSDQRIRHGGCFPIEDFIDGFWRPAQEYGDF

SEQ ID NO: 4441 - DNA, 657 bp, Escherichia coli
atgaaacagcctgcgcccgtttatcagagaattgcgggtcatcaatggcgacatatctggctttcaggcgatatacacggttgtcttgagcagttgcgccgcaaattatggcattgtcgttttgatccgtggcgagatttacttatctcagtgggagacgttatcgatcgtgggccgcaaagtttacgttgcctgcagttactggaacaacattgggttcgtgcggtaagaggcaatcatgaacagatggcgatggatgcgctggcatcccggcagatgtctttatggttgataaatggcggcgactggtttattgcgctggcagataatcaccagaaacaagcgaaaacggcgctggaaaaatgtcagcatttgccctttattcttgaattacacagtcgcaccggcaaacatgttattgctcatgccgattatccagatgatgtctatgaatggcaaaaggacgtcgatttgcatcaggtcttgtggagccgctcgcgattaggtgaacgccaaaaagggcagggaattgcaggtgctgatcatttctggtttggtcatacacctttgcgccatcgcgtggatattggcaacctgcattatattgataccggtgctgtctttgggggagaactgactcttgtgcaattgcaataa

SEQ ID NO: 4442 - protein, 218 aa, Escherichia coli
MKQPAPVYQRIAGHQWRHIWLSGDIHGCLEQLRRKLWHCRFDPWRDLLISVGDVIDRGPQSLRCLQLLEQHWVRAVRGNHEQMAMDALASRQMSLWLINGGDWFIALADNHQKQAKTALEKCQHLPFILELHSRTGKHVIAHADYPDDVYEWQKDVDLHQVLWSRSRLGERQKGQGIAGADHFWFGHTPLRHRVDIGNLHYIDTGAVFGGELTLVQLQ

SEQ ID NO: 4443 - DNA, 153 bp, Escherichia coli
ttgatttccaataaaaaaccgcctcagttctttcaccagaacgggcggtttttaacatttaagctgatgaccaccacgctttttattgaccattttgcacgcaaactggaaaacctggcgtcgtcatctattcttaaagagcaaggcaactaa

SEQ ID NO: 4444 - protein, 50 aa, Escherichia coli
MISNKKPPQFFHQNGRFLTFKLMTTTLFIDHFARKLENLASSSILKEQGN

SEQ ID NO: 4445 - DNA, 342 bp, Escherichia coli
atgatgagaaaaagtattctggcgtttctgttactcaccagttctgcagctgcgctggcggcaccgcaggtgattaccgtcagccgttttgaagtgggtaaagacaaatgggcgtttaatcgcgaagaggtgatgttgacttgccgaccgggtaatgctttgtatgtcattaacccaagtaccctcgtgcagtatcctttaaacgatatcgcacaaaaggaagttgccagtgggaagactaaagcccaacccatttcggtgattcagattgatgatcctaacaatcccggcgaaaaaatgagtctggcaccgtttatagagcgagctgaaaaactctgttaa

SEQ ID NO: 4446 - protein, 113 aa, Escherichia coli
MMRKSILAFLLLTSSAAALAAPQVITVSRFEVGKDKWAFNREEVMLTCRPGNALYVINPSTLVQYPLNDIAQKEVASGKTKAQPISVIQIDDPNNPGEKMSLAPFIERAEKLC

SEQ ID NO: 4447 - DNA, 873 bp, Escherichia coli
atgctggcgtttacctggatcgcgctgcgatttatccatttcacctcgctgatgctggtttttggcttcgcaatgtacggtgcctggctggcccccttaacgattcgtcgcttgctgacgaagcgttttctgcgtttacaacagcacgctgccgtctggagtttgatcagtgccactgcaatgctcgccgttcagggcgggttgatgggaacgggatggtcagatgtattttcgccaaacatttggctggctgttttgcaaacgcagtttggtggcgtctggttatggcaaattgttctcgccctcgtaacattgatcgtcgcccttatgcaaccgcggaatatgccacgtttgctgtttatgctcactaccgcgcaatttattctgctggcgggagtcgggcatgcgacgttgaatgaaggggtaacggcgaaaatccatcagactaatcacgcaattcacctgatctgtgcggcggcgtggtttgggggattactgccggtgctctggtgtatgcaactcatcaaaggccgttggcgacaccaggctattcaggcgctgatgcgtttttcctggtgcgggcattttgcggtgatcggcgtactggcaagcggcgtgcttaatgcattgttgattaccggatttccccccacgcttacgacttactggggccaactcttattgctcaaagccatcctggtgatgattatggtggtcatcgcgctggctaatcgttatgttcttgtaccgcgcatgaggcaggatgaagatcgtgcggctccctggtttgtctggatgactaaactcgaatgggcgataggtgcggtagtgctggtgatcatcagcctgcttgcgactctcgaacctttttga

SEQ ID NO: 4448 - protein, 290 aa, Escherichia coli
MLAFTWIALRFIHFTSLMLVFGFAMYGAWLAPLTIRRLLTKRFLRLQQHAAVWSLISATAMLAVQGGLMGTGWSDVFSPNIWLAVLQTQFGGVWLWQIVLALVTLIVALMQPRNMPRLLFMLTTAQFILLAGVGHATLNEGVTAKIHQTNHAIHLICAAAWFGGLLPVLWCMQLIKGRWRHQAIQALMRFSWCGHFAVIGVLASGVLNALLITGFPPTLTTYWGQLLLLKAILVMIMVVIALANRYVLVPRMRQDEDRAAPWFVWMTKLEWAIGAVVLVIISLLATLEPF

SEQ ID NO: 4449 - DNA, 375 bp, Escherichia coli
atggcttcaactgcacgctcccttcgctacgcgctggcaatcctgaccacttcgttggtgacaccttccgtctgggcacatgcgcatttaacgcatcagtatcctgcggcaaatgcacaagtgacagcagctccgcaggcaatcactttaaacttctcggaaggcgttgaaacaggattcagtggtgcaaaaatcacggggccaaaaaacgaaaatattaaaacattaccggcgaagcggaatgagcaggaccaaaagcaactgattgttccactggccgattcgctgaaacccggaacctacaccgttgactggcatgttgtttcggtggatgggcataaaacgaaaggacattacacctttagtgtgaaataa

SEQ ID NO: 4450 - protein, 124 aa, Escherichia coli
MASTARSLRYALAILTTSLVTPSVWAHAHLTHQYPAANAQVTAAPQAITLNFSEGVETGFSGAKITGPKNENIKTLPAKRNEQDQKQLIVPLADSLKPGTYTVDWHVVSVDGHKTKGHYTFSVK

SEQ ID NO: 4451 - DNA, 318 bp, Escherichia coli
atgtctgagtcgaggatcatcaattccggcttgccatcaaggctcactcttagtaacttttgcccgcgaatgatgaggagattaagaatgctgaagaatctggctaaactggatcaaacagaaatggataaagtgaatgtcgatttggcggcggcaggggtggcatttaaagaacgctacaatatgccggtgatcgctgaagcggttgaacgtgaacagcctgaacatttgcgcagctggtttcgcgagcggcttatcgcccaccgtttggcttcggtcaatctgtcacgtttaccttacgagcccaaacttaaataa

SEQ ID NO: 4452 - protein, 105 aa, Escherichia coli
MSESRIINSGLPSRLTLSNFCPRMMRRLRMLKNLAKLDQTEMDKVNVDLAAAGVAFKERYNMPVIAEAVEREQPEHLRSWFRERLIAHRLASVNLSRLPYEPKLK

SEQ ID NO: 4453 - DNA, 657 bp, Escherichia coli
atgtcgttctggaaagttgcagcagcgcaatatgagccccgtaaaacctcactcaccgaacaggtagctcatcatctggagtttgtgagggccgccgccaggcaacaatgtcagctgttagtttttccatcgctttctttactggggtgtgattattcgcgacgtgcccttcctgccccacccgatctctcgctattagacccgctttgttatgccgcaacgacctggcgaatgaccatcattgccggccttcccgttgaatataacgatcgctttattcgtggaattgcggtattcgcaccgtggcgaaaaacgccagggatctaccatcagagttatggtgcatgtctgggccgtcgttccagaaccatcacggtggtcgatgaacaaccgcaaggtatggatatggacccgacctgttcactgtttacgacagggcaatgtctgggagaacccgacctgctggcgtcggcccgtcgcttacaatttttttcacatcagtactcgattgcagtgctgatggcaaatgcccgtggtaacagtgcactatgggatgaacatggtcgtctcatcgttcgcgccgatcgtggttcattattgttagtcggtcagcgttcatcacagggttggcaaggcgatatcattccattacgctag

SEQ ID NO: 4454 - protein, 218 aa, Escherichia coli
MSFWKVAAAQYEPRKTSLTEQVAHHLEFVRAAARQQCQLLVFPSLSLLGCDYSRRALPAPPDLSLLDPLCYAATTWRMTIIAGLPVEYNDRFIRGIAVFAPWRKTPGIYHQSYGACLGRRSRTITVVDEQPQGMDMDPTCSLFTTGQCLGEPDLLASARRLQFFSHQYSIAVLMANARGNSALWDEHGRLIVRADRGSLLLVGQRSSQGWQGDIIPLR

SEQ ID NO: 4455 - DNA, 663 bp, Escherichia coli
atgttgcgcattatcgatacagaaacctgcggtttgcagggagggatcgtagagattgcctctgttgatgtcattgacggaaaaatcgtcaatcccatgagccacctggtgcgtcccgatcgtcctattagtccacaggcgatggcgattcatcgcatcaccgaagccatggtcgccgataaaccgtggattgaagatgtgatcccgcactattacggtagtgaatggtatgtcgcgcataacgccagctttgaccgccgcgtactgcctgaaatgcccggtgagtggatttgcactatgaaactggcccgtcgtttgtggccagggatcaagtacagcaatatggcgctatataaaacacggaagctcaatgtacagacgccgccgggcctgcatcatcaccgcgcgttgtatgactgttatatcaccgccgcgttgcttatcgatattatgaacacctctggctggacggcagaacagatggccgatatcaccggacgtccatcgttgatgacgaccttcacctttggcaaataccgtggcaaagcggtttccgacgttgccgaacgcgatccgggctatctgcgctggttgtttaataacctcgacagcatgagcccggagctgcgtttaacactgaaacattatctggaaaatacttaa

SEQ ID NO: 4456 - protein, 220 aa, Escherichia coli
MLRIIDTETCGLQGGIVEIASVDVIDGKIVNPMSHLVRPDRPISPQAMAIHRITEAMVADKPWIEDVIPHYYGSEWYVAHNASFDRRVLPEMPGEWICTMKLARRLWPGIKYSNMALYKTRKLNVQTPPGLHHHRALYDCYITAALLIDIMNTSGWTAEQMADITGRPSLMTTFTFGKYRGKAVSDVAERDPGYLRWLFNNLDSMSPELRLTLKHYLENT

SEQ ID NO: 4457 - DNA, 2061 bp, Escherichia coli
atgctaccaaaagccgcccgcattccccacgccatgacgcttcatggcgatacgcgcatcgataattactactggctgcgggacgatacgcgttctcagccggaagtcctggactatctgcaacaagaaaatagttacggtcatcgggtgatggcctcgcaacaagccttgcaggatcgcatcttaaaggaaatcatcgaccgcattccacaacgagaagtttctgcgccctacatcaaaaatggctaccgctatcggcatatttatgaaccaggctgtgaatatgctatctaccagcgtcaatcggcgttcagtgaagagtgggacgagtgggaaacattgctcgatgccaacaagcgcgcggctcatagtgagttttattcgatgggcggaatggcgattacgccagataacaccattatggcactggcagaagattttctttcccgacggcagtacggcattcgttttcgtaatctggaaacaggtaactggtacccggaactgctggataacgttgaacccagctttgtctgggcaaatgactcctggactttctactatgttcgcaagcatccagtgacgctgctgccttatcaggtctggcgtcacgccatcggtacgccagcatcgcaagataaactgatttacgaagaaaaagacgatacctattacgtcagcctgcataaaacgacctcgaagcattatgtggtcattcatctggccagctccaccaccagtgaagttcgcctgctggacgcggaaatggccgatgccgagccgtttgtttttctgcctcgccgcaaagatcacgaatacagccttgatcactaccagcatcggttttatctgcgttccaaccgccacggtaaaaactttggcttataccgtacccgtatgcgtgatgagcaacagtgggaagagttaattccgccacgtgataacattatgctggaagggtttacgctgtttaccgactggctggtggttgaagagcgtcagcgcgggttaaccagtttgcggcaaattaaccgcaagacccgggaagtcattggcattgcctttgatgatccggcctatgtgacctggattgcctacaatccagaacctgaaaccgcgcgattgcgttatggttattcgtccatgaccacaccagatactttgtttgaactggatatggataccggtgagcgtcgtgtattaaaacaaacggaagttcctggttttgatgcggcgaattaccgcagtgaacacctgtggatagtcgcccgtgatggcgtcgaagttccggtttcgctggtctatcatcgcaaacattttcgcaaaggacacaacccgctgctggtgtatggctacggttcttacggcgcaagtattgatgccgatttcagttttagccgcttgagtttgttggatcgtggatttgtctacgccattgtccatgttcgtggcggcggtgagctggggcaacaatggtacgaggacggtaaatttctgaagaagaaaaatacgtttaatgattatcttgatgcctgcgatgcattgttaaaactgggctatggctctccttcgctctgttatgcgatgggcgggagtgcgggggggatgttgatgggcgttgcgattaatcaacgcccggaattgttccacggcgttatcgcccaggtaccgtttgttgatgttgtaacaacaatgctggatgaatcaattcctcttaccaccggcgaatttgaagagtgggggaatccgcaggatccgcaatattacgagtatatgaaaagctacagcccgtatgacaacgtcaccgcacaggcttatccgcatttactggtaacgaccggtttacacgattctcaggtgcaatattgggaaccggcaaaatgggtcgctaaattgcgcgagctgaaaaccgatgaccatcttttattgctctgtaccgacatggactcaggtcatggcggtaaatctggtcgcttcaaatcgtacgaaggcgtagcgatggaatatgcttttctggtcgcgctggcgcagggaacattacccgctcagtcagcggattaa

SEQ ID NO: 4458 - protein, 686 aa, Escherichia coli
MLPKAARIPHAMTLHGDTRIDNYYWLRDDTRSQPEVLDYLQQENSYGHRVMASQQALQDRILKEIIDRIPQREVSAPYIKNGYRYRHIYEPGCEYAIYQRQSAFSEEWDEWETLLDANKRAAHSEFYSMGGMAITPDNTIMALAEDFLSRRQYGIRFRNLETGNWYPELLDNVEPSFVWANDSWTFYYVRKHPVTLLPYQVWRHAIGTPASQDKLIYEEKDDTYYVSLHKTTSKHYVVIHLASSTTSEVRLLDAEMADAEPFVFLPRRKDHEYSLDHYQHRFYLRSNRHGKNFGLYRTRMRDEQQWEELIPPRDNIMLEGFTLFTDWLVVEERQRGLTSLRQINRKTREVIGIAFDDPAYVTWIAYNPEPETARLRYGYSSMTTPDTLFELDMDTGERRVLKQTEVPGFDAANYRSEHLWIVARDGVEVPVSLVYHRKHFRKGHNPLLVYGYGSYGASIDADFSFSRLSLLDRGFVYAIVHVRGGGELGQQWYEDGKFLKKKNTFNDYLDACDALLKLGYGSPSLCYAMGGSAGGMLMGVAINQRPELFHGVIAQVPFVDVVTTMLDESIPLTTGEFEEWGNPQDPQYYEYMKSYSPYDNVTAQAYPHLLVTTGLHDSQVQYWEPAKWVAKLRELKTDDHLLLLCTDMDSGHGGKSGRFKSYEGVAMEYAFLVALAQGTLPAQSAD

SEQ ID NO: 4459 - DNA, 660 bp, Escherichia coli
atggctaactggttaaatcaactgcaatccctgcttgggcaaagccgttcttctacctcctcgtctgcggatcagggattgggcaaacttttagtgcctggcgcattaggcggactggctgggctgctggtcgcaaataaatcagcacgtaaacttcttacgaaatatggcacaaacgcgttactggttggcggcggagcggtagcgggtacggtgctgtggaataaatacaaagataaaattcgcgcggcgcatcaggatgaaccgcagtttggcgcgcaaagtacgccgctggatgagcgtacggaacgtttgatccttgcgctggtctttgccgctaaaagtgatggtcatattgatgccaaagaacgtgcggcaatcgaccagcaattgcgagaagccggtgtggaagagaaggggcgtgtactcattgagcaggcaatcgaacaaccgctggatccacaacgcctggctaccggggtccgcaatgaagaagaggcgctggaaatctatttcctgagctgcgcggctattgatattgaccattttatggaacgcagttacctgaatgcactgggtgatgcgctgaaaatcccccaggatgttcgtgaaggcattgaacgcgatctcgaacagcaaaaacgtactttggcggagtaa

SEQ ID NO: 4460 - protein, 219 aa, Escherichia coli
MANWLNQLQSLLGQSRSSTSSSADQGLGKLLVPGALGGLAGLLVANKSARKLLTKYGTNALLVGGGAVAGTVLWNKYKDKIRAAHQDEPQFGAQSTPLDERTERLILALVFAAKSDGHIDAKERAAIDQQLREAGVEEKGRVLIEQAIEQPLDPQRLATGVRNEEEALEIYFLSCAAIDIDHFMERSYLNALGDALKIPQDVREGIERDLEQQKRTLAE

SEQ ID NO: 4461 - DNA, 357 bp, Escherichia coli
atgaaaaaaagaggggcgtttttagggctgttgttggtttctgcctgcgcatcagttttcgctgccaataatgaaaccagcaagtcggtcactttcccaaagtgtgaaggtctggatgctgccggaattgccgcgagcgtaaaacgtgattaccaacaaaatcgcgtggcgcgctgggctgatgatcaaaaaattgtcggtcaggccgaccccgtggcatgggtcagtttgcaggacattcaggggaaagatgataaatggtcagtaccgctaaccgtgcgtggtaaaagtgccgatattcattaccaggtcagcgtggactgcaaagcgggaatggcggaatatcagcggcgttaa

SEQ ID NO: 4462 - protein, 118 aa, Escherichia coli [sequence omitted]

SEQ ID NO: 4463 - DNA, 114 bp, Escherichia coli
gtgaccgacttgctggtttcattattggcagcgaaaactgatgcgcaggcagaaaccaacaacagccctaaaaacgcccctctttttttcatgtttttctccatagcacaatga

SEQ ID NO: 4464 - protein, 37 aa, Escherichia coli
MTDLLVSLLAAKTDAQAETNNSPKNAPLFFMFFSIAQ

SEQ ID NO: 4465 - DNA, 291 bp, Escherichia coli
atggcggttgaagttaaatacgtagtcattcgtgagggcgaagagaaaatgtcgtttaccagcaaaaaggaagccgatgcttatgacaagatgcttgatacggccgatctgcttgacacctggctgacaaattctccagtgcaaatggaagatgagcaacgtgaagccctttcgctatggctggcagaacaaaaagatgtgctgagcaccattctgaaaaccggcaaattaccgtccccacaggtcgtcggtgctgaatccgaagaggaagatgcctcacacgcggcctga

SEQ ID NO: 4466 - protein, 96 aa, Escherichia coli
MAVEVKYVVIREGEEKMSFTSKKEADAYDKMLDTADLLDTWLTNSPVQMEDEQREALSLWLAEQKDVLSTILKTGKLPSPQVVGAESEEEDASHAA

SEQ ID NO: 4467 - DNA, 1179 bp, Escherichia coli
atgacgttattaggcactgcgctgcgtccggcagcaactcgcgtgatgttattaggctccggtgaactgggtaaagaagtggcaatcgagtgtcagcgtctcggcgtagaggtgattgccgtcgatcgctatgccgacgcaccagccatgcatgtcgcgcatcgctcccatgtcattaatatgcttgatggtgatgcattacgccgtgtggttgaactggaaaaaccacattatatcgtgccggagatcgaagctattgccaccgatatgctgatccaacttgaagaggaaggactgaatgttgtcccctgcgctcgcgcaacgaaattaacgatgaatcgcgagggtatccgtcgcctggcggcagaagagctgcagctgcccacttccacttatcgttttgccgatagcgaaaaccttttccgcgaagcggttgccgccattggctacccctgtattgttaaaccggtgatgagttcttccggtaaagggcagacgtttattcgttctgcagagcaacttgctcatgcatgggagtacgctcagcaaggtggtcgcgccggagcgggccgcgtaattgttgaaggcgtcgttaagtttgacttcgaaattaccctgctaaccgtcagcgcggtggatggcgtccatttctgtgcaccggtaggtcatcgccaggaagatggcgactatcgtgaatcctggcaaccacagcaaatgagcccgcttgcccttgaacgtgcgcaggagattgcccgtaaagtggtgctggcactgggcggttatgggctgtttggtgtcgagctgtttgtctgcggtgatgaggtgattttcagtgaagtctcccctcgcccgcatgacaccgggatggtgacgctaatttctcaggatctctcggagtttgccctgcatgtacgtgccttcctcggacttccggttggcgggatccgccagtatggtcctgctgcttctgccgttatcctgccgcaactgaccagtcagaatgtcacgtttgataatgtgcagaatgccgtaggcgcagatttgcagattcgtttatttggtaagccggaaattgatggcagccgtcgtctgggggtagcactggctactgcagagagtgttgttgacgccattgaacgcgcgaagcacgccgccggacaggtaaaagtacagggttaa

SEQ ID NO: 4468 - protein, 392 aa, Escherichia coli
MTLLGTALRPAATRVMLLGSGELGKEVAIECQRLGVEVIAVDRYADAPAMHVAHRSHVINMLDGDALRRVVELEKPHYIVPEIEAIATDMLIQLEEEGLNVVPCARATKLTMNREGIRRLAAEELQLPTSTYRFADSENLFREAVAAIGYPCIVKPVMSSSGKGQTFIRSAEQLAHAWEYAQQGGRAGAGRVIVEGVVKFDFEITLLTVSAVDGVHFCAPVGHRQEDGDYRESWQPQQMSPLALERAQEIARKVVLALGGYGLFGVELFVCGDEVIFSEVSPRPHDTGMVTLISQDLSEFALHVRAFLGLPVGGIRQYGPAASAVILPQLTSQNVTFDNVQNAVGADLQIRLFGKPEIDGSRRLGVALATAESVVDAIERAKHAAGQVKVQG

SEQ ID NO: 4469 - DNA, 642 bp, Escherichia coli
atgaaaaactggaaaacaagtgcagaatcaatcctgaccaccggcccggttgtaccggttatcgtggtaaaaaaactggaacacgcggtgccgatggcaaaagcgttggttgctggtggggtgcgcgttctggaagtgactctgcgtaccgagtgcgcagttgacgctatccgtgctatcgccaaagaagtgcctgaagcgattgtgggtgccggtacggtgctgaatccacagcagctggcagaagtcactgaagcaggtgcacagtttgcaattagcccgggtctgaccgagccgctgctgaaagctgctaccgaagggactattcctctgattccggggatcagcactgtttccgaactgatgctgggtatggactacggtttgaaaaagttcaaattcttcccggctgaagctaacggcggtgtgaaagccctgcaggcgatcgcgggtccgttctctcaggtccgtttctgcccgacaggtggtatttctccggctaactaccgtgactacctggcgctgaaaagcgtgctgtgcatcggtggttcctggctggttccggcagatgcgctggaagcgggcgattacgaccgcattactaagctggcgcgtgaagctgtagaaggcgctaagctgtaa

SEQ ID NO: 4470 - protein, 213 aa, Escherichia coli
MKNWKTSAESILTTGPVVPVIVVKKLEHAVPMAKALVAGGVRVLEVTLRTECAVDAIRAIAKEVPEAIVGAGTVLNPQQLAEVTEAGAQFAISPGLTEPLLKAATEGTIPLIPGISTVSELMLGMDYGLKKFKFFPAEANGGVKALQAIAGPFSQVRFCPTGGISPANYRDYLALKSVLCIGGSWLVPADALEAGDYDRITKLAREAVEGAKL

SEQ ID NO: 4471 - DNA, 1812 bp, Escherichia coli
atgaatccacaattgttacgcgtaacaaatcgaatcattgaacgttcgcgcgagactcgctctgcttacctcgcccggatagaacaagcgaaaacttcgaccgttcatcgttcgcagttggcatgcggtaacctggcacacggtttcgctgcctgccagccagaagacaaagcctctttgaaaagcatgttgcgtaacaatatcgccatcatcacctcctataacgacatgctctccgctcaccagccttatgaacactatccggaaatcattcgtaaagccctgcatgaagcgaatgcggttggtcaggttgcgggcggtgttccggcgatgtgtgatggtgtcacccaggggcaggatggaatggaattgtcgctgttaagccgcgaagtgattgcgatgtctgcggcggtggggctgtcccataacatgtttgatggtgctctgtttctcggtgtgtgcgacaagattgtcccaggtctgaccatggcagccctgtcgtttggtcatttgcctgcggtgtttgtgccgtctggaccgatggcaagcggtttgccaaataaagaaaaagtgcgtattcgccagctttatgccgaaggtaaagtggaccgcatggcattactggagtcagaagccgcgtcttatcatgcgccgggaacatgtactttctacggtactgccaacaccaaccagatggtggtggagtttatggggatgcagttgccaggctcttcttttgttcatccggattctccgctgcgcgatgctttgaccgctgcagctgcgcgccaggttacgcgcatgaccggtaatggtaatgaatggatgccgatcggtaagatgatcgatgagaaagtggtggtgaacggtatcgttgcactgctggcgaccggtggttccactaaccacaccatgcacctggtggcgatggcgcgcgcagccggtattcagattaactgggatgacttctctgacctttctgatgttgtaccgctgatggcacgtctctacccgaacggtccggccgatattaaccacttccaggcggcaggtggcgtaccggttctggtacgtgaactgctcaaagcaggcctgctgcatgaagatgtcaatacggtggcaggttttggtctgtctcgttatacccttgaaccatggctgaataatggtgaactggactggcgggaaggggcagaaaaatcactcgacaacaatgtgatcgcgtccttcgaacaacctttctctcatcatggtgggacaaaagtgttaagcggtaacctggggcgagcggttatgaaaacctctgccgtgccggtagagaaccaggtgattgaagcgccagcggttgtttttgaaagccagcatgacgttatgccggcctttgaagcgggtttactggaccgcgattgtgtcgttgttgtccgtcatcaggggccaaaagcgaacggaatgccagaattacataaactcatgccgccacttggtgtattattggaccggtgtttcaaaattgcgttagttaccgatggacgactctccggcgcttcaggtaaagtgccgtcagctatccacgtaacaccagaggcctacgatggcgggctgctggcaaaagtgcgcgacggggacatcattcgtgtgaatggacagacaggcgaactgacgctgctggtagacgaagcggaactggctgctcgcgaaccgcacattcctgacctgagcgcgtcacgcgtgggaacaggacgtgaattattcagcgccttgcgtgaaaaactgtccggtgccgaacagggcgcaacctgtatcactttttaa

SEQ ID NO: 4472 - protein, 603 aa, Escherichia coli
MNPQLLRVTNRIIERSRETRSAYLARIEQAKTSTVHRSQLACGNLAHGFAACQPEDKASLKSMLRNNIAIITSYNDMLSAHQPYEHYPEIIRKALHEANAVGQVAGGVPAMCDGVTQGQDGMELSLLSREVIAMSAAVGLSHNMFDGALFLGVCDKIVPGLTMAALSFGHLPAVFVPSGPMASGLPNKEKVRIRQLYAEGKVDRMALLESEAASYHAPGTCTFYGTANTNQMVVEFMGMQLPGSSFVHPDSPLRDALTAAAARQVTRMTGNGNEWMPIGKMIDEKVVVNGIVALLATGGSTNHTMHLVAMARAAGIQINWDDFSDLSDVVPLMARLYPNGPADINHFQAAGGVPVLVRELLKAGLLHEDVNTVAGFGLSRYTLEPWLNNGELDWREGAEKSLDNNVIASFEQPFSHHGGTKVLSGNLGRAVMKTSAVPVENQVIEAPAVVFESQHDVMPAFEAGLLDRDCVVVVRHQGPKANGMPELHKLMPPLGVLLDRCFKIALVTDGRLSGASGKVPSAIHVTPEAYDGGLLAKVRDGDIIRVNGQTGELTLLVDEAELAAREPHIPDLSASRVGTGRELFSALREKLSGAEQGATCITF

SEQ ID NO: 4473 - DNA, 1476 bp, Escherichia coli
atggcggtaacgcaaacagcccaggcctgtgacctggtcattttcggcgcgaaaggcgaccttgcgcgtcgtaaattgctgccttccctgtatcaactggaaaaagccggtcagctcaacccggacacccggattatcggcgtagggcgtgctgactgggataaagcggcttataccaaagttgtccgcgaggcgctcgaaactttcatgaaagaaaccattgatgaaggtttatgggacaccctgagtgcacgtctggatttttgtaatcttgatgtcaatgacactgctgcattcagccgtctcggcgcgatgctggatcaaaaaaatcgtatcaccattaactactttgccatgccgcccagcacttttggcgcaatttgcaaagggcttggtgaggcaaaactgaatgctaaaccggcacgcgtagtcatggagaaaccgctggggacgtcgctggcgacctcgcaggaaatcaacgatcaggttggcgaatacttcgaggagtgccaggtttaccgtatcgaccactatcttggtaaagaaacagtgctgaacctgttggcgctgcgttttgctaactctctgtttgtgaacaactgggacaatcgcaccattgatcatgttgagattaccgtggcagaagaagtggggatcgaagggcgctggggctattttgataaagccggtcagatgcgcgacatgatccagaaccacctgctgcaaattctttgcatgattgcgatgtctccgccgtctgacctgagcgcagacagcatccgcgatgaaaaagtgaaagtactgaagtctctgcgccgcatcgaccgctccaacgtgcgcgaaaaaaccgtacgcgggcaatatactgcgggcttcgctcagggcaaaaaagtgccgggctatctggaagaagagggcgcgaacaagagcagcaatacagaaaccttcgtggcgatccgcatcgacattgataactggcgctgggccggtgtgccattctacctgcgtactggtaaacgtctgccgaccaaatgttctgaagtcgtggtctatttcaaaacacctgaactgaatctgtttaaagagtcgtggcaggatctgccgcagaataaactgactatccgtctgcaacctgatgaaggcgtggatatccaggtactgaataaagttcctggccttgaccacaaacataacctgcaaatcaccaagctggatctgagctattcagaaacctttaatcaaacgcatctggcagatgcctatgaacgtctgctgctggaaaccatgcgtggtattcaggcactgtttgtacgtcgtgatgaagtggaagaagcctggaaatgggtagactccattactgaggcgtgggcgatggacaatgatgcgccgaaaccgtatcaggccggaacctggggccccgttgcctcggtggcgatgattacccgtgacggtcgttcctggaatgagtttgagtaa

SEQ ID NO: 4474 - protein, 491 aa, Escherichia coli
MAVTQTAQACDLVIFGAKGDLARRKLLPSLYQLEKAGQLNPDTRIIGVGRADWDKAAYTKVVREALETFMKETIDEGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRIDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 4475 - DNA, 150 bp, Escherichia coli
atgacgatttccgctctgaaagaaatcgaaatgcagttttgtcagatattacgcctgtgtgctgtgttaatgacaaaagcagataaaaaagttgttattttttttcataacatgatcagtgtcagatttttacccaatggaaaacgatga

SEQ ID NO: 4476 - protein, 49 aa, Escherichia coli
MTISALKEIEMQFCQILRLCAVLMTKADKKVVIFFHNMISVRFLPNGKR

SEQ ID NO: 4477 - DNA, 870 bp, Escherichia coli
atgaatatgctggaaaaaatccagtctcagctggaacatttgagcaaatctgagcgcaaagttgccgaggtcattctggcttcgcccgataacgcgatccattcgagtattgctgctctggcgctggaagccaatgttagcgaaccgacggtgaatcgtttctgtcgcagcatggacactcgcggttttcctgattttaaacttcatctggcacaaagtctggcgaatggcactccctatgttaatcgcaacgtcaatgaagatgacagcgttgaatcatacacggggaaaatatttgagtccgcaatggcaacgctcgatcatgtccgtcattcactggataaatctgccatcaaccgcgccgtcgacttgctcactcaggcaaaaaaaatcgcctttttcggattaggttcttcagccgccgttgcccacgatgcgatgaataagttctttcgttttaatgttccggtggtgtactccgatgatatcgtgctgcaacgcatgagttgtatgaattgtagcgacggagacgtggtggtgctgatttctcatactggaagaacaaaaaatctggtcgagctggcgcagctggcacgcgaaaacgacgctatggtaattgccctcacctctgcgggtaccccgctcgcccgggaagcaacgctggcaattaccctcgacgtaccggaagacactgacatttatatgcccatggtttctcgacttgcacagttgaccgtgatagatgtgctggcgacaggatttactttgcggcgcggtacaaaattcagagataacttgaagcgggtcaaggaagcgctgaaggaatcgcgttttgataagcagttacttaatttaagtgacgatcgctaa

SEQ ID NO: 4478 - protein, 289 aa, Escherichia coli
MNMLEKIQSQLEHLSKSERKVAEVILASPDNAIHSSIAALALEANVSEPTVNRFCRSMDTRGFPDFKLHLAQSLANGTPYVNRNVNEDDSVESYTGKIFESAMATLDHVRHSLDKSAINRAVDLLTQAKKIAFFGLGSSAAVAHDAMNKFFRFNVPVVYSDDIVLQRMSCMNCSDGDVVVLISHTGRTKNLVELAQLARENDAMVIALTSAGTPLAREATLAITLDVPEDTDIYMPMVSRLAQLTVIDVLATGFTLRRGTKFRDNLKRVKEALKESRFDKQLLNLSDDR

SEQ ID NO: 4479 - DNA, 1584 bp, Escherichia coli
gtgacgatcgctaaaaacgattgtcactgtcctaatcttatacgacatccgaatgagattaatttatcgccatcgcggcgttatttcattcggatttcatgttcaagcaacacctggttgtttcagtcaacggagtattacatgtccagaaggcttcgcagaactaaaatcgttaccacgttaggcccggcaacagatcgcgataataaccttgaaaaagttatcgcggcgggtgccaacgttgtacgtatgaatttttctcacggctcgcctgaagatcacaaaatgcgcgcggataaagttcgtgagattgccgcaaaactggggcgtcatgtggctattctgggtgacctccaggggcccaaaatccgtgtatccacctttaaagaaggcaaagttttcctcaatattggggataaattcctgctcgacgccaacctgggtaaaggtgaaggcgacaaagaaaaagtcggtatcgactacaaaggcctgcctgctgacgttgtgcctggtgacatcctgctgctggacgatggtcgcgtccagttaaaagtactggaagtccagggcatgaaagtgttcaccgaagtgaccgtcggtggtcccctctccaacaataaaggtatcaacaaacttggcggcggtttgtcggctgaagcgctgaccgaaaaagacaaagcagacattaagactgcggcgttaattggcgtagattacctggctgtctccttcccacgctgcggcgaagatctgaactatgcccgtcgcctggcacgcgatgcaggatgtgatgcgaaaattgttgccaaggttgaacgtgcggaagccgtttgcagccaggaggcaatggatgacatcatcctcgcctctgacgtggtaatggttgctcgcggcgacctcggtgtggaaattggcgatccggaactggtcggcattcagaaagcgttgatccgtcgtgcgcgtcagcttaaccgcgcggtaatcactgcgacccagatgatggagtcaatgattactaacccgatgccgacgcgtgcagaagtcatggacgtagcaaacgccgttctggatggtactgacgctgtgatgctgtcggcagaaactgctgctggtcaatacccgtcagaaactgttgcagccatggcgcgcgtttgcctgggggcggaaaaaatcccgagcatcaacgtttctaaacaccgtctggacgttcagttcgacaatgtggaagaagctattgccatgtcagcaatgtacgcggctaaccacctgaaaggcgttacggcgatcatcaccatgaccgaatcgggtcgtaccgcgctgatgacctcccgtatcagctctggtctgccaattttcgccatgtcacgccatgaacgtacgctgaacctgactgctctctatcgcggcgttacgccggtgcactttgatagcgctaatgacggcgtagcggctgccagcgaagcggttaatctgctgcgcgataaaggttacttgatgtctggtgacctggtgattgtcacccagggcgacgtgatgagtaccgtgggttctactaataccacgcgtattttaacggtagagtaa

SEQ ID NO: 4480 - protein, 527 aa, Escherichia coli
MTIAKNDCHCPNLIRHPNEINLSPSRRYFIRISCSSNTWLFQSTEYYMSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQEAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 4481 - DNA, 972 bp, Escherichia coli
atggaaacgaaaaaaaataatagcgaatacattcctgagtttgataaatcctttcgccacccgcgctactggggagcatggctgggcgtagcagcgatggcgggtatcgctttaacgccgccaaagttccgtgatcccattctggcacggctgggacgttttgccggacgactgggaaaaagctcacgccgtcgtgcgttaatcaatctgtcgctctgctttccagaacgtagtgaagctgaacgcgaagcgattgtagatgagatgtttgccaccgcgccgcaagcgatggtaatgatggctgagttggcaatacgcgggccggagaaaattcagccgcgcgttgactggcaagggctggagatcatcgaagagatgcggcgtaataacgagaaagtgatttttctggtgccgcacggttgggccgtcgatattcctgccatgctgatggcctcgcaagggcagaaaatggcagcgatgttccataatcagggcaacccggtttttgattatgtctggaacacggtgcgccgtcgctttggtggtcgtctgcatgcgagaaatgatggtattaaaccattcatccagtcggtacgtcagggttactggggatattatttacccgatcaggatcatggcccagaacacagcgaatttgttgatttctttgccacctataaagcgacgttgcccgcgattggtcgtttgatgaaagtgtgccgtgcgcgcgttgtaccgctgtttccgatttatgatggcaagacgcatcgtctgacgattcaggtgcgcccaccgatggatgatctgttagaggcggatgatcatacgattgcgcggcggatgaatgaagaagtcgagatttttgttggtccgcgaccagaacaatacacctggatattaaaattgctgaaaactcgcaaaccgggcgaaatccaaccgtataagcgcaaagatctttatcccatcaaataa

SEQ ID NO: 4482 - protein, 323 aa, Escherichia coli
METKKNNSEYIPEFDKSFRHPRYWGAWLGVAAMAGIALTPPKFRDPILARLGRFAGRLGKSSRRRALINLSLCFPERSEAEREAIVDEMFATAPQAMVMMAELAIRGPEKIQPRVDWQGLEIIEEMRRNNEKVIFLVPHGWAVDIPAMLMASQGQKMAAMFHNQGNPVFDYVWNTVRRRFGGRLHARNDGIKPFIQSVRQGYWGYYLPDQDHGPEHSEFVDFFATYKATLPAIGRLMKVCRARVVPLFPIYDGKTHRLTIQVRPPMDDLLEADDHTIARRMNEEVEIFVGPRPEQYTWILKLLKTRKPGEIQPYKRKDLYPIK

SEQ ID NO: 4483 - DNA, 1323 bp, Escherichia coli
gtgcaacagatagcccgctctgtcgccctggcgtttaataatttaccgcgaccacaccgcgttatgttggggtcgctcaccgttcttactctggccgtcgctgtctggcggccctatgtttatcaccgcgatgccacgccaattgtcaaaaccattgagctggaacagaacgaaattcgttcgctcttacctgaagccagtgagccgattgatcaagctgcacaagaagatgaagccattccccaggacgaactggatgacaaaatcgccggtgaagcgggcgtgcatgaatatgttgtttccactggcgatacgctaagcagcattctcaatcagtatggtattgatatgggtgatatcacccaactggctgctgccgacaaagaattgcgtaacctgaaaatcggtcaacaactctcctggacattaaccgcggacggcgaactgcagcgcctcacctgggaagtgtctcgtcgtgaaacccgaacctatgaccgtactgccgctaacggttttaaaatgaccagcgaaatgcagcaaggagagtgggtcaacaatctgctgaaaggtaccgtcgggggaagctttgttgccagcgccagaaacgccggtttaaccagcgccgaagtgagcgcagtgattaaagccatgcagtggcaaatggatttccgcaaactgaaaaaaggcgatgaatttgcggtgttaatgtcacgagaaatgcttgatggtaaacgtgagcaaagccagctgctgggcgtacgtttgcgttcagaaggtaaagattattacgcaatccgcgctgaagatggcaaattctacgatcgtaacggtactggtctggcgaaaggattcttgcgattcccgacggcgaaacagttccgtatctcatctaactttaacccgcgtcgtactaatccggtgaccggtcgcgttgcgccacacagaggtgttgattttgccatgccacaaggtacgccagtgctttcagtgggtgacggtgaagtggtggttgccaaacgcagtggcgcagcaggttattatgtggctattcgtcatggtcgcagctacaccacgcgttatatgcacttgcgcaagatcctggtgaaaccgggacagaaggtgaaacgtggcgaccgtatcgcgctttccggtaataccggacgttcaaccgggccgcatctgcactatgaagtatggataaaccagcaggccgtaaacccgctgacggcaaaactgccgcgtaccgaagggctgaccggctccgatcgtcgcgaattcctggcacaggccaaagagattgtgccgcagctacggtttgattaa

SEQ ID NO: 4484 - protein, 440 aa, Escherichia coli [sequence omitted]

SEQ ID NO: 4485 - DNA, 1059 bp, Escherichia coli
ttggccaaaagaaaccgagacattttccagggaaaccagacttgtcatgttaattttagtcttgcagtagttatgaaatgttataatatcacagttctcatattcattacgatgattggtcgcattatgttacataaaaaaacgcttcttttcgcagcattatccgccgctctctggggcggtgcaacacaggccgcagatgccgccgttgtcgcttcgcttaaacccgttgggttcatcgcttctgccattgctgatggggtaacagaaacgcaggttttactgcctgacggcgcttcagaacatgattattcactgcgtccatcggatgtaaaacgcttacagaacgcggacttagtcgtttgggttggcccggagatggaagcgttcatgcaaaaaccggtaagtaaattaccagaagcgaaacaggtaacgattgcgcagctagaagatgtgaaaccgctgctgatgaaaagtattcacgacgatgatgatgatcacgatcacgcggaaaaaagtgacgaagatcaccatcacggcgatttcaacatgcatctttggctttccccagagatagcgcgggctacagcggttgcaatccatggaaaattagtggaacttatgccgcaaagtcgagccaaacttgacgccaacctgaaggattttgaggcacaattagcctcaaccgaaacgcaggttggtaacgagctcgcgccgctcaaggggaaaggttatttcgtttttcacgatgcttacggctacttcgaaaaacagttcggactgacaccgcttggtcattttaccgttaaccctgagattcaacctggcgcgcagcgtttacatgaaataagaacacagttggttgagcaaaaagcaacctgcgtttttgctgagccacagttcaggccagcggtcgttgagagcgtcgcacgagggacatccgttcgtatgggaacgttggatcccctggggacgaatatcaaactgggtaaaacaagctattcagaattcctgaatcaattagccaaccagtatgcgagctgcctgaaaggagattaa

SEQ ID NO: 4486 - protein, 352 aa, Escherichia coli
MAKRNRDIFQGNQTCHVNFSLAVVMKCYNITVLIFITMIGRIMLHKKTLLFAALSAALWGGATQAADAAVVASLKPVGFIASAIADGVTETQVLLPDGASEHDYSLRPSDVKRLQNADLVVWVGPEMEAFMQKPVSKLPEAKQVTIAQLEDVKPLLMKSIHDDDDDHDHAEKSDEDHHHGDFNMHLWLSPEIARATAVAIHGKLVELMPQSRAKLDANLKDFEAQLASTETQVGNELAPLKGKGYFVFHDAYGYFEKQFGLTPLGHFTVNPEIQPGAQRLHEIRTQLVEQKATCVFAEPQFRPAVVESVARGTSVRMGTLDPLGTNIKLGKTSYSEFLNQLANQYASCLKGD

SEQ ID NO: 4487 - DNA, 756 bp, Escherichia coli
atgacaagtctggtttccctggaaaatgtctcggtttcttttggccaacgccgcgtcctctctgatgtgtcgctggaacttaaacctggaaaaattttgactttacttgggccaaacggcgcaggtaagtcgacactggtacgggtagtgctcggactggtaacacccgatgaaggggttatcaagcgcaacggaaaactgcgcatcggctatgtaccgcagaagctgtatctcgacaccacgttgccactgaccgtaaaccgttttttacgcttacgccctggcacacataaagaagatattttgcctgcactgaaacgtgtccaggccgggcatctgattaacgcaccgatgcaaaagctctcgggtggcgaaacgcagcgtgtactgttagcgcgagcattgttaaatcgaccgcaattattagtgctggatgaacccactcagggcgtggatgtgaatggtcaggtggcgttatatgaccttattgaccaactgcgtcgtgaactggattgtggcgttttaatggtatctcacgatctgcatctggtaatggcaaaaaccgatgaagtgctttgcctgaatcaccacatttgttgttccggcacaccggaagttgtttccctgcatccggagtttatttctatgtttggtcctcgtggtgctgaacaactgggtatctatcgccatcatcataatcatcgtcacgatttacagggacgaattgttttgcgtcggggaaatgatcgctcatga

SEQ ID NO: 4488 - protein, 251 aa, Escherichia coli
MTSLVSLENVSVSFGQRRVLSDVSLELKPGKILTLLGPNGAGKSTLVRVVLGLVTPDEGVIKRNGKLRIGYVPQKLYLDTTLPLTVNRFLRLRPGTHKEDILPALKRVQAGHLINAPMQKLSGGETQRVLLARALLNRPQLLVLDEPTQGVDVNGQVALYDLIDQLRRELDCGVLMVSHDLHLVMAKTDEVLCLNHHICCSGTPEVVSLHPEFISMFGPRGAEQLGIYRHHHNHRHDLQGRIVLRRGNDRS

SEQ ID NO: 4489 - DNA, 786 bp, Escherichia coli
atgattgaattattatttcccggttggttagccgggatcatgctcgcctgtgccgcgggtccgctgggttcgtttgtagtctggcgtcgtatgtcttatttcggtgatacgctggctcatgcctcattacttggcgtcgcgtttggtttgttgctggacgtgaatccattctatgcggtgattgcagttacgctgctgctggcgggcggtctggtatggctggagaagcgtccacagctggcgatcgacacgttattagggattatggcgcacagtgccctgtcgctgggcctggtggtcgttagtctgatgtctaatattcgtgttgatttgatggcttacctgttcggtgatttactggcagtgacgccagaagatctcatctctattgcgattggcgtggtcatcgtggtggctattttgttctggcaatggcgcaatttgctgtcgatgacgattagcccggatctggcgtttgttgatggtgtgaaattacagcgcgtgaaattgttgttgatgctggtgacggcattgacgattggtgtagcgatgaaatttgtcggcgcgttgattattacttcactgctgattattcctgctgctactgcacgtcgctttgcccgcacgccggaacagatggctggtgtcgctgttttggtggggatggtggcagtgactggcggtttaaccttttccgcattttacgatacacctgcaggcccgtcggtggtgctatgcgcggcactgttatttattctcagtatgatgaaaaaacaggccagctaa

SEQ ID NO: 4490 - protein, 261 aa, Escherichia coli
MIELLFPGWLAGIMLACAAGPLGSFVVWRRMSYFGDTLAHASLLGVAFGLLLDVNPFYAVIAVTLLLAGGLVWLEKRPQLAIDTLLGIMAHSALSLGLVVVSLMSNIRVDLMAYLFGDLLAVTPEDLISIAIGVVIVVAILFWQWRNLLSMTISPDLAFVDGVKLQRVKLLLMLVTALTIGVAMKFVGALIITSLLIIPAATARRFARTPEQMAGVAVLVGMVAVTGGLTFSAFYDTPAGPSVVLCAALLFILSMMKKQAS

SEQ ID NO: 4491 - DNA, 1011 bp, Escherichia coli
atgattgaagcagaccgtctgatttctgccggtaccactttgccggaagatgtggcagatcgcgccattcgccctaaattactggaagagtatgttggtcagccgcaggttcgttcgcagatggagattttcatcaaagcagcgaaactgcgcggcgatgccctcgatcatctattgatttttggtcctccggggttgggtaaaactacgcttgccaatattgtcgccaatgaaatgggcgttaatttacgcacgacttctggtccggtgctggaaaaggcgggcgatctggcagcaatgctcactaaccttgaaccacacgatgtactgtttattgatgagatccaccgtctttcaccagtggtggaagaggtgttgtatccggcaatggaagattaccaactggatatcatgattggtgaaggtccggcggcacgctccattaaaattgatttgccgccgtttaccctgattggtgcaaccacgcgcgcaggttcgctgacatcaccgttgcgcgatcgttttggtattgtgcaacgtctggagttttatcaggtgccggatctgcaatatatcgtcagtcgcagcgcacgctttatggggcttgagatgagtgatgacggcgcgctggaagttgctcgtcgtgcgcgcggtacgccacgtattgccaaccgtctgctgcgtcgagtgcgtgatttcgccgaagtgaagcacgatggcaccatctcggcagatatcgctgctcaggcgctggatatgttgaatgtcgatgctgaaggtttcgattatatggaccgcaaattgttgctggcggtaatcgataagttctttggtgggccggtaggtctggataacctggcggcagccattggcgaagaacgtgaaaccattgaggatgtactggaaccttatttgattcagcaaggctttttgcagcgtacaccgcgtgggcgtatggcgacgacgcgggcgtggaatcactttggcataacgccgccagaaatgccgtaa

SEQ ID NO: 4492 - protein, 336 aa, Escherichia coli
MIEADRLISAGTTLPEDVADRAIRPKLLEEYVGQPQVRSQMEIFIKAAKLRGDALDHLLIFGPPGLGKTTLANIVANEMGVNLRTTSGPVLEKAGDLAAMLTNLEPHDVLFIDEIHRLSPVVEEVLYPAMEDYQLDIMIGEGPAARSIKIDLPPFTLIGATTRAGSLTSPLRDRFGIVQRLEFYQVPDLQYIVSRSARFMGLEMSDDGALEVARRARGTPRIANRLLRRVRDFAEVKHDGTISADIAAQALDMLNVDAEGFDYMDRKLLLAVIDKFFGGPVGLDNLAAAIGEERETIEDVLEPYLIQQGFLQRTPRGRMATTRAWNHFGITPPEMP

SEQ ID NO: 4493 - DNA, 612 bp, Escherichia coli
gtgataggcagactcagaggcatcatcattgaaaaacaacccccgctggtgttaattgaagtgggcggcgtaggctatgaagtgcatatgccgatgacctgtttttatgaactccctgaagcgggtcaggaagcgatcgttttcacccactttgtggtgcgtgaagacgcgcaactgctgtacggttttaacaataaacaagagcgcacgttgttcaaagagttgatcaaaaccaacggcgtcggcccgaagttggcgctggcgatcctctccggaatgtcagcgcagcagttcgttaatgccgttgagcgtgaagaagtgggggcactggtgaaactgccgggtattggcaaaaaaaccgccgaacgcttgattgtcgaaatgaaagaccgatttaaaggtttgcatggcgatctctttacgccagccgccgacctggtactcacgtctcctgccagcccggcgaccgacgatgctgaacaggaagcggttgctgcgctggtggcactgggctataaaccacaagaagcaagccgcatggtgagcaaaatcgctcgccctgacgccagcagtgaaacattaattcgcgaagccctacgcgccgcgttatga

SEQ ID NO: 4494 - protein, 203 aa, Escherichia coli
MIGRLRGIIIEKQPPLVLIEVGGVGYEVHMPMTCFYELPEAGQEAIVFTHFVVREDAQLLYGFNNKQERTLFKELIKTNGVGPKLALAILSGMSAQQFVNAVEREEVGALVKLPGIGKKTAERLIVEMKDRFKGLHGDLFTPAADLVLTSPASPATDDAEQEAVAALVALGYKPQEASRMVSKIARPDASSETLIREALRAAL

SEQ ID NO: 4495 - DNA, 675 bp, Escherichia coli
ttgcgccccctgaaaaaaataaattttttatgctattacgtatattcatatctatttcaatggaatgacaacgtgaatattaattatcctgctgaatatgaaattggtgatatcgtctttacatgtataggtgctaccttatttggtcaaatatcagctgcatcaaattgctggagtaatcacgtcgggatcattatcggtcataacggtgaagactttctggttgcagaaagccgtgttcccctctcaaccatcactacgctatcccgttttattaaacgctctgctaatcaacgctatgctataaagcgattagacgccgggctaacagaacaacaaaaacaacgaattgttgaacaggttccctcccggctacgcaaactttaccacaccggttttaaatacgaatcttcgcgccagttctgttcaaaatttgtttttgatatttataaagaggcgctatgtattccggtgggtgaaatagagacatttggagaattgttaaatagcaatccgaatgcaaaactcactttctggaaattctggttcttaggttctattccgtgggagcgtaaaaccgtcacgccagccagtttgtggcatcatccgggtttggtgttgattcacgcggtgggagttgaaacgcctcagcctgaactgaccgaggcggtataa

SEQ ID NO: 4496 - protein, 224 aa, Escherichia coli
MRPLKKINFLCYYVYSYLFQWNDNVNINYPAEYEIGDIVFTCIGATLFGQISAASNCWSNHVGIIIGHNGEDFLVAESRVPLSTITTLSRFIKRSANQRYAIKRLDAGLTEQQKQRIVEQVPSRLRKLYHTGFKYESSRQFCSKFVFDIYKEALCIPVGEIETFGELLNSNPNAKLTFWKFWFLGSIPWERKTVTPASLWHHPGLVLIHAVGVETPQPELTEAV

SEQ ID NO: 4497 - DNA, 522 bp, Escherichia coli
atggctattattctcggcattgacccgggttcgcgcgtgaccggctatggcgtcatccgccaggtaggcaggcaactgtcctacctgggtagcggatgcatacgcaccaaagtggatgatttaccgtctcgtctgaagctcatctatgcgggcgtgacggaaatcatcacccaattccagcctgattatttcgccattgaacaggtctttatggcgaagaacgctgactcagccctgaaactggggcaggcgcgcggcgtggcgattgtggcggcggtgaatcaggaattgccggtatttgaatatgcggcacgtcaggtaaagcaaacagtggtaggtattggtagtgccgaaaaaagccaggtgcagcatatggtccgcaccttgctgaaactgcccgctaatccacaggcggatgccgccgatgcgctggcgattgccatcacccactgccacgttagtcagaatgcgatgcaaatgagcgaatcgcgactgaacctggcgagagggcgactgcgttaa

SEQ ID NO: 4498 - protein, 173 aa, Escherichia coli
MAIILGIDPGSRVTGYGVIRQVGRQLSYLGSGCIRTKVDDLPSRLKLIYAGVTEIITQFQPDYFAIEQVFMAKNADSALKLGQARGVAIVAAVNQELPVFEYAARQVKQTVVGIGSAEKSQVQHMVRTLLKLPANPQADAADALAIAITHCHVSQNAMQMSESRLNLARGRLR

SEQ ID NO: 4499 - DNA, 741 bp, Escherichia coli
atggcaggtcatagtaaatgggccaacaccagacatcgtaaagctgcgcaggatgctaagcgcggtaaaatcttcactaaaatcattcgtgagctggtaaccgcggctaagctgggcggtggtgatccggacgctaacccgcgtttgcgtgcagcaattgataaagcactgtctaacaacatgacccgtgacactctgaaccgcgcaattgcacgaggtgtgggcggtgatgatgatgcaaacatggaaaccatcatctacgaaggttacggtcctggcggcacggcaatcatgattgaatgtctgtctgacaaccgcaaccgtaccgttgctgaagtgcgtcatgcattcagcaaatgtggcggtaacctcggtactgatggttccgtagcttatttgttcagcaaaaaaggcgtgatctccttcgagaaaggcgatgaagacaccatcatggaagcagccctggaagccggtgctgaagacgttgtgacctatgatgacggcgcgattgatgtctacactgcatgggaagaaatgggcaaagtacgcgacgctctggaagcggcaggtctgaaagcagacagcgcggaagtttccatgatcccgtccaccaaagctgatatggatgcagaaaccgcaccgaaactgatgcgtctgatcgatatgctggaagattgcgacgacgtgcaggaagtttaccataacggtgaaatctctgatgaggttgcagcgactctctga

SEQ ID NO: 4500 - protein, 246 aa, Escherichia coli
MAGHSKWANTRHRKAAQDAKRGKIFTKIIRELVTAAKLGGGDPDANPRLRAAIDKALSNNMTRDTLNRAIARGVGGDDDANMETIIYEGYGPGGTAIMIECLSDNRNRTVAEVRHAFSKCGGNLGTDGSVAYLFSKKGVISFEKGDEDTIMEAALEAGAEDVVTYDDGAIDVYTAWEEMGKVRDALEAAGLKADSAEVSMIPSTKADMDAETAPKLMRLIDMLEDCDDVQEVYHNGEISDEVAATL

SEQ ID NO: 4501 - DNA, 444 bp, Escherichia coli
atggcttataagcgtcccgtttcgatcttagtggtcatctacgcacaagatacgaaacgggtgctgatgttgcagcggcgtgacgatcccgatttctggcagtcggtaaccggcagcgtggaagagggtgaaaccgcgccgcaagctgccatgcgcgaagtaaaggaagaggtcaccattgatgttgtcgctgaacaactgaccttaattgactgtcagcgcacggtagagtttgaaattttttcacatttacgtcatcgctatgcgccgggcgtgacgcgtaatacggaatcatggttctgtcttgcgcttccgcacgagcgccagatcgttttcactgaacatctggcttacaagtggcttgatgcgtctgctgcggcggcgctcactaagtcctggagcaaccggcaggcgattgaacagtttgtaattaacgctgcctga

SEQ ID NO: 4502 - protein, 147 aa, Escherichia coli
MAYKRPVSILVVIYAQDTKRVLMLQRRDDPDFWQSVTGSVEEGETAPQAAMREVKEEVTIDVVAEQLTLIDCQRTVEFEIFSHLRHRYAPGVTRNTESWFCLALPHERQIVFTEHLAYKWLDASAAAALTKSWSNRQAIEQFVINAA

SEQ ID NO: 4503 - DNA, 1773 bp, Escherichia coli
atgcgtacagaatattgtggacagctccgtttgtcccacgtggggcagcaggtgactctgtgtggttgggtcaaccgtcgtcgtgatcttggtagcctgatcttcatcgatatgcgcgaccgcgaaggtatcgtgcaggtatttttcgatccggatcgtgcggacgcgttaaagctggcctctgaactgcgtaatgagttctgcattcaggtcacgggcaccgtacgtgcgcgtgacgaaaaaaatattaaccgcgatatggcgactggcgaaatcgaagtactggcgtcctcgctgactatcatcaatcgtgcagatgttctgccgcttgactctaaccacgtcaacaccgaagaagcgcgtctgaaataccgctacctcgacctgcgtcgcccggaaatggctcagcgcctgaaaacccgcgctaaaatcaccagcctggtgcgccgttttatggatgaccacggcttcctcgacatcgaaactccgatgctgaccaaagccacgccggaaggcgcgcgtgactacctggtgccttctcgtgtgcacaaaggtaaattctacgcgctgccgcaatccccgcagttgttcaaacagctactgatgatgtccggctttgaccgctactatcagatcgttaaatgcttccgtgacgaagacctgcgtgctgaccgtcagcctgaatttactcagatcgatgtggaaacttctttcatgaccgcgccgcaagtgcgtgaagtgatggaagcgctggtgcgtcatctgtggctggaagtgaagggcgtggatctgggcgatttcccggtaatgacctttgcagaagcagaacgccgttatggttctgataaaccggatctgcgtaacccgatggaactgaccgacgttgccgatctgctgaaatctgttgagtttgcagtatttgcaggtccggcgaacgatccgaaaggccgtgttgccgctctgcgtgttccgggcggcgcatcgttgacccgtaagcagatcgacgaatacggtaacttcgttaaaatctacggcgcgaaaggtctggcttacatcaaagttaacgaacgcgcgaaaggcctggaaggtatcaatagcccggtagcgaagttccttaatgcagaaatcatcgaagccatcctggagcgtactggcgcgcaagatggcgatatgattttcttcggtgccgacaacaagaaaattgttgccgacgcgatgggcgcactgcgcctgaaagtgggtaaagaccttggtctgaccgacgaaagcaaatgggcaccgctgtgggttatcgacttcccgatgtttgaagacgacggtgaaggcggcctgacagcaatgcaccatccgttcacctcaccgaaagacatgacggcagcagaactgaaagctgcaccggaaaatgcggtggctaacgcttacgatatggtcatcaatggttacgaagtgggcggtggttctgtgcgtatccataatggtgatatgcagcagacggtgtttggtattctgggtatcaacgaagaggaacagcgcgagaaattcggcttcctgctcgacgccctgaaatacggtactccgccgcacgcaggtctggcattcggtcttgaccgtctgacgatgctgctgaccggcaccgacaatatccgtgacgttatcgccttcccgaaaaccacggcggcagcgtgtctgatgactgaagcaccgagctttgctaacccgactgcactggctgagctgagcattcaggttgtgaagaaggctgagaataactga

SEQ ID NO: 4504 - protein, 590 aa, Escherichia coli
MRTEYCGQLRLSHVGQQVTLCGWVNRRRDLGSLIFIDMRDREGIVQVFFDPDRADALKLASELRNEFCIQVTGTVRARDEKNINRDMATGEIEVLASSLTIINRADVLPLDSNHVNTEEARLKYRYLDLRRPEMAQRLKTRAKITSLVRRFMDDHGFLDIETPMLTKATPEGARDYLVPSRVHKGKFYALPQSPQLFKQLLMMSGFDRYYQIVKCFRDEDLRADRQPEFTQIDVETSFMTAPQVREVMEALVRHLWLEVKGVDLGDFPVMTFAEAERRYGSDKPDLRNPMELTDVADLLKSVEFAVFAGPANDPKGRVAALRVPGGASLTRKQIDEYGNFVKIYGAKGLAYIKVNERAKGLEGINSPVAKFLNAEIIEAILERTGAQDGDMIFFGADNKKIVADAMGALRLKVGKDLGLTDESKWAPLWVIDFPMFEDDGEGGLTAMHHPFTSPKDMTAAELKAAPENAVANAYDMVINGYEVGGGSVRIHNGDMQQTVFGILGINEEEQREKFGFLLDALKYGTPPHAGLAFGLDRLTMLLTGTDNIRDVIAFPKTTAAACLMTEAPSFANPTALAELSIQVVKKAENN

SEQ ID NO: 4505 - DNA, 567 bp, Escherichia coli
atgcttgaacttaatgctaaaaccaccgcgctggtggtgattgatttacaagaaggcatcttaccttttgccggaggtccacatactgccgatgaggtggttaatcgcgccgggaagctggcggcgaaatttcgcgccagcggtcagcccgtgtttctggtgcgcgttggctggtctgccgattacgccgaagcattaaaacagccggttgatgccccctcccccgcaaaagtgttgcccgaaaactggtggcaacatcctgctgcattaggtgcaaccgacagcgatatcgaaatcatcaaacgtcaatggggtgcgttttacggtacggatctggagttgcaattacgccgccggggtatcgatacaatagtgttatgtgggatctcgaccaatatcggtgttgaatccaccgcccgcaatgcctgggaactcggttttaatctggtgattgccgaagatgcctgtagcgccgctagcgccgagcagcacaataacagcattaatcatatctacccgcgcatcgcccgtgtgcgcagtgtggaagagatcctccacgcgttatga

SEQ ID NO: 4506 - protein, 188 aa, Escherichia coli
MLELNAKTTALVVIDLQEGILPFAGGPHTADEVVNRAGKLAAKFRASGQPVFLVRVGWSADYAEALKQPVDAPSPAKVLPENWWQHPAALGATDSDIEIIKRQWGAFYGTDLELQLRRRGIDTIVLCGISTNIGVESTARNAWELGFNLVIAEDACSAASAEQHNNSINHIYPRIARVRSVEEILHAL

SEQ ID NO: 4507 - DNA, 819 bp, Escherichia coli
atgatttacatcggtttgccgcaatggtcgcatcctaaatgggtgcggttggggatcaccaaccttgaagagtatgcccgcaactttaactgcgtggagggtaacaccacgctttatgccctgccgaaacccgaggttgtcctgcgctggcgtgagcagaccacagatgacttccgcttctgttttaagtttccggcgaccatttcgcatcaggcagcattacggcattgcgatgatttagtgactgaatttttgacccgcatgtcaccgttggctccgcgcattggacaatactggctgcaactgcctgccacattcggcccacgagagctgcctgcgctttggcattttctcgattctcttcccggtgaatttaattatggggtggaagtccgccatccacagtttttcgccaaaggggaagaggaacaaacgcttaatcgcggtttacatcagcgcggcgttaatcgggtgattttagacagccgcccggttcatgcagcacgtccacacagtgaagctattcgcgacgctcaacgaaaaaaacctaaagttccggtacatgctgtactgacggcgaaaaatccactgatccgttttatcggtagtgatgatatgacgcaaaaccgggagttatttcaggtctggttacaaaaattagcacagtggcatcagaccactacgccttatctttttttacatacgccagatattgcccaggccccggaactggtacataccctgtgggaagacttacgtaaaacgcttccagagatcggagcagttccggctattccacagcaatcttctcttttctga

SEQ ID NO: 4508 - protein, 272 aa, Escherichia coli
MIYIGLPQWSHPKWVRLGITNLEEYARNFNCVEGNTTLYALPKPEVVLRWREQTTDDFRFCFKFPATISHQAALRHCDDLVTEFLTRMSPLAPRIGQYWLQLPATFGPRELPALWHFLDSLPGEFNYGVEVRHPQFFAKGEEEQTLNRGLHQRGVNRVILDSRPVHAARPHSEAIRDAQRKKPKVPVHAVLTAKNPLIRFIGSDDMTQNRELFQVWLQKLAQWHQTTTPYLFLHTPDIAQAPELVHTLWEDLRKTLPEIGAVPAIPQQSSLF

SEQ ID NO: 4509 - DNA, 396 bp, Escherichia coli
atggtaagcgcgctgtatgccgttttaagtgcgttgttattaatgaagttctcttttgatgtcgttcgcctgcgaatgcagtaccgcgttgcctatggcgacggcggttttagcgaactgcaaagcgctattcgcattcatggtaacgcggtggaatatattcctatcgcgattatgttgatgctgtttatggaaatgaatggcgcagaaacctggatggtgcatatttgcggcatcgttttgcttgctggtcgtctgatgcattattacggttttcatcaccgtctgttccgctggcgacgttctggcatgagcgcgacctggtgtgcgctgttgctgatggtgctggcgaatctttggtatatgccctgggagttggttttctccctgcgttag

SEQ ID NO: 4510 - protein, 131 aa, Escherichia coli
MVSALYAVLSALLLMKFSFDVVRLRMQYRVAYGDGGFSELQSAIRIHGNAVEYIPIAIMLMLFMEMNGAETWMVHICGIVLLAGRLMHYYGFHHRLFRWRRSGMSATWCALLLMVLANLWYMPWELVFSLR

SEQ ID NO: 4511 - DNA, 744 bp, Escherichia coli
atgtctcaccgcgacacgctattttctgcccctatcgccagactgggcgactggacctttgatgaacgggtagctgaagtcttcccggatatgatccagcgttccgttcccggctattccaatattatttccatgattggtatgttagccgagcgcttcgttcaacctggtacgcaggtttacgatctgggttgttctctgggcgcggcgacgctctcggtgcgtcgcaacattcatcatgataattgcaaaattattgccatcgataactccccggcgatgattgaacgctgccgtcgtcatattgacgcctataaagctcctacgccagtagacgttattgaaggtgatattcgcgatatcgccattgaaaacgcatcgatggtggtgctgaattttaccctgcaattcctggaaccttccgagcgccaggcgttactggataaaatttatcaagggctgaacccgggcggtgcgctggtgctttcggaaaaattcagtttcgaagatgccaaagttggtgaattgctgttcaacatgcaccacgactttaaacgtgccaacggttacagcgaactggagatcagccagaaacgcagcatgctggaaaacgtgatgctgaccgattccgtggaaacccataaagcacgcctgcataaagccggttttgagcatagcgagctgtggttccagtgctttaactttggttcactggtggcattaaaagcagaggacgctgcatga

SEQ ID NO: 4512 - protein, 247 aa, Escherichia coli
MSHRDTLFSAPIARLGDWTFDERVAEVFPDMIQRSVPGYSNIISMIGMLAERFVQPGTQVYDLGCSLGAATLSVRRNIHHDNCKIIAIDNSPAMIERCRRHIDAYKAPTPVDVIEGDIRDIAIENASMVVLNFTLQFLEPSERQALLDKIYQGLNPGGALVLSEKFSFEDAKVGELLFNMHHDFKRANGYSELEISQKRSMLENVMLTDSVETHKARLHKAGFEHSELWFQCFNFGSLVALKAEDAA

SEQ ID NO: 4513 - DNA, 972 bp, Escherichia coli
atgatcgactttggtaacttttattctctgattgccaaaaatcatctttcacactggctcgaaacgctgcccgcgcagattgctaactggcagcgcgagcagcagcacgggctgtttaagcagtggtccaacgcggtggaatttctgcctgaaattaaaccgtatcgtcttgatttactgcatagcgtgacggcagaaagcgaagaaccactgagcgccgggcaaattaagcgcattgaaacgctgatgcgcaacctgatgccgtggcgcaaagggccgttctcactgtatggcgtcaacatcgataccgaatggcgttccgactggaaatgggatcgcgttctgccccatctttctgatttaaccgggcgcaccattcttgatgtcggctgcggcagcggttatcacatgtggcgcatgattggcgcaggcgcgcacctcgcggtggggatcgaccctacgcaactgtttctgtgccagtttgaagcggtgcgtaaactactgggtaacgatcagcgcgcacatttgttaccgttaggtattgaacaacttccggcactgaaagcctttgataccgtcttttcgatgggcgtgctttatcatcgtcgttcaccgctcgagcatctctggcagttgaaagatcaactggtgaatgagggtgaactggtgcttgaaacgctggttattgatggcgacgaaaacacggtgctggtgccgggcgatcgttacgctcaaatgcgtaatgtctatttcattccttccgcgctggcgctgaaaaactggctgaagaagtgtggttttgttgatattcgcattgcagatgtgagcgttaccaccacagaagagcagcgacgcaccgaatggatggtcaccgagtctctggccgattttctcgacccgcatgatccgggtaaaacggtggaaggttatcctgcgcctaaacgcgcggtgctgattgcgcgcaagccgtaa

SEQ ID NO: 4514 - protein, 323 aa, Escherichia coli [sequence omitted]

SEQ ID NO: 4515 - DNA, 2430 bp, Escherichia coli
atgacattaacaagacgtgaatttattaaacatagcggtattgcggcagggacgctggtggtgacatcggctgcaccgctacccgcatgggcagaagagaagggcggcaaaattctcactgcgggccgttggggagcgatgaacgtagaagtgaaggacggcaagattgtttcttcgacaggcgcgctggcgaaaaccataccgaactccttacagtctacggcggcggatcaggtacacaccacggcgcgtattcagcatccgatggtgagaaaaagctatctcgataatccactgcaaccggcgaaaggtcgtggcgaagatacctatgtacaggtgagctgggaacaagcattaaaactgattcatgaacaacacgatcgtattcgtaaagctaacggaccatcggccatttttgccggatcttacggctggcgttcttctggcgtgttgcataaagcgcaaaccttactgcaacgttatatgaacctggcgggcggttattccgggcatagcggcgattattcaaccggagcggcacaggtgatcatgccgcatgtggtcggttctgtagaggtgtatgaacagcagacctcctggccgcttattctggaaaacagccaggtggtggtgctgtgggggatgaacccgctgaacacgctcaaaattgcctggagcagtaccgatgagcaagggctggaatacttccatcagctgaaaaaatctggcaaaccagtgattgccattgatcctatctgctccgaaaccatcgaattctttggcgataatgccacctggatcgcaccgaatatgggcaccgatgtggcactgatgttagggattgcgcataccctgatgacacaaggcaaacacgataaagtgttccttgaaaaatacactaccgggtatccgcagtttgaagagtatctgacaggtaagagcgataatacgccgaagagcgcggcctgggcggcggaaattactggcgtaccggaagcacagatagtcaaactcgctgaactgatggcggcaaatcgcacaatgctgatggcaggctggggaattcagcgccagcaatatggtgaacagaaacactggatgctggtgacgctggcggcgatgttagggcagattggtacaccgggcggcgggtttggtttctcttatcattactccaacggtggcaacccgacgcgtgttggcggagtgctaccagaaatgtctgcggcgattgccggacaggccagcgaggccgctgatgatggcggaattacggcgattcctgttgcccgtatcgtcgatgcgctggaaaatcctggcggcaaatatcagcataacggtaaagaacaaacgtatccgaatatcaaaatgatctggtgggcgggtggcggtaactttacccatcaccaggatactaatcgtctgattaaagcatggcagaaaccggagatgatcgtcgtttctgaatgctactggaccgcagctgctaaacatgcagatatcgtattaccgatcaccacatcgtttgagcgcaatgacctgacgatgaccggtgattacagcaaccagcatattgtgccgatgaagcaggctgtcgctccgcaatttgaagcgcgcaacgattttgacgtgtttgccgatcttgctgaattactcaaacctggcggaaaagagatctataccgaaggtaaagatgaaatggcgtggctgaaatttttctatgatgccgctcagaaaggtgcgcgtgcgcaacgcgtgacgatgccaatgtttaatgccttctggcagcaaaataaactgatcgaaatgcgccgcagcgagaagaacgaacagtacattcgttatggtgatttccgcgccgatccggtgaaaaatgcgctgggtacaccaagcggcaaaattgagatttactccagaacgctggaaaaatttggctataaggattgcccggcacacccaacctggcttgcgcctgatgagtggaagggtaccgccgacgagaagcagttgcagcttctgaccgcacatccggcacaccgtttacacagtcagcttaactatgcggaactgcgtaaaaaatatgcggttgccgatcgtgaaccaatcactattcacaccgaagatgctgctcgctttggtattgcgaatggcgatctggtgcgtgtctggaacaagcgcggtcagattctgacaggcgcggtggtgactgacgggatcaaaaaaggcgtggtatgcgtgcatgaaggtgcatggctagatctggaaaatggcttgtgtaaaaacggtagtgcgaacgtgttaacggcggatatccccagctcgcagctggcgaatgcctgtgccggtaacactgcgctggtgtatatcgaaaaatatacgggcaatgcgccgaagttaacggcgtttgatcagccagctgttcaggcataa

SEQ ID NO: 4516 - protein, 809 aa, Escherichia coli
MTLTRREFIKHSGIAAGTLVVTSAAPLPAWAEEKGGKILTAGRWGAMNVEVKDGKIVSSTGALAKTIPNSLQSTAADQVHTTARIQHPMVRKSYLDNPLQPAKGRGEDTYVQVSWEQALKLIHEQHDRIRKANGPSAIFAGSYGWRSSGVLHKAQTLLQRYMNLAGGYSGHSGDYSTGAAQVIMPHVVGSVEVYEQQTSWPLILENSQVVVLWGMNPLNTLKIAWSSTDEQGLEYFHQLKKSGKPVIAIDPICSETIEFFGDNATWIAPNMGTDVALMLGIAHTLMTQGKHDKVFLEKYTTGYPQFEEYLTGKSDNTPKSAAWAAEITGVPEAQIVKLAELMAANRTMLMAGWGIQRQQYGEQKHWMLVTLAAMLGQIGTPGGGFGFSYHYSNGGNPTRVGGVLPEMSAAIAGQASEAADDGGITAIPVARIVDALENPGGKYQHNGKEQTYPNIKMIWWAGGGNFTHHQDTNRLIKAWQKPEMIVVSECYWTAAAKHADIVLPITTSFERNDLTMTGDYSNQHIVPMKQAVAPQFEARNDFDVFADLAELLKPGGKEIYTEGKDEMAWLKFFYDAAQKGARAQRVTMPMFNAFWQQNKLIEMRRSEKNEQYIRYGDFRADPVKNALGTPSGKIEIYSRTLEKFGYKDCPAHPTWLAPDEWKGTADEKQLQLLTAHPAHRLHSQLNYAELRKKYAVADREPITIHTEDAARFGIANGDLVRVWNKRGQILTGAVVTDGIKKGVVCVHEGAWLDLENGLCKNGSANVLTADIPSSQLANACAGNTALVYIEKYTGNAPKLTAFDQPAVQA

SEQ ID NO: 4517 - DNA, 1101 bp, Escherichia coli
atgcgagggaaaaaacgcattgggttattgtttttgctgatagcggttgtggttggtggcggcgggttattgctggcgcaaaaagccttacataaaacgtcggataccgcattttgcctttcctgccactcgatgagtaaaccttttgaggaatatcagggaactgtccacttttcaaaccagaaagggatacgtgcggaatgtgctgattgccatattccaaagtcagggatggattatttatttgctaaattaaaagcatctaaagatatttatcatgaatttgttagcggcaaaatagacagtgacgataagttcgaagctcatcgccaggaaatggccgaaacagtatggaaagaattaaaagcaactgactctgcaacctgccgtagttgccattcttttgatgccatggatattgcctcgcaaagtgaatctgcgcaaaaaatgcataataaagcgcaaaaggacggcgaaacctgtatcgattgccataaaggcattgcccattttccgccagaaataaaaatggatgacaacgcggcgcatgagctggaaagtcaggccgctacttcagttactaatggcgcacatatttatcctttcaaaacttctcgcataggcgacctggctaccgtgactcctggtaccgatcttaccgtcgttgatgtcagtggtaaacagccaattgttcggttgcagggttatcaaatgcagggcagtgaaaacacgctctacctggcggcaggtcaacggctggcgctcgccacattaagtgaagaaggtatcaaggcgctaacggtaaacggggaatggcaggctgacgaatacggcaatcaatggcgtcaggcgtctttgcaggggtcgcttatcgatcccgcattagcggaccgtaaaccgctatggcaatacgctgaaaaacttgacgatacctattgcgctggctgccatgcccctattgccgccgaccattacaccgtcaatgcatggccgtccattgccaaaggaatgggggcgcgaaccagcatgagcgaaaacgaactggacattttgacgcggtacttccagtacaacgccaaagatattaccgagaaacagtga

SEQ ID NO: 4518 - protein, 366 aa, Escherichia coli
MRGKKRIGLLFLLIAVVVGGGGLLLAQKALHKTSDTAFCLSCHSMSKPFEEYQGTVHFSNQKGIRAECADCHIPKSGMDYLFAKLKASKDIYHEFVSGKIDSDDKFEAHRQEMAETVWKELKATDSATCRSCHSFDAMDIASQSESAQKMHNKAQKDGETCIDCHKGIAHFPPEIKMDDNAAHELESQAATSVTNGAHIYPFKTSRIGDLATVTPGTDLTVVDVSGKQPIVRLQGYQMQGSENTLYLAAGQRLALATLSEEGIKALTVNGEWQADEYGNQWRQASLQGSLIDPALADRKPLWQYAEKLDDTYCAGCHAPIAADHYTVNAWPSIAKGMGARTSMSENELDILTRYFQYNAKDITEKQ

SEQ ID NO: 4519 - DNA, 747 bp, Escherichia coli
atggcattactggaaatttgctgttacagcatggaatgcgcgctaacggcgcagcaaaacggcgctgacagagttgaattatgcgcagctccaaaagaggggggcttaacgccgtcgttgggggtactgaaatccgtgcgccagcgggtgacgatcccagtgcatccgattatccgcccacgcggtggtgatttttgctacagcgacggtgagtttgccgccattcttgaagatgtgcgcacagtccgcgaattaggttttcctggactggtgacgggcgttctcgaggttgacgggaatgtcgatatgccacgaatggaaaaaataatggctgctgccggtccgctggcagtgacttttcatcgcgccttcgatatgtgcgctaaccctttaaatacactcaataatcttacggaattgggcattacccgggtactgacatcagggcaaaaatcagacgcactgcaaggtttatcaaaaattatggaacttattgcccatcgtgatgctccaatcattatggccggagcaggagtccgtgcggaaaacctgcaccacttcctcgatgccggagtgctggaagtccatagctccgcgggagcgtggcaagcctcaccgatgcgttatcgtaatcaaggattgtccatgtcatcagatgcacacgcggacgagtatttgcgttatgtcgtagacggggcggcggttgctgaaatgaaaggaatcattgaacgccatcaggccaaatga

SEQ ID NO: 4520 - protein, 248 aa, Escherichia coli
MALLEICCYSMECALTAQQNGADRVELCAAPKEGGLTPSLGVLKSVRQRVTIPVHPIIRPRGGDFCYSDGEFAAILEDVRTVRELGFPGLVTGVLEVDGNVDMPRMEKIMAAAGPLAVTFHRAFDMCANPLNTLNNLTELGITRVLTSGQKSDALQGLSKIMELIAHRDAPIIMAGAGVRAENLHHFLDAGVLEVHSSAGAWQASPMRYRNQGLSMSSDAHADEYLRYVVDGAAVAEMKGIIERHQAK

SEQ ID NO: 4521 - DNA, 567 bp, Escherichia coli
atggcgaactggcaatctatcgacgagctgcaggatattgcatcggatttaccgcgatttacccacgcattagatgaactttcccgccgtctggggttggatatcactccgctgactgccgatcacatttccttgcgttgccatcaaaacgtcaccgctgaacgctggcgtcgcgggtttgaacagtgcggcgagcttttgtcagaaaatatgatcaatggcagaccgatttgtctgtttaaattgcatgaaccggtacaggttgcgcactggcagttttccattgtggagctaccgtggcccggggaaaaacgttacccgcacgaaggttgggaacatattgaaatcgttctgccgggtgatccagaaacgctgaatgcccgtgcgctggcattgctttctgatgaaggactcagcctgccggggatctcagttaaaaccagttcgccaaaaggtgagcatgaacgattaccgaatccgacgctggcggtcaccgatggtaaaacaaccattaagtttcatccgtggtccattgaagagatcgttgccagcgagcagtcggcgtaa

SEQ ID NO: 4522 - protein, 188 aa, Escherichia coli
MANWQSIDELQDIASDLPRFTHALDELSRRLGLDITPLTADHISLRCHQNVTAERWRRGFEQCGELLSENMINGRPICLFKLHEPVQVAHWQFSIVELPWPGEKRYPHEGWEHIEIVLPGDPETLNARALALLSDEGLSLPGISVKTSSPKGEHERLPNPTLAVTDGKTTIKFHPWSIEEIVASEQSA

SEQ ID NO: 4523 - DNA, 1734 bp, Escherichia coli
gtgaatattcaggctcttctctcagaaaaagtccgtcaggccatgattgcggcaggcgcgcctgcggattgcgaaccgcaggttcgtcagtcagcaaaagttcagttcggcaactatcaggctaacggcatgatggcagttgctaaaaaactgggtatggcaccgcgacaattagcagagcaggtgctgactcatctggatcttaacggtatcgccagcaaagttgagatcgccggtccaggctttatcaacattttccttgatccggcattcctggctgaacatgttcagcaggcgctggcgtccgatcgtctcggtgttgctatgccagaaaaacaaaccattgtggttgactactctgcgccaaacgtggcgaaagagatgcatgtcggtcacctgcgctctaccattattggtgacgcagcagtgcgtactctggagttcctcggtcacaaagtgattcgcgcaaaccacgtcggcgactggggcactcagttcggtatgctgattgcatggctggaaaagcagcagcaagaaaacgccggtgaaatggagctggctgaccttgaaggtttctaccgcgatgcgaaaaagcattacgacgaggatgaagagtttgccgagcgtgcacgtaactacgtggtaaaactgcaaagcggtgacgaatatttccgcgagatgtggcgcaaactggtcgacatcaccatgacgcagaaccagatcacctacgatcgtctgaacgtgacgttgacccgcgatgacgtcatgggtgaaagtctctacaacccaatgctgccgggtatcgtggcggacctgaaagccaaaggtctggcagtagaaagtgaaggcgcgaccgttgtattccttgatgagttcaaaaacaaggaaggcgaaccgatgggcgttatcattcagaagaaagatggcggctatctctacaccaccactgatatcgcctgtgcgaaatatcgttatgaaacactgcatgccgatcgcgtgctgtattacatcgactcccgtcagcatcaacacctgatgcaggcgtgggctatcgtccgcaaagcaggctatgtaccggaatccgtaccgctggaacaccacatgttcggcatgatgctgggtaaagacggcaaaccgttcaaaacccgcgcgggtggtacagtgaaactggccgatctgctggatgaagccctggagcgtgcacgccgtctggtggcagaaaagaacccggatatgccagccgacgagctggaaaaactggctaacgcggttggtattggtgcggtgaaatatgcggatctctccaaaaaccgcaccacggactacatcttcgactgggacaacatgctggcgtttgagggtaataccgcgccatacatgcagtatgcttacacgcgtgtattatccgtgttccgtaaagcagaaattgacgaagagcaactggctgcagctccggtaatcatccgtgaagatcgtgaagcgcaactggcagctcgcctgctgcagtttgaagaaaccctcactgtggttgcccgtgaaggcacgccgcatgtgatgtgtgcttacctgtacgatctggccggtctgttctctggcttctacgagcactgcccgatcctcagcgcagaaaacgaagaagtgcgtaacagccgtctgaaactggcacaactgacggcgaagacgctgaagctgggtctggatacgctgggtattgagacagtagagcgtatgtaa

SEQ ID NO: 4524 - protein, 577 aa, Escherichia coli
MNIQALLSEKVRQAMIAAGAPADCEPQVRQSAKVQFGNYQANGMMAVAKKLGMAPRQLAEQVLTHLDLNGIASKVEIAGPGFINIFLDPAFLAEHVQQALASDRLGVAMPEKQTIVVDYSAPNVAKEMHVGHLRSTIIGDAAVRTLEFLGHKVIRANHVGDWGTQFGMLIAWLEKQQQENAGEMELADLEGFYRDAKKHYDEDEEFAERARNYVVKLQSGDEYFREMWRKLVDITMTQNQITYDRLNVTLTRDDVMGESLYNPMLPGIVADLKAKGLAVESEGATVVFLDEFKNKEGEPMGVIIQKKDGGYLYTTTDIACAKYRYETLHADRVLYYIDSRQHQHLMQAWAIVRKAGYVPESVPLEHHMFGMMLGKDGKPFKTRAGGTVKLADLLDEALERARRLVAEKNPDMPADELEKLANAVGIGAVKYADLSKNRTTDYIFDWDNMLAFEGNTAPYMQYAYTRVLSVFRKAEIDEEQLAAAPVIIREDREAQLAARLLQFEETLTVVAREGTPHVMCAYLYDLAGLFSGFYEHCPILSAENEEVRNSRLKLAQLTAKTLKLGLDTLGIETVERM

SEQ ID NO: 4525 - DNA, 393 bp, Escherichia coli
atgagagccttattagcaatattattgtttccgctgctggtgcaagccgccggggaggggatgtggcaggcgagtagcgtgggcgttacgctaaatcatcgcggtgaatcgatgtcgtcagcgcctctttctacgcgacaacctgcttcaggattgatgacgctggtggcgtggcgttatcagcttatcggtccgacacctgcaggactgcgggttcgcttgtgttcacaatctcgttgtgtcgaattagaggggcagagtggaaccaccatggccttttccggtataccggcggcagaaccgttgcgctttatctgggaagtgcctggcggtgggcggttaattccgccgctaaagattcaacggaatgaagtgattgtaaattatcgttaa

SEQ ID NO: 4526 - protein, 130 aa, Escherichia coli
MRALLAILLFPLLVQAAGEGMWQASSVGVTLNHRGESMSSAPLSTRQPASGLMTLVAWRYQLIGPTPAGLRVRLCSQSRCVELEGQSGTTMAFSGIPAAEPLRFIWEVPGGGRLIPPLKIQRNEVIVNYR

SEQ ID NO: 4527 - DNA, 2154 bp, Escherichia coli
gtggacaacgccctgtacaacctacacatcttccggtgccggaagccctggattttattaacgagaaaccgacccatgagtaatctggccgcgatgctgcgcctgcctgcaaacctgaaatcgacacaatggcagatccttgccggaccgattttgatcctgttgatcttgtcgatgatggtactgccactgcccgcattcatactcgacctgctgtttaccttcaatattgccttgtcgatcatggtgttgctggtggcgatgtttacccagcgcacgcttgagtttgctgcgtttccgaccatcctgttgtttaccacgctgttgcgtctggcacttaacgtggcttcaacccgtatcattttgatggaagggcataccggcgcggcggcggctggaaaggtggtcgaagcgttcggtcacttcctcgttggtggcaatttcgctatcggtatcgtggtgttcgtcattctcgtgatcatcaactttatggttatcaccaaaggtgccgggcgtattgcggaagtgggcgcgcgctttgttctcgatggtatgccgggtaagcagatggcgattgacgccgaccttaacgctggattgattggtgaagatgaagcgaaaaaacgccgctccgaagtgactcaggaagccgatttttacggctcgatggacggggcaagtaagtttgttcgcggcgatgccatcgccgggatcctcatcatggtcattaacgttgtcggcggattgctggtcggtgtgctgcaacatggcatgagcatggggcacgcggcggaaagttatacgctattgaccattggcgacggtctggtggcacaaatcccggcactggtgatttctaccgccgcgggcgtcatcgttacacgtgtcagcaccgatcaggatgttggcgagcagatggtgaatcagcttttcagtaacccaagcgttatgttattaagcgccgccgtgctcggtttactcggcctggtgcctggaatgccgaacctggtatttttgctgttcactgccggattgctgggactggcctggtggatccgcggacgtgaacaaaaagcgcctgccgaaccaaaaccggtaaaaatggcagagaataataccgttgtcgaagcgacgtggaacgatgtacaactggaagattctctgggaatggaagtgggttatcgactgatcccgatggtcgatttccagcaggatggtgagttgttgggccgtatacgcagtatccgcaagaaatttgcccaggagatggggtttctgccgccagtggtgcacattcgcgacaatatggatctgcaacctgcccgctatcgcattttgatgaaaggcgtggagataggcagtggtgatgcttatccggggcgttggttggcgattaaccctggaaccgctgccgggacgttacctggtgaggcgaccgtcgatccggcatttggcctgaatgctatctggattgaaagtgcgcttaaagaacaggcgcagattcaggggtacaccgtggttgaggccagcacggtggtggcaacgcatcttaaccacctcattagccagcatgccgcagagctgtttggtcgtcaggaggcgcaacagctgctggatcgcgtcgcccaggagatgccaaagctgacggaagatctcgttcctggcgtcgtcacgcttaccacactgcataaagtgctgcaaaatctgctcgatgaaaaagtgccgattcgcgatatgcgcaccattctcgaaacgctggcggaacatgcgcccattcagagcgatccacatgaattaaccgccgtcgtgcgcgtggcgttgggacgggcgattacccagcagtggtttcctggcaaagatgaagtccatgttattggcctcgatacaccgctggaacgtttgttgctacaggcattgcagggcggggggggactggagccagggctggcggatcgcttgttggcgcaaactcaggaagcgctatcccgtcaggagatgttgggtgcgccgccggtattgttggtgaaccacgcgctgcgaccattattgtctcgcttcctgcgccgcagcttgccgcagttagtggtgctgtcgaatctggaactatcagataaccgacatatccgtatgacggcgacgattggcggcaaataa

SEQ ID NO: 4528 - protein, 717 aa, Escherichia coli
MDNALYNLHIFRCRKPWILLTRNRPMSNLAAMLRLPANLKSTQWQILAGPILILLILSMMVLPLPAFILDLLFTFNIALSIMVLLVAMFTQRTLEFAAFPTILLFTTLLRLALNVASTRIILMEGHTGAAAAGKVVEAFGHFLVGGNFAIGIVVFVILVIINFMVITKGAGRIAEVGARFVLDGMPGKQMAIDADLNAGLIGEDEAKKRRSEVTQEADFYGSMDGASKFVRGDAIAGILIMVINVVGGLLVGVLQHGMSMGHAAESYTLLTIGDGLVAQIPALVISTAAGVIVTRVSTDQDVGEQMVNQLFSNPSVMLLSAAVLGLLGLVPGMPNLVFLLFTAGLLGLAWWIRGREQKAPAEPKPVKMAENNTVVEATWNDVQLEDSLGMEVGYRLIPMVDFQQDGELLGRIRSIRKKFAQEMGFLPPVVHIRDNMDLQPARYRILMKGVEIGSGDAYPGRWLAINPGTAAGTLPGEATVDPAFGLNAIWIESALKEQAQIQGYTVVEASTVVATHLNHLISQHAAELFGRQEAQQLLDRVAQEMPKLTEDLVPGVVTLTTLHKVLQNLLDEKVPIRDMRTILETLAEHAPIQSDPHELTAVVRVALGRAITQQWFPGKDEVHVIGLDTPLERLLLQALQGGGGLEPGLADRLLAQTQEALSRQEMLGAPPVLLVNHALRPLLSRFLRRSLPQLVVLSNLELSDNRHIRMTATIGGK

SEQ ID NO: 4529 - DNA, 1149 bp, Escherichia coli
gtgtctgacgagagcgacgacaaaacagaagcccccacacctcaccgactagaaaaagcgcgggaagaggggcaaatcccgcgttcccgtgaactgacttcactgctgattttgctggtgggcgttagtgttatctggtttggcggtgtgtcgctggcccgtcgattgtcgggcatgctctccgcagggctgcattttgatcacagtattatcaatgacccgaatctgatcctcgggcagattattctgctgatcagagaagccatgctggcgctgctaccgctgattagcggcgtggtgctggtggcgattatttctccggttatgctgggggggctggtatttagcggaaaatccttgcagccgaagttttccaaactcaacccgctaccgggcattaaacggatgttctcggcacagactggcgcggagttgcttaaggcaattttgaaaaccatcctggttggcagcgtgacggggttttttctctggcatcactggccgcagatgatgcgcttaatggccgagtctccgattaccgccatgggtaatgcgatggatctggtagggctatgcgcgctgctggtggtgcttggtgtcattccaatggtgggatttgacgtctttttccaaatcttcagccacctgaaaaagctgcgaatgtcacggcaggatattcgtgatgagttcaaacaaagcgaaggcgacccccatgttaaagggcggatccgtcagatgcagcgagcggccgcacggcgtcggatgatggccgatgtgccgaaagcggatgtcattgtcaataacccgacccactattcggtagcgttgcagtatgacgaaaacaaaatgagcgcaccgaaagtggtcgctaaaggtgcagggctggtcgcgctgcgcattcgtgaaattggcgctgaaaataacgtcccgacgcttgaagcgccgccgctggcgcgtgcgctgtatcgacatgcggagatcggtcaacaaatcccgggtcaactgtacgccgcggtggcggaagtgctggcctgggtctggcaactgaaacgctggcgtctggctggtggacaacgccctgtacaacctacacatcttccggtgccggaagccctggattttattaacgagaaaccgacccatgagtaa

SEQ ID NO: 4530 - protein, 382 aa, Escherichia coli
MSDESDDKTEAPTPHRLEKAREEGQIPRSRELTSLLILLVGVSVIWFGGVSLARRLSGMLSAGLHFDHSIINDPNLILGQIILLIREAMLALLPLISGVVLVAIISPVMLGGLVFSGKSLQPKFSKLNPLPGIKRMFSAQTGAELLKAILKTILVGSVTGFFLWHHWPQMMRLMAESPITAMGNAMDLVGLCALLVVLGVIPMVGFDVFFQIFSHLKKLRMSRQDIRDEFKQSEGDPHVKGRIRQMQRAAARRRMMADVPKADVIVNNPTHYSVALQYDENKMSAPKVVAKGAGLVALRIREIGAENNVPTLEAPPLARALYRHAEIGQQIPGQLYAAVAEVLAWVWQLKRWRLAGGQRPVQPTHLPVPEALDFINEKPTHE

SEQ ID NO: 4531 - DNA, 147 bp, Escherichia coli
atgatgccagagcgcaaagcgttcaatggtttgagtaaggggcaaaacaggcgggatttagggcttttgccacagcacatcaggcatggtgacatgtttgtcgggtacggcgtaaacgccttatccaaccttgaagatctgatgtga

SEQ ID NO: 4532 - protein, 48 aa, Escherichia coli
MMPERKAFNGLSKGQNRRDLGLLPQHIRHGDMFVGYGVNALSNLEDLM

SEQ ID NO: 4533 - DNA, 645 bp, Escherichia coli
atgatgcaaccatcaatcaaacctgctgacgagcattcagctggcgatatcattgcgcgcatcggcagcctgacgcgtatgctgcgcgacagtttgcgggagctggggctggatcaggccattgccgaagcagcggaagccatccccgatgcgcgcgatcgtttgtactatgttgtgcagatgaccgcccaggctgcggagcgggcgctgaacagtgttgaggcgtcacaaccgcatcaggatcaaatggagaaatcagcaaaagcgttaacccaacgttgggatgactggtttgccgatccgattgaccttgccgacgcccgtgaactggtaacagacacgcggcaatttctggcagatgtccccgcgcataccagctttactaacgcgcaactgctggaaatcatgatggcgcaggattttcaggatctcaccggacaggtcattaagcggatgatggatgtcattcaggagatcgaacgtcagttgctgatggtgctgttggaaaacatcccggaacaggagtcgcgtccaaaacgtgaaaaccagagtttgcttaatggacctcaggtcgataccagcaaagccggtgtggtagccagtcaggatcaggtggacgatttgttggatagtcttggattttga

SEQ ID NO: 4534 - protein, 214 aa, Escherichia coli
MMQPSIKPADEHSAGDIIARIGSLTRMLRDSLRELGLDQAIAEAAEAIPDARDRLYYVVQMTAQAAERALNSVEASQPHQDQMEKSAKALTQRWDDWFADPIDLADARELVTDTRQFLADVPAHTSFTNAQLLEIMMAQDFQDLTGQVIKRMMDVIQEIERQLLMVLLENIPEQESRPKRENQSLLNGPQVDTSKAGVVASQDQVDDLLDSLGF

SEQ ID NO: 4535 - DNA, 390 bp, Escherichia coli
atggcggataaagaacttaaatttttggttgtggatgacttttccaccatgcgacgcatagtgcgtaacctgctgaaagagctgggattcaataatgttgaggaagcggaagatggcctcgatgctctcaataagttgcaggcaggcggttatggatttgttatctccgactggaacatgcccaatatggatggcctggagttgctgaaaacgattcgtgcggatggcgcgatgtcggcattgccagtgttaatggtgactgcagaagcgaagaaagagaacatcattgctgcggcgcaagcgggggccagtggctatgtggtgaaaccatttaccgctgcgacgctggaggaaaaactcaacaaaatctttgagaaactgggcatgtga

SEQ ID NO: 4536 - protein, 129 aa, Escherichia coli
MADKELKFLVVDDFSTMRRIVRNLLKELGFNNVEEAEDGLDALNKLQAGGYGFVISDWNMPNMDGLELLKTIRADGAMSALPVLMVTAEAKKENIIAAAQAGASGYVVKPFTAATLEEKLNKIFEKLGM

SEQ ID NO: 4537 - DNA, 1050 bp, Escherichia coli
atgagcaaaatcagggtgttatctgtcgatgattcggcactgatgcgccagatcatgacagaaatcatcaacagccatagcgacatggaaatggtggcgaccgcccctgatccgctggttgcgcgtgatttgattaagaaattcaatcccgatgtattgacgctggatgttgaaatgccgcggatggacggactggatttcctcgaaaaattaatgcgtttgcgtccaatgcccgttgtgatggtttcttccctgaccggcaaagggtcagaagttacgctgcgcgcgctggagctgggggcgatagattttgtcaccaaaccgcaactgggtattcgcgaaggaatgctggcatatagcgaaatgattgctgaaaaggtgcgtacggcagcaaaggcgagccttgcagcacataagccattgtcggtaccgacaacgctgaaggcggggccgttgttgagttctgaaaaactgattgcgattggtgcttcaacgggtggaactgaggcaattcgtcacgtactgcaaccgttgccgctttccagtccggcactgttaattacccagcatatgccgcccggtttcacccgctcttttgccgacagacttaataagctttgccagatcggggttaaagaagccgaagacggagagcgcgtcttgccgggacatgcctatatcgcgccgggcgatcggcatatggagctggcgcgtagtggcgcaaattatcaaatcaaaattcacgatggccctgcggttaatcgccatcggccatcggtagatgtgttgttccattctgtggccaaacaggcggggcgtaatgcggttggggtaatcctaaccggtatgggcaacgacggcgcggcgggaatgttggcgatgcgtcaggcgggggcatggacccttgcgcaaaacgaagcaagttgcgtggtgttcggcatgccgcgcgaggccatcaatatgggtggtgtctgcgaagtggtcgatcttagccaggtaagtcagcaaatgctggcaaaaattagtgccggacaggcgatacgtatttaa

SEQ ID NO: 4538 - protein, 349 aa, Escherichia coli
MSKIRVLSVDDSALMRQIMTEIINSHSDMEMVATAPDPLVARDLIKKFNPDVLTLDVEMPRMDGLDFLEKLMRLRPMPVVMVSSLTGKGSEVTLRALELGAIDFVTKPQLGIREGMLAYSEMIAEKVRTAAKASLAAHKPLSVPTTLKAGPLLSSEKLIAIGASTGGTEAIRHVLQPLPLSSPALLITQHMPPGFTRSFADRLNKLCQIGVKEAEDGERVLPGHAYIAPGDRHMELARSGANYQIKIHDGPAVNRHRPSVDVLFHSVAKQAGRNAVGVILTGMGNDGAAGMLAMRQAGAWTLAQNEASCVVFGMPREAINMGGVCEVVDLSQVSQQMLAKISAGQAIRI

SEQ ID NO: 4539 - DNA, 861 bp, Escherichia coli
atgacttcatctctgccctgtgggcaaacgtctttattgttacagatgaccgagcgcctggcgctttccgacgcgcattttcggcggataagtcaattgatctatcaacgagccgggatcgttctggctgaccataaacgcgacatggtttacaaccgactggttcgtcgtttgcgtgcgctgggactggcggatttcggtcattacctgaacttgctggaatctaatcagcacagcggtgagtggcaggcgtttatcaattcgctgaccacgaatctgacggcatttttccgtgaggcacaccattttcctctgctcgcggatcacgcacgtcgccgttctggcgagtatcgcgtatggagcgcggcggcttcaaccggcgaagagccgtacagcatagcgatgacgctggctgatacattgggcaccgcgcccggacgctggaaagtgtttgccagcgatatcgacaccgaagtgctggaaaaagccagaagcggtatttatcgccatgaagagttgaaaaacctgacgccgcagcaactgcaacggtatttcatgcgagggacgggaccgcatgaagggctggtacgcgtgcgtcaggagctggcgaactatgttgattttgccccgctgaatttactggcgaaacagtacaccgtgccggggccgtttgatgcgatcttctgtcgtaacgtcatgatctacttcgatcaaactacccagcagaagattttgcgccgctttgttccgctccttaaacccgacggattgctgtttgcgggtcactctgaaaactttagccaccttgagcgccgcttcacgctgcgtggtcagacggtgtatgcgctaagtaaggattaa

SEQ ID NO: 4540 - protein, 286 aa, Escherichia coli
MTSSLPCGQTSLLLQMTERLALSDAHFRRISQLIYQRAGIVLADHKRDMVYNRLVRRLRALGLADFGHYLNLLESNQHSGEWQAFINSLTTNLTAFFREAHHFPLLADHARRRSGEYRVWSAAASTGEEPYSIAMTLADTLGTAPGRWKVFASDIDTEVLEKARSGIYRHEELKNLTPQQLQRYFMRGTGPHEGLVRVRQELANYVDFAPLNLLAKQYTVPGPFDAIFCRNVMIYFDQTTQQKILRRFVPLLKPDGLLFAGHSENFSHLERRFTLRGQTVYALSKD

SEQ ID NO: 4541 - DNA, 120 bp, Escherichia coli
ttgcaacgactgaatcaggccgaccatctttcgtcgcgtgtggcggtatttacccttgaagaacatgaagtagcacgacatgagtcggcgcagttacaaattgcgccagtggtatcctga

SEQ ID NO: 4542 - protein, 39 aa, Escherichia coli
MQRLNQADHLSSRVAVFTLEEHEVARHESAQLQIAPVVS

SEQ ID NO: 4543 - DNA, 120 bp, Escherichia coli
atgtttaatcgtattcgaatttcgaccacgctgtttttaattttgattctctgcgggatcttgcagattggcagtaacggcatgtcttttgggcatttcgcgacgatttgcaacgactga

SEQ ID NO: 4544 - protein, 39 aa, Escherichia coli
MFNRIRISTTLFLILILCGILQIGSNGMSFGHFATICND

SEQ ID NO: 4545 - DNA, 1662 bp, Escherichia coli
atgattaaccgtatccgcgtagtcacgctgttggtaatggtgctgggggtattcgcactgttacagcttatttccggcagtctgtttttttcttcccttcaccatagccagaagagctttgtggtttccaatcaattacgggaacagcagggcgagctgacgtcaacatgggatttaatgctacaaacgcgcattaacctgagtcgttcagcggtgcggatgatgatggattcatccaatcagcaaagtaatgccaaagttgagttgctcgatagtgccaggaaaacattggcccaggccgcgactcattataaaaaattcaaaagcatggcaccgttacctgaaatggtcgctaccagtcgtaatattgatgaaaaatataaaaactatcacacagcgttaactgaactgattgattatcttgattatggcaatactggagcttatttcgctcagccaacccagggaatgcaaaatgcaatgggcgaagcgtttgctcagtacgccctcagcagtgaaaaactgtatcgcgatatcgtcactgacaacgcagatgattaccgatttgcccagtggcaactggcggttatcgcgctggtggtggtattgattctgctggtggcgtggtacggcattcgccgtatgttgcttacaccgctggcaaaaattattgcgcatattcgcgaaattgccggtggtaacctggcgaataccctgaccattgacgggcgcagtgaaatgggcgacctggcgcagagcgtttcacatatgcaacgctctttgactgacaccgtcactcatgtgcgcgaaggttcagatgccatctatgccggtacccgtgaaattgcggcgggcaacaccgatctttcctcccgtactgaacagcaggcatccgcgctggaagaaactgccgccagcatggagcagctcaccgcgacagtgaagcaaaacgccgataacgcccgccaggcctcgcaactggcgcaaagtgcctccgacaccgcccagcacggcggcaaagtggtggatggcgtagtgaaaacgatgcatgagatcgccgatagttcgaagaaaattgccgacattatcagcgttatcgatggtattgccttccagactaatatcctcgcgctgaatgccgctgttgaagccgcgcgagcgggtgaacagggccgtggttttgccgtggtggcgggtgaagtgcgtaatcttgccagtcgcagtgcacaggcggcaaaagagatcaaagtcctcattgaagactccgtctcgcgcgttgataccggttcggtgctggtcgaaagcgctggggaaacaatgaacaatatcgtcaatgctgtcactcgcgtgactgacattatgggcgagattgcatcagcatcggatgaacagagccgtggcatcgatcaagtcgcattggcggtttcggaaatggatcgcgtcacgcaacagaacgcatcgctggtgcaggaatcagctgccgccgcagctgcgctggaagaacaggcgagtcgtttaacgcaagcggtttccgcgttccgtctggcagccagcccactcaccaataaaccgcaaacaccatcccgtcctgccagtgagcaaccaccggcacagccacgactgcgaattgctgaacaagatccaaactgggaaacattttga

SEQ ID NO: 4546 - protein, 553 aa, Escherichia coli
MINRIRVVTLLVMVLGVFALLQLISGSLFFSSLHHSQKSFVVSNQLREQQGELTSTWDLMLQTRINLSRSAVRMMMDSSNQQSNAKVELLDSARKTLAQAATHYKKFKSMAPLPEMVATSRNIDEKYKNYHTALTELIDYLDYGNTGAYFAQPTQGMQNAMGEAFAQYALSSEKLYRDIVTDNADDYRFAQWQLAVIALVVVLILLVAWYGIRRMLLTPLAKIIAHIREIAGGNLANTLTIDGRSEMGDLAQSVSHMQRSLTDTVTHVREGSDAIYAGTREIAAGNTDLSSRTEQQASALEETAASMEQLTATVKQNADNARQASQLAQSASDTAQHGGKVVDGVVKTMHEIADSSKKIADIISVIDGIAFQTNILALNAAVEAARAGEQGRGFAVVAGEVRNLASRSAQAAKEIKVLIEDSVSRVDTGSVLVESAGETMNNIVNAVTRVTDIMGEIASASDEQSRGIDQVALAVSEMDRVTQQNASLVQESAAAAAALEEQASRLTQAVSAFRLAASPLTNKPQTPSRPASEQPPAQPRLRIAEQDPNWETF

SEQ ID NO: 4547 - DNA, 504 bp, Escherichia coli
atgaccggtatgacgaatgtaacaaagctggccagcgagccgtcaggccaggaatttctggtatttacccttggtgatgaagagtacggtattgatattctgaaagtgcaggagatccgtggctacgatcaggtgacacggattgcgaacacgccagcgtttatcaaaggcgtcacgaatctgcgcggcgttattgtgccgattgttgacttacgaattaagttcagccaggtggatgtggactataacgacaacacggtagttatcgtcctgaatctcggacagcgggtggtcggcatcgtggttgacggcgtctcagacgtgctttcattgacggcggagcaaattcgtccggcaccggaatttgccgtgacgctttcaaccgaatatctcacaggactgggcgcactgggcgaccgcatgttgattctggtgaacatcgaaaaactgctgaacagcgaagagatggcgctgttagatagcgcggcgtcagaagtggcgtaa

SEQ ID NO: 4548 - protein, 167 aa, Escherichia coli [sequence omitted]

SEQ ID NO: 4549 - DNA, 1965 bp, Escherichia coli
gtgagcatggatataagcgatttttatcagacattttttgatgaagcggacgaactgttggctgatatggagcagcatctgctggttttgcagccggaagcgccagatgccgaacagttgaatgccatctttcgggctgcccactcgatcaaaggaggggcaggaacctttggcttcagcgttttgcaggaaaccacgcatctgatggaaaacctgctcgatgaagccagacgaggtgagatgcaactcaacaccgacattatcaatctgtttttggaaacgaaggacatcatgcaagaacagctcgacgcttataaacagtcgcaagagccggatgccgccagcttcaattatatctgccaggccttacgtcaactggcattagaagcgaaaggcgaaacgccatccgcagtgacccgattaagtgtggttgccaaaagtgaaccgcaagatgagcagagtcgtagtcagtcaccgcgacgaattatcctttcgcgcctgaaggccggcgaagtcgacctgctggaagaagagttggggcatctgacaacgttaactgacgtggtgaaaggggcggattctctctcggcaatattaccggacgacatcgccgaagatgacatcactgcggtactctgttttgtgattgaagccgatcagattacctttgaaacagtagacgtctcgccaaaaatatccaccccaccaatgcttaaactggcagccgaacaagcgccaatcggtcgcgtggagcgggaaaaaacgacgcgcagcagtgaatccaccagcatccgtgtagcggtagaaaaggttgatcaattaattaacctcgtcggtgagctggtcatcacccagtccatgcttgcccagcgttccagcgaactggacccggttaatcatggtgatttgattaccagcatggggcagttacaacgtaacgcccgtgatttgcaggaatcagtgatgtcgattcgcatgatgccgatggaatatgtctttagtcgttatccccggctggtgcgtgatctggcgggaaaactcggcaagcaggtagaactgacgctggtgggcagttctactgaactcgacaagagcctgattgaacgcattatcgacccgctgacccacctggtacgcaatagcctcgatcacggtattgaactgccagaaaaacggctcgctgcaggtaaaaacagcgtcggaaatttaattctgtctgccgaacatcagggcggcaacatttgcattgaagtgaccgacgatggggcggggctaaaccgtgaacgaattctggcaaaagcggcctcgcaaggtctgaccgtcagcgaaaacatgagcgacgacgaagttgcgatgctgatatttgcccctggcttctccacggcggagcaggtcaccgacgtctccgggcgtggcgtcggcatggacgtcgttaaacgtaatatccaggagatgggcggtcatgtcgagatccagtcgatgcagggtactggcacgacgatccgcattttactgccgctgacgctggccatcctcgacggcatgtccgtacgcgttgcggatgaagttttcattctgccgctgaatgctgttatggaatcactgcaaccccgtgaagccgatctccatccactggccggcggcgagcgggtgctggaagtgcggggtgaatatctgcctatcgtcgaactgtggaaagtgttcaacgtcgcgggcgcgaaaaccgaagctacccagggaattgtggtgatcttacaaagtggcggtcgccgctacgccttgctggtggatcaattaattggtcaacaccaagttgtggttaaaaaccttgaaagtaactatcgcaaagtccccggcatttctgctgcgaccattcttggcgacggcagcgtggcactgattgttgatgtctccgccttgcaggcgataaaccgcgaacaacgtatggcgaacaccgccgcctga

SEQ ID NO: 4550 - protein, 654 aa, Escherichia coli
MSMDISDFYQTFFDEADELLADMEQHLLVLQPEAPDAEQLNAIFRAAHSIKGGAGTFGFSVLQETTHLMENLLDEARRGEMQLNTDIINLFLETKDIMQEQLDAYKQSQEPDAASFNYICQALRQLALEAKGETPSAVTRLSVVAKSEPQDEQSRSQSPRRIILSRLKAGEVDLLEEELGHLTTLTDVVKGADSLSAILPDDIAEDDITAVLCFVIEADQITFETVDVSPKISTPPMLKLAAEQAPIGRVEREKTTRSSESTSIRVAVEKVDQLINLVGELVITQSMLAQRSSELDPVNHGDLITSMGQLQRNARDLQESVMSIRMMPMEYVFSRYPRLVRDLAGKLGKQVELTLVGSSTELDKSLIERIIDPLTHLVRNSLDHGIELPEKRLAAGKNSVGNLILSAEHQGGNICIEVTDDGAGLNRERILAKAASQGLTVSENMSDDEVAMLIFAPGFSTAEQVTDVSGRGVGMDVVKRNIQEMGGHVEIQSMQGTGTTIRILLPLTLAILDGMSVRVADEVFILPLNAVMESLQPREADLHPLAGGERVLEVRGEYLPIVELWKVFNVAGAKTEATQGIVVILQSGGRRYALLVDQLIGQHQVVVKNLESNYRKVPGISAATILGDGSVALIVDVSALQAINREQRMANTAA

SEQ ID NO: 4551 - DNA, 927 bp, Escherichia coli
atgaagaatcaagcgcatccgattattgtcgtcaaacgacgcaaagccaaaagccacggagcagcacatggatcgtggaagattgcttatgccgactttatgaccgcaatgatggccttttttctggtgatgtggctgatctctatctccagtccaaaagagctgattcagattgcggagtacttccggactccgctggcgacagcggttacgggtggcgatcgcatttctaatagtgaaagcccaattcccggcggtggtgatgattacacccaaagccagggggaagtgaataagcagccgaacatcgaagagctgaaaaaacgcatggagcaaagtcgattgcggaaattgcgtggcgatctcgaccagttgattgagtccgatccgaaactgcgggcgttacgtccacatctcaaaatcgatctggtccaggaaggtctacgtattcagatcatcgatagccagaatcgcccgatgtttagaactggcagtgccgacgtcgaaccctatatgcgcgacattctgcgcgccatcgcgcccgtactgaacggtattcccaaccgaattagcctctcgggtcataccgatgattttccctacgccagcggtgagaaaggttacagcaactgggagctttctgccgatcgtgccaatgcatcccgccgcgaactgatggttggtgggttgaatggcggcaaagtgttacgtgtcgtcggcatggcggcaacgatgcgcttaagcgatcgcggacctgatgatgccgtcaaccgtcgcatcagcctgctggtactgaacaaacacgccgaacaggccattttgcatgaaaacgccgaaagccagaatgagccagtaagcgccccggaaaaacctgaggttgcaccacaggtcagtgttcccacaatgccatcagccgaaccgaggtga

SEQ ID NO: 4552 - protein, 308 aa, Escherichia coli
MKNQAHPIIVVKRRKAKSHGAAHGSWKIAYADFMTAMMAFFLVMWLISISSPKELIQIAEYFRTPLATAVTGGDRISNSESPIPGGGDDYTQSQGEVNKQPNIEELKKRMEQSRLRKLRGDLDQLIESDPKLRALRPHLKIDLVQEGLRIQIIDSQNRPMFRTGSADVEPYMRDILRAIAPVLNGIPNRISLSGHTDDFPYASGEKGYSNWELSADRANASRRELMVGGLNGGKVLRVVGMAATMRLSDRGPDDAVNRRISLLVLNKHAEQAILHENAESQNEPVSAPEKPEVAPQVSVPTMPSAEPR

SEQ ID NO: 4553 - DNA, 888 bp, Escherichia coli
gtgcttatcttattaggttacctggttgttctcggtacagttttcggcggttatttgatgaccggtggaagccttggagcactctatcaacccgctgaactggtgattattgccggtgcagggattgggtcgtttatcgtcggcaataatggcaaagcgattaaaggcacgctgaaggcgctgccgttgctgtttcgtcgctccaaatacaccaaagcaatgtatatggatctgctggctctgctttatcggttgatggcgaaatcgcggcagatggggatgttttcgctggaacgcgatattgaaaatccccgtgagagcgagatcttcgccagctacccacgcatccttgcggatagcgtcatgcttgaatttatcgtcgattatctgcgcctgattatcagcggtcacatgaacaccttcgaaatcgaagctctgatggatgaagagattgagacgcacgaaagcgaggcagaagtcccggcgaacagtctggcgctggtcggggactcacttccggcgtttggtattgttgcggctgtaatgggggtcgttcacgcgttaggttcagccgatcgtcctgccgccgagctgggggcgcttatcgctcatgcgatggtggggactttcctcggtattttattggcttacggatttatttccccattagcgagtgttttacgtcagaaaagcgccgaaaccagcaaaatgatgcagtgcgtcaaagtcactctgctttctaatctgaacggttacgcaccgcctatcgccgttgagtttggtcgcaaaacgctctattccagcgaacgtccgtcgtttattgagctggaagagcatgtgcgtgcggtgaaaaatccgcaacaacagacgacaaccgaggaagcatga

SEQ ID NO: 4554 - protein, 295 aa, Escherichia coli
MLILLGYLVVLGTVFGGYLMTGGSLGALYQPAELVIIAGAGIGSFIVGNNGKAIKGTLKALPLLFRRSKYTKAMYMDLLALLYRLMAKSRQMGMFSLERDIENPRESEIFASYPRILADSVMLEFIVDYLRLIISGHMNTFEIEALMDEEIETHESEAEVPANSLALVGDSLPAFGIVAAVMGVVHALGSADRPAAELGALIAHAMVGTFLGILLAYGFISPLASVLRQKSAETSKMMQCVKVTLLSNLNGYAPPIAVEFGRKTLYSSERPSFIELEEHVRAVKNPQQQTTTEEA

SEQ ID NO: 4555 - DNA, 579 bp, Escherichia coli
atgagtgaaaaaagcattgttcaggaagcgcgggatattcagctggcaatggaattgatcaccctgggcgctcgtttgcagatgctggaaagcgaaacacagttaagtcgcggacgtctgataaaactctataaagaactgcgcggaagcccaccgccgaaaggcatgctgccattttcaaccgactggtttatgacctgggaacaaaacgttcatgcttcgatgttctgtaatgcatggcagtttttactgaaaactggcttgtgtaatggcgtcgatgcggtgatcaaagcctaccgtttataccttgaacagtgcccgcaagcagaagaaggaccgctgctggcattaacccgtgcctggacattggtgcggtttgttgaaagtggattactgcaactttccagctgcaactgctgcggcggcaattttattacccatgctcaccagcctgttggcagctttgcctgcagcttatgtcagccgccatcccgggcagtaaaaagacgtaaactttcccagaatcctgccgatattatcccacaactgctggatgaacagagagtacaggctgtttaa

SEQ ID NO: 4556 - protein, 192 aa, Escherichia coli [sequence omitted]

SEQ ID NO: 4557 - DNA, 351 bp, Escherichia coli
atgcatacctccgagttgctgaaacacatttatgacatcaacttgtcatatttactacttgcacagcgtctgattgttcaggacaaagcgtccgctatgtttcgtctcggcataaatgaagaaatggcgacaacgttagcggcactgactcttccgcaaatggttaagctggcagaaaccaatcaactggtttgtcacttccgttttgacagccaccagacgattactcagttgacgcaagattcccgcgttgacgatctccagcaaattcataccggcatcatgctctcaacacgcttgctgaatgatgttaatcagcctgaagaagcgctgcgcaagaaaagggcctga

SEQ ID NO: 4558 - protein, 116 aa, Escherichia coli
MHTSELLKHIYDINLSYLLLAQRLIVQDKASAMFRLGINEEMATTLAALTLPQMVKLAETNQLVCHFRFDSHQTITQLTQDSRVDDLQQIHTGIMLSTRLLNDVNQPEEALRKKRA

SEQ ID NO: 4559 - DNA, 429 bp, Escherichia coli
atgagctatagcaatattcttgtcgccgttgcggttacaccggaaagtcagcaactgctggcaaaagcggtatctatcgccaggccagtaaagggacacatcagtttaattactctcgcttccgacccggaaatgtacaatcaattagctgcgccgatgcttgaagatttacgcaatgtgatgcaggaagaaacgcaaagctttcttgataagttaattcaggatgcggggtatcccgttgacaagacgtttattgcctacggtgagttaagcgaacatattctggaagtttgtcgcaaacatcatttcgatttggtgatttgcggtaatcacaatcacagtttcttttcgcgagcatcctgctcggcgaaaagagtgattacctcaagtgaggtcgatgtgctgttagttccacttacgggagattaa

SEQ ID NO: 4560 - protein, 142 aa, Escherichia coli
MSYSNILVAVAVTPESQQLLAKAVSIARPVKGHISLITLASDPEMYNQLAAPMLEDLRNVMQEETQSFLDKLIQDAGYPVDKTFIAYGELSEHILEVCRKHHFDLVICGNHNHSFFSRASCSAKRVITSSEVDVLLVPLTGD

SEQ ID NO: 4561 - DNA, 1425 bp, Escherichia coli
atgagtcgtttagtcgtagtatctaaccggattgcaccaccagacgagcacgccgccagtgccggtggccttgccgttggcatactgggggcactgaaagccgcaggtggactgtggtttggctggagcggtgaaacagggaatgaggatcagccgctaaaaaaggtgaaaaagggtaacattacgtgggcctcttttaacctcagcgaacaggaccttgacgaatactacaacaaattctccaatgccgttctctggcccgcttttcattatcggctcgatctggtgcaatttcagcgtcctgcctgggatggctatctacgcgtaaatgcgttgctggcagataaattactgccgctgttgcaagacgatgacattatctggatccacgattatcacctgttgccctttgcgcatgaattacgcaaacggggcgtgaataatcgcattggtttctttctgcatattcctttcccgacaccagaaatcttcaacgcgctgccgacatatgacaccttgcttgaacagctttgtgaatatgatttgctgggtttccagacggagaacgatcgtctggcgttcctggattgcctttctaacctgacccgcgtcacgacacgtagcgcaaaaagccatacggcctgcggcaaagcgtttcgaacggaagtttacccgatcggcattgagccgaaagaaatagcgaaacaggctgccggtccactgccgccaaaactggcgcaactcaaagcagaactgaaaaacgtacaaaatatcttttctgtcgaacgactggattattccaaaggtttgccggagcgttttctcgcctatgaagcgttactggaaaaatatccgcaacatcacggtaaaattcgttatacccagatcgcgccaacgtctcgtggtgatgtgcaagcctatcaggatattcgtcatcagctcgaaaatgaagccggacgaattaatggtaaatatgggcaattaggctggacgccgctttattatttgaatcagcattttgaccgtaaattactgatgaaaatattccgctactctgacgtgggcttagtgacgccagtgcgtgacgggatgaacctggtggcaaaagagtatgttgccgctcaggacccagccaacccgggcgttcttgttctttcgcaatttgcgggagcggcaaacgagttaacgtcggcgttaattgttaatccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttcctaagcttgcgtag

SEQ ID NO: 4562 - protein, 474 aa, Escherichia coli
MSRLVVVSNRIAPPDEHAASAGGLAVGILGALKAAGGLWFGWSGETGNEDQPLKKVKKGNITWASFNLSEQDLDEYYNKFSNAVLWPAFHYRLDLVQFQRPAWDGYLRVNALLADKLLPLLQDDDIIWIHDYHLLPFAHELRKRGVNNRIGFFLHIPFPTPEIFNALPTYDTLLEQLCEYDLLGFQTENDRLAFLDCLSNLTRVTTRSAKSHTACGKAFRTEVYPIGIEPKEIAKQAAGPLPPKLAQLKAELKNVQNIFSVERLDYSKGLPERFLAYEALLEKYPQHHGKIRYTQIAPTSRGDVQAYQDIRHQLENEAGRINGKYGQLGWTPLYYLNQHFDRKLLMKIFRYSDVGLVTPVRDGMNLVAKEYVAAQDPANPGVLVLSQFAGAANELTSALIVNPYDRDEVAAALDRALTMSLAERISRHAEMLDVIVKNDINHWQECFISDLKQIVPRSAESQQRDKVATFPKLA

SEQ ID NO: 4563 - DNA, 801 bp, Escherichia coli
gtgacagaaccgttaaccgaaacccctgaactatccgcgaaatatgcctggttttttgatctcgatggaacgctggcggaaatcaaaccgcatcccgatcaggtcgtcgtgcctgacactattctgcaaggacttcagctactggcaaccgcaagtgatggtgcattggcattgatttcagggcgctcaatggtggagcttgacgcactggcaaaaccttatcgcttcccgttagcgggcgtgcatggggcggagcgccgtgacatcaatggtaaaacgcatatcgttcatctgccggatgcgattacgcgtgatattagcgtgcaactgcatacggtcatcgcccagtatcccggcgcggagctggaggcgaaagggatggcttttgcgctgcattatcgccaggctccgcagcatgaagacgcattaatgacattagcgcaacgtattactcagatctggccacaaatggcgttacagcagggaaagtgtgttgtcgagatcaaaccgaaaggtaccagtaaaggtgaggcgattgctgcctttatgcaggaagctccctttatcgggcgaacgcccgtatttctgggcgatgatctgaccgatgaatctggcttcgcagtcgttaaccggctgggcggaatgtcagtaaaaattggcacaggtgcaactcaggcatcatggcgactggcgggcgtgccggatgtctggagctggcttgaaatgataaccaccgcattacaacaaaaaagagaaaataacaggagtgatgactatgagtcgtttagtcgtagtatctaa

SEQ ID NO: 4564 - protein, 266 aa, Escherichia coli
MTEPLTETPELSAKYAWFFDLDGTLAEIKPHPDQVVVPDTILQGLQLLATASDGALALISGRSMVELDALAKPYRFPLAGVHGAERRDINGKTHIVHLPDAITRDISVQLHTVIAQYPGAELEAKGMAFALHYRQAPQHEDALMTLAQRITQIWPQMALQQGKCVVEIKPKGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 4565 - DNA, 987 bp, Escherichia coli
atgtcttctgtttctacatcgggttctggagcacctaagtcgtcattcagctttgggcgtatctgggatcagtacggcatgctggtggtgtttgcggtgctttttatcgcctgtgccatttttgtcccaaattttgccaccttcattaatatgaaagggttgggcctggcaatttctatgtcggggatggtggcgtgtggcatgttgttctgccttgcttccggtgactttgacctttctgtcgcctccgtaattgcctgtgcgggtgtcaccactgcggtggttatcaacctgactgaaagcctgtggattggcgtggcagcgggtttgttgctgggcgttctctgtggcctggtcaatggctttgttatcgccaaactgaaaataaatgccctcatcacgactctggcaacgatgcagattgttcgaggtctggcgtacatcatttcagacggtaaagcggtcggtatcgaagatgaaagcttctttgcccttggttacgccaactggttcggtctgcctgcgccaatctggctcaccgtcgcgtgtctgatcatctttggcttgctgctgaataaaaccacctttggtcgtaataccctggcgattggcgggaacgaagaggctgcgcgtctggcgggtgtaccggttgttcgcaccaaaattattatttttgttctctctggcctggtatcagcgatagccggaattattctggcttcacgtatgaccagtgggcagccaatgacgtcgattggttatgagctgattgtgatctccgcctgcgttttaggtggcgtttctctgaaaggcggcatcggaaaaatctcatatgtggtggcgggtatcttaattttaggcaccgtggaaaacgccatgaacctgcttaatatctctcctttcgcacagtacgtagttcgcggcttaatcctgctggcagcggtgattttcgaccgttacaagcaaaaagcgaaacgcactgtctga

SEQ ID NO: 4566 - protein, 328 aa, Escherichia coli
MSSVSTSGSGAPKSSFSFGRIWDQYGMLVVFAVLFIACAIFVPNFATFINMKGLGLAISMSGMVACGMLFCLASGDFDLSVASVIACAGVTTAVVINLTESLWIGVAAGLLLGVLCGLVNGFVIAKLKINALITTLATMQIVRGLAYIISDGKAVGIEDESFFALGYANWFGLPAPIWLTVACLIIFGLLLNKTTFGRNTLAIGGNEEAARLAGVPVVRTKIIIFVLSGLVSAIAGIILASRMTSGQPMTSIGYELIVISACVLGGVSLKGGIGKISYVVAGILILGTVENAMNLLNISPFAQYVVRGLILLAAVIFDRYKQKAKRTV

SEQ ID NO: 4567 - DNA, 1515 bp, Escherichia coli
atgcaacagtctaccccgtatctctcatttcgcggcatcggtaaaacgtttcccggcgttaaggcgctgacggatattagttttgactgctatgccggtcaggttcatgcgttgatgggtgaaaatggcgcaggaaaatcaactctcttaaaaatcctcagcggaaactatgcgccaaccacgggttctgtagtgattaatgggcaggaaatgtccttttccgacacgaccgcagcacttaacgcgggtgtggcgattatttatcaggaactgcatctcgtgccggaaatgaccgtcgcggaaaacatctatctcggccagctgccgcataaaggcggcattgtgaatcgttcattgctgaattatgaggcaggtttacaaattaaacatcttggtatggatattgacccggacacgccgctgaaatatctctccattggtcagtggcagatggttgaaatcgccaaagcgctggcgcgtaacgccaaaattatcgcctttgatgagccaaccagctccctctctgcccgcgaaatcgacaatcttttccgcgttattcgtgaactgcgaaaagaggggcgggtgatcttatacgtttctcaccgtatggaagaaatatttgccctcagcgatgccatcaccgtctttaaagatgggcgttatgtcaaaacctttaccgatatgcagcaggttgaccacgacgcactggtgcaggcgatggtcgggcgcgacattggcgatatctacggctggcaaccgcgtagttatggcgaggagcggctgcgtcttgatgctgtgaaagcaccaggcgtgcgtacgccaataagtctggcggttcgcagtggagaaattgtcggtctgtttggtctggtcggggcagggcgtagcgaattaatgaaaggcatgtttggcgggacgcaaatcaccgccggtcaggtttatatcgaccaacagccgatcgatattcgtaaaccgagccacgccattgccgcaggcatgatgctctgcccggaagatcgcaaagcggaaggcattattcccgtgcactccgttcgcgacaatatcaacatcagtgccagacgtaaacatgtgcttggcggttgtgtaatcaacaacggttgggaagaaaacaatgccgatcaccacattcgttcgctcaacatcaaaacgccgggcgctgagcaactgatcatgaatctctcaggcggaaatcagcaaaaagccattctgggccgctggttatcggaagagatgaaggtcattttgctggatgaacctacgcgtggcattgatgttggtgctaagcatgaaatttacaacgtgatttatgcgctggcggcgcagggtgtggcggtgctgtttgcctccagcgacttacctgaagtcctcggcgttgccgaccggattgtggtgatgcgggaaggcgaaatcgccggtgaattgttacacgagcaggcagatgagcgtcaggcactgagccttgcgatgcctaaagtcagccaggcagttgcctga

SEQ ID NO: 4568 - protein, 504 aa, Escherichia coli
MQQSTPYLSFRGIGKTFPGVKALTDISFDCYAGQVHALMGENGAGKSTLLKILSGNYAPTTGSVVINGQEMSFSDTTAALNAGVAIIYQELHLVPEMTVAENIYLGQLPHKGGIVNRSLLNYEAGLQIKHLGMDIDPDTPLKYLSIGQWQMVEIAKALARNAKIIAFDEPTSSLSAREIDNLFRVIRELRKEGRVILYVSHRMEEIFALSDAITVFKDGRYVKTFTDMQQVDHDALVQAMVGRDIGDIYGWQPRSYGEERLRLDAVKAPGVRTPISLAVRSGEIVGLFGLVGAGRSELMKGMFGGTQITAGQVYIDQQPIDIRKPSHAIAAGMMLCPEDRKAEGIIPVHSVRDNINISARRKHVLGGCVINNGWEENNADHHIRSLNIKTPGAEQLIMNLSGGNQQKAILGRWLSEEMKVILLDEPTRGIDVGAKHEIYNVIYALAAQGVAVLFASSDLPEVLGVADRIVVMREGEIAGELLHEQADERQALSLAMPKVSQAVA

SEQ ID NO: 4569 - DNA, 990 bp, Escherichia coli
atgcacaaatttactaaagccctggcagccattggtctggcagccgttatgtcacaatccgctatggcggagaacctgaagctcggtttcctggtgaagcaaccggaagagccgtggttccagaccgaatggaagtttgccgataaagccgggaaggatttagggtttgaagttattaagattgccgtgccggatggcgaaaaaacattgaacgctatcgacagcctggctgccagtggcgcgaaaggtttcgttatttgtactccggacccgaaactcggctctgccatcgtggcgaaagcgcgtggctacgatatgaaagtcattgccgtggatgaccagtttgttaacgccaaaggtaagccaatggataccgttccgctggtgatgatggctgcgaccaaaattggcgaacgtcagggccaggaactgtataaagagatgcagaaacgtggctgggatgtcaaagaaagcgcggtgatggcgattacctccaacgaactggatacggctcgtcgccgtactacggggtctatggatgcgctgaaagctgcaggattcccggaaaaacaaatttatcaggtacctaccaaatctaacgacatcccgggggcatttgacgctgccaactcaatgctggttcaacatccggaagttaaacattggctgattgtcggtatgaacgacagcaccgtgctgggcggcgtacgcgcgacggaaggtcagggctttaaagcgagcgatatcatcggtatcggtattaacggtgtggatgcggtgagtgaactgtctaaggcacaggcaaccggcttctacggttccctgctgccaagcccggacgtacatggttataagtccagcgaaatgctttacaactgggttgcaaaaggtgttgaaccgaccaaattcaccgaagttaccgacgtggtgctgatcacgcgtgacaactttaaagaagaactggagaaaaaaggtttaggcggtaagtaa

SEQ ID NO: 4570 - protein, 329 aa, Escherichia coli
MHKFTKALAAIGLAAVMSQSAMAENLKLGFLVKQPEEPWFQTEWKFADKAGKDLGFEVIKIAVPDGEKTLNAIDSLAASGAKGFVICTPDPKLGSAIVAKARGYDMKVIAVDDQFVNAKGKPMDTVPLVMMAATKIGERQGQELYKEMQKRGWDVKESAVMAITSNELDTARRRTTGSMDALKAAGFPEKQIYQVPTKSNDIPGAFDAANSMLVQHPEVKHWLIVGMNDSTVLGGVRATEGQGFKASDIIGIGINGVDAVSELSKAQATGFYGSLLPSPDVHGYKSSEMLYNWVAKGVEPTKFTEVTDVVLITRDNFKEELEKKGLGGK

SEQ ID NO: 4571 - DNA, 504 bp, Escherichia coli
atggcaaccgctggaatgcttctcaaactcaactctcaaatgaaccgcgagttttacgcatccaatctctaccttcacctgagtaactggtgttctgaacagagtctgaacggcaccgccactttccttcgcgcccaggcacagagtaatgtgacccaaatgatgcgcatgtttaactttatgaagagtgtcggcgctacccccatcgttaaagccattgatgttcccggtgaaaaactgaactctctggaagaactgttccaaaaaacgatggaagaatacgagcaacgttcaagcacgctggcgcagttagccgatgaagcgaaagaactgaatgatgattcaaccgtcaatttcctgcgcgatctggaaaaagaacagcagcatgatggcctgttactgcaaaccattcttgatgaagtgcgcagtgcgaaacttgctggtatgtgtcctgtgcagaccgaccaacatgttctgaatgtcgtgtcgcatcagctacattga

SEQ ID NO: 4572 - protein, 167 aa, Escherichia coli
MATAGMLLKLNSQMNREFYASNLYLHLSNWCSEQSLNGTATFLRAQAQSNVTQMMRMFNFMKSVGATPIVKAIDVPGEKLNSLEELFQKTMEEYEQRSSTLAQLADEAKELNDDSTVNFLRDLEKEQQHDGLLLQTILDEVRSAKLAGMCPVQTDQHVLNVVSHQLH

SEQ ID NO: 4573 - DNA, 252 bp, Escherichia coli
atgtcccagccgctgaatgccgatcaggaactggtttctgatgtggttgcttgccagttggttatcaaacaaattctggatgttctcgatgtgatcgcgcccgttgaagttcgcgaaaaaatgtccagccagctgaagaatatcgactttactaaccatcccgccgccgcagacccggtcaccatgcgggtaatccaaaaagccatcgcgttgattgaactcaagtttaccccacagggcgaatcccattaa

SEQ ID NO: 4574 - protein, 83 aa, Escherichia coli
MSQPLNADQELVSDVVACQLVIKQILDVLDVIAPVEVREKMSSQLKNIDFTNHPAAADPVTMRVIQKAIALIELKFTPQGESH

SEQ ID NO: 4575 - DNA, 324 bp, Escherichia coli
atgagacttctgattctgactctttccttaataacgctgacaggatgtacggttactcgccaggcccatgtgagcgaagttgacgcggcaacaggtattgttcggttggtttatgatcaggcttttttgcagcatgccagtaccgatcgttatgtcagtcgcgggatcgccgatcgcgcatgccagcaggcaggctatacccacgctatcccctttggtcagccagtaggcaactgtagcctctttgcgggttccttatgtttgaatacggaattcactttgtcatatcagtgccatcattccgccttccctgtctttctctaa

SEQ ID NO: 4576 - protein, 107 aa, Escherichia coli
MRLLILTLSLITLTGCTVTRQAHVSEVDAATGIVRLVYDQAFLQHASTDRYVSRGIADRACQQAGYTHAIPFGQPVGNCSLFAGSLCLNTEFTLSYQCHHSAFPVFL

SEQ ID NO: 4577 - DNA, 114 bp, Escherichia coli
ttgttattttattatttgcaaaaggtaaaatataaatatcatttattaaaaatacgaatgggaataaaacgcattaccgctatttatttaatcagcgaagatccccctcgctga

SEQ ID NO: 4578 - protein, 37 aa, Escherichia coli
MLFYYLQKVKYKYHLLKIRMGIKRITAIYLISEDPPR

SEQ ID NO: 4579 - DNA, 498 bp, Escherichia coli
atgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaacttaccgcgtattaataccgttgaatctccgtttgctgaatattcctcacttgatgaattattccaggaaacctataaacacgaacaattaatcacgcagaaaattaacgaactggctcatgctgcaatgaccaatcaggactacccaacatttaatttcctgcaatggtatgtttctgagcagcatgaagaagagaaactgttcaaatcgattattgataaattaagccttgcaggcaaaagcggcgaaggtctgtattttatcgacaaagaactctctaccctcgacacacaaaactaa

SEQ ID NO: 4580 - protein, 165 aa, Escherichia coli
MLKPEMIEKLNEQMNLELYSSLLYQQMSAWCSYHTFEGAAAFLRRHAQEEMTHMQRLFDYLTDTGNLPRINTVESPFAEYSSLDELFQETYKHEQLITQKINELAHAAMTNQDYPTFNFLQWYVSEQHEEEKLFKSIIDKLSLAGKSGEGLYFIDKELSTLDTQN

SEQ ID NO: 4581 - DNA, 240 bp, Escherichia coli
atggactctattcacggtcacgaagtgttaaatatgatgattgaatcaggcgagcaatatacgcatgccagtctggaagcagcaattaaagcgcgttttggtgaacaggcacgttttcacacctgctcggcagaagggatgactgcgggagagttggtggcgtttctggcagcaaaaggcaaatttataccttcagaagaaggtttttcaaccgatcagagtaagatttgccgtcactga

SEQ ID NO: 4582 - protein, 79 aa, Escherichia coli
MDSIHGHEVLNMMIESGEQYTHASLEAAIKARFGEQARFHTCSAEGMTAGELVAFLAAKGKFIPSEEGFSTDQSKICRH

SEQ ID NO: 4583 - DNA, 1212 bp, Escherichia coli
gtgaaaaacagaactctgggaagtgtttttatcgtggcgggaaccacaattggcgctggtatgctggcaatgccgctggctgcggcaggtgttggttttagcgtcacgttaatcttgttaattgggctttgggcattgatgtgctacacggcgctattactgctggaggtgtaccagcatgtcccggcagataccggtctgggcacgctggcaaaacgctatctgggacgctacggtcagtggctgacgggcttcagtatgatgttcttaatgtatgctctgactgcggcatacatcagcggtgccggtgaattgttggcctccagcatcagcgactggacaggtatttcaatgtcggcaaccgctggcgtgctgttgttcacttttgttgccggtggcgtggtttgtgtcggaacttcgctggtcgatttatttaaccgttttctgttcagcgccaaaattatttttttggtggtgatgctggtattgctgctaccgcatattcacaaagtgaatcttttaaccctgccgttgcaacagggactggcactgtctgcaatcccggtgatttttacgtcgtttggttttcacggtagcgtgccgagtattgtcagctatatggatggcaacattcgtaagctacgctgggtgtttataatcggtagtgcgatccccctggtggcatatattttctggcagctggcgacccttggcagcattgattcaacaacctttatgggattgctggctaatcatgccggattaaacgggctgttacaggcgttacgcgaaatggtggcctctccgcatgttgagctggcagtgcatttatttgctgatttagccctcgccacgtccttcctcggcgtagcgttaggcttatttgattatctggcagatttgtttcagcgttcaaataccgttggtggacgattgcaaactggtgcaattacctttctgccgccactggcgtttgcactgttttatccacgaggatttgtgatggcgctgggttacgccggtgtggcactggcggtactggcattgattatcccttcgctgttgacctggcaaagcaggaagcacaatcctcaggcgggttaccgggtgaaaggtggtcgtccggcgctggtggtggtgtttctctgtggtattgctgtgattggcgtgcaatttttgattgcggcaggcttgttaccagaagtggggtga

SEQ ID NO: 4584 - protein, 403 aa, Escherichia coli
MKNRTLGSVFIVAGTTIGAGMLAMPLAAAGVGFSVTLILLIGLWALMCYTALLLLEVYQHVPADTGLGTLAKRYLGRYGQWLTGFSMMFLMYALTAAYISGAGELLASSISDWTGISMSATAGVLLFTFVAGGVVCVGTSLVDLFNRFLFSAKIIFLVVMLVLLLPHIHKVNLLTLPLQQGLALSAIPVIFTSFGFHGSVPSIVSYMDGNIRKLRWVFIIGSAIPLVAYIFWQLATLGSIDSTTFMGLLANHAGLNGLLQALREMVASPHVELAVHLFADLALATSFLGVALGLFDYLADLFQRSNTVGGRLQTGAITFLPPLAFALFYPRGFVMALGYAGVALAVLALIIPSLLTWQSRKHNPQAGYRVKGGRPALVVVFLCGIAVIGVQFLIAAGLLPEVG

SEQ ID NO: 4585 - DNA, 549 bp, Escherichia coli
gtgttgagttctccgcaagagattgaaccggcacagtggctggttgccgtgtggggtggggctgactatgtgccgcgctgggcgtcagagaaagagatgacgcgctttatgaacctggcttttcaacatatggccgataccgcagagcgtctgaacgaattcccggagcagtttgagccgttattcggcttgcgagaagtcgatggcagcgagctgacgattgttgaggagtggtgctttggctatatgcggggcgtggcactttctgactggtcaacgttgcccgattcgttaaaaccagcgctggaggcgattgcgctgcacggtactgaggaaaacttcgagcgggtagagaagatgtcgccagaagcgtttgaagagagcgtagatgctattcggctggcggcgcttgatttacatgcatactggatggcgcatccgcaggaaaaagctgttcagcaaccgatcaaagcagaagagaaaccggggcgtaacgatccttgtccgtgtggcagtggtaagaaatttaagcagtgctgcctgcattaa

SEQ ID NO: 4586 - protein, 182 aa, Escherichia coli
MLSSPQEIEPAQWLVAVWGGADYVPRWASEKEMTRFMNLAFQHMADTAERLNEFPEQFEPLFGLREVDGSELTIVEEWCFGYMRGVALSDWSTLPDSLKPALEAIALHGTEENFERVEKMSPEAFEESVDAIRLAALDLHAYWMAHPQEKAVQQPIKAEEKPGRNDPCPCGSGKKFKQCCLH

SEQ ID NO: 4587 - DNA, 144 bp, Escherichia coli
atgaaaacgggaccgttaaacgaaagtgagttggaatggctggacgatattctgaccaaatacaacactgaccacgccattcttgatgtggcggaagctggacggtttattgacggcggtgttgagttctccgcaagagattga

SEQ ID NO: 4588 - protein, 47 aa, Escherichia coli
MKTGPLNESELEWLDDILTKYNTDHAILDVAEAGRFIDGGVEFSARD

SEQ ID NO: 4589 - DNA, 1767 bp, Escherichia coli
atgaaggggctggaacttctggccgaagcccgtggcgacaaagcggtgtttctgaccatcacctgcccgtcaaaataccacgccacaacagagaacggtcatccgaatcccaaatggaacggggccaccatgcgcgactccagcgattacctggttaacacgttttttgcggcggtccgcaagaaactgaaccgcgacggcctgcgctggtatggcatccgcacggtggagcctcaccatgacggcaccgtgcactggcatatgatggtctttgctcatccggaagaaatcgacaccattgtgtcccacacccgcgatattgccattcaggaagatcgtcacgagctgggtgatgatattaccccacgctttaaggcggagtacgtcgacggctcaaaaggcacgccaaccagctacatcgccacctacatcggaaagaacctggacagccgcgccgtagatggcatcgacccgaaaacgggcaagccacgcgttgaccacgaaaccggaaaatcaatggccgagagcgtggaacgcgccatcggctgggcgcgccttcaccgtgtccgccagttccagttctttggtatcccctcccgtcaggtgtggcgtgaactccgccgccttgccagccagatggcacgcaacccggaaggcccgcaacggctgaaggatgacgcaatggatgcggtactcgctgccgctgatgccggatgttttgccacctacatagagaaacagggcggcgtacttgttccacgccaagactacctgattcgcaccgcctacgacctcgcagatgagctgaacgattacggcgaacagagcgtacagatttacgggatctggtcgccgctcatcggggagtcttcccgcgtatgcacgcatccggataactggaagctggtaagacgcaaaccggaagcggaagacagctcccacgaaaatggttttgaccttcagggcggccccgccgccccttggactcgtggcaataactgtccccgtgtacaggaaacggacaacaacgggacagaacagccggaagaacggccagcaccgtggccgcagcttcctgacggcgttgacgtgaatgaatggatgcgctcactgaaacggcacgaacgccgggcgctgatgcgttcgctgcgtgacaaacaggcaaaaaacagcagtgatgaaatgcagaactggacacagagccgcaaacagccacggcctttgcctgataaccacgagttactcgctaaagaatggcgggagtctgctgaatctctcggcctgcatatcggtgaacagcagatgcagcacctgttacggggcggcagtctgtacgttgacggcagcatcattgcaccgcagggatttgaaattgtacgcaaaccagatacccgcccggacagccgaatcacgcaactctggcagcgcctgagccgtaatcacggcgtaagcagcacggagatccgccataacccggtcgccagctatctggaacagctgggggcatcagaccccgaagccgccgcacacctggcatccacacttcagcaggaccagaacaccatgaaaacccccgttaccgtgctttctgacatgctgcgcgccatccgtgacgcagagcacgcacagagaatcagtgaaaccactgaacgcgcccaccgcaaagcagacctgctgcggggtagcctgaccagtggaaacaaaaaacagacagaaacgggactcacaaatcccgtaaatgagcaaaaaacgtgccgcgatatatga

SEQ ID NO: 4590 - protein, 588 aa, Escherichia coli
MKGLELLAEARGDKAVFLTITCPSKYHATTENGHPNPKWNGATMRDSSDYLVNTFFAAVRKKLNRDGLRWYGIRTVEPHHDGTVHWHMMVFAHPEEIDTIVSHTRDIAIQEDRHELGDDITPRFKAEYVDGSKGTPTSYIATYIGKNLDSRAVDGIDPKTGKPRVDHETGKSMAESVERAIGWARLHRVRQFQFFGIPSRQVWRELRRLASQMARNPEGPQRLKDDAMDAVLAAADAGCFATYIEKQGGVLVPRQDYLIRTAYDLADELNDYGEQSVQIYGIWSPLIGESSRVCTHPDNWKLVRRKPEAEDSSHENGFDLQGGPAAPWTRGNNCPRVQETDNNGTEQPEERPAPWPQLPDGVDVNEWMRSLKRHERRALMRSLRDKQAKNSSDEMQNWTQSRKQPRPLPDNHELLAKEWRESAESLGLHIGEQQMQHLLRGGSLYVDGSIIAPQGFEIVRKPDTRPDSRITQLWQRLSRNHGVSSTEIRHNPVASYLEQLGASDPEAAAHLASTLQQDQNTMKTPVTVLSDMLRAIRDAEHAQRISETTERAHRKADLLRGSLTSGNKKQTETGLTNPVNEQKTCRDI

SEQ ID NO: 4591 - DNA, 960 bp, Escherichia coli
atgaaaatttgtatcgacgacggctccaccaacatcaagctggcatggactgagaacggcgaacgccgcaacgccatcagcccgaacagcttcaagtcggaatggtctgcgccgttcggtggcacgcagcccgcgaactacatgcttgatggcgtgcgctatggttttgatccggtcagcgatcgctttgtccagacgaccgacacgcaataccagtacagcgatgtgaatataattgccattcatcacgcgctggtcaaatcaggcatcacaccacaggaagtggatgtggttgtcaccctgccactgagcgagtatttcgatacaaacgcacagccggacatggccaacatcaaccgcaaaaaagcgaacgtcatgcgcccggtggagtaccagaacggcgaagcattcactatccgtaacgtacgggttatgcctgaatccattccggctggctttaaggcactggctgacatgagtccgtttgaatccctgctgattgtggatttgggcggaaccacgctggatgtggcaaaggttcaggggcaactggcaggtatcagccaggtgttttgcgatccacacgtgggcgtttctctgatggccgatgccgtactgtcggtgatggccactaacggtatgcgcaccagtcaccacatcgccaataccattatcgaacatcgccatgatgaagcctggctgcgccagcacatccacaatgacgcgcattacgccagcctgatggcggtaattcgtgaaaaggaagaaacactgaaacaacgcgtgatccgcgcgctggcgggtttttcgggttacgggcgggtgatggttgtcggtggaggggcggagattgtggcacccgctatccgcgaagcctgcggagttaatgcgactttcatcgcggacggggtgccacagtttgctctggttaatgggctgtacgcaatggacaaggagtaa

SEQ ID NO: 4592 - protein, 319 aa, Escherichia coli
MKICIDDGSTNIKLAWTENGERRNAISPNSFKSEWSAPFGGTQPANYMLDGVRYGFDPVSDRFVQTTDTQYQYSDVNIIAIHHALVKSGITPQEVDVVVTLPLSEYFDTNAQPDMANINRKKANVMRPVEYQNGEAFTIRNVRVMPESIPAGFKALADMSPFESLLIVDLGGTTLDVAKVQGQLAGISQVFCDPHVGVSLMADAVLSVMATNGMRTSHHIANTIIEHRHDEAWLRQHIHNDAHYASLMAVIREKEETLKQRVIRALAGFSGYGRVMVVGGGAEIVAPAIREACGVNATFIADGVPQFALVNGLYAMDKE

SEQ ID NO: 4593 - DNA, 591 bp, Escherichia coli
atgagcgaaatcaactatcaggcattacgtgaacgttattcacctgtgcctgtaccgaaatgccctatttgcggcgaggaaatgtcaattcagcgaatatctggagcacaggttgtttatgcctgctccggttatggtgatgatggagatttcaaaattggccgaactcttgctgacgaacattatgaaaaatcacgcgtaacagtgttggatgtcggggatcctgaagtattggcgctacttgattggctggaaaccaaagacaaccgaatcgctgaactggaaaaaatcgccactgactatgcacttaaattccagaaagcacaggacgcattaaagcatgccgctttgctgcatagcaggacggcgcaacaaacaaataattttgcagtatcgcttccggacataagcgaatatttcattaatgacgtatttcagcccttgcgatacgagcgggatgttgaaagagccatcataaaggctggcggaaaagcattgtggcaggagaaacacgaggacagaacgcatcagtcctgcgatgtaaatcgtggatggtttagctcactgacgacagataaaaataacacctga

SEQ ID NO: 4594 - protein, 196 aa, Escherichia coli
MSEINYQALRERYSPVPVPKCPICGEEMSIQRISGAQVVYACSGYGDDGDFKIGRTLADEHYEKSRVTVLDVGDPEVLALLDWLETKDNRIAELEKIATDYALKFQKAQDALKHAALLHSRTAQQTNNFAVSLPDISEYFINDVFQPLRYERDVERAIIKAGGKALWQEKHEDRTHQSCDVNRGWFSSLTTDKNNT

SEQ ID NO: 4595 - DNA, 129 bp, Escherichia coli
gtggcagataaggccgtcaaaatcgcactgaggcggcgagaacatgcagtcagcgcagtgggattgcgtaagagtctgaccgtcgatgatggcaataagcaggaaagcgtcgtgaaattatctgattga

SEQ ID NO: 4596 - protein, 42 aa, Escherichia coli
MADKAVKIALRRREHAVSAVGLRKSLTVDDGNKQESVVKLSD

SEQ ID NO: 4597 - DNA, 1047 bp, Escherichia coli
atgagcagaaaaaataaaaaagtgcgcatgagttcacgcattgatctcgctgatgcgctcaggaaagagtcatcgctcagtgcattcacatttgatggtccttatcgcctgaccgggcatgacctgctggacaatatgtactgtgctgataacgggcggtggtatgaaaccccggtggactggtacggtctggcaagagctgcccggcaaacgtcctggcatcagtctgcgctttactttaagcgcaatgtattactcggttgctacatcccgcacccgctgctttcccggcaggatttctcggcgctggcgctggactggtttgtgttcggtaacgcattccttgagcttcgaagcaatatgctcggcgaaccgcttaaattacggcacgccctggcgaaatacatgcgacgcggaagcgatcttgaatcatggtggtatgtgcaggatggcaaggacgcgttccagtttcgtcctggcaaagtgtgccacctgatgaatccggatattaaccaggaaatctacggcatgccggaatatcttggcgcattactctcggccagcctttctcattcggcggacatgttcagaaaactgtactacgacaacggatcccacgccgggtgcatcatctacatcggtgcagcgcaggtaaaccgcgaaagcatggactctctgaaagaaacgctacagggggcacgtggtggtggtgcgtttaaaaacgtgctcattcatgcgcccaacgggggcaaagagggggtgcaaattttgccgttccagcagatcaccgcaaaagatgagtttatgaatgttaaggcggcatcccgtgatgatgtgctggctgcgcaccgcgttccgccgcaactgatgggggcgatgccgggcgaaaaaagtgcgtttggtgatgtggagaaggccgcgcgggtttacgcaattaacgagctgatgcccgtcatggaggccatgaagcacatcaatgactggcttggcgaagaggtgatccgctttaacccttacgcactgttagatacccagcccacatcctga

SEQ ID NO: 4598 - protein, 348 aa, Escherichia coli
MSRKNKKVRMSSRIDLADALRKESSLSAFTFDGPYRLTGHDLLDNMYCADNGRWYETPVDWYGLARAARQTSWHQSALYFKRNVLLGCYIPHPLLSRQDFSALALDWFVFGNAFLELRSNMLGEPLKLRHALAKYMRRGSDLESWWYVQDGKDAFQFRPGKVCHLMNPDINQEIYGMPEYLGALLSASLSHSADMFRKLYYDNGSHAGCIIYIGAAQVNRESMDSLKETLQGARGGGAFKNVLIHAPNGGKEGVQILPFQQITAKDEFMNVKAASRDDVLAAHRVPPQLMGAMPGEKSAFGDVEKAARVYAINELMPVMEAMKHINDWLGEEVIRFNPYALLDTQPTS

SEQ ID NO: 4599 - DNA, 1752 bp, Escherichia coli
atgattcaggacgcttttgtgcgccagcgtgcgcggcaactttactggcagggttatccgcccgcagaaatatcacgtctgatgggaataaacccgaacacgatttatgcgtggaaaaaacgtgaccagtgggatgaaacgccacccgtgcagcgtgtcacgcagtccatcgatgcgcgcctcatccagcttactgaaaaacagaataaaacaggcggtgactttaaggaaatagacctgctgacccggcagcttaaaaagctgcatgatggccagccggatgtgatggccgcaggaaagaaaggccgggcgaaaaaactcaaaaatcatttcacgccggaacagattgccgcactgcgggaaaaaatcatcagcaggctggagtggcatcagcggggctggtttgactccctgaccctttgcagggaagccgggatacgtaacaggatgatcctgaaatcccgacagattggggcgacctggtattttgcacaggaagcactgctgatggcgctgcgtgacgatgtggcgcaaccttaccagcgtaaccagatttttttgtctgcgtcgcgtcgtcaggcgttccagtttaaaagcattattcagaaggccgcggctgaagttgatgtggagctgaaagggggcgataaaatcatcctctccaacggcgcagagctgcattttctcggcacttctgctgcgtcggcacagtcctatacgggcaatttttattttgatgaatttttctgggtcagtcgctttgctgaactgcgcaaggtggctggcgctatggcaaccctcagcggactgcggcgcacctacttctccacgccatccaccgaaacgcacgaggcatacgcctactggaacggcgaccgctggaacgagaaaaaggcctcgcataaacgccagcgtttttctgtggactggaaaacgctgcataacgggcttatctgccctgaccggacgtggcggcaaattgtcacgctggaagatgtggttaatcacggctggaaacacaccgatatcgacgaaattcgtgatgaaaacaccgaagacgagttcctcaatctctatatgtgtgagtttgtccgcgaaggggaatcggcatttaacctgaatatcctgattggctgcggtgttgacggatacgacgactggaaagactggaaaccttttgctccccgcccgatggggaatcgtccggtatggattgggtatgacgcaaacggcagtagtggcaacggcgacagcggcgctgtctccgtggtggttcctccggctgttcctggtggccgttttcgaacggtggagacgcgacgcgttcaggggctggagtttgaagaacaggccagagtcattgaagagttcacgtatcgctacaacgtggaacacatcggcattgatgtgacgggcgggaacggggaggctgtttatcagatagtgaagcggtttttccctgctgctattccgtacaccttcacgctgtcatcaaaacggtcgctggtactgaaaatgctgcaaataatgcgtgccgggcggtgggaatacgatcgcgccgaacgcgagctggtcgcggcctttaacgccgtgcgtaaggtgaaaacaccgggcggctttatcacttacgaaacggaccgagcgagggggatcagccacggcgaccttgcgtgggcaaccatgcttgctgtcattaacgaaccgattggcggcgaaggagaaaacgagcgtttcacggttatggagttctga

SEQ ID NO: 4600 - protein, 583 aa, Escherichia coli
MIQDAFVRQRARQLYWQGYPPAEISRLMGINPNTIYAWKKRDQWDETPPVQRVTQSIDARLIQLTEKQNKTGGDFKEIDLLTRQLKKLHDGQPDVMAAGKKGRAKKLKNHFTPEQIAALREKIISRLEWHQRGWFDSLTLCREAGIRNRMILKSRQIGATWYFAQEALLMALRDDVAQPYQRNQIFLSASRRQAFQFKSIIQKAAAEVDVELKGGDKIILSNGAELHFLGTSAASAQSYTGNFYFDEFFWVSRFAELRKVAGAMATLSGLRRTYFSTPSTETHEAYAYWNGDRWNEKKASHKRQRFSVDWKTLHNGLICPDRTWRQIVTLEDVVNHGWKHTDIDEIRDENTEDEFLNLYMCEFVREGESAFNLNILIGCGVDGYDDWKDWKPFAPRPMGNRPVWIGYDANGSSGNGDSGAVSVVVPPAVPGGRFRTVETRRVQGLEFEEQARVIEEFTYRYNVEHIGIDVTGGNGEAVYQIVKRFFPAAIPYTFTLSSKRSLVLKMLQIMRAGRWEYDRAERELVAAFNAVRKVKTPGGFITYETDRARGISHGDLAWATMLAVINEPIGGEGENERFTVMEF

SEQ ID NO: 4601 - DNA, 837 bp, Escherichia coli
atggctaatgaaaaaaagacatcccgcaaaaagtttcgcgtggctgtctccggatcaactgttgatggccgtgaaatcagtccggtgcatctgcgtgaagccgccgagaacttcaacccggatgtttacgctgcccgcgtgaacgttgagcactatctctcgccatgcccgtcaagcgaattttccgcaatgggcgatgtcaccgcactgagtacggaagacattacggaaggtccgctggccggacgtactgcgctgtatgcagaaatcgaaccgaccgagcgcatgaagcagcttgtcgcggacggcaagaaaatctattccagtatcgaactgcacccgcagttctccgttaacgggcgcgcctatctggtcgggctggcgatgaccgacaccccggcaagcctgggcactgagcgcctgaaattcacggcacagcaacgtcaggcggtgatgacgttcaacagtatccagggtgaagcgccgcttatctccgaagccatcgagtctgaaatcatcgaaatggcagaacaacgccaggaagaaggcacccagtggtttaaccgcgtaatggggattattggccgtggccgcaaagcggatgacgccagtttttcccgtattcaggaagcggtggaaggcgtcgcaacgtcacaggccgacattatcgaccgttttaatgtgctggaaacccgccatcagcaggaccgccagaaaattacgtcactgaccacagagctggcagcactgaaggaaaaactgcgcacgcaggacggcgatccgcagaaccggttcaccgcaacaggtgcagcctccgaccagctggctgacttctga

SEQ ID NO: 4602 - protein, 278 aa, Escherichia coli
MANEKKTSRKKFRVAVSGSTVDGREISPVHLREAAENFNPDVYAARVNVEHYLSPCPSSEFSAMGDVTALSTEDITEGPLAGRTALYAEIEPTERMKQLVADGKKIYSSIELHPQFSVNGRAYLVGLAMTDTPASLGTERLKFTAQQRQAVMTFNSIQGEAPLISEAIESEIIEMAEQRQEEGTQWFNRVMGIIGRGRKADDASFSRIQEAVEGVATSQADIIDRFNVLETRHQQDRQKITSLTTELAALKEKLRTQDGDPQNRFTATGAASDQLADF

SEQ ID NO: 4603 - DNA, 1053 bp, Escherichia coli
atgaatctggtgatgtcagatattacccgcaacaagctgggttgctatatggcgcagcaggcgtcgcttaataatattccggtttccgcactggtatcgcgatttaccgtggaaccctcggtgcagcagcgttttgaaaacgcctcaaaggaaagcaccgaatttacaaaaagaattaacgtgatcggcgtgaccgaccagaaaggcgaaaaaatcctcctggacaccaccgggccaattgcacgcacgaataccagttatgacggcacaaaacgccgtaacccgaataacgtggttgatctgaaaaaccgcaaataccagtgcgaacaggtgaactacgacacgtttatttcatatccgcagcttgatgcctgggcggcacaccctgattttcagtcccgcatcagcgcacagattgcccgacaggtggcgcttgaccgcatcatgatcggtttcaacggcacgtctcacgcggatgagtccaacttcagcaccaacaagctgcttcaggacgttaacgtgggatggctggagcacatcagaaccgacgccagcgaacgcgttatgaatgacgtgacgctgacctcccgcaacatggataacaccgtggcgcacgcgggtaagtatgcgaacgctgatgcactggtacaggacgcgcgttcatccctgctggatgaatggcacaaggaagctgacgaccttgtggtgattatggggcgcaacctgtttaactcgctgcgtctgcccgtgctgaacagcatcagcggccagaatcccaatgcggaattacttgccgggcagctcatcctgtcatcgcgcaccattggcgggctgggcgtgttccttgcgccgttcttcccggatgcaacgatgctgatcacctcgttcaacaacctgtcgatttactggcagaaaggttcaatgcgtcgcctgatgaaagacgagccggaatacaaccgcatcgccacctaccagtccatcaatgacgcttatgtcgttgaagactatggcaagtgcgcgatggtcactggcctgaagttcgccgacagctaa

SEQ ID NO: 4604 - protein, 350 aa, Escherichia coli
MNLVMSDITRNKLGCYMAQQASLNNIPVSALVSRFTVEPSVQQRFENASKESTEFTKRINVIGVTDQKGEKILLDTTGPIARTNTSYDGTKRRNPNNVVDLKNRKYQCEQVNYDTFISYPQLDAWAAHPDFQSRISAQIARQVALDRIMIGFNGTSHADESNFSTNKLLQDVNVGWLEHIRTDASERVMNDVTLTSRNMDNTVAHAGKYANADALVQDARSSLLDEWHKEADDLVVIMGRNLFNSLRLPVLNSISGQNPNAELLAGQLILSSRTIGGLGVFLAPFFPDATMLITSFNNLSIYWQKGSMRRLMKDEPEYNRIATYQSINDAYVVEDYGKCAMVTGLKFADS

SEQ ID NO: 4605 - DNA, 801 bp, Escherichia coli
atgattactcctgcacagcaacactggcagaacgtgatggcacagcgcgcaggccgggcgaatgaaggcgtggaccacgccgcgcgtaccgcgcatgaagaggtgctgtatcgtctgcgtctggcacaggcccggcttaagggcgtacaggccagaagcgcgaaagccgccatcaaaaaagagttgttgccggatttttccggctggattgagggaacgctggaggctgacggcgggcagcaggatgaagtgattgccacgctgatggtgtgggcgattgactgtggcgatcttccgcttgcgctgcgtatcggcgcgtatgtggtccgtcacaacctcatcatgccggataactttggccgtactgctgccacggtactgaccgaagaaatctgtaatccggtactgacgcaggccgggacggatgccgacgcggatttgtccgcctttatcgaaccactggacaccctccgggagattgtcaccgaccaggacatgccggacgaagtgcgcgccaaattatgcaaagcgtgcgcctttgtccgccgtggcctgagtgatgcggacagcatggccctgtcactgaagctgctgcgcgaagcaatgcacctgaacccgaacgcaggtgtgaaacgcgagattgcaaccctttcccgcgccctgaaaaaagccgattccgcagccgcaccagaagacgccagcacaccgcaggcgcaggacgaaagcagcaaaagtaaaaagacaacgcggaagcctgcaacacgaaaaaccaccgcgacgcagaaggcgaagcgcggttaa

SEQ ID NO: 4606 - protein, 266 aa, Escherichia coli
MITPAQQHWQNVMAQRAGRANEGVDHAARTAHEEVLYRLRLAQARLKGVQARSAKAAIKKELLPDFSGWIEGTLEADGGQQDEVIATLMVWAIDCGDLPLALRIGAYVVRHNLIMPDNFGRTAATVLTEEICNPVLTQAGTDADADLSAFIEPLDTLREIVTDQDMPDEVRAKLCKACAFVRRGLSDADSMALSLKLLREAMHLNPNAGVKREIATLSRALKKADSAAAPEDASTPQAQDESSKSKKTTRKPATRKTTATQKAKRG

SEQ ID NO: 4607 - DNA, 495 bp, Escherichia coli
atgagtatggttgccaggaccaaccccggacccgcagaggacgacatcaccgataccgatgatggtgatacccgtatttcagcgggtgcattctggccggatattgtgctgcgtgagctgcgtctggcggtacgactgccggggcgcgtgaccacctcccgcctgctgcataccgccaccggagctgtggcacacgttacccgcgagctggaagcatggcagcaggaacagcaggcggctggccatcagacgctggccgatgttccggcacccgtaattaacggagaaagcgtcaatctctggcactggcgcaatgctgtttataccgccacgcgcgccctgattctggagcgttatcgtgatgcagacacaacggacaagggcgaccgccgggcggacgcactggatatacagacatcggatttgtggcgcgatgtgagctgggccatctctgacattctgtgccgcccgcgaatctttgcggagttgtgctga

SEQ ID NO: 4608 - protein, 164 aa, Escherichia coli
MSMVARTNPGPAEDDITDTDDGDTRISAGAFWPDIVLRELRLAVRLPGRVTTSRLLHTATGAVAHVTRELEAWQQEQQAAGHQTLADVPAPVINGESVNLWHWRNAVYTATRALILERYRDADTTDKGDRRADALDIQTSDLWRDVSWAISDILCRPRIFAELC

SEQ ID NO: 4609 - DNA, 201 bp, Escherichia coli
atgaaagtgaaggcactggaaggcgacaccgtggattcgctctgtttccggtactacggcacgacgcagggcgtcaccgaaaaggtgctggatgccaaccccggactctgtcagcaggtatttctggacgccgggcaggaagtggagatgccggagccggagaagaagaaacgagaaatgattcagttgtggggggagtag

SEQ ID NO: 4610 - protein, 66 aa, Escherichia coli
MKVKALEGDTVDSLCFRYYGTTQGVTEKVLDANPGLCQQVFLDAGQEVEMPEPEKKKREMIQLWGE

SEQ ID NO: 4611 - DNA, 546 bp, Escherichia coli
atgaaatcgaaagacgaaatttttgatgccgttcttggcaaagaaggcggctacgtcaatcacccggatgacagaggcggtccgacaaaatggggcatcactgaaaaggtggcacgggcgcacggataccgtggcgatatgcgtgatttaacgcgcggacaggcactggaaatccttgaagctgattactggtacggaccgcgttttgatcagatagcgaagctgtccccggatattgccgcagaactgtgtgactccggagtaaatatgggaccgtctgtggcaaccagaatgcttcagcgctggctgaacgcattcaatcagggcgggaaactgtatcccgatatggacacggacggacgcactggcccacgcacgattaacgcattgcgtgcatatctggaaaaacgcggtcgggacggcgagatggtgatgttaacagcactgaactgtacacagggtgaacgctatctggagctggcggaaaaacgcgaagccaacgaatcgtttgtctacggctggataaaggaacgcgtggcagcatga

SEQ ID NO: 4612 - protein, 181 aa, Escherichia coli
MKSKDEIFDAVLGKEGGYVNHPDDRGGPTKWGITEKVARAHGYRGDMRDLTRGQALEILEADYWYGPRFDQIAKLSPDIAAELCDSGVNMGPSVATRMLQRWLNAFNQGGKLYPDMDTDGRTGPRTINALRAYLEKRGRDGEMVMLTALNCTQGERYLELAEKREANESFVYGWIKERVAA

SEQ ID NO: 4613 - DNA, 408 bp, Escherichia coli
atgaagttatggacttctctgggcgtcgcttttcttctgattgccgcatggggaacatccatgcgtctgtcgtggtcgctgggccgggagaacgccagaaacgaagcgcaggccagcaccctgaaaagtaccgtcgacaccctgaatatcatcagcaccggggtacaggatatgcagcaggtgctggcgcaactccgcgtggaaaatcagcaacgcaatcaggacggagaagccagacgtgaacagctacgcaacgatattgcaaaagatgaatgcgcccacgctttgcctgatgctcgttttactgacaggttgcgcaggcacgcagaacgcgccacggccagcgccgtcagtccggcttataccgcagacgctgaccataccggtaacgcctccccccttccctga

SEQ ID NO: 4614 - protein, 135 aa, Escherichia coli
MKLWTSLGVAFLLIAAWGTSMRLSWSLGRENARNEAQASTLKSTVDTLNIISTGVQDMQQVLAQLRVENQQRNQDGEARREQLRNDIAKDECAHALPDARFTDRLRRHAERATASAVSPAYTADADHTGNASPLP

SEQ ID NO: 4615 - DNA, 468 bp, Escherichia coli
atgctgaaaactgattccctgcgtgaagccatgacccgttcatgccgatggtgtcaggccaacccggaaaaattcaccattttcgtggagagcggcaacattgaaacgaccggagaaacgccctcgtttgtttaccgctatcagatggtgatgtttgtcatggattacgccggggagctggacgacctcacgctgccgctactggcgtggttatcagaaaatcagccacagttgttgctcaatccggagcgtaatcaggacatcaaattctccgccgttatcaatgacgatgacagcgccgatctcctgtttacgctccctctgcgggaacgcgttcgcatcacgcgcagcagtcagggcacgccgcaggcagaacacctgccggagccaaaaccccgcctgccatcttccgaaggcgactggtcgcatgtattccaggatgtgacgtggggtgaaagcgatggataa

SEQ ID NO: 4616 - protein, 155 aa, Escherichia coli
MLKTDSLREAMTRSCRWCQANPEKFTIFVESGNIETTGETPSFVYRYQMVMFVMDYAGELDDLTLPLLAWLSENQPQLLLNPERNQDIKFSAVINDDDSADLLFTLPLRERVRITRSSQGTPQAEHLPEPKPRLPSSEGDWSHVFQDVTWGESDG

SEQ ID NO: 4617 - DNA, 636 bp, Escherichia coli
atggataaggcattcacccgcgtggatgaaacctttgaggccatccgcgacagcctgaatcagcaggccatcaataacatcgccagaaagctggcacaggatttacgccgcgcccagcaggcgcgtatccggtcacagaaagcgccggacgggaccgcgtggacaccacgcagacgccgcgtaacccggatacaggaacgcattcgctttatctggaataacgaagcacgcacgctgaaaaactggcatcacgacacggggaaatacgggcgaaccattaccgggtgggatgaggataaaaataatatccgcacgttttaccgggatgacatcgaccgttttctggaaatacgcacccggcgcatcaaccaggacagcacaaagcgcgtccccatgttcgtaaaactgcgcaccgcccgctacctgaaagcccgtgcagatgcttccggtgtgacggtgggttacagcggcgtggccgcacgtattgcacgcgttcatcagttcggtgagcgcgatcaggttatgccgggcattttcaccgattacccggtacgtgagctgctgggtatcagccaggcagatgagcgcctgatttataacacggtgctgggccggattgcggaggctatacggtga

SEQ ID NO: 4618 - protein, 211 aa, Escherichia coli
MDKAFTRVDETFEAIRDSLNQQAINNIARKLAQDLRRAQQARIRSQKAPDGTAWTPRRRRVTRIQERIRFIWNNEARTLKNWHHDTGKYGRTITGWDEDKNNIRTFYRDDIDRFLEIRTRRINQDSTKRVPMFVKLRTARYLKARADASGVTVGYSGVAARIARVHQFGERDQVMPGIFTDYPVRELLGISQADERLIYNTVLGRIAEAIR

SEQ ID NO: 4619 - DNA, 582 bp, Escherichia coli
gtgagcgcagaactcatgcgactgctgagcaacatcatccgcaccgggatcatctctgaagttgatgagaagtcctggcgcgtgcgcgttcgcagcggcgaactggaaacaggctggctgcgctggaacaccacgcgcgcgggagccttcaatgtgtggctgccgccatcaccaggcgaacaggtggtaatagcctgcattggcggcaacccggaaaccgccatgataattggcagcctgtggagtgatgccagtccggcccccggcgaaagcctgaaagaaatcgtggtcagtgcgccggatggcgcggtgttccgctacgacgcggacgcaggcgcactgagcgccagcggcatgaaaacggccactttacaggcatccgtcagcgtgacactggacacgcccgtcgtggaatgcacaaaccttctgagaacggcgacgcttgacgtcacaaaagggggaaagatgagcggcaatatcacgcacagcggcggcaatttcacctcaaacggcatcacagtgcatacgcataaacacggtggcgttaaaggtggcagcgattcgacaggaggcccgcagtga

SEQ ID NO: 4620 - protein, 193 aa, Escherichia coli
MSAELMRLLSNIIRTGIISEVDEKSWRVRVRSGELETGWLRWNTTRAGAFNVWLPPSPGEQVVIACIGGNPETAMIIGSLWSDASPAPGESLKEIVVSAPDGAVFRYDADAGALSASGMKTATLQASVSVTLDTPVVECTNLLRTATLDVTKGGKMSGNITHSGGNFTSNGITVHTHKHGGVKGGSDSTGGPQ

SEQ ID NO: 4621 - DNA, 330 bp, Escherichia coli
atgaacccggacggaacgggaaacctgaacgatatggagcacctgaaacagtcagtcagggacatcctgaccaccccgctggcaagccgggttatgcgacgggaatatggcagccttgtgcctgatttgattgacgaacccatgaataacaccacgcgtctgcaatgcatgagtgctaccgtgattgcactgacacgatgggaaccccgcattgccctggatgccatcgatgttgtctggaaagcaggaggccgcgctggggtgacgctgtcgggcactgtcatgcagaccatgcagaatgttgaattaaccatcacgctgagagagtaa

SEQ ID NO: 4622 - protein, 109 aa, Escherichia coli
MNPDGTGNLNDMEHLKQSVRDILTTPLASRVMRREYGSLVPDLIDEPMNNTTRLQCMSATVIALTRWEPRIALDAIDVVWKAGGRAGVTLSGTVMQTMQNVELTITLRE

SEQ ID NO: 4623 - DNA, 897 bp, Escherichia coli
atgcctgccgttgacctttcccagttaccggaacccgccatcatagcggagcctgactttgaggcaattctggctgacacaaaggccatgatgattgcgtcctatcctgccgaacagcgtgaagccgtctccgccgcgctggagctggaatcggaacccctgaacgttatcgctcaaaccatgtcttttcgtgaaatgctgttacgccagcgggttaacgagggggcacgcgcctgcatgttaagccacagcgccggaacagacctggacaacctcgcgggcaatatgaacacaaagcgcctggttatcactccggcaacggataccaccgacgcggtgatggagagcgacacctcgctgagactgcgggcgcagcgggcgtacgacggcctgagtgttgctggcccgtcaggtgcatacgagtattttgcccgcagcgccagcggtctggtgcgtgatgcgcgggctatcagtccgtctccggcaaatgtgacggtttcaatcctgtccactgaaggcgacggcacagcaacggaggcgttgcttaataccgttcgcgccgttctgaatgcagaggatacccgcccggtggccgaccgcctgaccgtacagagcgccagcatcgtgacatggcggctgaatgcaaaactgtacttttaccccggtccggaatccgaacctattctggccgcggcggaatcgtcattcaggaagtggctggctgaacaggggcttatcggtcaggacgtggcgttgtccgccattgctgccgcacttcatgtacacggcgtgcaacgcgtggagataatcgaacccacacagaatatggccatcagcgacatacaggcggcgcgctgtgagtcattcaccatcagcgaaggtgggcgtaatgagtaa

SEQ ID NO: 4624 - protein, 298 aa, Escherichia coli
MPAVDLSQLPEPAIIAEPDFEAILADTKAMMIASYPAEQREAVSAALELESEPLNVIAQTMSFREMLLRQRVNEGARACMLSHSAGTDLDNLAGNMNTKRLVITPATDTTDAVMESDTSLRLRAQRAYDGLSVAGPSGAYEYFARSASGLVRDARAISPSPANVTVSILSTEGDGTATEALLNTVRAVLNAEDTRPVADRLTVQSASIVTWRLNAKLYFYPGPESEPILAAAESSFRKWLAEQGLIGQDVALSAIAAALHVHGVQRVEIIEPTQNMAISDIQAARCESFTISEGGRNE

SEQ ID NO: 4625 - DNA, 531 bp, Escherichia coli
atgagtaattcactgttaccgccatcagccagcaatttcatgcgttgtgccgaagctgtcggaacgcgcattacagacatcccggtagacctcaacacgctgtggtcgccggacacctgcccggtgcacctgctgccttatctcgcctgggcattttccgttgaccgctgggatcgcaactggccggaagagacaaaacgacaggtgattcgtgatgcatggctggtacaccgacacaagggaaccatcagcgcactgcgccgggccattgagccgctgggatacctcattcgtgtgtctgagtggtgggagttcggcggagaaccgggaacatttaccgttgaagtgggcacgctggacagtggcgtgacggaggaaatgtatctggaaatggagcggttgattgctgatgcccgcccggtcagccgccacatgacagggctgaatatcattcaggagatcccgggagatattttcgcggcggcagcaacttacgacggtgaagtcattaccatttatccggacgattaa

SEQ ID NO: 4626 - protein, 176 aa, Escherichia coli
MSNSLLPPSASNFMRCAEAVGTRITDIPVDLNTLWSPDTCPVHLLPYLAWAFSVDRWDRNWPEETKRQVIRDAWLVHRHKGTISALRRAIEPLGYLIRVSEWWEFGGEPGTFTVEVGTLDSGVTEEMYLEMERLIADARPVSRHMTGLNIIQEIPGDIFAAAATYDGEVITIYPDD

SEQ ID NO: 4627 - DNA, 1986 bp, Escherichia coli
atgagtaccacaacacgtaaatttaaaaccgttatcaccgatacgggtgccaaaaaattagcgcaggcagccgcgccagatggtaagcctgtccgcctgactcatatggccgtgggcgacggtggcggcacgttgcccacaccagacagtaagcagacccgtctggtgcatgaggtgtggcgacatactgttaatcgcgtcatcctggacgcaacacatcagaaccgcattattgcggagctggttattcctcctgaaacgggcggattctggatccgggaaattggtgtatttgatgagcacggcgatttaatcgcggtgggaaatactgccgaaagttacaagccagccgttgccgaagggtccggacgtgcacaaacatttcgcaccattctgaccgtatccagcactgccaccgtggcgcttaccgtggataacaccatggtgatggccacagtggattacgtggatgacaaactgaaagagcatgaacagtcacgacgtcacccggacgcctctctgaccgcaaaaggctttgttcaactcagtagcgccactaacagcgtgtctgaaacgcaggctgcaacgccgaaagcagtaaaggccgcgtatgatcttgctaacggtaaatatactgcgcaggatgccagcacgacgcgaaaaggccttgtccagctcagtagcgccaccaacagcacgtctgaaacgcaggctgcaacgccgaaagcagtgaaggccgcgtatgaccttgctaacgcaaaatataccgctcaagacgctacgacggcacaaaaagggatagtccagctcagtagtgccaccaacagcacgtctgaaacactggccgcgacatcgaaagcggttaaggcggtaatgggtgaaacgaacaagaaagcgcccttaaacagtcctgcgttgaccggaacgccaacaacgccaactgcgcgacagggaacgaataatacccaaatcgcaagcacggctttcgttatggctgcgattgccgcccttgtagattcgtcacctgacgcactgaatacgctgaacgagttagcggcggcgctgggaaacgacccgaattttgcgaccaccatgactaacgcgcttgcgggtaagcaaccgaaagatgccaccctgacggcgctggccgggcttgctactgcggcagacaagtttccgtattttacggggaatgatgtcgccagcctggcaaccctgacaaaagtcgggcgggatattcttgcgaaatcgaccgttgccgccgttatcgaatacctcggtttacgagaactcggcacaagcggggagaaaataccgttactcagtacagcgaatacctggaccaatcgacaaacattcagcggtggcctttctggggaactgtccggcaatgccgctactgcaacaaagctgaaaacagcacgaaaaattgctggagttggttttgatggttctagcgatatttcaattagtgccaaaaatgtcaatgcatttgcactccgacaaacaggtaatactgttaatggtgatacatccgttggatggaattgggatagtggtgcatataacgccctgattggtggtgcatctgtattaattcttcactttaatataaatgctggtagctgtcctgccgtacaattccgtgtgaattataaaaatggtggcatttcctacaggtcggctcgtgatggttatgggtttgaattaggttggtcagatttctataccacgacacgaaaaccttcagcgggagatgttggtgcatatacgcaggcagaatgtaactcaaggtttattacaggtattcgccttggcggtctgtcatctgttcagacatggaatggtcccggctggtctgacaggtcaggttatgtcgttacgggttcagttaacggaaaccgtgatgaattaattgatacaacacaggcaaggccaattcagtattgcattaatgggacgtggtataacgcggggagtatttaa

SEQ ID NO: 4628 - protein, 661 aa, Escherichia coli
MSTTTRKFKTVITDTGAKKLAQAAAPDGKPVRLTHMAVGDGGGTLPTPDSKQTRLVHEVWRHTVNRVILDATHQNRIIAELVIPPETGGFWIREIGVFDEHGDLIAVGNTAESYKPAVAEGSGRAQTFRTILTVSSTATVALTVDNTMVMATVDYVDDKLKEHEQSRRHPDASLTAKGFVQLSSATNSVSETQAATPKAVKAAYDLANGKYTAQDASTTRKGLVQLSSATNSTSETQAATPKAVKAAYDLANAKYTAQDATTAQKGIVQLSSATNSTSETLAATSKAVKAVMGETNKKAPLNSPALTGTPTTPTARQGTNNTQIASTAFVMAAIAALVDSSPDALNTLNELAAALGNDPNFATTMTNALAGKQPKDATLTALAGLATAADKFPYFTGNDVASLATLTKVGRDILAKSTVAAVIEYLGLRELGTSGEKIPLLSTANTWTNRQTFSGGLSGELSGNAATATKLKTARKIAGVGFDGSSDISISAKNVNAFALRQTGNTVNGDTSVGWNWDSGAYNALIGGASVLILHFNINAGSCPAVQFRVNYKNGGISYRSARDGYGFELGWSDFYTTTRKPSAGDVGAYTQAECNSRFITGIRLGGLSSVQTWNGPGWSDRSGYVVTGSVNGNRDELIDTTQARPIQYCINGTWYNAGSI

SEQ ID NO: 4629 - DNA, 246 bp, Escherichia coli
  n 227, 228, 229, 230, 231: n is any nucleotide
atgatgcacttaaaaaacattactgctggcaaccctaaaacaaaagagcaatatcagctaacaaagcaatttaacatcaaatggctttattcagatgatggaaaaaactggtatgaggaacaaaagaatttccagccagacactttgaaaatggtctatgaccataacggcgttattatttgtattgaaaaggatgtttcagcaattaatccggagcgcaagcgtcnnnnncattccattcattaa

SEQ ID NO: 4630 - protein, 81 aa, Escherichia coli
  Xaa 76, 77: Xaa is any amino acid
MMHLKNITAGNPKTKEQYQLTKQFNIKWLYSDDGKNWYEEQKNFQPDTLKMVYDHNGVIICIEKDVSAINPERKRXXHSIH

SEQ ID NO: 4631 - DNA, 549 bp, Escherichia coli
atgcaatttaatatccctacgttgcttacactgttccgtgtcatccttatcccattctttgtattggtcttttatctgcctgtcacctggtcgccgtttgccgccgcgctcattttctgcgtcgcggcggtgactgactggttcgatggttttctggcacgccgctggaatcagagtacccggtttggtgctttccttgaccctgtcgcagataaagttctcgtggctatcgccatggtgctggtaaccgagcattaccacagctggtgggtgaccttaccggcagcaacgatgatcgcccgtgaaattattatttctgcgctacgcgaatggatggcggagttgggtaaacgcagtagcgtggctgtctcctggattgggaaagtgaaaaccactgcccagatggtggcgttagcctggctgctgtggcgtccgaacatttgggttgagtacgccggtattgcacttttctttgtggctgcggtactgactctgtggtcaatgttgcaatatttgagcgctgcgcgtgcagatttgcttgatcagtga

SEQ ID NO: 4632 - protein, 182 aa, Escherichia coli
MQFNIPTLLTLFRVILIPFFVLVFYLPVTWSPFAAALIFCVAAVTDWFDGFLARRWNQSTRFGAFLDPVADKVLVAIAMVLVTEHYHSWWVTLPAATMIAREIIISALREWMAELGKRSSVAVSWIGKVKTTAQMVALAWLLWRPNIWVEYAGIALFFVAAVLTLWSMLQYLSAARADLLDQ

SEQ ID NO: 4633 - DNA, 1767 bp, Escherichia coli
atgtacgatgctggtggtacggttatctatgtcggcaaagcgaaagacctgaaaaaacggctttccagctatttccgtagcaacctcgcttcgcgcaaaaccgaagcgctggtcgcccagatccagcaaattgatgtaacggttactcatacagaaaccgaagcgctgttactggaacacaactacatcaaactttatcagccgcgttacaacgttttgctacgcgatgataaatcatatccttttatcttcctgagtggcgatacccacccgcgtctggcgatgcatcgtggagcgaagcatgccaaaggtgaatatttcggcccgttcccgaatggctatgccgtacgtgaaacactggcgctactgcaaaagattttccccattcgccagtgcgaaaacagtgtttatcgcaaccgctcgcgtccgtgtctgcaatatcagatagggcgctgtctggggccgtgcgttgaaggactggtgagtgaagaagaatacgctcagcaggtcgagtatgtgcgcctgtttttgtctggcaaagatgatcaggtgcttacgcaactcattagtcgtatggaaactgccagccagaatctggagtttgaagaagcggcgcggattcgcgaccaaattcaggcggtgcgacgtgtcaccgaaaaacagtttgtttccaataccggcgacgaccttgacgttattggagtggcgttcgatgcgggtatggcttgtgtccacgtattgttcattcgtcagggcaaagtgctcggcagccgcagctatttcccgaaagtgcctggcggtacggaactgagcgaggtggtggaaaccttcgtaggtcagttctatttacaaggcagccagatgcgcaccttaccgggtgagatcctgctcgattttaatcttagcgataaaacgctgctcgccgattccctttcagaactggcgggacgcaagattaatgttcaaaccaaacctcgtggcgatagagcgcgttatctgaaactcgcgcgtaccaatgcggcgacggccttaaccagcaaactttcgcagcaatctaccgttcaccagcggctgaccgcgcttgccagcgtgttgaaattgccggaagtgaagcggatggagtgctttgacatcagccataccatgggtgaacaaaccgtcgcttcctgtgtggtgtttgatgctaacggcccgctgcgtgcggagtatcggcgctataacattactggcatcacaccgggcgatgattatgcggcgatgaatcaggtgctgcgtcggcgttatggtaaagccattgacgacagtaagatcccggatgtgatccttatagacggcggcaaaggccagcttgcgcaggcgaaaaatgtcttcgccgaactggatgtctcatgggataaaaatcatccgctgctacttggcgttgccaaaggagcagatcgtaaggctgggctggaaacgctgttctttgagccggaaggtgagggatttagtttgccgccagattctcccgcgctgcatgttatccagcatattcgcgatgaatcacacgatcacgcgattggcgggcaccgtaaaaaacgggcgaaggtcaaaaataccagttccctggaaaccattgaaggcatcgggccaaaacgtcggcaaatgttgttgaaatatatgggtggtttgcaaggtttacgtaacgccagcgttgaggaaattgcaaaagtgccgggtatttcgcaaggtctggcagaaaagatcttctggtcgttgaaacattga

SEQ ID NO: 4634 - protein, 588 aa, Escherichia coli
MYDAGGTVIYVGKAKDLKKRLSSYFRSNLASRKTEALVAQIQQIDVTVTHTETEALLLEHNYIKLYQPRYNVLLRDDKSYPFIFLSGDTHPRLAMHRGAKHAKGEYFGPFPNGYAVRETLALLQKIFPIRQCENSVYRNRSRPCLQYQIGRCLGPCVEGLVSEEEYAQQVEYVRLFLSGKDDQVLTQLISRMETASQNLEFEEAARIRDQIQAVRRVTEKQFVSNTGDDLDVIGVAFDAGMACVHVLFIRQGKVLGSRSYFPKVPGGTELSEVVETFVGQFYLQGSQMRTLPGEILLDFNLSDKTLLADSLSELAGRKINVQTKPRGDRARYLKLARTNAATALTSKLSQQSTVHQRLTALASVLKLPEVKRMECFDISHTMGEQTVASCVVFDANGPLRAEYRRYNITGITPGDDYAAMNQVLRRRYGKAIDDSKIPDVILIDGGKGQLAQAKNVFAELDVSWDKNHPLLLGVAKGADRKAGLETLFFEPEGEGFSLPPDSPALHVIQHIRDESHDHAIGGHRKKRAKVKNTSSLETIEGIGPKRRQMLLKYMGGLQGLRNASVEEIAKVPGISQGLAEKIFWSLKH

SEQ ID NO: 4635 - DNA, 657 bp, Escherichia coli
ttgatcaacgttctacttgttgatgaccacgaactggtgcgcgcagggatacgacgcattctggaagatataaagggtataaaagtcgtcggtgaggcatcgtgcggtgaagacgccgttaaatggtgccgggcaaatgccgttgacgtggtgctaatggacatgagtatgccgggcattggcggtcttgaggcgacgcgtaaaatcgcgcgttccacagctgatgtcaaaatcatcatgcttaccgtccatacagaaaaccctttaccagcgaaagtcatgcaggccggagctgcgggctacctcagcaaaggcgcggctccgcaggaagtcgtgagtgcgattcgttctgtctattcagggcagcgttacattgcttctgatatcgctcaacaaatggcgttaagccagatcgaaccagaaaaaacagaaagcccatttgccagtttgtctgaacgtgaattgcagattatgctgatgatcaccaagggccagaaggtcaatgagatctcagaacagctcaatctcagtccgaaaacggtgaacagctaccgctatcgtatgttcagtaaactaaacattcatggcgatgttgagctgactcacctggcaattcgccatggtctgtgtaatgcggagacattatcaagtcagtga

SEQ ID NO: 4636 - protein, 218 aa, Escherichia coli
MINVLLVDDHELVRAGIRRILEDIKGIKVVGEASCGEDAVKWCRANAVDVVLMDMSMPGIGGLEATRKIARSTADVKIIMLTVHTENPLPAKVMQAGAAGYLSKGAAPQEVVSAIRSVYSGQRYIASDIAQQMALSQIEPEKTESPFASLSERELQIMLMITKGQKVNEISEQLNLSPKTVNSYRYRMFSKLNIHGDVELTHLAIRHGLCNAETLSSQ

SEQ ID NO: 4637 - DNA, 225 bp, Escherichia coli
atgagtacgcctgatttttctactgccgagaataatcaagaactggcaaatgaagtctcctgcctgaaagcgatgctgacgctgatgctgcaggcgatgggacaagctgacgcgggccgcgtgatgttaaagatggaaaaacagcttgcgctgatcgaagacgaaacccaggctgcagtattttccaaaacggttaagcaaattaaacaagcctaccgtcagtaa

SEQ ID NO: 4638 - protein, 74 aa, Escherichia coli
MSTPDFSTAENNQELANEVSCLKAMLTLMLQAMGQADAGRVMLKMEKQLALIEDETQAAVFSKTVKQIKQAYRQ

SEQ ID NO: 4639 - DNA, 723 bp, Escherichia coli
atgcaggatacggattttttcagctggcttcgcacgatgttgttgcgttttcagaggatggaggccgcagaagaggtctaccatgaaatagagcttcaggctcagcagctggagtacgattactattcgttatgtgttcgccacccggtaccattcacgcgacctaaagtggctttctataccaattaccctgagtcgtgggttagttattatcaggcaaaaaattttctcgcaattgatccggtgctgaaccctgaaaactttagtcagggccatttaatgtggaatgatgacttattcagcgaagcacagccgttatgggaagctgcgcgcgcacatggtttacgccgcggtgtcactcagtatttaatgctgccaaatcgggcgttgggctttttgtccttttcccgttgcagcacgcgcgaaatacccattcttagtgatgaactgcaattaaaaatgcagctactggtgcgcgaaagtctgatggctctgatgcgtttaaatgatgaaatagtgatgacgccagagatgaatttcagcaagcgcgaaaaagaaattctgaaatggacggcggaaggtaagacatcagcagagatagcgatgattttgtcaatctctgagaatacggtcaatttccatcagaaaaacatgcagaaaaaaatcaatgcaccgaataagacgcaggttgcctgttacgcggccgctactggcttaatttga

SEQ ID NO: 4640 - protein, 240 aa, Escherichia coli
MQDTDFFSWLRTMLLRFQRMEAAEEVYHEIELQAQQLEYDYYSLCVRHPVPFTRPKVAFYTNYPESWVSYYQAKNFLAIDPVLNPENFSQGHLMWNDDLFSEAQPLWEAARAHGLRRGVTQYLMLPNRALGFLSFSRCSTREIPILSDELQLKMQLLVRESLMALMRLNDEIVMTPEMNFSKREKEILKWTAEGKTSAEIAMILSISENTVNFHQKNMQKKINAPNKTQVACYAAATGLI

SEQ ID NO: 4641 - DNA, 753 bp, Escherichia coli
atgagtgccattgaagttaagaacctggtgaaaaaattccacggtcagacggtgctgcatggtatcgaccttgaggtgaagcctggcgaagtagtggctattatcggtccgagtggttccggcaaaaccacgttgctacgcagcataaatctgctggaacaaccggaagcgggaaccatcaccgttggcgatatcactattgatactgcacgttcattaagtcagcaaaaatcgctgattcgccagttgcgtcagcacgtcgggtttgtcttccagaactttaatctgtttccgcatcgtacggtgctggaaaacattattgaagggccggtgatcgtcaaaggcgaaccgaaagaagaggccacggcgcgcgctcgcgagctgctggcgaaagttgggctggccggtaaagaaaccagttatccacgtcgtttgtctggcggtcaacagcagcgcgttgcgattgcgcgtgctctggcaatgcgtcctgaagtgattttgtttgatgagccaacgtcggcgctggatccagagctggtgggcgaagtcctgaacaccattcgtcagctggcgcaggaaaagcgcacgatggtgattgtgacgcacgaaatgagctttgcccgggatgttgcggaccgggcgatttttatggaccaggggcggatagtcgagcagggggtagcaaaagcgttatttgctgatcctcagcagcctcgcacccgccagttcatggagaagtttctgctgcaataa

SEQ ID NO: 4642 - protein, 250 aa, Escherichia coli
MSAIEVKNLVKKFHGQTVLHGIDLEVKPGEVVAIIGPSGSGKTTLLRSINLLEQPEAGTITVGDITIDTARSLSQQKSLIRQLRQHVGFVFQNFNLFPHRTVLENIIEGPVIVKGEPKEEATARARELLAKVGLAGKETSYPRRLSGGQQQRVAIARALAMRPEVILFDEPTSALDPELVGEVLNTIRQLAQEKRTMVIVTHEMSFARDVADRAIFMDQGRIVEQGVAKALFADPQQPRTRQFMEKFLLQ

SEQ ID NO: 4643 - DNA, 669 bp, Escherichia coli
atgcaagaaagtatacaactggttattgattccttgccgttcctgctgaaaggggctgggtatacgctgcaactcagtatcggcggcatgttttttggcttactgctagggtttattctcgcgctgatgcgcctttcgccaatctggcccgtgcgctggctggcgcgtttttatatctctatttttcgtggtacgccgctcatcgcccaactgtttatgatctattacggcttgccgcagtttggcatcgaactagatcccattccgtcagcaatgattggtctgtcgctgaacactgccgcctatgctgccgaaacgctgcgcgccgccatttcttctattgataaaggtcagtgggaagctgcagccagtattggtatgacgccatggcagaccatgcgtcgcgcgattttgccacaggcggcgcgggtggcgttgccgccgctgtcgaacagctttatcagcctggtaaaagatacgtcgctggccgcgacaatccaggtgccggagctgttccgtcaggcgcagttgattacctcgcgcacgctggaggtgttcaccatgtacctggcggcttcgctcatctactggattatggcgactgtgttatcgacgttgcagaaccattttgagaatcaacttaatcgccaggagagggaacccaaatga

SEQ ID NO: 4644 - protein, 222 aa, Escherichia coli
MQESIQLVIDSLPFLLKGAGYTLQLSIGGMFFGLLLGFILALMRLSPIWPVRWLARFYISIFRGTPLIAQLFMIYYGLPQFGIELDPIPSAMIGLSLNTAAYAAETLRAAISSIDKGQWEAAASIGMTPWQTMRRAILPQAARVALPPLSNSFISLVKDTSLAATIQVPELFRQAQLITSRTLEVFTMYLAASLIYWIMATVLSTLQNHFENQLNRQEREPK

SEQ ID NO: 4645 - DNA, 987 bp, Escherichia coli
atgccactgcataatttaacccgttttccacggctggagtttatcggcgcgccaacgccgctcgaatatctgccgcgcttttctgattatcttggacgggaaattttcatcaaacgggatgacgtcactcccatggcaatgggcggcaataaattacgtaagctggaatttctcgcggcagatgctctgcgtgaaggtgccgatacgctgattactgccggggcgatccagtctaaccatgtgcgccagactgccgcagtcgctgcgaaactcggtctgcattgcgtggcgctgctggaaaatcctattggtacaaccgcggaaaactatttaaccaacggcaatcgtttgttgctggatctgttcaatacccagattgaaatgtgcgacgcactgaccgatcccaatacccaactggaagagctggcgacgcgagtcgaagcacaaggctttcgcccgtatgtcattccggttggcggttctaatgctttgggcgcgctgggttatgtggagagtgcgctggaaatcgcgcaacagtgtgaaggggcagttaatatttcgtcggtggtggtcgcatcgggcagtgccggaactcacgccggactggctgttgggctggaacacctgatgcctgaaagcgaactgattggcgtgactgtgtcgcgttctgttgccgatcaattgccgaaagtggttaacctccaacaggcgattgcgaaagaactggagctgaccgcatcagcggaaattttactctgggatgactattttgcacctggctacggcgtgccgaacgacgaaggcatggaagcagtgaaattgctggcgcggctggaaggcattctgcttgatcctgtgtataccggaaaagcgatggcggggctgattgacggtatcagtcagaaacgcttcaaagatgaagggccgattctgtttattcataccggcggtgcgcctgcgctgttcgcctatcatccccacgtttag

SEQ ID NO: 4646 - protein, 328 aa, Escherichia coli
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNTQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 4647 - DNA, 801 bp, Escherichia coli
atgaaattagcacatctgggacgtcaggcattgatgggtgtgatggccgtggcgctggttgcgggtatgagcgttaaaagttttgcagatgaaggtctgcttaataaagtcaaagagcgcggcacgctgctggtagggctggaaggaacttatccgccgttcagttttcagggggatgacggcaaattaaccggttttgaagtggaatttgcccaacagctggcaaaacatcttggcgttgaggcgtcactaaaaccgactaaatgggacggtatgctggcgtcgctggactctaaacgcattgatgtggtgattaaccaggtcaccatttctgacgagcgcaagaaaaaatacgatttctctaccccgtacaccatttccggtattcaggcgctggtgaaaaaaggtaacgaaggcaccattaaaacggctgatgatctgaaaggcaaaaaagtgggtgtcggtctgggcaccaactatgaagagtggctgcgtcagaatgttcagggcgtggatgtgcgtacctatgatgatgacccgaccaaatatcaggatctgcgcgtaggccgtatcgatgcgatcctcgttgatcgtctggcggcgctggatctggtgaagaaaaccaacgatacgctggcagtaaccggtgaagcattctcccgtcaggagtctggcgtggcgctgcgtaaaggaaatgaagacctgctgaaagcggtgaatgatgcaattgcggaaatgcaaaaagatggcactttgcaagccctttccgaaaaatggtttggtgctgatgtgaccaaataa

SEQ ID NO: 4648 - protein, 266 aa, Escherichia coli
MKLAHLGRQALMGVMAVALVAGMSVKSFADEGLLNKVKERGTLLVGLEGTYPPFSFQGDDGKLTGFEVEFAQQLAKHLGVEASLKPTKWDGMLASLDSKRIDVVINQVTISDERKKKYDFSTPYTISGIQALVKKGNEGTIKTADDLKGKKVGVGLGTNYEEWLRQNVQGVDVRTYDDDPTKYQDLRVGRIDAILVDRLAALDLVKKTNDTLAVTGEAFSRQESGVALRKGNEDLLKAVNDAIAEMQKDGTLQALSEKWFGADVTK

SEQ ID NO: 4649 - DNA, 552 bp, Escherichia coli
atgatggtgcagcacctgaaaagacggccattaagccgctatcttaaagactttaaacacagccagacccattgcgcgcattgccgtaaattactcgatcgcattaccttagttcgcgacggcaaaatagtgaataaaatcgagatttcccgcctggacacgctgcttgatgaaaatggctggcaagtggaacaacaatcatgggcggcattgtgccgattttgcggtgatttacattgcaaaacgcagagtgattttttcgatattatcggctttaagaaatttctttttgagcaaactgaaatgagccctggtacggtgcgtgaatatgtcgttcgtctgcgccgtttggggaatcatctacacgagcaaaatatttccctcgaccagctgcaggacggtttccttgatgaaatcctcgccccgtggctgccctccaccagcaccaacaattaccgcatcgcgttacggaagtatcaacactatcagcgtcaaacgtgtaccggacttgtgcagaaatcctccagccaacctgcttctgatatatattaa

SEQ ID NO: 4650 - protein, 183 aa, Escherichia coli
MMVQHLKRRPLSRYLKDFKHSQTHCAHCRKLLDRITLVRDGKIVNKIEISRLDTLLDENGWQVEQQSWAALCRFCGDLHCKTQSDFFDIIGFKKFLFEQTEMSPGTVREYVVRLRRLGNHLHEQNISLDQLQDGFLDEILAPWLPSTSTNNYRIALRKYQHYQRQTCTGLVQKSSSQPASDIY

SEQ ID NO: 4651 - DNA, 720 bp, Escherichia coli
gtgaattcactctataccgctgaaggtgtaatggataaacactcgctgtggcagcgttatgtcccgctggtgcgtcacgaagcattgcgcctgcaggttcgactgcccgcgagcgtggaacttgacgatctgctacaggcgggcggcattgggttacttaatgccgtcgaacgctatgacgccctacaaggaacggcatttacaacttacgcagtgcagcgtatacgtggcgctatgctggatgaacttcgcagccgtgactgggtgccgcgcagcgtgcgacgcaacgcgcgtgaagtggcacaggcaatagggcaactggagcaggaacttggccgcaacgccacggaaactgaggtagcggaacgtttagggatcgatattgccgattatcgccaaatgttgctcgacaccaataacagccagctcttctcctacgatgagtggcgcgaagagcacggcgatagcatcgaactggttactgatgatcatcagcgagaaaacccgctacaacaactgctggacagtaatctgcgccagcgggtgatggaaaccatcgaaacgttgccggagcgcgaaaaactggtattaaccctctattatcaggaagagctgaatctcaaagagattggcgcggtgctggaggtcggggaatcgcgggtcagtcagttacacagccaggctattaaacggttacgcactaaactgggtaagttataa

SEQ ID NO: 4652 - protein, 239 aa, Escherichia coli
MNSLYTAEGVMDKHSLWQRYVPLVRHEALRLQVRLPASVELDDLLQAGGIGLLNAVERYDALQGTAFTTYAVQRIRGAMLDELRSRDWVPRSVRRNAREVAQAIGQLEQELGRNATETEVAERLGIDIADYRQMLLDTNNSQLFSYDEWREEHGDSIELVTDDHQRENPLQQLLDSNLRQRVMETIETLPEREKLVLTLYYQEELNLKEIGAVLEVGESRVSQLHSQAIKRLRTKLGKL

SEQ ID NO: 4653 - DNA, 1758 bp, Escherichia coli
atggcacaagtcattaataccaacagcctctcgctgatcactcaaaataatatcaacaagaaccagtctgcgctgtcgagttctatcgagcgtctgtcttctggcttgcgtattaacagcgcgaaggatgacgccgcgggtcaggcgattgctaaccgttttacttctaacattaaaggcctgactcaggctgcacgtaacgccaacgacggtatttctgttgcacagaccaccgaaggcgcgctgtctgaaatcaacaacaacttacagcgtatccgtgagctgacggttcaggcttctaccggaactaactctgattcggatctggactccattcaggacgaaatcaaatcccgtcttgatgaaattgaccgcgtatccggccagacccagttcaacggcgtgaacgtactggcaaaagacggttcgatgaaaattcaggttggtgcgaatgacggtgaaactatcactatcgacctgaagaaaatcgattctgatactctgggtctgaatggttttaacgtaaatggtaaaggtactattaccaacaaagctgcaacggtaagtgatttaacttctgctggcgcgaagttaaacaccacgacaggtctttatgatctgaaaaccgaaaataccttgttaactaccgatgctgcattcgataaattagggaatggcgataaagtcaccgttggcggcgtagattatacttacaacgctaaatctggtgattttactaccaccaaatctactgctggtacgggtgtagacgccgcggcgcaggctactgattcagctaaaaaacgtgatgcgttagctgccacccttcatgctgatgtgggtaaatctgttaatggttcttacaccacaaaagatggtactgtttctttcgaaacggattcagcaggtaatatcaccatcggtggaagccaggcatacgtagacgatgcaggcaacttgacgactaacaacgctggtagcgcagctaaagctgatatgaaagcgctgcttaaagccgcgagcgaaggtagtgacggtgcttctctgacattcaatggcactgaatatactatcgcaaaagcaactcctgcgacaacctctccagtagctccgttaatccctggtgggattacttatcaggctacagtgagtaaagatgtagtattgagcgaaaccaaagcggctgccgcgacatcttcaattacctttaattccggtgtactgagcaaaactattgggtttaccgcgggtgaatccagtgatgctgcgaagtcttatgtggatgataaaggtggtattactaacgttgccgactatacagtctcttacagcgttaacaaggataacggctctgtgactgttgccgggtatgcttcagcgactgataccaataaagattatgctccagcaattggtactgctgtaaatgtgaactccgcgggtaaaatcactactgagactaccagtgctggttctgcaacgaccaacccgcttgctgccctggacgacgctatcagctccatcgacaaattccgttcttccctgggtgctatccagaaccgtctggattccgcagtcaccaacctgaacaacaccactaccaacctgtctgaagcgcagtcccgtattcaggacgccgactatgcgaccgaagtgtccaacatgtcgaaagcgcagattatccagcaggccggtaactccgtgctggcaaaagccaaccaggtaccgcagcaggttctgtctctgctgcagggttaa

SEQ ID NO: 4654 - protein, 585 aa, Escherichia coli
MAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGETITIDLKKIDSDTLGLNGFNVNGKGTITNKAATVSDLTSAGAKLNTTTGLYDLKTENTLLTTDAAFDKLGNGDKVTVGGVDYTYNAKSGDFTTTKSTAGTGVDAAAQATDSAKKRDALAATLHADVGKSVNGSYTTKDGTVSFETDSAGNITIGGSQAYVDDAGNLTTNNAGSAAKADMKALLKAASEGSDGASLTFNGTEYTIAKATPATTSPVAPLIPGGITYQATVSKDVVLSETKAAAATSSITFNSGVLSKTIGFTAGESSDAAKSYVDDKGGITNVADYTVSYSVNKDNGSVTVAGYASATDTNKDYAPAIGTAVNVNSAGKITTETTSAGSATTNPLAALDDAISSIDKFRSSLGAIQNRLDSAVTNLNNTTTNLSEAQSRIQDADYATEVSNMSKAQIIQQAGNSVLAKANQVPQQVLSLLQG

SEQ ID NO: 4655 - DNA, 1407 bp, Escherichia coli
atggcaagtatttcatcgctgggagtcgggtcaggtctggatttaagttcaatccttgatagcctcaccgccgcgcaaaaagcgacgctaacccctatttcaaatcagcaatcgtcgtttaccgctaaacttagcgcctacggtacgctgaaaagcgcgctgacaactttccagaccgccaatactgcattgtctaaagccgatcttttttccgctaccagcaccaccagcagcaccaccgcgttcagtgccaccaccgcgggtaacgccatcgccgggaaatacaccatcagcgtcacccatctggcgcaggcgcaaaccctgacaacgcgcaccaccagagacgatacgaaaacggcgatcgccaccagcgacagtaaactcaccattcaacaaggcggcgacaaagatccgattaccattgatatcagcgcggctaactcgtcgttaagcgggatccgtgatgccatcaacaacgcaaaagcgggcgtaagcgcaagcatcattaacgtgggtaacggtgaatatcgtctgtcagtcacatcaaatgacaccggccttgacaatgcgatgacgctctcggttagcggtgatgatgcgctacaaagttttatgggctatgacgccagtgccagcagcaacggcatggaggtctcggtcgccgcccagaatgcacagctgacggtcaataacgtcgccattgagaacagcagcaacaccatcagcaacgcgctggaaaacatcaccctgaacctgaacgatgtcaccacaggcaaccagacgctgaccatcactcaggacacctccaaagcgcaaacggcgattaaagactgggtgaatgcctataactcgctaatagatacctttagcagcctgaccaaatacaccgccgtagatgcgggagctgatagccagaattctagcaatggcgcactactcggcgactccacgctgcgaacgattcagacgcagttgaaatcgatgctgagtaataccgtcagttcttccaactataaaacgctggcgcagattggtatcacgaccgatcccagcgatggcaaactggaactggatgccgacaaactcaccgctgcattgaaaaaagatgccagcggcgtaggtgcattgattgttggcgatggtaaaaaaaccggcatcacgaccaccatcggcagcaacctgaccagttggctttcgacaacgggcattattaaagccgctaccgatggcgttagtaagaccctgaataagttaactaaagactacaacgccgccagcgatcgcattgatgcgcaggtcgcgcgctataaagaacaatttacccaactggacgttttaatgacctcgttaaacagcaccagcagctacttaacacagcagttcgaaaacaacagtaattccaagtaa

SEQ ID NO: 4656 - protein, 468 aa, Escherichia coli
MASISSLGVGSGLDLSSILDSLTAAQKATLTPISNQQSSFTAKLSAYGTLKSALTTFQTANTALSKADLFSATSTTSSTTAFSATTAGNAIAGKYTISVTHLAQAQTLTTRTTRDDTKTAIATSDSKLTIQQGGDKDPITIDISAANSSLSGIRDAINNAKAGVSASIINVGNGEYRLSVTSNDTGLDNAMTLSVSGDDALQSFMGYDASASSNGMEVSVAAQNAQLTVNNVAIENSSNTISNALENITLNLNDVTTGNQTLTITQDTSKAQTAIKDWVNAYNSLIDTFSSLTKYTAVDAGADSQNSSNGALLGDSTLRTIQTQLKSMLSNTVSSSNYKTLAQIGITTDPSDGKLELDADKLTAALKKDASGVGALIVGDGKKTGITTTIGSNLTSWLSTTGIIKAATDGVSKTLNKLTKDYNAASDRIDAQVARYKEQFTQLDVLMTSLNSTSSYLTQQFENNSNSK

SEQ ID NO: 4657 - DNA, 411 bp, Escherichia coli
atgtacgcggcaaaaggcacccaggcctatgcacaaattggcgtcgaaagcgccgtaatgagcgccagccaacagcagttggtcaccatgctatttgatggagtgctgagcgcactggttagagcgcgactgtttatgcaggacaacaatcagcaaggcaaaggtgtctctttgtcaaaagcgatcaacatcattgagaacggactgcgggtgagtcttgatgaagagagcaaagacgaattaacccaaaacttaattgctctttatagctatatggtcaggcgtttgctgcaagccaatttacgcaacgatgtctccgcagtcgaagaggtggaagcattaatgcgtaatattgccgatgcctggaaagagtctttactctccccttctttgattcaggacccagtctga

SEQ ID NO: 4658 - protein, 136 aa, Escherichia coli
MYAAKGTQAYAQIGVESAVMSASQQQLVTMLFDGVLSALVRARLFMQDNNQQGKGVSLSKAINIIENGLRVSLDEESKDELTQNLIALYSYMVRRLLQANLRNDVSAVEEVEALMRNIADAWKESLLSPSLIQDPV

SEQ ID NO: 4659 - DNA, 366 bp, Escherichia coli
atgaacaatgcaccgcatttgtatttcgcctggcaacaactcgtcgaaaaaagccagctcatgttacgcctggcaacggaagaacaatgggacgaactcatcgccagcgaaatggcgtatgtgaatgcggtgcaggagatcgcacacctgactgaagaggttgccccgtccactacgatgcaggagcagctccgcccgatgctgcacctgattctcgacaacgaaagcaaggtaaagcagttattacagattcggatggatgaactggcgaaactggtcggtcagtcatcggtgcaaaaatcggtgttaagtgcctatggcgatcagggcggctttgtgctggctccgcaggataacctcttttga

SEQ ID NO: 4660 - protein, 121 aa, Escherichia coli
MNNAPHLYFAWQQLVEKSQLMLRLATEEQWDELIASEMAYVNAVQEIAHLTEEVAPSTTMQEQLRPMLHLILDNESKVKQLLQIRMDELAKLVGQSSVQKSVLSAYGDQGGFVLAPQDNLF

SEQ ID NO: 4661 - DNA, 1488 bp, Escherichia coli
atgcgtaatcccacgctgttacaatgttttcactggtattacccggaaggcggtaagctctggcctgaactggccgagcgcgcagacggttttaatgatattggtatcaatatggtctggttgccgcccgcctataaaggcgcatcgggcgggtattcggtcggctacgactcctatgatttatttgatttaggtgagtttgatcagaaaggctgcatccctactaaatatggtgataaagcacaactgctggccgccattgacgccctgaaacgtaatgacattgcggtgctgctggacgtggtagtcaaccacaaaatgggcgcagatgaaaaagaagctattcgcgtgcagcgtgtaaatgctgatgaccgtacgcaaattgacgaagaaatcattgagtgtgaaggctggacgcgttacaccttccccgctcgtgccgggcaatactcgcagtttatctgggatttcaaatgttttagcggtatcgaccatatcgaacaccctgatgaagatggcatttttaaaattgttaacgactataccggagaaggctggaacgatcaggttgatgatgaactcggtaatttcgattatctgatgggtgagaatatcgattttcgcaatcatgccgtgacggaagagattaaatactgggcgcgctgggtgatggaacaaacgcaatgcgacggctttcgtcttgatgcggtcaaacatattccggcatggttttataaagagtggatcgaacacgtacaggaagttgcgccaaagccgctgtttattgtggctgaatactggtcgcatgaagtcgataaactgcaaacgtatattgatcaggtggaaggcaaaaccatgctgtttgatgcgccgctgcagatgaaattccatgaagcatcgcgcatgggtcgcgactacgacatgacgcagatcttcactgggacgctggtggaagccgatccttttcacgccgtaaccctcgttgccaaccacgacacccaaccgttgcaagccctcgaagcaccggtcgaaccgtggtttaaaccgctggcgtatgccttaattttgttgcgggaaaatggcgttccttcggtgttctatccggacctctacggtgcacattacgaagatgtcggtggtgacgggcaaacctatccgatagatatgccaataatcgaacagcttgatgagttaattctcgcccgtcagcgtttcgcccacggtgtacagacgttatttttcgaccatccgaactgcattgcctttagccgcagtggcaccgacgaatatcccggctgcgtggtggtcatgtcgaacggagatgatggcgaaaaaaccattcatctgggagagaattacggcaataaaacctggcgtgattttctggggaaccggcaagagagcgtagtgacagacgaaaacggcgaagcgaccttcttttgcaacggcggcagcgttagcgtgtgggttatcgaagaggtgatttaa

SEQ ID NO: 4662 - protein, 495 aa, Escherichia coli
MRNPTLLQCFHWYYPEGGKLWPELAERADGFNDIGINMVWLPPAYKGASGGYSVGYDSYDLFDLGEFDQKGCIPTKYGDKAQLLAAIDALKRNDIAVLLDVVVNHKMGADEKEAIRVQRVNADDRTQIDEEIIECEGWTRYTFPARAGQYSQFIWDFKCFSGIDHIEHPDEDGIFKIVNDYTGEGWNDQVDDELGNFDYLMGENIDFRNHAVTEEIKYWARWVMEQTQCDGFRLDAVKHIPAWFYKEWIEHVQEVAPKPLFIVAEYWSHEVDKLQTYIDQVEGKTMLFDAPLQMKFHEASRMGRDYDMTQIFTGTLVEADPFHAVTLVANHDTQPLQALEAPVEPWFKPLAYALILLRENGVPSVFYPDLYGAHYEDVGGDGQTYPIDMPIIEQLDELILARQRFAHGVQTLFFDHPNCIAFSRSGTDEYPGCVVVMSNGDDGEKTIHLGENYGNKTWRDFLGNRQESVVTDENGEATFFCNGGSVSVWVIEEVI

SEQ ID NO: 4663 - DNA, 384 bp, Escherichia coli
atgttgctggcgggctgtgccgaagtcgaaaactataacaatgtcgtgaaaacccccgcgccggactggctgacgggttactggcagaccaaagggccgcaacgtgcgctggtcagtccggaagcgataggcagcctcattgtcactaaagagggcgataccctggattgccgtcagtggcagcgggtgattgccgtgccgggtaagttgacattgatgtctgatgatctcactaacgttaccgtaaaacgtgagctgtacgaggttgagcgtgacggtaacaccattgagtacgatggtatgacgatggagcgtgtggatcgcccgacggcagagtgtgccgccgcgctggataaagcgccgttaccgacgccactgccgtaa

SEQ ID NO: 4664 - protein, 127 aa, Escherichia coli
MLLAGCAEVENYNNVVKTPAPDWLTGYWQTKGPQRALVSPEAIGSLIVTKEGDTLDCRQWQRVIAVPGKLTLMSDDLTNVTVKRELYEVERDGNTIEYDGMTMERVDRPTAECAAALDKAPLPTPLP

SEQ ID NO: 4665 - DNA, 1206 bp, Escherichia coli
atgtcatggcagcaattcaaacacgcctggttgattaaattctgggcacccatccctgcggtcatcgcggcgggtattctctccacttactattttggcatcactggcacattttgggcagtcacgggtgaatttacccgttggggcggtcagctcctgcagttgttcggcgtccatgctgaagagtggggttattttaaaattatccatctggaaggatcgccattaacccgcatcgacggaatgatgatcctcggtatgtttggcggctgttttgccgcagcgctgtgggccaacaatgtcaaactgcgcatgccgcgcagccgtatccgcattatgcaggccatcattggcggtattatcgccggttttggcgcacgtctggcaatgggctgtaacctggcggcgttctttaccggaattccacagttctcgctgcacgcctggttctttgccatcgccactgccattggttcatggtttggcgcgcgctttaccctgctgcccatcttccgtattcccgtgaaaatgcagaaagtttctgccgcctcaccgctgacgcaaaaaccggatcaggcgcggcgtcgttttcgtctcgggatgctggtctttttcggcatgctgggctgggcgctgctcacggcgatgaaccaacccaaactggggctggcaatgctgtttggcgtcggctttggtttactgattgaacgtgcgcaaatctgctttacttcggcgttccgcgatatgtggatcaccggacgtacccatatggcgaaagcaatcattatcggtatggcggtaagtgccatcgggatcttcagttacgtacagttaggcgttgaacccaaaatcatgtgggcgggaccaaacgcggtaattggtggtttactgtttggttttggcatcgtgctggcaggcggctgcgaaaccggctggatgtaccgcgcggtagaaggccaggtgcactactggtgggtcggtctgggcaacgtgatcggctcaacgattctggcgtattactgggatgatttcgctccggcgctggccaccgactgggacaaaatcaacctgctgaaaacctttggtccgatgggtggcctgctggtgacatatttgctgttgtttgcagctctaatgttgattatcggctgggaaaaacgcttcttccgccgtgcggcaccgcagattgctaaggagatcgcatga

SEQ ID NO: 4666 - protein, 401 aa, Escherichia coli
MSWQQFKHAWLIKFWAPIPAVIAAGILSTYYFGITGTFWAVTGEFTRWGGQLLQLFGVHAEEWGYFKIIHLEGSPLTRIDGMMILGMFGGCFAAALWANNVKLRMPRSRIRIMQAIIGGIIAGFGARLAMGCNLAAFFTGIPQFSLHAWFFAIATAIGSWFGARFTLLPIFRIPVKMQKVSAASPLTQKPDQARRRFRLGMLVFFGMLGWALLTAMNQPKLGLAMLFGVGFGLLIERAQICFTSAFRDMWITGRTHMAKAIIIGMAVSAIGIFSYVQLGVEPKIMWAGPNAVIGGLLFGFGIVLAGGCETGWMYRAVEGQVHYWWVGLGNVIGSTILAYYWDDFAPALATDWDKINLLKTFGPMGGLLVTYLLLFAALMLIIGWEKRFFRRAAPQIAKEIA

SEQ ID NO: 4667 - DNA, 234 bp, Escherichia coli
atgaaaaatatcgttcctgattaccgtcttgatatggtgggtgaaccctgcccttatccggctgtcgcaacccttgaggcgatgccgcagttaaaaaaaggggagatcctggaagtggtgagcgactgtccgcagtcgatcaataatattccactggatgcgcgtaatcacggctatacggtgctggatattcagcaagacgggccgaccattcgttatttaattcagaagtaa

SEQ ID NO: 4668 - protein, 77 aa, Escherichia coli
MKNIVPDYRLDMVGEPCPYPAVATLEAMPQLKKGEILEVVSDCPQSINNIPLDARNHGYTVLDIQQDGPTIRYLIQK

SEQ ID NO: 4669 - DNA, 669 bp, Escherichia coli
atgtgtggacgctttgcccaatcccaaacgcgtgaagattacctcgcgtttctcgcggaagatattgaacgcgatattccctacgatcccgaacctattggcagatacaacgtcgcgccgggaaccaaagtccttctgctcagtgaacgtgatgaacaccttcatctggatccggttttctggggatatgctcccggatggtgggataaaccgccgctgattaacgcccgcgtagaaactgccgcaaccagtcgcatgtttaaaccgctctggcaacatggtcgggtaatatgctttgccgatggctggtttgagtggaaaaaagaaggcgacaaaaaacagccttattttatctatcgcgctgatggacaacctgtttttatagccgcgataggtagcacaccgtttgagcgcggtgacgaagccgaaggagttttaattgtcactgcagcagcagaccagggcctggtagatattcatgaccgccgcccgctggtactgtcgccagaaactgcgcgggaatggatgcggcaagacattggtggtaaagaagcctcagaaatcgctaccagaagctgtgtgccagcaaaccagttcatctggcaccctgtgtcgcgcgcggtgggtaatgttaaaaaccagggcgcggagttaattcaacctgtttga

SEQ ID NO: 4670 - protein, 222 aa, Escherichia coli
MCGRFAQSQTREDYLAFLAEDIERDIPYDPEPIGRYNVAPGTKVLLLSERDEHLHLDPVFWGYAPGWWDKPPLINARVETAATSRMFKPLWQHGRVICFADGWFEWKKEGDKKQPYFIYRADGQPVFIAAIGSTPFERGDEAEGVLIVTAAADQGLVDIHDRRPLVLSPETAREWMRQDIGGKEASEIATRSCVPANQFIWHPVSRAVGNVKNQGAELIQPV

SEQ ID NO: 4671 - DNA, 1083 bp, Escherichia coli
atgaaaaaattaacagtggcaatttctgctgtagctgcatcagtactgatggcgatgtctgctcaggcagcagagatttacaataaagacagtaacaagctggatctgtacggaaaagttaatgctaagcactacttctcttctaacgatgcagatgatggcgacacaacttatgttcgtctgggcttcaaaggcgaaactcaaatcaacgatcaactgactggtttcggtcagtgggaatatgaattcaaaggcaaccgtgctgaatctcaaggttcttccaaagataaaacccgtcttgccttcgctggcctgaaattcggtgactacggctccatcgattatggccgtaactacggtgtagcatacgatatcggtgcatggaccgacgttctgccagaattcggtggcgatacctggacccaaacagatgtgttcatgactggtcgcaccacaggtgttgcaacctatcgtaacaacgacttctttggtctggttgatggtctgaactttgctgctcagtatcagggtaaaaatgaccgcactgacgtaactgaagctaacggtgatggtttcggtttctccactacttatgagtatgaaggattcggtgtaggtgcaacctatgctaaatctgaccgcactaatgatcaggttatctacggtaacaacagcctgaatgcatctggtcaaaatgctgaagtatgggcagctggtctgaaatatgatgcgaacaacatctatctggctaccacctattctgaaacccagaacatgactgtttttggtaataaccatattgccaacaaagcacaaaacttcgaagtagttgcacaatatcagttcgacttcggtctgcgtccgtccgttgcttacctgcaatctaaaggaaaagacttgggtgcgtggggtgatcaggacctggttgaatatattgatgtaggtgcaacctattacttcaacaaaaatatgtccacttttgttgattacaaaatcaacctgattgataagagcgatttcacgaaagcatctggcgttgctaccgatgatatcgttgctgtaggattggtttaccagttctaa

SEQ ID NO: 4672 - protein, 360 aa, Escherichia coli
MKKLTVAISAVAASVLMAMSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 4673 - DNA, 798 bp, Escherichia coli
atgctggcaaaagataagtctaacctaaagattgaagaaatacggatgcataaacatcatgagattcacagggttaagcctcttatgccagctttatgtcgtatccgtcagggaaaaaaagttatcaattgggagacgcatagtctaactgttgataataatcagataatattatttccctgtggatatgaattttatattgcgaattatccagaagcaggtctttatcttgcagaaatgctttattatcccattgatctaattgaaaagtttcaaaaattttatgcgataactgatcaaattcgtaacacgacaggtttctgcttacctcagaaccccgagttaatatattgttgggagcaactaaaaacatctattttccgaggcttctcaacgcaaattcaggaacacttagcaatgggcgttctactttcattaggagcacatcatgttaattgtttacttttatcagatagtaaacaatcattaataagtcgttgttataacctaatgctatccgaacctggaacaaaatggacagcaaacaaggtagcgagatatctctacatttctgtttccacattgcatcgccgtctggcaagcgagggaataagttttcaaagtatattggacgacgtgaggttaaataatgcgttgtctgctatacaaacgacagtaaaacccatcagcgagattgccagggaaaatggttacaagtgtccttctcgttttactgaaaggttccataatcgttttaagataacaccaagagagctaagaaaagcgtccagagagtaa

SEQ ID NO: 4674 - protein, 265 aa, Escherichia coli
MLAKDKSNLKIEEIRMHKHHEIHRVKPLMPALCRIRQGKKVINWETHSLTVDNNQIILFPCGYEFYIANYPEAGLYLAEMLYYPIDLIEKFQKFYAITDQIRNTTGFCLPQNPELIYCWEQLKTSIFRGFSTQIQEHLAMGVLLSLGAHHVNCLLLSDSKQSLISRCYNLMLSEPGTKWTANKVARYLYISVSTLHRRLASEGISFQSILDDVRLNNALSAIQTTVKPISEIARENGYKCPSRFTERFHNRFKITPRELRKASRE

SEQ ID NO: 4675 - DNA, 123 bp, Escherichia coli
atgctccaccaaatcctgcataaccaaaatcatttcggccttgaacagcaccagtcggaagttttgtaccatcacgtcttcctgcatcagtgggcaaatatgttacagttgctggaatattag

SEQ ID NO: 4676 - protein, 40 aa, Escherichia coli
MLHQILHNQNHFGLEQHQSEVLYHHVFLHQWANMLQLLEY

SEQ ID NO: 4677 - DNA, 330 bp, Escherichia coli
aacccttatatttatcttggtggcgcaatacttgcagaggtcattggtacaaccttaatgaagttttcagaggggtttacacggttatggccctctgttggcacaattatttgctattgtgcctcattctggttattagctcagacgctggcttatatacctacagggattgcttatgctatctggtcaggagtcggtatcgttctgattagtttgctttcctggggattttttggtcaacgactggacctgccagctatcataggcatgatgttgatttgtgccggtgtgttagtcattaacttgttgtcacgaagtgcaccgcattaa

SEQ ID NO: 4678 - protein, 109 aa, Escherichia coli
NPYIYLGGAILAEVIGTTLMKFSEGFTRLWPSVGTIICYCASFWLLAQTLAYIPTGIAYAIWSGVGIVLISLLSWGFFGQRLDLPAIIGMMLICAGVLVINLLSRSAPH

SEQ ID NO: 4679 - DNA, 315 bp, Escherichia coli
atgtcagcgatacaggggattgaaggggttatcagccagttacaggctacggcgatgagtgcgcgtgcgcaggaatcactgccgcaaccgaccattagttttgccgggcagctgcacgccgcgctcgatcgcataagcgatacacaaacagtcgcccgcacgcaggcagaaaaattcaccctcggtgaacccggcgtggcgctaaacgatgtgatgaccgatatgcaaaaagcctcagtttctatgcaaatggggattcaggtgcgtaataagctggtggcggcgtatcaggaagtgatgtccatgcaggtgtag

SEQ ID NO: 4680 - protein, 104 aa, Escherichia coli
MSAIQGIEGVISQLQATAMSARAQESLPQPTISFAGQLHAALDRISDTQTVARTQAEKFTLGEPGVALNDVMTDMQKASVSMQMGIQVRNKLVAAYQEVMSMQV

SEQ ID NO: 4681 - DNA, 1659 bp, Escherichia coli
atgaatgcgactgcagcccagacaaaatctcttgagtggcttaatcgcctgcgtgcgaatccgaaaattccattgattgttgccggttccgcagcagtggcggtcatggtcgcactgatcctgtgggcgaaagcccccgactaccgcacattattcagcaatctttccgatcaggatggtggcgcaattgtcagccaactgacgcaaatgaatattccttaccgcttcagcgaagccagcggcgctattgaggttccggcagataaagttcacgaactgcgcctgcgcctggcgcaacaaggtttgcccaaaggcggcgcggtcggtttcgaactgctcgatcaggaaaagtttggtatcagccagttcagcgaacaggtgaattatcagcgggcgctggaaggcgagctttctcgtaccatcgaaactatcggcccggtaaaaggggcgcgcgtacatctggcaatgccgaaaccgtctttattcgtccgtgaacaaaaatccccttctgcatcggtgacggtaaatctgttacccggccgcgcactcgatgaagggcaaattagcgctattgtacatctggtttccagcgcggttgctggtctgccgccaggaaacgtcacgctggtggatcagggcgggcatctgttaacccagtccaataccagcgggcgcgatcttaatgacgctcagttgaaatatgccagcgatgtcgaaggccgtattcagcggcgtattgaagcgatcctgtcgcctattgttggtaacggtaatattcacgcccaggtcacggcgcaactggacttcgccagtaaagaacaaacggaagaacagtatcgccctaacggtgatgaatctcatgcggcgcttcgttcacgccagcttaatgagagcgagcaaagcggttccggttatccgggcggcgtaccgggagcgttgtcgaatcaaccggcacctgcgaataacgcgccaatcagcacgcctccggcaaatcaaaataaccgccagcagcaggcgagcaccaccagcaatagtgggccgcgtagcacacagcggaatgaaaccagtaactacgaagtcgatcgcaccattcgtcataccaaaatgaacgtgggcgatgtgcaacgtctgtcagtcgcggtagtggtgaattacaaaaccttgccagacggtaaaccattgcctctcagcaacgaacagatgaagcaaattgaagctctgacccgcgaggcgatgggcttttctgaaaaacgcggtgattcgctcaatgttgttaactcgccgttcaatagcagtgacgaaagcggcggagcactgccgttctggcaacagcaagtgtttatcgatcagttgctggctgccggtcgctggttgctggtactgctggtggcgtggttgctgtggcggaaagcggtacgcccgcagctaacacgtcgcgccgaggcggtgaagactgtgcagcaacaggcgcaggcccgcgaggaagtggaagatgcggtggaagtccgtctgagcaaagacgaacaactccaacaacggcgcgctaaccaacgactgggggcagaagtcatgagccagcgtatccgtgaaatgtctgataacgatccgcgcgtggtggcgctggtcattcgccagtggataaataacgatcatgagtaa

SEQ ID NO: 4682 - protein, 552 aa, Escherichia coli
MNATAAQTKSLEWLNRLRANPKIPLIVAGSAAVAVMVALILWAKAPDYRTLFSNLSDQDGGAIVSQLTQMNIPYRFSEASGAIEVPADKVHELRLRLAQQGLPKGGAVGFELLDQEKFGISQFSEQVNYQRALEGELSRTIETIGPVKGARVHLAMPKPSLFVREQKSPSASVTVNLLPGRALDEGQISAIVHLVSSAVAGLPPGNVTLVDQGGHLLTQSNTSGRDLNDAQLKYASDVEGRIQRRIEAILSPIVGNGNIHAQVTAQLDFASKEQTEEQYRPNGDESHAALRSRQLNESEQSGSGYPGGVPGALSNQPAPANNAPISTPPANQNNRQQQASTTSNSGPRSTQRNETSNYEVDRTIRHTKMNVGDVQRLSVAVVVNYKTLPDGKPLPLSNEQMKQIEALTREAMGFSEKRGDSLNVVNSPFNSSDESGGALPFWQQQVFIDQLLAAGRWLLVLLVAWLLWRKAVRPQLTRRAEAVKTVQQQAQAREEVEDAVEVRLSKDEQLQQRRANQRLGAEVMSQRIREMSDNDPRVVALVIRQWINNDHE

SEQ ID NO: 4683 - DNA, 924 bp, Escherichia coli
gtgttcaagcacctctcccagcgcgaagtgcaaaccctgagcgctgcaatggcgaacgtcacgcagatctccaacaagcagctaaccgatgtgctggcggagtttgagcaagaagctgaacagtttgctgcactgaatatcaacgccaacgattatctgcgttcggtattggtcaaagctctgggtgaagaacgtgccgccagcctgctggaagatattctcgaaacccgcgataccgccagcggtattgaaacgctcaactttatggagccgcagagcgccgccgatctgattcgcgatgagcatccgcaaattatcgccaccattctggtgcatctgaagcgcgcccaggccgccgatattctggcgttgttcgatgaacgtctgcgccacgacgtgatgttgcgtatcgccacctttggcggcgtgcagccagccgcgctggccgaactgaccgaagtactgaatggcttgctcgacggtcagaatctcaagcgcagcaaaatgggcggcgtgagaacggcagccgaaattatcaacctgatgaaaacgcagcaggaagaagccgttattaccgccgtgcgtgaattcgacggcgagctggcgcagaaaatcatcgacgagatgttcctgttcgagaatctggtggatgtcgacgatcgcagcattcagcgactgttgcaggaagtggattccgaatcgctgttgatcgcgctgaaaggggccgagcagccactgcgcgagaaattcctgcgcaatatgtcgcagcgtgccgccgatattctgcgcgacgatctcgccaaccgtggtccggtgcgtctgtcgcaggtggaaaacgaacagaaagcgattctgctgattgtgcgccgccttgccgaaactggcgagatggtgattggcagcggcgaggatacctatgtctga

SEQ ID NO: 4684 - protein, 307 aa, Escherichia coli
MFKHLSQREVQTLSAAMANVTQISNKQLTDVLAEFEQEAEQFAALNINANDYLRSVLVKALGEERAASLLEDILETRDTASGIETLNFMEPQSAADLIRDEHPQIIATILVHLKRAQAADILALFDERLRHDVMLRIATFGGVQPAALAELTEVLNGLLDGQNLKRSKMGGVRTAAEIINLMKTQQEEAVITAVREFDGELAQKIIDEMFLFENLVDVDDRSIQRLLQEVDSESLLIALKGAEQPLREKFLRNMSQRAADILRDDLANRGPVRLSQVENEQKAILLIVRRLAETGEMVIGSGEDTYV

SEQ ID NO: 4685 - DNA, 621 bp, Escherichia coli
gtgccaatggtcgagccggaagaaaccatcattgaagaggccgaacccagccttgagcagcaactggcgcaactgcaaatgcaggcccacgagcaaggttatcaggcggggattgccgaaggtcgccagcaaggtcatgagcagggctatcaggaaggcctggcccaggggctggaacaaggtctggcagaggcgaagtctcaacaagcgccaattcatgcccggatgcagcaactggtcagcgaatttcaaactacccttgatgcgcttgatagtgtgattgcttcgcgcctgatgcagatggcgctggaggcggcacgccaggtgatcggtcagacgccaacggtggacaactcggcactgatcaaacagatccaacagttgttgcagcaagaaccgttgttcagcggtaaaccgcagctgcgcgtgcaccccgatgatctgcaacgtgttgatgatatgctcggcgcaactttaagtttgcatggctggcgcttgcggggcgatcccaccctccatcctggcggctgtaaagtctccgccgatgaaggcgatctcgacgccagtgtcgccacccgctggcaagaactctgccgtctggcagcaccaggagtggtgtaa

SEQ ID NO: 4686 - protein, 206 aa, Escherichia coli
MPMVEPEETIIEEAEPSLEQQLAQLQMQAHEQGYQAGIAEGRQQGHEQGYQEGLAQGLEQGLAEAKSQQAPIHARMQQLVSEFQTTLDALDSVIASRLMQMALEAARQVIGQTPTVDNSALIKQIQQLLQQEPLFSGKPQLRVHPDDLQRVDDMLGATLSLHGWRLRGDPTLHPGGCKVSADEGDLDASVATRWQELCRLAAPGVV

SEQ ID NO: 4687 - DNA, 1374 bp, Escherichia coli
atgaccacgcgcctgactcgctggctaaccacgctggataactttgaagccaaaatggcgcagttgcctgcggtacgtcgctatgggcgattaacccgcgctaccgggctggtgctggaagccaccggattacaattgccgctcggcgcaacctgtgtgattgagcgccagaacggcagcgaaacgcacgaagtagaaagcgaagtcgttggctttaacggtcaacgactgtttttaatgccgctggaggaagtggaaggtgtcctgcccggcgcgcgtgtttatgccaaaaacatttcggctgaagggctgcaaagcggcaagcagttgccgctcggtccggcgttattaggtcgcgttctggacggcagcggtaaaccgctcgatggcctcccctcccccgatacgacggaaaccggtgcgctgattaccccgccatttaacccattgcaacgtacaccgattgaacatgtgctggacaccggcgtgcgcccaatcaatgccctgcttaccgtcgggcgcgggcagcgtatggggctgtttgccgggtccggcgttggtaaaagtgtgctgctggggatgatggcccgttacacccgcgccgatgtcattgtcgtgggtttgattggtgaacgagggcgcgaagtaaaagattttattgagaatatcctcggtgccgaaggacgtgcacgctccgtggtgattgccgctccggcggatgtttctccgctcctgcgaatgcagggcgccgcctatgccacgcgcattgccgaagattttcgcgatcgtggtcagcatgtgttgctgattatggactccctcacccgctatgcgatggcccagcgtgaaattgcgctggcgattggcgaaccacctgccactaaaggttatccaccgtcggtgtttgccaaattaccggcactggtcgagcgtgccggaaatggcattagcggcggcggctcgattaccgcgttttataccgtgctcaccgaaggcgatgaccagcaggaccccattgccgactccgcgcgggcaatcctcgacggtcacattgtgctgtctcgccgactggcggaagccgggcactatccggctatcgatatcgaagcgtcgatcagtcgcgcaatgacggcgttgatcagtgagcaacattacgcgcgagtgcgcaccttcaaacagctgttgtcgagttttcagcgtaaccgcgatctggttagcgtcggcgcgtatgccaaaggcagcgatccgatgctcgacaaagccatcgccctgtggccgcagctggagagctatttgcaacaaggcatttttgaacgcgcggactgggaagcgtctctccaggggctggagcgtattttcccgacagtgtcataa

SEQ ID NO: 4688 - protein, 457 aa, Escherichia coli
MTTRLTRWLTTLDNFEAKMAQLPAVRRYGRLTRATGLVLEATGLQLPLGATCVIERQNGSETHEVESEVVGFNGQRLFLMPLEEVEGVLPGARVYAKNISAEGLQSGKQLPLGPALLGRVLDGSGKPLDGLPSPDTTETGALITPPFNPLQRTPIEHVLDTGVRPINALLTVGRGQRMGLFAGSGVGKSVLLGMMARYTRADVIVVGLIGERGREVKDFIENILGAEGRARSVVIAAPADVSPLLRMQGAAYATRIAEDFRDRGQHVLLIMDSLTRYAMAQREIALAIGEPPATKGYPPSVFAKLPALVERAGNGISGGGSITAFYTVLTEGDDQQDPIADSARAILDGHIVLSRRLAEAGHYPAIDIEASISRAMTALISEQHYARVRTFKQLLSSFQRNRDLVSVGAYAKGSDPMLDKAIALWPQLESYLQQGIFERADWEASLQGLERIFPTVS

SEQ ID NO: 4689 - DNA, 444 bp, Escherichia coli
atggcggaacatggtgcgctggcgaccctgaaagatctggcagaaaaagaggtagaggatgccgctcgcctgctgggtgaaatgcgtcgcggatgtcagcaggcggaagaacagctcaaaatgctgatcgattatcagaatgaatatcgcaataacctcaatagcgatatgagtgccgggatgaccagcaaccgctggatcaactatcagcagtttatccagacgctggaaaaagccattactcagcatcgccagcaacttaatcagtggacgcagaaagttgacattgccctgaacagctggcgagaaaagaaacaacgtttgcaggcctggcagacactgcagaaacggcaatccacggcggcactgcttgcagaaaaccgcctcgatcagaaaaagatggatgagttcgcccagcgcgccgccatgaggaaacctgaatga

SEQ ID NO: 4690 - protein, 147 aa, Escherichia coli
MAEHGALATLKDLAEKEVEDAARLLGEMRRGCQQAEEQLKMLIDYQNEYRNNLNSDMSAGMTSNRWINYQQFIQTLEKAITQHRQQLNQWTQKVDIALNSWREKKQRLQAWQTLQKRQSTAALLAENRLDQKKMDEFAQRAAMRKPE

SEQ ID NO: 4691 - DNA, 1128 bp, Escherichia coli
atgattcgcttagcgcccttgattaccgccaacgttgacaccaccacattgcctggcggcaaagccagcgatgctgcacaagattttctcgcgttgttgagcgaagcattagcaggcgagacaacaaccgacaaagcggccccccagttgctggtggcaacagataagcccacgacaaaaggcgaaccgctggtcagcgatattgtttccgatgcgcaacaagcggatttactgatccctgtggatgaaacacttcctgtcatcaacgacgaacaatccacatcaacaccgttaaccaccgctcagacgatgacgttggctgcggtggctgacaaaaatacgacaaaagacgaaaaagcggatgaccttaatgaagacgtcaccgcaagtctgagcgccctttttgcgatgttgccgggttttgacaatacgcccaaagtgactgatgcaccgtcaaccgtgttaccggcagagaaaccaacgctcttcacaaaactgacttctgcgcaactcactacagcacagcctgatgacgcccccggcacaccagctcagccattaacaccgctggtagcagaagcccagagtaaagcggaagtcatcagcacgccttcgccggtgaccgctgacgccagcccgctaatcactccacaccagacacagccactgcccaccgtcgccgcgcctgttttgagtgcaccgctgggttctcacgaatggcaacaatcattaagccagcatatttcgctgttcacccgccaggggcaacaaagtgcagagttgcgtctgcacccacaggatttaggtgaagtgcaaatttccctcaaagtggatgataaccaggcgcagatccagatgatttcaccgcatcagcacgtacgcgccgccctggaagcagcgctgccggtactgcgtacgcagctggccgaaagtggcattcagttagggcaaagcaacatcagtggcgaaagctttagtggtcagcagcaggccgcttcccagcaacagcaaagccaacgcacagcaaaccatgaacctctggcgggggaagacgacgatacgcttccggttcccgtctctttacaagggcgtgtaacaggtaacagcggcgttgatattttcgcctaa

SEQ ID NO: 4692 - protein, 375 aa, Escherichia coli
MIRLAPLITANVDTTTLPGGKASDAAQDFLALLSEALAGETTTDKAAPQLLVATDKPTTKGEPLVSDIVSDAQQADLLIPVDETLPVINDEQSTSTPLTTAQTMTLAAVADKNTTKDEKADDLNEDVTASLSALFAMLPGFDNTPKVTDAPSTVLPAEKPTLFTKLTSAQLTTAQPDDAPGTPAQPLTPLVAEAQSKAEVISTPSPVTADASPLITPHQTQPLPTVAAPVLSAPLGSHEWQQSLSQHISLFTRQGQQSAELRLHPQDLGEVQISLKVDDNQAQIQMISPHQHVRAALEAALPVLRTQLAESGIQLGQSNISGESFSGQQQAASQQQQSQRTANHEPLAGEDDDTLPVPVSLQGRVTGNSGVDIFA

SEQ ID NO: 4693 - DNA, 465 bp, Escherichia coli
atgactgattacgcgataagcaagaaaagcaagcgatcgctttggatcccgattctggtattcattaccctcgcggcctgtgccagcgcaggttacagctactggcattcgcatcaggttgccgctgacgacaaagcgcagcaacgcgtcgtgccctccccggtcttctatgcgctggatacctttacggtcaatttgggcgatgcggatcgcgtgctttatatcggcataaccctgcgactgaaagatgaagctacccgctcgcggctgagtgagtatttgccggaagtccgtagccgtttgctgttactgttttcgcgtcaggatgctgccgtactggcgacagaagaaggcaagaaaaacctgattgccgagattaaaaccacactttccaccccgcttgttgccgggcaaccgaaacaggatgtcaccgacgtgctgtataccgcttttattctgcgataa

SEQ ID NO: 4694 - protein, 154 aa, Escherichia coli
MTDYAISKKSKRSLWIPILVFITLAACASAGYSYWHSHQVAADDKAQQRVVPSPVFYALDTFTVNLGDADRVLYIGITLRLKDEATRSRLSEYLPEVRSRLLLLFSRQDAAVLATEEGKKNLIAEIKTTLSTPLVAGQPKQDVTDVLYTAFILR

SEQ ID NO: 4695 - DNA, 1050 bp, Escherichia coli
atgtcaccgacgtgctgtataccgcttttattctgcgataacgacatgggcgatagtattctttctcaagctgaaattgatgcgctgttgaatggcgacagcgaagtcaaagacgaaccgacagccagtgttagcggcgaaagtgacattcgtccgtacgatccgaatacccaacgacgggttgtgcgcgaacgtttgcaggcgctggaaatcattaatgagcgctttgctcgccattttcgtatggggctgttcaacctgctgcgccgtagcccggatattaccgtcggggccatccgcattcagccgtaccatgaatttgcccgcaacctgccggtgccgaccaacctgaaccttattcatctgaaaccgctgcgcggcacagggctggtggtgttctcgccgagtctggtgtttatcgccgtggataacctgtttggcggcgatggacgcttcccgaccaaagtggaaggccgcgagtttacccataccgaacagcgcgtcatcaaccgcatgttgaaactggcgcttgaaggctatagcgacgcatggaaggcgattaatccgctggaagttgagtacgtgcgttcggaaatgcaggtgaaatttaccaatatcaccacctcgccaaacgacattgtggttaacacgccgttccatgtggagattggcaacctgaccggcgaatttaatatctgcctgccattcagcatgatcgagccgctacgggaattgttggttaacccgccgctggaaaactcgcgtaatgaagatcagaactggcgcgataacctggtgcgccaggtgcagcattcacagctggaactggtggccaactttgccgatatctcgctacgcctgtcgcagattttaaaactgaaacccggcgacgtcctgccgatagaaaaacccgatcgcatcatcgcccatgttgacggcgtcccggttctgaccagtcagtacggcactctcaacggtcagtatgcgttacggatagaacatttgattaacccgattttaaattctctgaacgaggaacagcccaaatga

SEQ ID NO: 4696 - protein, 349 aa, Escherichia coli
MSPTCCIPLLFCDNDMGDSILSQAEIDALLNGDSEVKDEPTASVSGESDIRPYDPNTQRRVVRERLQALEIINERFARHFRMGLFNLLRRSPDITVGAIRIQPYHEFARNLPVPTNLNLIHLKPLRGTGLVVFSPSLVFIAVDNLFGGDGRFPTKVEGREFTHTEQRVINRMLKLALEGYSDAWKAINPLEVEYVRSEMQVKFTNITTSPNDIVVNTPFHVEIGNLTGEFNICLPFSMIEPLRELLVNPPLENSRNEDQNWRDNLVRQVQHSQLELVANFADISLRLSQILKLKPGDVLPIEKPDRIIAHVDGVPVLTSQYGTLNGQYALRIEHLINPILNSLNEEQPK

SEQ ID NO: 4697 - DNA, 414 bp, Escherichia coli
atgagtgacatgaataatccggccgatgacaacaacggcgcaatggacgatctgtgggctgaagcgttgagcgagcaaaaatcaaccagcggaaaaagcgctgccgacgcggtgttccagcaatttggcggtggtgatgtcagcggggcgttgcaggatatcgacctgattatggatattccggtcaagctgaccgtcgagctgggccgtacgcggatgaccatcaaagagctgttgcgtctgacgcaagggtcagtcgtggcgctggacggtctggcgggcgaaccgctggatattctgatcaacggttatttaatcgcccagggcgaagtggtggttgttgccgataaatatggcgtgcggatcaccgatatcattaccccgtccgagcggatgcgccgcctgagccgttag

SEQ ID NO: 4698 - protein, 137 aa, Escherichia coli
MSDMNNPADDNNGAMDDLWAEALSEQKSTSGKSAADAVFQQFGGGDVSGALQDIDLIMDIPVKLTVELGRTRMTIKELLRLTQGSVVALDGLAGEPLDILINGYLIAQGEVVVVADKYGVRITDIITPSERMRRLSR

SEQ ID NO: 4699 - DNA, 369 bp, Escherichia coli
gtgatgaataaccacgctactgtgcaatcttccgcgccggtatctgctgcgccactgctgcaggtgagcggcgcactcatcgccattattgccctgatcctcgctgctgcctggctggtaaaacggctgggatttgcccctaaacgcactggcgttaacggtctgaaaattagcgccagtgcttcactgggcgcgcgtgaacgggttgtggtggtcgatgtggaagatgcacggctggtgctcggcgttaccgcagggcaaatcaatctgctgcataaacttcccccttcagcaccaacggaagagataccgcagaccgattttcagtcggttatgaaaaacttgcttaagcgtagcgggagatcctga

SEQ ID NO: 4700 - protein, 122 aa, Escherichia coli
MMNNHATVQSSAPVSAAPLLQVSGALIAIIALILAAAWLVKRLGFAPKRTGVNGLKISASASLGARERVVVVDVEDARLVLGVTAGQINLLHKLPPSAPTEEIPQTDFQSVMKNLLKRSGRS

SEQ ID NO: 4701 - DNA, 426 bp, Escherichia coli
atgaaaatcaagcatgaacacatccgcatggcaatgaatgcctgggcgtatccagacggtgagaaagttccagcagctgaaatagcccggacttatttcgagctgggaatgacgttcccggaactgtatgacgacagccatccggaagccctggctcgcaatacccagaaaattttccgctgggtagagaaagacacccctgatgcagttgaaaaaattcaggcgttgttaccagcgatcgaaaaggcaatgccacctttgctggtggccagaatgcgcagccacagttcagcttattttcgggagctggtggagacgcgggagcgactggtgagagacgctgatgattttgtcgcagtggcaatcgccggtttcaatcagatgaaccgtggtggcccggcaggaaatgctgtggcagtacattga

SEQ ID NO: 4702 - protein, 141 aa, Escherichia coli
MKIKHEHIRMAMNAWAYPDGEKVPAAEIARTYFELGMTFPELYDDSHPEALARNTQKIFRWVEKDTPDAVEKIQALLPAIEKAMPPLLVARMRSHSSAYFRELVETRERLVRDADDFVAVAIAGFNQMNRGGPAGNAVAVH

SEQ ID NO: 4703 - DNA, 369 bp, Escherichia coli
atcagcaagcttcttcaggaaactggatggagccaggctgagcttgcccgtagaattggtgtgacacaacaaactgttcaacaatgggtcagcggtaaggctacacctaaagcctcaagtttggataaactggttgaggttacagggcatccattgcattggtttttattgcctcctgaagagggggagcaaattttcacccctgacacgatgaaaattggtcctcgtcaacgcgaactgctccaggcttttagtgcgtttccagaggaagaccaagaaaaaatgcttcaagaaatcaaagacaagaaaaaatcaatggaagaaaccattgcccggtggttggcggcacaaaaaagccgccgggcgtga

SEQ ID NO: 4704 - protein, 122 aa, Escherichia coli
ISKLLQETGWSQAELARRIGVTQQTVQQWVSGKATPKASSLDKLVEVTGHPLHWFLLPPEEGEQIFTPDTMKIGPRQRELLQAFSAFPEEDQEKMLQEIKDKKKSMEETIARWLAAQKSRRA

SEQ ID NO: 4705 - DNA, 288 bp, Escherichia coli
atgttacccattttgtggctaccatctgctcgcgatgatttgcgtcagatcgtagcctatattgctaaggaaaatattcctgcagcacgcagactaaaaatacggattgaaacgtctgttttagccctctctgagcatccatatctatatccgccaagtgatcgagtatccggtttgcgggaaattgtggttcaccctaattatatcgttttgtaccgagtagcaacttcaagcattgaaattgcaaatattgtgcatgcccgccgacaatttcccttccctatctga

SEQ ID NO: 4706 - protein, 95 aa, Escherichia coli
MLPILWLPSARDDLRQIVAYIAKENIPAARRLKIRIETSVLALSEHPYLYPPSDRVSGLREIVVHPNYIVLYRVATSSIEIANIVHARRQFPFPI

SEQ ID NO: 4707 - DNA, 153 bp, Escherichia coli
atggatactatcgagcttggcaacaacgaatctctggtatgtggagtattccccaacctggacggaacgtttaccgcgatgacgtataccagaagcaaaacgtttaaaacggaagctggcgcgcgtcgctggttaaccagaaacactgactga

SEQ ID NO: 4708 - protein, 50 aa, Escherichia coli
MDTIELGNNESLVCGVFPNLDGTFTAMTYTRSKTFKTEAGARRWLTRNTD

SEQ ID NO: 4709 - DNA, 108 bp, Escherichia coli
gtgttatgggtggattctctgtatccggcgttaattgttaactggttaacgtcacctggaggcaccagacaccgcatcaacaaagttcacttcggtgatgaaaggtaa

SEQ ID NO: 4710 - protein, 35 aa, Escherichia coli
MLWVDSLYPALIVNWLTSPGGTRHRINKVHFGDER

SEQ ID NO: 4711 - DNA, 846 bp, Escherichia coli
ttgaatgtagctattgaaaaccagtacgggtggaattatagtgcacctgcacctcataaaccgggtgccgggcgtggaaacccgaaagttactcgagcgcataaccgcgccgaagcggtttttttatgcgttaagcacagccacattcagataatggtggggcgtgcagggcagctgcaaggctggccgggttctcgagtgaccggtatttccacccctgtacgtctcgccacccttatggtcgtggaaagcctcggtggtgagttaattaacttaacacttgaggatgccatcatggctactacccttaccctttctcaccctgacgtaaccattgaaaatggtcgcgcagtcactacgtctattgcgatcgcagaattcttcggcaagcagcatcaccatgttgttcaaaaaatagaggccctcgaatgttctgaacgctttttaaccagcaacttttcgcgggttaaattcgagcaccgtggcaatacctacaatgcctaccaaatcaccaaaaacggcttcgttttcctggtgatgggcttcaccggcaaaaaggccgctgcattcaaggaagcctacattgccgagttcgaccgcatggaggaagaactgcgccggaataacaccacacccgctgacaaaataatcccgggtgatgaccgaaccctggttatccgcttcgacgaacacggctacatcaaattcaccgaaaccgttcctgatggcgcactggtctgtactctggatactttccgtttttatctggaaaagcagggatggactctcataaaccggggcgcaattaaaaatatgaccgtcgagcagttgctgagtattaaatag

SEQ ID NO: 4712 - protein, 281 aa, Escherichia coli
MNVAIENQYGWNYSAPAPHKPGAGRGNPKVTRAHNRAEAVFLCVKHSHIQIMVGRAGQLQGWPGSRVTGISTPVRLATLMVVESLGGELINLTLEDAIMATTLTLSHPDVTIENGRAVTTSIAIAEFFGKQHHHVVQKIEALECSERFLTSNFSRVKFEHRGNTYNAYQITKNGFVFLVMGFTGKKAAAFKEAYIAEFDRMEEELRRNNTTPADKIIPGDDRTLVIRFDEHGYIKFTETVPDGALVCTLDTFRFYLEKQGWTLINRGAIKNMTVEQLLSIK

SEQ ID NO: 4713 - DNA, 2481 bp, Escherichia coli
atgagtaaagtctttatttgcgccgccattccggacgaacaggtaataaaggaagaaggtgcagtcgctgtagccactgccattgaagccggtgatgaacgtcgcgcccgcgcaaaatttcactggcaattcctggaacattatccggctgctcaggactgcgcttataaatttcttgtttgcgaggataaacctggtataccccgccctgccctcgattcctgggatgctgaatatatgcaggaaaaccgctgggatgaggagtctgcttcctttgtcccggttgagactgaatcagatccgatgaacgtcacttttgacaagctggcccctgaagtacagaacgctgtcatggttaagttcgacacatgtgaaaacatcaccgttgatatggtgattagcgcgcaggaactattgcaggaagacatggcaacattcgacggacatatcgttgaagcgttgatgaaaatgccagaagttaacgccatgtatccggagcttaagctgcatgccatcgggtgggttaagcataaatgtaagcctggtgccaaatggcccgaaattcaggcagagatgcgcatctggaaaaaacgtcgcgaaggtgaacgcaaggaaaccggaaaatacacgtctgttgttgatctcgcccgcgccagagccaatcaacagcacactgaaaattcaacaggaaaaatcagcccggtcattgctgccattcatcgcgaatacaagcagacatggaaaacactggatgacgaactggcctacgctctctggcctggtgatgtggatgccggaaacattgacggcagcatccatcgctgggcaaaaaatgaagttatcgacaacgaccgcgaagactggaagcgtatctcggcatcaatgcgcaaacagcctgatgcccttcgctacgaccgccagactatttttggccttgtccgtgaacgcccgatcgacattcacaaagaccctgtggcactgaacaaatacattactgaatacctgactacaaagggcgtgtttgaagatgaaggaacaaatcagagcgcaactgatactctctcatcgccagtaccagaaactgatgcagtggaaacggcaattccggacaacgaaaaaaccgaatgcaaagtggaaatcgaaccatctgtagagcgtgaggggccgttctacttcctcttcaccgacaaggatggcgaaaaatacggtcgcgcaaacaaactttctggtctggataaggcgctggctgccggggctactgaaatcacgaaagaagaatatttcgcccgcaaaaacggtacatactcaggttcacaacaaaatactggtgcatctgacacgaccgcacaaccagagccggtaaaagttacagctgacgaagtaagcaaaattatgcaggcagccaatatcagccagcctgacgccgataagttgcttgcggcctctcgcggtgaatttgttgcagggattagcgatccgaatgatccgaaatgggtgaaggggattgaaacccgcgattctgtgaaccagaaccagcaagaaacggaacagaacgaccagaaagcggaacaaaacagcccaaatacgcaacaaaacgagccagaaacgaaacaacctgagccagtagcgcaacaggaaccagaaaaagtctgcaccgcctgcggtcagaccagcggcggcaactgccctgattgtggctcagtaatgggtgacgcaacataccaggaaacattcaatggagaaaatcaggctgaatctcaggaaaaaaatccggaggaaacggaaggcactgagcatccgcacaaggagaacactggcggcgctcaggaccacgccagcgataataaaactggcgaaacagaaaattccttaattaagatgaacggtcatcgtgaaatcacatccaccagcagagtatggaatcacctgtcagtcgaccttgaaacaatgggagccaacaccaatgcacccatagtagttattggtgcggttttcttcgacccggaaacaggggaaatcgggccggtattttatatcgttatcagcctgactgacgcaatgaatacaggggctgttcctgatggtggcaccatcgaatggtggctgaagcagtccagcgaagccagagctgccattttaactgaccaggtaaaaatgaaagatgcccttttgcgttttcgggaattcgtcaatgaacactctgatgaaaaattcgttcaggtgtggggtaatggcgcaacgttcgataacgcaattttgcgcacctcatacgaacgtctggacatcccctgtccgtggcattacagcaacgatcgtgatgtacgcacaatcgttgagatggggaaaatcacagacttcaatgccagaagcgtaattccattcgaaggcgtgcgccataatgctctggatgacgctcttcaccaggcaaaatacgtaacagccactatacaaaaactgatcccgaatcaggctgatttttaa

SEQ ID NO: 4714 - protein, 826 aa, Escherichia coli
MSKVFICAAIPDEQVIKEEGAVAVATAIEAGDERRARAKFHWQFLEHYPAAQDCAYKFLVCEDKPGIPRPALDSWDAEYMQENRWDEESASFVPVETESDPMNVTFDKLAPEVQNAVMVKFDTCENITVDMVISAQELLQEDMATFDGHIVEALMKMPEVNAMYPELKLHAIGWVKHKCKPGAKWPEIQAEMRIWKKRREGERKETGKYTSVVDLARARANQQHTENSTGKISPVIAAIHREYKQTWKTLDDELAYALWPGDVDAGNIDGSIHRWAKNEVIDNDREDWKRISASMRKQPDALRYDRQTIFGLVRERPIDIHKDPVALNKYITEYLTTKGVFEDEGTNQSATDTLSSPVPETDAVETAIPDNEKTECKVEIEPSVEREGPFYFLFTDKDGEKYGRANKLSGLDKALAAGATEITKEEYFARKNGTYSGSQQNTGASDTTAQPEPVKVTADEVSKIMQAANISQPDADKLLAASRGEFVAGISDPNDPKWVKGIETRDSVNQNQQETEQNDQKAEQNSPNTQQNEPETKQPEPVAQQEPEKVCTACGQTSGGNCPDCGSVMGDATYQETFNGENQAESQEKNPEETEGTEHPHKENTGGAQDHASDNKTGETENSLIKMNGHREITSTSRVWNHLSVDLETMGANTNAPIVVIGAVFFDPETGEIGPVFYIVISLTDAMNTGAVPDGGTIEWWLKQSSEARAAILTDQVKMKDALLRFREFVNEHSDEKFVQVWGNGATFDNAILRTSYERLDIPCPWHYSNDRDVRTIVEMGKITDFNARSVIPFEGVRHNALDDALHQAKYVTATIQKLIPNQADF

SEQ ID NO: 4715 - DNA, 204 bp, Escherichia coli
atgagcagcttatttttaaccgaagatgaattgctaatattaacgggctgcaaatatgcaagccaccagcgaaaatggttaatggaaaacgggcttccgttctataccaatcgtagtggcaaaccgattgtcagccgggatctatttacctgcaataaaactttaccaccacgcgaggtagagccgaattttggtgcgatctga

SEQ ID NO: 4716 - protein, 67 aa, Escherichia coli
MSSLFLTEDELLILTGCKYASHQRKWLMENGLPFYTNRSGKPIVSRDLFTCNKTLPPREVEPNFGAI

SEQ ID NO: 4717 - DNA, 1026 bp, Escherichia coli
atgggaagacgaaggaaaaatcctgaacacgaaaaattacctccaaatgtatacccaaataaatatagttatgtatggaaaccaacatccagagaatctgtaacactaaccgccatcaaggatggtttagctgctttatggaaaaagtatgaggaaactgtaaataatcgcgatcgtgcaatgacattcggtcgcttgtgggaaaaattcctcgccagcgcctgttacagtgatcttagtccaagaacacaaaaagattatctgcaacatcaaaaaaagttgcttgccgtattcggtaaggtaccagcggattccataaaaccagaacacatccgtcgatacatggacaaaagaggggaacagagtaaaacgcaagccaaccatgaaaaaagcagtatgtcccgtgtttacagttgggggtatgagcgagggtacgtgaaggctaacccatgtgcaggtgtaagtaaattcaaggccaaaaaccgcgaacgatatgtaaccgacaaagaataccaggcagtattaagcgtggcaccccttcctgtttttatcgcaatggaaattgcctatctgtgtgcagcgagggtttccgatgtgttatcgctgaaatgggagcagattggaaacgacgggatctttatccagcaagggaaaacagggaaaaaacagataaaagcatggagtccacgattacaggcagcggtcgaaaaagcaaaacagttaccaaaatccgcctatgtgatcagcaatcaatacggcaaccgatatatgtacaaaggctttaacgaaatgtgggtagaagcaagaaatcgcgcaggcaaagtttcaggtattttaaccgacttcacctttcatgatctgaaggcgaaaggaatttcagactatgaaggaagcagccgggataagcaacttttctctggtcacaaaaccgaagggcaagtgctaatctatgaccggaaggttaaagtttcaccaacacttgatgtcccgttacctgaaaatattccaagaaaatattccaagtaa

SEQ ID NO: 4718 - protein, 341 aa, Escherichia coli
MGRRRKNPEHEKLPPNVYPNKYSYVWKPTSRESVTLTAIKDGLAALWKKYEETVNNRDRAMTFGRLWEKFLASACYSDLSPRTQKDYLQHQKKLLAVFGKVPADSIKPEHIRRYMDKRGEQSKTQANHEKSSMSRVYSWGYERGYVKANPCAGVSKFKAKNRERYVTDKEYQAVLSVAPLPVFIAMEIAYLCAARVSDVLSLKWEQIGNDGIFIQQGKTGKKQIKAWSPRLQAAVEKAKQLPKSAYVISNQYGNRYMYKGFNEMWVEARNRAGKVSGILTDFTFHDLKAKGISDYEGSSRDKQLFSGHKTEGQVLIYDRKVKVSPTLDVPLPENIPRKYSK

SEQ ID NO: 4719 - DNA, 837 bp, Escherichia coli
gtgcaattttgttcaagtgacgagtttgcgagcaaaacgatgattaagtggccctggaaagtacaagaatcagcacatcaaactgcccttccctggcaggaagcactatcgatcccccttttaacgtgtctgacggaacaggaacaaagcaaattagtcactcttgccgaacgttttttacagcaaaaacggcttgttcctttacagggctttgagctgaattcattaagaagctgccggatagcacttctattttgcctgcccgttctggagttaggactggaatggctggatagttttcatgaagtcttaatttatcctgcgccatttgtggtcgatgatgaatgggaagacgatatcggtctggtgcataaccaacgtattgttcagtcaggtcagagctggcagcaagggcctatcgttttgaactggttggatatacaagattcttttgatgcttctggttttaacctgattattcatgaagtcgctcataagctggacacccgtaacggcgatcgcgccagcggagttccctttattccgttgcgtgaggttgctggctgggaacacgatcttcatgctgcaatgaacaacattcaggaagaaatcgaattggttggcgagaatgcggcgagcatcgatgcttatgctgccagtgatcctgctgaatgttttgccgtactttctgaatatttctttagcgccccagaactttttgctcctcgtttcccttcattgtggcaacgtttctgccaattttatcaacaagatcctttgcagagactgcatcacgctaatgatacagactcgttttcggcgacgaatgttcattaa

SEQ ID NO: 4720 - protein, 278 aa, Escherichia coli
MQFCSSDEFASKTMIKWPWKVQESAHQTALPWQEALSIPLLTCLTEQEQSKLVTLAERFLQQKRLVPLQGFELNSLRSCRIALLFCLPVLELGLEWLDSFHEVLIYPAPFVVDDEWEDDIGLVHNQRIVQSGQSWQQGPIVLNWLDIQDSFDASGFNLIIHEVAHKLDTRNGDRASGVPFIPLREVAGWEHDLHAAMNNIQEEIELVGENAASIDAYAASDPAECFAVLSEYFFSAPELFAPRFPSLWQRFCQFYQQDPLQRLHHANDTDSFSATNVH

SEQ ID NO: 4721 - DNA, 120 bp, Escherichia coli
atggaccgcatggcgtattatgttactcaggtgctgccgtgtgcgggacgcaacctccagcagacctttttcctcgatccctttctgcaggtcaatgaaatgacggggtttaagttctga

SEQ ID NO: 4722 - protein, 39 aa, Escherichia coli
MDRMAYYVTQVLPCAGRNLQQTFFLDPFLQVNEMTGFKF

SEQ ID NO: 4723 - DNA, 963 bp, Escherichia coli
atgctggcgctgaatatcaacccggtacagcagcgggctgctgtacgtggctcacgaacaccggagaaagtttttaaaaacgtggcgctggcgtggcataaaagtaacaggaaatggtcgcagaacaccgccgaccgtctgcttgccagcctgaacaatcacatctttccggtcatcgggaacctacctgtatcagaacttaaaccccgtcatttcattgacctgcagaaagggatcgaggaaaaaggtctgctggaggttgcgtcccgcacacggcagcacctgagtaacataatacgccatgcggtccatcaggagttaatcgatacgaaccctgcagcaaaccttggcggcgtgaccacacctcctgtcagacggcactatcctgccctgccgctggagcggctgcctgaactgcttgaacgtattggggcatatcatcagggccgtgaactgacccggcatgccgttctgctgatgctgcatgtgttcattcgctccagtgaactgcgtttcgcccgctggtcagagattgatttcacaaaccgagtctggacgatacccgcgacgcgagaacccattattggcgtgcattattccggccgcggggcaaaaatgcgaatgccgcatatcgtccccctctcagaacagtccatcgccattctgaaacagattaaggatatcaccggtaataatgaactgatcttccccggcgaccataacccgtataagccaatgtgtgaaaacacggtcaataaggcactgcgggtgatgggttacgacacgaaaaaggatatctgcggtcacggcttccgggcaatggcatgcagtgcgctgatggaatcgggtttatgggcaaaggacgcagtagaacgccagatgagtcatcaggagcgcaataccgtgcgcatggcttatattcataaggcagagcacctggaagcccgcaaagcgatgatgtag

SEQ ID NO: 4724 - protein, 320 aa, Escherichia coli
MLALNINPVQQRAAVRGSRTPEKVFKNVALAWHKSNRKWSQNTADRLLASLNNHIFPVIGNLPVSELKPRHFIDLQKGIEEKGLLEVASRTRQHLSNIIRHAVHQELIDTNPAANLGGVTTPPVRRHYPALPLERLPELLERIGAYHQGRELTRHAVLLMLHVFIRSSELRFARWSEIDFTNRVWTIPATREPIIGVHYSGRGAKMRMPHIVPLSEQSIAILKQIKDITGNNELIFPGDHNPYKPMCENTVNKALRVMGYDTKKDICGHGFRAMACSALMESGLWAKDAVERQMSHQERNTVRMAYIHKAEHLEARKAMM

SEQ ID NO: 4725 - DNA, 1305 bp, Escherichia coli
atgaaaatcagtgagtttctacatctggcgttaccagaggaacaatggctaccgacgatttctggcgttttacgccagttcgcagaagaagagtgttatgtctatgagcgtcaaccctgttggtatttaggcaaagggtgccaggcacggctgcacattaatgccgacggaacgcaggcgacatttattgatgatgctggggagcaaaaatgggcggtggattccattgccgactgcgcgcgtcgttttatggcgcatcctcaggtgaaaggacgtcgggtatatggacaggttgggttcaactttgcggcgcatgcgcgggggattgcctttaacgccggggagtggccgctgctgacgttaaccgttccccgtgaagaacttatttttgaaaagggaaatgtcaccgtttatgcggactccgccgacgggtgccgacgtttgtgcgagtgggtaaaagaggccggtacaacgacgcagaacgcaccactggcggtggataccgccctcaatggtgaggcatataaacaacaggttgcgcgcgccgttgcggagatccgccgtggcgagtatgtcaaagtgattgtctcgcgcgccattcccctgccatcgcggattgatatgcccgccacgctgttatacgggcggcaggcaaacacgcctgtgcgctcgtttatgttccgtcaggaaggacgcgaagcgctgggctttagcccggaactggtgatgtcagtgacgggcaataaagtggtcactgaaccgcttgcgggcacccgcgatcgcatgggaaacccggagcataataaggcgaaagaggcagaactgctgcacgacagtaaagaggtgcttgagcatatcctttctgtcaaagaagctattgctgaactggaggctgtttgccagccgggcagcgtggtggttgaagatttaatgtcggttcgccagcgcggcagcgttcagcatctggggtctggcgtgagcggtcagcttgcggaaaacaaggatgcctgggatgcgtttaccgtgctgtttccgtcgattaccgcctcaggtatccctaaaaatgctgctctgaacgcgattatgcaaattgagaagacgccgcgagagctttattccggcgcaatcctgctgctggacgatacgcgctttgatgcggcgctagttctgcgttccgtatttcaggatagccagcgctgctggatacaggcgggggcgggaatcatcgcgcaatctacgccggaacgcgaactgacagaaacccgggagaaattagcgagcattgcgccctatttaatggtgtag

SEQ ID NO: 4726 - protein, 434 aa, Escherichia coli
MKISEFLHLALPEEQWLPTISGVLRQFAEEECYVYERQPCWYLGKGCQARLHINADGTQATFIDDAGEQKWAVDSIADCARRFMAHPQVKGRRVYGQVGFNFAAHARGIAFNAGEWPLLTLTVPREELIFEKGNVTVYADSADGCRRLCEWVKEAGTTTQNAPLAVDTALNGEAYKQQVARAVAEIRRGEYVKVIVSRAIPLPSRIDMPATLLYGRQANTPVRSFMFRQEGREALGFSPELVMSVTGNKVVTEPLAGTRDRMGNPEHNKAKEAELLHDSKEVLEHILSVKEAIAELEAVCQPGSVVVEDLMSVRQRGSVQHLGSGVSGQLAENKDAWDAFTVLFPSITASGIPKNAALNAIMQIEKTPRELYSGAILLLDDTRFDAALVLRSVFQDSQRCWIQAGAGIIAQSTPERELTETREKLASIAPYLMV

SEQ ID NO: 4727 - DNA, 1389 bp, Escherichia coli
atgcgcaattgctctcacatcatggacgttatcaggcgctgtggcaggcgcaaatggccgcgcgcgtgtggcgcgacgacgggggttccgcgtctggagagtgggtgcatgagtgatgttcagtcgaatgtgaaacctctgacgttgacgaccgggcgggtgatttttgctattgccggcgtctatgtgacgcagagtctggtatcggcgctgtctatgcagtccttacccgcgctggtgcgcgctgctggcggttcgctggcgcttgccggtgcgacaaccctgtttatgctgccctgggcgctgaagtttatttgggcgccgtggatcgagcgctggcggcttccgcccggtagccaggaacgccgttcccgcatgttaatcctgcgtggtcaggtcgcgctagcggcgatcctgactattgccgcagcgattggctggtttgggcgagaagggggattccccgatacgcaaatcgtcgcgttatttgttctgtttatggtggcaggcacggtcgcctccaccattgatatcgccagcgacggcttttgtgtcgatcaactgacccgcacgggttacggctggggaaacagcgtgcaggtcggcggcagctatctgggaatgatgtgcggcggcggggtgttcctgatgctgtcggcggcatccggctggcctgtcgccatgctgatgatggcggtgctgattatggcgctgtcactcccgctgtggcgcattacggagccgacgcgaacagcgactatcccgcatgttccggcgttaggttatgcgctaaggaggaagcaggcgcgcctgggcttactgctggtattgatgctgaattcaggcatgcggtttgtgctgcctcttctggcaccgctgttgttggatcatgggttgagcatgtccgcattgggcgcgctgttcagcggcggcaatattgcagcgggcatagcaggaacgctggccggcggattgctgatgaaatacacctcacccggcagagcgctgttgacggcttatggcgtccaggggatcgcgctgctggcggtggtgatgacgctcatgatggcgccgggtcatctgctgctgcagattctccagtgtctggtcattgtccagtccatttcgctggcctgcgcgctggtctgtctttacgccacgctgatgtcgctttcatcgcctttgcaggccggtgtcgacttcaccctctttcaatgtactgacgcggcaatcgccattctggctggcgttatcggtggcgttgttgctcaacattttggctatgcggcctgcttcctgtttgccggggcattcacgttgctggcggcgtgggttgcttatatccggctgcattcggcaagagaactgatgacaagcgcaattgattga

SEQ ID NO: 4728 - protein, 462 aa, Escherichia coli
MRNCSHIMDVIRRCGRRKWPRACGATTGVPRLESGCMSDVQSNVKPLTLTTGRVIFAIAGVYVTQSLVSALSMQSLPALVRAAGGSLALAGATTLFMLPWALKFIWAPWIERWRLPPGSQERRSRMLILRGQVALAAILTIAAAIGWFGREGGFPDTQIVALFVLFMVAGTVASTIDIASDGFCVDQLTRTGYGWGNSVQVGGSYLGMMCGGGVFLMLSAASGWPVAMLMMAVLIMALSLPLWRITEPTRTATIPHVPALGYALRRKQARLGLLLVLMLNSGMRFVLPLLAPLLLDHGLSMSALGALFSGGNIAAGIAGTLAGGLLMKYTSPGRALLTAYGVQGIALLAVVMTLMMAPGHLLLQILQCLVIVQSISLACALVCLYATLMSLSSPLQAGVDFTLFQCTDAAIAILAGVIGGVVAQHFGYAACFLFAGAFTLLAAWVAYIRLHSARELMTSAID

SEQ ID NO: 4729 - DNA, 1803 bp, Escherichia coli
atgaaagacaataatcctgcggataacctggcctggcgcgtcatctggcgccagcttatctccagcgttggcagtcaggccaggatgctgcgacgcagtatgctggcgctgttgctggcggcattcatgcaggggatcgcctttgcctgtctttatccgatcattgatgcgctgttacggggagacgcgccgcaacttcttaactgggctatggccttcagcgtcgccgcaattgtgacgctggtgctacgctggtatggcctgggctttgaataccgtggtcatctggcgcaggctacccatgagttgcgcctgcgacttggcgagcagttacgccgcgtgccgctggagaagctccagcgcggcagggcgggtgaaatgaacgccttgctgctgggcagcgtggatgaaaacctcaattatgttattgcgatagccaatattttgctgctcaccattgtcacgccgctgacggcgtcgctggcgacattgtggatagactggcggctggggctggtgatgttgctgatcttccctctgctggtgccgttttattactggcgccgcccggcgatgcggcgacaaatgcagacgctgggggaagcgcaccagcgtctgagcggcgatatcgttgaatttgctcaggggatgatggtattgcgcacctgcggcagcgatgccgataaaagccgggcgctgctggcgcatttcaatgcgctggaaaacttacagacccgcactcaccgtcagggcgctggcgcaacgatgctgatcgccagcgtcgtggagttgggcctacaggtggtggtgttatccgggatcgtctgggtagtgacgggcactctgaacctcgcctttttgattgccgccgtcgcgatgattatgcgcttcgcagaaccgatggcgatgtttatcagctacacctcggttgtggaactgatcgccagcgccctgcaacggattgagcagtttatggcgatagcaccgcttcccgtcgcagagcaaagcgagatgccggaacgttacgatatccgctttgacaacgtcagctatcgctacgaagaaggtgacggccacgcgcttaatcatgtttctttgacgttcccggcagccagtatgagcgcgctggtgggtgcctccggcgcaggcaaaactacggtcaccaaactgttaatgcgctatgccgatccgcagcaagggcagatttctattggcggcgtcgatattcgccgcctgacgccggaacagctcaatagcctgatttctgttgttttccaggatgtctggctgtttgatgacacgctgctggcgaatatccgtatcgcgcgcccacaggcgacgcggcaggaggtagaagaggccgcccgcgcggcgcagtgccttgagtttatttcccgtcttccgcaaggctggctgacgccaatgggagagatgggcggccagctatcgggcggcgagcgccagcggatttccattgccagagcgttattgaaaaacgcgccggtcgtcattctcgatgaaccgactgccgcgctggatattgaaagcgagctggcggtgcaaaaagcgatcgataacctggttcacaaccggacggtgattatcatcgctcaccgtttatccaccatcgccggggccggaaacattctggtgatggaagagggacaggtggttgagcagggtactcatgcgcaattgctctcacatcatggacgttatcaggcgctgtggcaggcgcaaatggccgcgcgcgtgtggcgcgacgacgggggttccgcgtctggagagtgggtgcatgagtga

SEQ ID NO: 4730 - protein, 600 aa, Escherichia coli
MKDNNPADNLAWRVIWRQLISSVGSQARMLRRSMLALLLAAFMQGIAFACLYPIIDALLRGDAPQLLNWAMAFSVAAIVTLVLRWYGLGFEYRGHLAQATHELRLRLGEQLRRVPLEKLQRGRAGEMNALLLGSVDENLNYVIAIANILLLTIVTPLTASLATLWIDWRLGLVMLLIFPLLVPFYYWRRPAMRRQMQTLGEAHQRLSGDIVEFAQGMMVLRTCGSDADKSRALLAHFNALENLQTRTHRQGAGATMLIASVVELGLQVVVLSGIVWVVTGTLNLAFLIAAVAMIMRFAEPMAMFISYTSVVELIASALQRIEQFMAIAPLPVAEQSEMPERYDIRFDNVSYRYEEGDGHALNHVSLTFPAASMSALVGASGAGKTTVTKLLMRYADPQQGQISIGGVDIRRLTPEQLNSLISVVFQDVWLFDDTLLANIRIARPQATRQEVEEAARAAQCLEFISRLPQGWLTPMGEMGGQLSGGERQRISIARALLKNAPVVILDEPTAALDIESELAVQKAIDNLVHNRTVIIIAHRLSTIAGAGNILVMEEGQVVEQGTHAQLLSHHGRYQALWQAQMAARVWRDDGGSASGEWVHE

SEQ ID NO: 4731 - DNA, 1803 bp, Escherichia coli
atgtcatctcaatcatccaatactgaatcgctgtcccgatttcctctctggcaggtgattacaccggttcgcaggaaggttattttagctatggcgctggcggggctggcggcattaaccagcctgggggcgctcctttttctggcgtggagcctgcgtgacattcgcgcgacgcctgacgctattccggcctggccgctgggcggcgtgatcggctgcgtggtcttaacttttgttctgcgcttacaggcgttcaacacctctcattacgcggcttttcatctggagaacattctgcgcagcaggttagcccgtaaagcattgcagcttccgcctggcgtgttacagcaaatgggcagcgggtcagtggcgaaagtgatgctggatgacgtgaagtcgttacatatttttgtggccgacagcacgccgctctatgcccgcgcgatcatcatgccgctggcgacaatcgttatcttgttctggctggactggcggctggcaatcgcgacgctgggggtactggcgtttggatcggttgttctcgtgctcgcccgccagcgttcggaaaatatggctcagcgttatcataaggcgcgcgagcaggttagcgcggcggttattgagttcgtgcaggccatgcccgtggtgagaacgtttgatagcggcagcaccagttttttgcgctatcaacgcgcccttgaagagtgggtcgatgtgctcaaaacctggtatcgcaaagccggtttttcagcgcgtttttccttctcgattctgaatcctctcccgaccctgtttgtcctgatctggtcgggatacggcctgttgcactatggcagtttcgattttatcgcgtgggtggccgttttactgctgggcagcggaatggccgaagccgtaatgccaatgatgatgctcaataacctggtcgcgcaaacgcgtttaagcattcagcgtatttatcaggttctcgcgatgccggagttatcgctgccgcagtctgaccagcagccgcaagaggcgagcattacctttgagcaggtgagctttcattatccgcaagcgcgtactggcgccgcgttgcaggaggtgagctttcatgtgcctgccgggcaaattgtggcgctggtcgggccaagcggcgccggaaaaagcaccgtggcgcgcttgctgctgcgttacgccgacccggacaaaggccatatccgtattggcggcgtggatctgcgtgatatgcagacggacaccctgatgaagcaactctcgtttgtgtttcaggacaacttcctttttgccgacacgatagccaataacattcgtctgggcgcgccggatacgccgctggaggcggttatagcggcggccagagtggcgcaggcccatgattttattagcgctctgccagaaggttacaacactcgagtcggggaacgtggggtatttctctccggcggccagcggcagcgcattactatcgcccgggcgcttttgcaggatcgccccatcctggtgctcgatgaggcgacggcgtttgctgacccggaaaacgaagcggcgcttatcaaggcgctcgcggcggccatgcgtggccggacggtcatcatggtcgcgcatcgtctctcaatggtgactcaggccgatgtgatattgctgttttccgacggacaactcagggaaatggggaaccatacgcaactgttggcgcagggcggcctgtatcaacggctctggcaacactatcagcaggcgcagcattgggtgccgggtggaacacaggaagaggtggtggaaaatgaaagacaataa

SEQ ID NO: 4732 - protein, 600 aa, Escherichia coli
MSSQSSNTESLSRFPLWQVITPVRRKVILAMALAGLAALTSLGALLFLAWSLRDIRATPDAIPAWPLGGVIGCVVLTFVLRLQAFNTSHYAAFHLENILRSRLARKALQLPPGVLQQMGSGSVAKVMLDDVKSLHIFVADSTPLYARAIIMPLATIVILFWLDWRLAIATLGVLAFGSVVLVLARQRSENMAQRYHKAREQVSAAVIEFVQAMPVVRTFDSGSTSFLRYQRALEEWVDVLKTWYRKAGFSARFSFSILNPLPTLFVLIWSGYGLLHYGSFDFIAWVAVLLLGSGMAEAVMPMMMLNNLVAQTRLSIQRIYQVLAMPELSLPQSDQQPQEASITFEQVSFHYPQARTGAALQEVSFHVPAGQIVALVGPSGAGKSTVARLLLRYADPDKGHIRIGGVDLRDMQTDTLMKQLSFVFQDNFLFADTIANNIRLGAPDTPLEAVIAAARVAQAHDFISALPEGYNTRVGERGVFLSGGQRQRITIARALLQDRPILVLDEATAFADPENEAALIKALAAAMRGRTVIMVAHRLSMVTQADVILLFSDGQLREMGNHTQLLAQGGLYQRLWQHYQQAQHWVPGGTQEEVVENERQ

SEQ ID NO: 4733 - DNA, 102 bp, Escherichia coli
atgggagtaactgaatttcctgatgaatttttacggacgccaaaaacgacaattcagggtggcgttctgagaattaatgtgaataataaccattatcaataa

SEQ ID NO: 4734 - protein, 33 aa, Escherichia coli
MGVTEFPDEFLRTPKTTIQGGVLRINVNNNHYQ

SEQ ID NO: 4735 - DNA, 960 bp, Escherichia coli
atgacggagtcaccgcaaacgcaatctgaaatctctattcaccagttggtggtcgggaaacctgcaaacgatggcaatattcctgctcagtgtgaactgctgcgctgttcgttgcaggaaggtatggatattttgctctggaggggccattttgcgcggccagagacgttgcagctacacgacgatctgggcaggattaacttctcgtgcatcctggaaggcacatcgcgctttgcgattcagggactccggcgccacaccgactgggagcttgcgcgcaatcgccattacattacccatacgccagactgtcgcggcagcgcctcctattgtggccgattcgagagcattaccctctccttcagccctgaaaccctcgcgctgtgggtgccggatattagcgcggtcattaagaataagatcgactcccactgctgttgccagcagcagcgttgtaatgctgaaacccacttaacggctcaggccttgcgtcacgcgctgatgcgcatgcacggcggcttcagtcatgaacaaaagccgtcgacgctatggttgcaggggcaaagtctggtcatgctcagcctggtgctggatgaacatcgcgaagacgccagttgcctctcctgccacttcaacccgatggaacgccagaaactgctgcgggcgaaggatctgctgctggctgatctgacgcaagcgccgggcgtcgcggagctggccagagagtccggtctgagcgttctcaaaattaagcgaggcttccgcgttctgttcaacaacagcgtctatggcctgtttcaggctgaacgaatgcaggaagccagaagacgcctggccaacggcaatacctccgtcatgacggtggcggccgatctgggctatgccaacgccagccatttctctgccgccttccagaaacagtttggcgtaactccttcgacctttaaacgcgggatgtaa

SEQ ID NO: 4736 - protein, 319 aa, Escherichia coli
MTESPQTQSEISIHQLVVGKPANDGNIPAQCELLRCSLQEGMDILLWRGHFARPETLQLHDDLGRINFSCILEGTSRFAIQGLRRHTDWELARNRHYITHTPDCRGSASYCGRFESITLSFSPETLALWVPDISAVIKNKIDSHCCCQQQRCNAETHLTAQALRHALMRMHGGFSHEQKPSTLWLQGQSLVMLSLVLDEHREDASCLSCHFNPMERQKLLRAKDLLLADLTQAPGVAELARESGLSVLKIKRGFRVLFNNSVYGLFQAERMQEARRRLANGNTSVMTVAADLGYANASHFSAAFQKQFGVTPSTFKRGM

SEQ ID NO: 4737 - DNA, 6108 bp, Escherichia coli
atgatttctggcgcaccatctcaggattcgctgttaccggacaaccgccacgcggctgattaccaacaattacgcgagcggctcatacaggaactgaatttaacgccgcagcagttacatgaagagagcaacctgatccaggccggcctggattccataagattgatgagatggttacactggtttcgtaaaaatggctaccgccttacccttcgcgagctgtatgccgcccccacgctggcggcatggaaccagttaatgctcagccggtcgccggagaacgcggaagaagaaacgccgcccgacgaatcatcctggccgaacatgaccgaaagtacgcccttcccattgacgccagtacagcacgcctacctgacgggccgcatgccggggcagacgcttggcggcgtgggttgccacctgtatcaggagtttgaaggccattgtctgacggcgtcgcagctggagcaggccatcacgaccttgctgcaacgccacccaatgctgcatatcgcctttcgccccgacgggcagcaggtctggctaccgcaaccttactggaacggcgtcaccgttcatgatttacgccataacgacgctgaaagccgccaggcctatctggacgcactgcgccagcgcctgagccaccgtcttttacgcgtggaaatcggcgaaacgtttgattttcagctgacgctcttgccggacaatcgccaccgcctccatgtcaatattgacctgctgattatggatgcctccagctttacgcttttcttcgatgagcttaacgccctgctggccggagaatcgctgccggctatcgacacccgctatgatttccgctcgtatttgctgcaccagcagaagatcaatcaaccactgagagacgacgctcgcgcttactggctggcgaaagcatcgacgcttccccccgcgcccgtcttgccgctggcctgcgaacccgccacgctacgtgaagtccgtaatacccgacgccgcatgattgtcccggcaacacgctggcacgcctttagcaaccgggccggcgagtatggcgtgacgccgacaatggcactggcgacctgtttttctgccgtgctggctcgctggggcggcctgacgcgtctgctgcttaacatcaccttattcgaccgccagccgctgcacccggcggttggcgcgatgcttgccgacttcaccaatattcttctgctggataccgcctgcgatggcgataccgtcagcaacctggcgcgtaaaaaccagctcacgtttacggaggactgggagcatcgccactggtccggcgtcgaattactccgtgaactcaaacgccagcagcgctacccccacggcgccccggtggtatttaccagcaatctggggcgttccctctacagcagccgcgcagaatcgccgttgggcgagccggaatggggcatctcgcaaacgccgcaggtctggatagatcatctggcgttcgagcatcacggcgaggtctggctacaatgggacagcaacgacgcgctgttccctccggcgttagtcgaaacattgttcgacgcctactgccagttgattaaccaactctgcgatgacgaaagcgcctggcaaaagccgttcgcagatatgatgcccgccagccagcgcgcgatacgcgaacgggtcaacgccaccggcgcccccattcccgaaggcttgctgcatgaaggcattttccgtatcgctctgcaacagccgcaggcgctggcggtaacggacatgcgttatcagtggaattatcatgagctgacagactatgcccgccgttgcgcgggcaggttaatcgagtgcggggttcagcccggcgataatgtggctatcacgatgtcgaaaggcgcaggacaacttgttgcggttctggccgtcctgctggccggggcggtttacgttccggtttcgctggatcagcctgccgcacggcgcgagaaaatctacgctgacgccagcgtccggctggtgctcatttgtcagcacgacgccagcgccgggtcagacgatattcccgtccttgcctggcagcaggccattgaggcggagccgatcgccaacccggtagtacgcgcccccacgcaaccggcctacattatctacacctccggctctaccggtacgccgaaaggggtagtcatttctcaccggggagcgcttaacacctgttgcgatatcaatacccgctatcaggttggcccgcatgacagggtgctggccctctccgccctacattttgatttatcggtttacgacatttttggcgtactgcgcgcgggcggcgcgctggtgatggtgatggaaaatcaacggcgcgatcctcacgcatggtgtgagctgatccagcgccatcaggtcacgctctggaacagcgtcccggcgctgttcgatatgctgctgacctggtgtgaaggtttcgccgacgccacgccggaaaacctgcgcgcagtgatgctttccggcgactggatcgggcttgacctccccgcccgttatcgggccttccggccacaaggacaatttatcgcgatgggcggcgccaccgaggcgtctatctggtctaacgcctgcgaaattcacgacgtccccgcccactggcgctccatcccttacggttttccgctaaccaaccaacgctaccgggtggtggatgaacagggccgggactgccctgactgggtgccgggtgaattatggattggcggcattggggtcgcggaaggctatttcaacgatcccctgcgtagcgagcagcaatttttgacgctcccggacgagcgctggtatcgcaccggcgatctcggctgctactggccagatggcacaatcgagttcctcggtcgtcgcgacaagcaggtcaaagtcggaggatatcgcatcgagctgggcgaaatcgaaagcgcgctcagccagctggcgggggtgaaacaagcaaccgttctggcgatcggcgaaaaagaaaaaacgctggcggcatacgttgttcctcagggcgaggctttttgcgttaccgatcatcggaacccggcactgccgcaggcgtggcacacgcttgcgggaacgttgccctgttgcgccatctcgccagagatctccgcagaacaggtagccgatttccttcagcatcgcctgctaaaactgaagccgggtcacaccgctggcgccgatcctctccccctgatgaactcactcgctatccagccgcgctggcaggccgtggtggaacgctggttagcatttctggtgacacaacggcgactgaagcccgctgctgaaggttatcaggtctgcgctggtgaagaacgcgaggatgagcacccgcacttcagcggacatgatttaacgttatcgcaaattcttcgcggtgcccgtaacgaactgtcgttactgaacgacgcgcagtggtcgccggaaagcctggcctttaaccatccggccagcgccccgtatattcaggaactggcgacaatttgccaacagcttgcacagcgcttacagcgcccggtacgcctgcttgaggtgggaacccgcactggccgcgccgcagaatcgctgttagcacagctcaacgccggacagattgagtatgtcgggcttgagcagagccaggagatgctgctgagcgcccggcagaggctcgccccctggcctggcgcccgtctgtccctctggaatgcagacacgctggcgacgcacgctcactcggcggacattatctggcttaataacgccctgcatcgtctgctgccggaagatcccgggctccttgcgacattacaacagcttgccgttcccggcgcgctgctctacgtgatggagtttcgccagttaacgccgtccgccctactcagcacgctcctgttaaccaatgggcagccggaggccttgctgcataacagcgccgactgggcggcattatttagcgcggccggcttcaactgtcagcatggcgatgaggtcgcggggttacaacgcttcctcgtacaatgtcctgacaggcaggtgcgccgcgatccccgtcaacttcaggccgccctcgccgggcgtctgccggggtggatggtgccgcaacggatcgtattcctcgacgccttaccgctgacggctaacgggaaaattgactaccaggcgctgaagcgtcgtcatacccctgaagcggaaaacccggccgaagcggatttaccccagggcgacattgaaaaacaggttgccgccctctggcagcaactcttatcaactggcaatgtcaccagagaaaccgacttcttccagcaaggcggcgatagcctgctggcgacccgtctgaccgggcaacttcatcaggcaggttatgaagcgcaattaagcgacctgtttaatcatccccggctggcggattttgccgccacgctgcggaaaaccgacgtcccggtcgaacaaccattcgtccactcccctgaagatcgctaccagccctttgcgcttaccgacgtgcagcaggcttacctggtggggcgtcagccgggctttgccctgggcggcgtcggctcacatttctttgttgaatttgaaattgccgatctggacctcacccggctggagacggtctggaaccgattaatcgcccgccacgatatgctgcgcgccatcgtgcgtgatggacagcaacaggtgctcgaacagacgcccccttgggtgatacccgcacacaccctccatacgcctgaagaggcgttgcgggtgcgcgaaaaactggcgcatcaggtactcaaccccgaagtgtggccggtattcgatctccaggtcggatacgtggacgggatgcctgcccgcctgtggctgtgtctggataacctgttgcttgacggtctgagcatgcagatcctgctggcggagctggagcacggctaccgctacccgcaacagctgcttccgccgctgcccgtcaccttcagggattatctgcaacaaccctcgctacagtcgcccaatccagattctctggcatggtggcaggcgcagcttgatgatattcctccggcgcctgcgttgccgctgcgctgcttgcctcaggaggttgaaacaccgcgcttcgcccgcctgaacggcgcactggacagcacgcgctggcatcggctgaaaaaacgggcggctgacgcccatctcaccccgtcggccgtactgttgtcggtgtggtcaacggttctctctgcatggagtgcacagcctgagttcacgcttaaccttacgcttttcgacaggcgaccgctgcacccgcaaatcaaccagattctgggcgatttcacctcgctgatgctgctgagctggcatcccggcgaaagctggctgcacagcgcgcagtcactacagcagcggctgagccagaacctcaaccaccgcgatgtgtcagccatccgcgtgatgcgtcaactggcgcaacggcaaaacgtgcctgccgttccgatgcccgtcgtctttaccagcgcactgggctttgagcaggataacttcctcgcccggcgtaatctgctcaaaccggtctggggcatctcccagacgccgcaggtctggctcgatcaccagatttatgaatccgaaggcgaactgcgctttaactgggattttgtcgccgcgctgtttcctgccgggcaggtggagcgccagtttgaacagtattgcgcattgctaaaccgaatggccgaggatgaaagcggctggcaactgccgctcgccgcgctggtgcctcccgttaaacacgcagggcaatgcgcagagcgctcaccgcgcgtatgccctgagcactctcagccacacattgcggcggacgagagcaccgtcagcctgatttgcgacgccttccgcgaggtggttggcgagtctgtcacgcccgcagaaaacttctttgaggcgggcgcaacgtcgctgaatctggtgcaactgcacgttttgttacaacgtcacgaattttccaccctgacgttgcttgacctcttcacccacccttctcctgctgccctggccgattatctggccggcgtcgccacggtggagaaaacaaaacgacctcgccctgttcgccgtcgtcagcggcggatatag

SEQ ID NO: 4738 - protein, 2035 aa, Escherichia coli
MISGAPSQDSLLPDNRHAADYQQLRERLIQELNLTPQQLHEESNLIQAGLDSIRLMRWLHWFRKNGYRLTLRELYAAPTLAAWNQLMLSRSPENAEEETPPDESSWPNMTESTPFPLTPVQHAYLTGRMPGQTLGGVGCHLYQEFEGHCLTASQLEQAITTLLQRHPMLHIAFRPDGQQVWLPQPYWNGVTVHDLRHNDAESRQAYLDALRQRLSHRLLRVEIGETFDFQLTLLPDNRHRLHVNIDLLIMDASSFTLFFDELNALLAGESLPAIDTRYDFRSYLLHQQKINQPLRDDARAYWLAKASTLPPAPVLPLACEPATLREVRNTRRRMIVPATRWHAFSNRAGEYGVTPTMALATCFSAVLARWGGLTRLLLNITLFDRQPLHPAVGAMLADFTNILLLDTACDGDTVSNLARKNQLTFTEDWEHRHWSGVELLRELKRQQRYPHGAPVVFTSNLGRSLYSSRAESPLGEPEWGISQTPQVWIDHLAFEHHGEVWLQWDSNDALFPPALVETLFDAYCQLINQLCDDESAWQKPFADMMPASQRAIRERVNATGAPIPEGLLHEGIFRIALQQPQALAVTDMRYQWNYHELTDYARRCAGRLIECGVQPGDNVAITMSKGAGQLVAVLAVLLAGAVYVPVSLDQPAARREKIYADASVRLVLICQHDASAGSDDIPVLAWQQAIEAEPIANPVVRAPTQPAYIIYTSGSTGTPKGVVISHRGALNTCCDINTRYQVGPHDRVLALSALHFDLSVYDIFGVLRAGGALVMVMENQRRDPHAWCELIQRHQVTLWNSVPALFDMLLTWCEGFADATPENLRAVMLSGDWIGLDLPARYRAFRPQGQFIAMGGATEASIWSNACEIHDVPAHWRSIPYGFPLTNQRYRVVDEQGRDCPDWVPGELWIGGIGVAEGYFNDPLRSEQQFLTLPDERWYRTGDLGCYWPDGTIEFLGRRDKQVKVGGYRIELGEIESALSQLAGVKQATVLAIGEKEKTLAAYVVPQGEAFCVTDHRNPALPQAWHTLAGTLPCCAISPEISAEQVADFLQHRLLKLKPGHTAGADPLPLMNSLAIQPRWQAVVERWLAFLVTQRRLKPAAEGYQVCAGEEREDEHPHFSGHDLTLSQILRGARNELSLLNDAQWSPESLAFNHPASAPYIQELATICQQLAQRLQRPVRLLEVGTRTGRAAESLLAQLNAGQIEYVGLEQSQEMLLSARQRLAPWPGARLSLWNADTLATHAHSADIIWLNNALHRLLPEDPGLLATLQQLAVPGALLYVMEFRQLTPSALLSTLLLTNGQPEALLHNSADWAALFSAAGFNCQHGDEVAGLQRFLVQCPDRQVRRDPRQLQAALAGRLPGWMVPQRIVFLDALPLTANGKIDYQALKRRHTPEAENPAEADLPQGDIEKQVAALWQQLLSTGNVTRETDFFQQGGDSLLATRLTGQLHQAGYEAQLSDLFNHPRLADFAATLRKTDVPVEQPFVHSPEDRYQPFALTDVQQAYLVGRQPGFALGGVGSHFFVEFEIADLDLTRLETVWNRLIARHDMLRAIVRDGQQQVLEQTPPWVIPAHTLHTPEEALRVREKLAHQVLNPEVWPVFDLQVGYVDGMPARLWLCLDNLLLDGLSMQILLAELEHGYRYPQQLLPPLPVTFRDYLQQPSLQSPNPDSLAWWQAQLDDIPPAPALPLRCLPQEVETPRFARLNGALDSTRWHRLKKRAADAHLTPSAVLLSVWSTVLSAWSAQPEFTLNLTLFDRRPLHPQINQILGDFTSLMLLSWHPGESWLHSAQSLQQRLSQNLNHRDVSAIRVMRQLAQRQNVPAVPMPVVFTSALGFEQDNFLARRNLLKPVWGISQTPQVWLDHQIYESEGELRFNWDFVAALFPAGQVERQFEQYCALLNRMAEDESGWQLPLAALVPPVKHAGQCAERSPRVCPEHSQPHIAADESTVSLICDAFREVVGESVTPAENFFEAGATSLNLVQLHVLLQRHEFSTLTLLDLFTHPSPAALADYLAGVATVEKTKRPRPVRRRQRRI

SEQ ID NO: 4739 - DNA, 9492 bp, Escherichia coli
atggataacttgcgcttctcttctgcgccgacagcagattccattgatgcatcgatcgctcaacactacccggactgcgaacctgtcgcggttatcggctacgcctgccattttcctgaatcgccggatggcgaaacgttctggcaaaatctgctggaaggtcgtgaatgcagccgacgctttacgcgcgaagagcttctggccgtcggtctggatgccgccatcattgacgatcctcattatgtcaatatcggtacggtgttagacaacgccgactgcttcgacgccaccctgtttggctattcgcgacaggaagcggagtcgatggacccgcagcagcgcctgtttttgcaggcggtctggcatgcgctggaacatgccggttatgcccccggcgccgtcccccataagaccggcgttttcgcctcttcccggatgagtacctaccccggtcgcgaagcattgaacgtgacagaagtcgcgcaggtaaaaggtctgcaatctctgatgggcaatgataaagactatattgccacccgcgccgcgtacaaactcaacctgcacggcccggcgttatcggtacagaccgcctgctccagctcgctggttgccgtgcatctggcctgtgaaagcctgcgcgcaggcgaatccgatatggcggttgccggcggcgtggcgctctctttcccccagcaggcaggctaccgctaccagcccggaatgattttctctcctgatggtcactgtcgtccctttgacgcctcggctgagggcacctgggccggtaacggtctcggctgcgtggtgctgcgtcgcctgaaagacgcgctactgtcaggcgatccgattatctcggtgatcctctccagcgcggtcaacaacgacggcaacagaaaggtcggctataccgccccttccgtcgcagggcaacaggcagtcatcgaagaggcgttaatgctggcggccatcgacgacaggcaggtaggttacattgaaacccacggcaccggcacaccgctgggcgacgcgattgaaattgaagcgttacgcaacgtctatgcgcctcgcccgcaggatcagcgctgtgcgctcggttccgtgaaaagtaacatgggccatctggataccgcggcgggcattgccggactgctgaaaaccgttctggcagtcagtcgcgggcaaattcctcccttactgaattttcacacccccaacccggcgctgaaacttgaagagagcccctttaccataccggtgtcggcacaggcatggcaggacgaaatgcgctatgcgggcgtctcctcctttggtattggcggcaccaactgccatatgatcgtcgcctcgctgcccgacgcgctcaacgcgcgcctccccaatacggatagcggcagaaaaagtaccgcgctgctgctcagcgccgccagcgacagcgcgttgcggcggctggcgacggattatgccggggcgctgagagagaatgcggatgccagctctctggccttcacagccctgcacgcgcgccgtctcgatctccccttccgcctggcggcgccattaaaccgtgaaaccgccgaggcgctcagcgcctgggccggtgagaaatcgggggcgctggtttacagcggccacggcgccagcggcaagcaggtgtggctgtttaccggccagggctcgcactggcgcactatgggtcaaacgatgtaccatcactcaacggcgtttgccgacacgctggatcgctgtttttccgcctgtagcgaaatgctcacgccgtcactgcgcgaagcgatgtttaaccccgattcggcgcagctggacaatatggcctgggcgcagccggcgattgtcgcgtttgaaatcgcgatggcggcgcactggcgtgctgaaggactgaagccagacttcgccattgggcattccgtcggtgaatttgccgctgccgttgtctgcggacactatacgattgaacaggtcatgccactggtttgtcggcgcggcgcgctaatgcagcagtgcgcaagcggcgcgatggtggcggtatttgcagacgaagacacgctgatgccgctggctcgccagtttgagctggatctcgccgccaacaacggtacgcaacatacggtattttccgggccggaagcccgtctcgcggtattttgcgccacgctctcgcagcatgacattaactatcgtcgcctgagcgtaaccggtgcggcgcactccgctttactggagccgatactcgatcggttccaggacgcctgcgcgggactgcacgcggagccggggcaaataccgattatttccacgctcaccgccgacgtcattgatgagtcaacgctcaaccaggcggattactggcgccgacacatgcgccagccggtgcgttttatccagagtattcaggtggcgcatcagctcggcgcccgcgtttttctggagatggggcccgatgcccagttggttgcttgcgggcagcgcgaataccgcgataacgcatactggatagccagcgcccggcgtaacaaagaggcgagcgatgtcctcaatcaggccctgctccagctttacgctgccggcgtcgccctaccgtgggccgacctgctggcgggcgatggacaacgtatcgctgcgccatgttatccgtttgatactgaacgttactggaaagagcgcgtctccccggcctgcgagcctgccgacgcagcgctgtctgccgggctggaggtggcgagtcgcgccgcgacagcgctcgatctccctcgcctggaagcgcttaaacagtgcgccacgcgactgcacgccatctacgtcgatcaactggtacaacgctgtaccggctatgccattgagaacggcgtggacgccatgaccatcatgcgccgtggacgtctgctgccccgctaccagcagctactccagcgcctgctgaataactgcgtggtcgacggcgattaccgctgcaccgacgggcgatacgtccgcgcccgccccattgaacatcaacagcgggaatcactgctgacggaacttgccggttattgtgaaggttttcaggctattcccgacaccatcgcccgtgccggcgatcggttatatgaaatgatgagcggcgcggaagaaccggtggcgattatcttcccgcaaagcgcctccgacggcgtggaagtgctgtatcaggaattcagctttggccgctatttcaaccaaatcgccgccggggtattacgcggcattgtccagacgcgtcagccccgccagccgttgcgtattcttgaagttggcggcggaaccggcggcaccaccgcgtggctgctgccggaactcaacggcgttccggcactggagtaccatttcaccgatatctcggcgctgttcacccgtcgcgcccagcagaaattcgccgactacgattttgtgaagtatagcgagctggatctcgaaaaagaggcgcagtctcagggtttccaggcacagtcttacgatcttatcgtggcagcgaacgtgattcacgccacccgccatattggccgcacgctcgataatctgcgccccctgctcaagccgggcgggcgcctgctgatgcgcgaaatcacccagccaatgcgtctgtttgacttcgttttcggcccgctggttcttccgctacaggatctcgacgcccgcgaaggtgagttattcctcaccaccgctcagtggcaacaacagtgccgccacgccggattcagcaaagtggcgtggctaccgcaggatggcagcccgaacgccgggatgagcgaacatatcattctcgccacgctgcccggtcaggcggttagcgccgtaacattcaccgcgccatcagaacccgtgttggggcaggcgctgacggataacggtgattatctcgccgactggtctgattgcgcaggtcagcccgaacagtttaacgctcgctggcaggaggcatggcgtctgctttcacagcgtcatggcgacgctctgcctgtggaaccgccccccgtcgccgccccggagtggctggggaaggttcgcttaagctggcaaaacgaagccttttcccgcggtcagatgcgcgttgaagcccgtcatcctgctggcgagtggctgccgctatcgcccgccgcgcctcttcctgcgccgcaaacgcattatcaatggcgctggacgcccctcaacgtcgccagcattgaccatccgcttacctttagcttcagcgccggtacgcttgcgcgcagcgacgagctggcgcaatacggcatcattcacgatccgcacgcctcttcacgactgatgattgttgaggagagcgaggatacgctggccttagcggagaaagtgatagcagcgctcaccgccagcgcagccggattgattgtggttactcgccgcgcgtggcgagtcgaggaaaatgaagcactctctgcatcccatcacgcgctatgggccttgcttcgcgtcgcggccaacgaacagccggaacggttgcttgccgccatcgatctcgccgaaaacaccccgtgggaaacgctgcatcaagggttgagcgcagtctcactatcacagcgctggctcgccgcacggggtgacaccctttggcttccttcactgtcgcccaatacgggatgcgccgctgaattaccggcaaacgtgtttaccggcgatagccgctggcatctggtgaccggagcgtttggcggattaggccgccttgccgtgaactggctcagagaaaaaggggcgcgacgcatcgccctgctggcgccgcgcgtggatgagtcatggctacgcgacgtggagggcgggcagacgcgcgtctgccgttgtgatgtgggcgatgccgggcaactggccacggttcttgacgatctggcggccaacggcggcattgccggagcgattcatgccgctggcgtattggctgacgcgcccttacaggagcttgatgaccaccagctggctgccgttttcgcggtaaaagcgcaggcggcaagccagctgttgcaaaccctgcgcaaccacgacggacgctatcttattctctactcttccgctgccgccaccctcggcgcgccgggtcagagcgcccatgcgctggcctgcggctacctggacgggctggcccagcagttttccacccttgatgcgccgaaaacgctctctgtcgcctggggcgcatggggagaaagcggtcgggcggccacgccggaaatgctggcgacgctcgccagccgaggtatgggcgcgttaagcgatgccgaaggctgctggcacctggaacaggcggtgatgcgcggcgccccgtggcgactggcgatgcgcgtttttaccgacaaaatgcccccgttacaacaggctctgtttaacatcagcgccacagaaaaagccgcaacgccggtcattcctcctgctgatgacaacgcctttaacggcagcctgagcgatgaaacagcggtgatggcatggctgaaaaagcggattgcggttcagctaaggctgagcgatccggcgtcactgcatccaaaccaggatctgttgcaactcggcatggactcgctgctcttccttgaactcagtagcgatattcagcactacctgggtgtacgcatcaatgcggaacgggcgtggcaggatctgtctcctcatggactcacgcagcttatctgttctaagccagaggcgacgcctgccgcttcgcagccggaagtgttgcggcacgacgccgacgagcgttatgcgcccttccctttgacgcccattcagcacgcctactggctggggcgaacccacctcattggctatggcggcgtcgcctgtcacgtcctgtttgagtgggataaacgccacgatgagttcgatctcgccatactggagaaagcatggaaccagctcatcgcacgccacgatatgttgcgtatggtggttgatgccgacgggcagcagcgaatcctggcgacaacgccggagtatcacatcccgcgtgacgatctgcgcgcgctttccccggaagaacagcgcatcgcgctggaaaaacggcggcatgaactgagctatcgcgttttgcctgccgaccagtggcctctttttgagctggtggtcagcgaaatcgacgattgccattaccgtctgcatatgaacctcgaccttttgcagtttgatgtgcagagttttaaagtcatgatggacgacctggcgcaggtctggcgcggtgaaacgctggcaccgctcgctattaccttccgtgattatgtgatggctgaacaggcgcgccgacagacatcggcatggcacgatgcctgggattactggcaggaaaaactgccgcaactgcccttagcgccagagctgccggtggttgagacgcccccggaaacgccacacttcaccaccttcaaatcgacgatcggcaagacagaatggcaggccgtgaaacagcgctggcagcagcaaggcgtcacaccgtctgccgcgctgctcacgctgtttgccgccacccttgagcgctggagccgtaccacaacatttacgctgaacctgacgttcttcaatcgccagccgatccatccgcaaatcaaccagttgattggtgattttacctccgtcacgctggttgattttaacttctcagcgccggtgacgttgcaagagcagatgcaacagacccaacagcgcctctggcaaaacatggcgcacagtgaaatgaacggtgttgaggtgatccgtgagctgggccgcctgcgcggatcacaacgtcaaccgctgatgccggtagtgtttaccagtatgctggggatgacgctggaaggcatgactatcgatcaggcgatgagccatctgttcggcgaaccctgctatgtattcacgcaaacgccgcaggtctggctggatcatcaggtcatggagagcgacggcgagttgatgtttagctggtactgcatggacaacgtgctggaacccggcgctgccgaggcgatgtttaatgactattgcgccatcctgcaagccgtcatcgccgcccctgaaagcctgaagactctcgccagcggcatcgccgggcacattccccgccgacgctggccgctgaacgcgcaggcggactacgacctgcgggatattgagcaggcgacgctcgaataccccggcatccggcaggccagagcggaaataaccgaacagggcgcgttgacgctggatatcgtgatggccgacgatccgtcgccatcagcggcgatgcctgatgagcacgaacttacccaactggcgctgccgttgcctgagcaggcgcagcttgatgagctggaggcgacctggcgctggctggaggcgcgtgcgctacaggggatcgcggctacgctaaatcgtcacggcctgtttaccacgccggagatcgcccatcgctttagcgcagtagtacaggcgctgtccgcgcaagcgtctcaccagcgtctgctgcgccagtggctacagtgtctgacggaaagagagtggttaatccgcgaaggtgaaagctggcgctgccgcattccgctcagcgagattcctgagcctcaggaagcgtgcccgcaaagccaatggagccaggcgctggcgcagtatctggaaacctgcatcgcccggcacgacgccctcttctccgggcagtgttctccgctggaattgctgttcaacgagcagcatcgcgttaccgacgcgctgtatcgcgacaaccccgccagcgcctgtctgaatcgctataccgcgcagattgccgccttgtgcagcgcagaacggattctggaggttggcgccggaaccgcagccactaccgcgccggtgctgaaggccacgcggaacacgcggcagtcgtaccacttcacggacgtctccgcgcagttcctcaatgacgccagagcccgtttccatgatgaatcgcaggtgtcttatgccttgttcgacatcaaccagccgctggatttcaccgcccacccggaggcgggttacgacctgatcgttgccgtcaatgtgctccacgacgccagccatgtcgtccagacgttgcgcagattaaaactgttgctgaaagccggcggacgtttgctgatcgttgaagcgacggagcgaaacagcgtattccagctggcgagcgtgggctttattgagggattaagcggataccgcgatttccgccgccgggatgagaaaccgatgctcacccgctccgcatggcaggaggttctcgttcaggccgggtttgcaaacgagctggcgtggcccgcgcaggaatcgtcgccgctgcgccagcatctgctggtagcgcgttcgcctggcgtaaatcgcccggataaaaaagccgtgagccgctatttacagcagcgctttggcaccggtctgcccattttacagatccggcaaagagaagcgttatttacgccgctgcatgccccgtctgatgcgccgactgagccagccaaacccacgccagttgccggggggaatccggcgctggaaaaacaggtggctgaactctggcaatcgctgctgtctcgccccgtggcaaggcatcacgactttttcgaactgggcggcgacagcctgatggcgacaaggatggtcgcgcagctaaaccggagagggattgccagggctaaccttcaggatctgttcaaccattcgacgctgagcgacttctgcgcccatctacaggcggctacgtcaggagaggacaacccgatacccctttgccagggcgacggtgaggaaaccctgtttgtcttccacgcttcagacggcgatatcagcgcctggctgccgctcgctaacgcgttgaacaggcgcgttttcggcctgcaagcaaaatcgccgcagcgctttgccacgctcgaccagatgatcgatgagtatgtcgggtgcatccgtcgtcagcagcctcacggcccttatgtgctggcgggttggtcgtatggcgcgtttcttgcggcgggcgccgcacagcgcctgtacgccaaaggcaagcaggttcggatggtgttaatcgatcccgtgtgccgacaggatttctgttgcgaaaaccgggcggccctgctgcgcctgttagccgaaggacaaacgcctctggcactgcccgaacatttcgaccagcagacgcccgacagccagcttgccgactttatcagcctcgctaaaacggtcggtatggtgtcgcaaaacctgacgctgcaagcggcagaaacgtggctcgacaacatcgcgcatctgctgcgtttactgactgagcatacgccgggcgaaagcgttccggtcccctgtctcatggtgtatgccgccgggagacccgcgcgctggacgccagcagaaaccgagtggcagggctggataaacaacgccgacgacgctgtgattgaagccagccactggcaaatcatgatggaagccccccacgttcaggcttgtgcgcaacacattacgcgctggctttgcgcaacctcaacgcaaccggagaacacgttatga

SEQ ID NO: 4740 - protein, 3163 aa, Escherichia coli
MDNLRFSSAPTADSIDASIAQHYPDCEPVAVIGYACHFPESPDGETFWQNLLEGRECSRRFTREELLAVGLDAAIIDDPHYVNIGTVLDNADCFDATLFGYSRQEAESMDPQQRLFLQAVWHALEHAGYAPGAVPHKTGVFASSRMSTYPGREALNVTEVAQVKGLQSLMGNDKDYIATRAAYKLNLHGPALSVQTACSSSLVAVHLACESLRAGESDMAVAGGVALSFPQQAGYRYQPGMIFSPDGHCRPFDASAEGTWAGNGLGCVVLRRLKDALLSGDPIISVILSSAVNNDGNRKVGYTAPSVAGQQAVIEEALMLAAIDDRQVGYIETHGTGTPLGDAIEIEALRNVYAPRPQDQRCALGSVKSNMGHLDTAAGIAGLLKTVLAVSRGQIPPLLNFHTPNPALKLEESPFTIPVSAQAWQDEMRYAGVSSFGIGGTNCHMIVASLPDALNARLPNTDSGRKSTALLLSAASDSALRRLATDYAGALRENADASSLAFTALHARRLDLPFRLAAPLNRETAEALSAWAGEKSGALVYSGHGASGKQVWLFTGQGSHWRTMGQTMYHHSTAFADTLDRCFSACSEMLTPSLREAMFNPDSAQLDNMAWAQPAIVAFEIAMAAHWRAEGLKPDFAIGHSVGEFAAAVVCGHYTIEQVMPLVCRRGALMQQCASGAMVAVFADEDTLMPLARQFELDLAANNGTQHTVFSGPEARLAVFCATLSQHDINYRRLSVTGAAHSALLEPILDRFQDACAGLHAEPGQIPIISTLTADVIDESTLNQADYWRRHMRQPVRFIQSIQVAHQLGARVFLEMGPDAQLVACGQREYRDNAYWIASARRNKEASDVLNQALLQLYAAGVALPWADLLAGDGQRIAAPCYPFDTERYWKERVSPACEPADAALSAGLEVASRAATALDLPRLEALKQCATRLHAIYVDQLVQRCTGYAIENGVDAMTIMRRGRLLPRYQQLLQRLLNNCVVDGDYRCTDGRYVRARPIEHQQRESLLTELAGYCEGFQAIPDTIARAGDRLYEMMSGAEEPVAIIFPQSASDGVEVLYQEFSFGRYFNQIAAGVLRGIVQTRQPRQPLRILEVGGGTGGTTAWLLPELNGVPALEYHFTDISALFTRRAQQKFADYDFVKYSELDLEKEAQSQGFQAQSYDLIVAANVIHATRHIGRTLDNLRPLLKPGGRLLMREITQPMRLFDFVFGPLVLPLQDLDAREGELFLTTAQWQQQCRHAGFSKVAWLPQDGSPNAGMSEHIILATLPGQAVSAVTFTAPSEPVLGQALTDNGDYLADWSDCAGQPEQFNARWQEAWRLLSQRHGDALPVEPPPVAAPEWLGKVRLSWQNEAFSRGQMRVEARHPAGEWLPLSPAAPLPAPQTHYQWRWTPLNVASIDHPLTFSFSAGTLARSDELAQYGIIHDPHASSRLMIVEESEDTLALAEKVIAALTASAAGLIVVTRRAWRVEENEALSASHHALWALLRVAANEQPERLLAAIDLAENTPWETLHQGLSAVSLSQRWLAARGDTLWLPSLSPNTGCAAELPANVFTGDSRWHLVTGAFGGLGRLAVNWLREKGARRIALLAPRVDESWLRDVEGGQTRVCRCDVGDAGQLATVLDDLAANGGIAGAIHAAGVLADAPLQELDDHQLAAVFAVKAQAASQLLQTLRNHDGRYLILYSSAAATLGAPGQSAHALACGYLDGLAQQFSTLDAPKTLSVAWGAWGESGRAATPEMLATLASRGMGALSDAEGCWHLEQAVMRGAPWRLAMRVFTDKMPPLQQALFNISATEKAATPVIPPADDNAFNGSLSDETAVMAWLKKRIAVQLRLSDPASLHPNQDLLQLGMDSLLFLELSSDIQHYLGVRINAERAWQDLSPHGLTQLICSKPEATPAASQPEVLRHDADERYAPFPLTPIQHAYWLGRTHLIGYGGVACHVLFEWDKRHDEFDLAILEKAWNQLIARHDMLRMVVDADGQQRILATTPEYHIPRDDLRALSPEEQRIALEKRRHELSYRVLPADQWPLFELVVSEIDDCHYRLHMNLDLLQFDVQSFKVMMDDLAQVWRGETLAPLAITFRDYVMAEQARRQTSAWHDAWDYWQEKLPQLPLAPELPVVETPPETPHFTTFKSTIGKTEWQAVKQRWQQQGVTPSAALLTLFAATLERWSRTTTFTLNLTFFNRQPIHPQINQLIGDFTSVTLVDFNFSAPVTLQEQMQQTQQRLWQNMAHSEMNGVEVIRELGRLRGSQRQPLMPVVFTSMLGMTLEGMTIDQAMSHLFGEPCYVFTQTPQVWLDHQVMESDGELMFSWYCMDNVLEPGAAEAMFNDYCAILQAVIAAPESLKTLASGIAGHIPRRRWPLNAQADYDLRDIEQATLEYPGIRQARAEITEQGALTLDIVMADDPSPSAAMPDEHELTQLALPLPEQAQLDELEATWRWLEARALQGIAATLNRHGLFTTPEIAHRFSAVVQALSAQASHQRLLRQWLQCLTEREWLIREGESWRCRIPLSEIPEPQEACPQSQWSQALAQYLETCIARHDALFSGQCSPLELLFNEQHRVTDALYRDNPASACLNRYTAQIAALCSAERILEVGAGTAATTAPVLKATRNTRQSYHFTDVSAQFLNDARARFHDESQVSYALFDINQPLDFTAHPEAGYDLIVAVNVLHDASHVVQTLRRLKLLLKAGGRLLIVEATERNSVFQLASVGFIEGLSGYRDFRRRDEKPMLTRSAWQEVLVQAGFANELAWPAQESSPLRQHLLVARSPGVNRPDKKAVSRYLQQRFGTGLPILQIRQREALFTPLHAPSDAPTEPAKPTPVAGGNPALEKQVAELWQSLLSRPVARHHDFFELGGDSLMATRMVAQLNRRGIARANLQDLFNHSTLSDFCAHLQAATSGEDNPIPLCQGDGEETLFVFHASDGDISAWLPLANALNRRVFGLQAKSPQRFATLDQMIDEYVGCIRRQQPHGPYVLAGWSYGAFLAAGAAQRLYAKGKQVRMVLIDPVCRQDFCCENRAALLRLLAEGQTPLALPEHFDQQTPDSQLADFISLAKTVGMVSQNLTLQAAETWLDNIAHLLRLLTEHTPGESVPVPCLMVYAAGRPARWTPAETEWQGWINNADDAVIEASHWQIMMEAPHVQACAQHITRWLCATSTQPENTL

SEQ ID NO: 4741 - DNA, 1101 bp, Escherichia coli
atgatgccgtccgcctccccaaagcaacgcgtactgattgtgggcgccaaatttggcgaaatgtacctgaatgcctttatgcagcccccggaggggctggaactggtcggcctgctggcgcagggaagcgcccgttcaagagagctggctcatgcgtttggcattccgctgtatacctcgccggaacagataaccaggatgccggatatcgcctgtattgtcgtgcgttcgaccgtcgccggaggaaccggtacgcagcttgccagacactttctgacgcgcggcgtacacgtcattcaggagcatcccctccacccggatgacatcagttccttacaaacgctggcgcaggaacagggctgctgctattgggtaaacacgttttatccgcatacgcgcgcgggacgcacatggcttcgcgatgcgcagcagctgcgtcgctgcctggctaagacgccgccggtagtccacgccaccaccagccgacagttgctctactccactctggatttgttgttgctggctctgggcgttgatgccgccgccgtggagtgcgacgtggttggcagctttagcgattttcactgtctgagactcttctggccggagggagaagcctgcctgctgcttcagcgctatctcgatcctgacgatccagatatgcatagccttatcatgcaccgcctgctgctgggctggccggaaggtcatctttcgctggaggcgagctacggccccgtcatctggtcatccagcctgtttgtcgcagaccatcaggagaacgcccacagcctctaccgcagaccggagatcctgcgcgatctgccgggtctgatgcgcagcgcggcgcccctgagctggcgcgactgctgcgaaaccgtcgggccggagggcgtcagctggttgctacaccagttgcgcagcaatctggcgggcgaacatccaccagcggcctgccaaagcgtacatcagatcgcgttatcacgtttatggcagcagattttacgtaagaccggcaatgcggagatcagacgcctgacgccgccgcaccacgaccggttagccggtttctacaacgatgatgataaggaggcgctgtga

SEQ ID NO: 4742 - protein, 366 aa, Escherichia coli
MMPSASPKQRVLIVGAKFGEMYLNAFMQPPEGLELVGLLAQGSARSRELAHAFGIPLYTSPEQITRMPDIACIVVRSTVAGGTGTQLARHFLTRGVHVIQEHPLHPDDISSLQTLAQEQGCCYWVNTFYPHTRAGRTWLRDAQQLRRCLAKTPPVVHATTSRQLLYSTLDLLLLALGVDAAAVECDVVGSFSDFHCLRLFWPEGEACLLLQRYLDPDDPDMHSLIMHRLLLGWPEGHLSLEASYGPVIWSSSLFVADHQENAHSLYRRPEILRDLPGLMRSAAPLSWRDCCETVGPEGVSWLLHQLRSNLAGEHPPAACQSVHQIALSRLWQQILRKTGNAEIRRLTPPHHDRLAGFYNDDDKEAL

SEQ ID NO: 4743 - DNA, 789 bp, Escherichia coli
atgtgcatcccgctgtggcccgcccggaacggcaatactgcgcatctggtcatgtgccctttcgctggcggcagcagtagcgcgtttcgccactggcaagctgagcaactggctgattgcgcgctttctctggtgacctggccggggcgcgatcgccttcgccatctggaaccgctcagaagcattacacaactggcggcactgctggcgaacgagctggaagcatccgtatcgcctgacacgccgcttttactcgccgggcacagcatgggggcgcaggtggcgtttgaaacctgccgacttctggagcaacgggggcttgcgccacaaggactgattatttccgggtgccatgccccgcatctgcattctgaacgccagctcagccatcgcgatgatgccgactttatcgctgagctgatagacattggcggatgttctcctgaactgcgggaaaaccaggaattaatgtcgctgtttcttcctcttctgcgcgctgatttttacgccaccgagagctatcactacgactcgcccgacgtctgtccgccgctgcgcacgcctgcgctgttattgtgcggcagccacgatcgcgaagcctcctggcagcaggtcgatgcctggcgtcagtggctgagccacgttacaggcccggtggtgattgacggcgatcacttctatcccattcaacaagcccggtccttttttacgcagattgtccgccattttccccacgcattttctgcaatgaccgcgtggcaaaaacagcccagtacttcagaaaggtga

SEQ ID NO: 4744 - protein, 262 aa, Escherichia coli
MCIPLWPARNGNTAHLVMCPFAGGSSSAFRHWQAEQLADCALSLVTWPGRDRLRHLEPLRSITQLAALLANELEASVSPDTPLLLAGHSMGAQVAFETCRLLEQRGLAPQGLIISGCHAPHLHSERQLSHRDDADFIAELIDIGGCSPELRENQELMSLFLPLLRADFYATESYHYDSPDVCPPLRTPALLLCGSHDREASWQQVDAWRQWLSHVTGPVVIDGDHFYPIQQARSFFTQIVRHFPHAFSAMTAWQKQPSTSER

SEQ ID NO: 4745 - DNA, 1578 bp, Escherichia coli
atgaattcttcctttgaatctctgattgaacagtatcccttacccattgccgaacagttgcgccactgggcggcccgttatgcctcgcgaattgccgtcgttgatgcaaaggggtcgttaacctacagcgagcttgatgcacaagttgacgaacttgccgcaggtctgtcatcactgggtttgcgttcgggggagcatgtaattgtgcagcttcccaacgacaacgcgtttgttaccctgctgttcgccttgttaagactgggcgttatccccgtgctggcgatgccctcgcaacgggcgctggatatcgacgcgctgattgagctggcgcaacccgtcgcttacgttattcacggggaaaaccacgcagagctggcccgacagatggcgcacaaacacgcctgcttgcgtcatgttctggtcgctggagagaccatgagcgacgattttacgccgctcttctcccttcacggtgagcgacaggcatggccgcagcctgatgtttccaccaccgcgttgttgttgctctcaggcggcacaaccggcacgcccaaactcatcccgcgccgacatgccgactatagctataacttcagcgcttctgctgaactgtgcggcatcagccaacagagcgtgtatctcgccgtcctcccggtggcgcataactttccgctggcctgccccggtattctgggaacgcttgcctgcggcggaaaagtggtgctgaccgacagcgccagctgtgatgaggtgatgcctttaatcgcgcaggaaagagtgactcacgtcgccctggttccggcgctggcgcaattatgggtgcaggccagggagtgggaagacagcgacctttcgtcgctgcgcgtcattcaggcaggcggcgcccggctcgacccgacgcttgctgagcaggttatcgccacctttgactgtaccctgcaacaggttttcggtatggcggaaggcctgctctgttttacccggctggacgatccgcatgccaccattctccacagccaggggcgcccgttgtcccctctggatgaaatccgcatcgttgatcaagacgagaacgacgtcgcgccgggcgaaaccgggcaattgttaacgcgcggcccttataccatttcgggctattaccgcgcccctgcccacaacacgcaggcctttaccgcgcaagggttttaccgcacaggcgacaatgtcaggctggatgaggtggggaacctgcacgttgagggacgcataaaagagcagatcaaccgcgccggagaaaaaatagccgcggctgaagtggaatcggcactgctgcgtttagcggaagtgcaagattgcgcggtggtcgccgcgccggacacgctgcttggcgagcggatttgcgcgtttatcatcgcgcagcaggtgccaactgactatcagcagttgcgtcaacaactgacccgtatggggctcagcgcgtggaaaattcctgaccaaatcgagtttctggaccactggccgctcaccgccgtcggcaagatagacaaaaaacgcctgacggctctcgccgtcgaccgttatcgccattctgcccaataa

SEQ ID NO: 4746 - protein, 525 aa, Escherichia coli
MNSSFESLIEQYPLPIAEQLRHWAARYASRIAVVDAKGSLTYSELDAQVDELAAGLSSLGLRSGEHVIVQLPNDNAFVTLLFALLRLGVIPVLAMPSQRALDIDALIELAQPVAYVIHGENHAELARQMAHKHACLRHVLVAGETMSDDFTPLFSLHGERQAWPQPDVSTTALLLLSGGTTGTPKLIPRRHADYSYNFSASAELCGISQQSVYLAVLPVAHNFPLACPGILGTLACGGKVVLTDSASCDEVMPLIAQERVTHVALVPALAQLWVQAREWEDSDLSSLRVIQAGGARLDPTLAEQVIATFDCTLQQVFGMAEGLLCFTRLDDPHATILHSQGRPLSPLDEIRIVDQDENDVAPGETGQLLTRGPYTISGYYRAPAHNTQAFTAQGFYRTGDNVRLDEVGNLHVEGRIKEQINRAGEKIAAAEVESALLRLAEVQDCAVVAAPDTLLGERICAFIIAQQVPTDYQQLRQQLTRMGLSAWKIPDQIEFLDHWPLTAVGKIDKKRLTALAVDRYRHSAQ

SEQ ID NO: 4747 - DNA, 2022 bp, Escherichia coli
atgaaaatgacacggctttatcctctggccttggggggattattgctccccgccattgctaatgcccagacttcacagcaagacgaaagcacgctggtggttaccgccagtaaacaatcttcccgctcggcatcagccaacaacgtctcgtctactgttgtcagcgcgccggaattaagcgacgccggcgtcaccgccagcgacaaactccccagagtcttgcccgggctcaatattgaaaatagcggcaacatgcttttttcgacgatctcgctacgcggcgtctcttcagcgcaggacttctataaccccgccgtcaccctgtatgtcgatggcgtccctcagctttccaccaacaccatccaggcgcttaccgatgtgcaaagcgtggagttgctgcgaggcccacagggaacgttatatggcaaaagcgctcagggcgggatcatcaacatcgtcacccagcagccggacagcacgccgcgcggctatattgaaggcggcgtcagtagccgcgacagttatcgaagtaagttcaacctgagcggccccattcaggatggcctgctgtacggcagcgtcaccctgttacgccaggttgatgacggcgacatgattaaccccgcgacgggaagcgatgacttaggcggcacccgcgccagcatagggaatgtgaaactgcgtctggcgccggacgatcagccctgggaaatgggctttgccgcctcacgcgaatgtacccgcgccacccaggacgcctatgtgggatggaatgatattaagggccgtaagctgtcgatcagcgatggttcaccagacccgtacatgcggcgctgcactgacagccagaccctgagtgggaaatacaccaccgatgactgggttttcaacctgatcagcgcctggcagcagcagcattattcgcgcaccttcccttccggttcgttaatcgtcaatatgcctcagcgctggaatcaggatgtgcaggagctgcgcgctgcaaccctgggcgatgcgcgtaccgttgatatggtgtttgggctgtaccggcagaacacccgcgagaagttaaattcagcctacgacatgccgacaatgccttatttaagcagtaccggctataccaccgctgaaacgctggccgcatacagtgacctgacctggcatttaaccgatcgttttgatatcggcggcggcgtgcgcttctcgcatgataaatccagtacacaatatcacggcagcatgctcggcaacccgtttggcgaccagggtaagagcaatgacgatcaggtgctcgggcagctatccgcaggctatatgctgaccgatgactggagagtgtatacccgtgtagcccagggatataaaccttccgggtacaacatcgtgcctactgcgggtcttgatgccaaaccgttcgtcgccgagaaatccatcaactatgaacttggcacccgctacgaaaccgctgacgtcacgctgcaagccgcgacgttttatacccacaccaaagacatgcagctttactctggcccggtcgggatgcagacattaagcaatgcgggtaaagccgacgccaccggcgttgagcttgaagcgaagtggcggtttgcgccaggctggtcatgggatatcaatggcaacgtgatccgttccgaattcaccaatgacagtgagttgtatcacggtaaccgggtgccgttcgtaccacgttatggcgcgggaagcagcgtgaacggcgtgattgatacgcgctatggcgcactgatgccccgactggcggttaatctggtcgggccgcattatttcgatggcgacaaccagttgcggcaaggcacctatgccaccctggacagcagcctgggctggcaggcgactgaacggatgaacatttccgtctatgtcgataacctgttcgaccgtcgttaccgtacctatggctacatgaacggcagcagcgccgtcgcgcaggtcaatatgggtcgcaccgtcggtatcaatacgcgaattgatttcttctga

SEQ ID NO: 4748 - protein, 673 aa, Escherichia coli
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 4749 - DNA, 750 bp, Escherichia coli
atgtcaaaaaaatatcagccattgcttataactcattatatgtcaacatgggtcactataacggaagcagttgagatcactaccaaagccataaaacaaaaaattactcctagcgatatttatcgtcatgccttgagtggcaacatcctactatcggtctatttccagtctccagtgatacttaagaagatacaaacttttaatggaaaaataaaattcaggcagtttgtgggagacctacttgataaactatgcatgcttgacagggacggttttatttatggtcaaaatttaagactctgtacagaagccagatatatttgtcctgtgcaacaaattatagatacccccctgttacgcaaactcaaccagtttcgtacgtttgttcgtaatgtccgcccgggtgatgaactggatgtcccggcacaagttagtgaaaaaaatttaaccccgccgccgggtaacagcagtggcaaccttgagcaacagatagccagcacttcacagctaattggatctctgctcgccgaagatatgaacagcgagcaagcggcaaacatagcacgtggatgggcctcttctcaggcttcaggggtaatgacagactggttaagccgcttcggtaccgcaagaatcacgctgggcgtggatgaagatttcagcctgaagaactcccgtgacggcaaccctcgaaaatggcgattcgatgcaacaaacagtgaactatgtgccgaacgtcacgaatgctga

SEQ ID NO: 4750 - protein, 249 aa, Escherichia coli
MSKKYQPLLITHYMSTWVTITEAVEITTKAIKQKITPSDIYRHALSGNILLSVYFQSPVILKKIQTFNGKIKFRQFVGDLLDKLCMLDRDGFIYGQNLRLCTEARYICPVQQIIDTPLLRKLNQFRTFVRNVRPGDELDVPAQVSEKNLTPPPGNSSGNLEQQIASTSQLIGSLLAEDMNSEQAANIARGWASSQASGVMTDWLSRFGTARITLGVDEDFSLKNSRDGNPRKWRFDATNSELCAERHEC

SEQ ID NO: 4751 - DNA, 171 bp, Escherichia coli
gtgacggcaaccctcgaaaatggcgattcgatgcaacaaacagtgaactatgtgccgaacgtcacgaatgctgaaatcacgctggcagcctcgaaggatccggtgattgccgacaataacgatctcacgacactaacagcaccgtcgctgatacagagggcaatgcgatag

SEQ ID NO: 4752 - protein, 56 aa, Escherichia coli
MTATLENGDSMQQTVNYVPNVTNAEITLAASKDPVIADNNDLTTLTAPSLIQRAMR

SEQ ID NO: 4753 - DNA, 1368 bp, Escherichia coli
gtgacagcatcgatggttggcggtaagagtgagcagttggtggtgaactttactgcggatacgctcactgcgcaggttaatcttaacgttaccgaggacaatttcatcgccaataacattggaatgaccaggctacaggcaacagtgactgatggaaacggcaacccagtagaaggtataaaagttaatttccgcggaacctccgtcacgctaagcagcaccagcgttgaaacggatgatcaggttttcgctgaaattcttgtgacaagcaccgaggtcggactaaaaacagtttcagcctctctggcagataaacctactgaagtcatctcgcgattactgaatgccaaggtagatgttaattctgcgacgattaccagtcaggagatacctgaaggtcaggtcatggtcgcacaagacatagcagttaaagctcacgttaacgaccagtttggcaacccggtgacgcatcaacccgcgacattcagtgcagcgccatcctcgcaaatgatcatcagccagaatacggtctctactaatacgcagggagtagccgaggtcaccatgacgcctgaaagaaacggctcgtatactgtaaaagcatccctagcgaatggagcttcacttgagaaacaactggaggctattgatgaaaaactgacactcacgtccagtccgcttatcggtgtcaatgctcctaaaggcgctactctgacggcaacgctaacctctgcaaatggcactccagtggagggtcaggtcatcaactttagcgtaacgctagaaggtgcgacgttaagtggcggaaaagtgagaaccaactcttcaggtcaggctccagtcgttctgaccagcaataaagtcggtacatatacggtgactgcatcgttccataacggcgtcacaatacagacacagacaaccgtgaaggttactggcaacccaagcaccgcacatgttgctagctttatcgctgatccgtcgactatcgccgccaccaacagtgatttaagtaccttaaaggcaacggttgaggatggcagtggtaacctgatcgaaggtctcactgtgtacttcgccttaaaaagcggctccaccacattaacgtcattaacagcggtgaccgatcaaaacggaatcgcgacaacaagcgtgaaaggtgagataacggggagcgtcactgtaagcgcagtcacaagcgcaggtggaatgcaaacagtagatatatcgctagtggcaggcccagcagacgcctcgcagtccatccttaagaacaaccagtcatcactgaaaggggactttaccgatagtgctgagctacatcttgttctgcacgatatatcaggcaatccgatcaaagtttcttaa

SEQ ID NO: 4754 - protein, 455 aa, Escherichia coli
MTASMVGGKSEQLVVNFTADTLTAQVNLNVTEDNFIANNIGMTRLQATVTDGNGNPVEGIKVNFRGTSVTLSSTSVETDDQVFAEILVTSTEVGLKTVSASLADKPTEVISRLLNAKVDVNSATITSQEIPEGQVMVAQDIAVKAHVNDQFGNPVTHQPATFSAAPSSQMIISQNTVSTNTQGVAEVTMTPERNGSYTVKASLANGASLEKQLEAIDEKLTLTSSPLIGVNAPKGATLTATLTSANGTPVEGQVINFSVTLEGATLSGGKVRTNSSGQAPVVLTSNKVGTYTVTASFHNGVTIQTQTTVKVTGNPSTAHVASFIADPSTIAATNSDLSTLKATVEDGSGNLIEGLTVYFALKSGSTTLTSLTAVTDQNGIATTSVKGEITGSVTVSAVTSAGGMQTVDISLVAGPADASQSILKNNQSSLKGDFTDSAELHLVLHDISGNPIKVS

SEQ ID NO: 4755 - DNA, 1053 bp, Escherichia coli
atgtttttagtatcattgttgagacgtattgcatttagttactacgattataaagcttataattttaatattgaaaaaacagactttgttgtcatacatattcccgatcagattggcgatgctatggccatctttcctgttattcgggcgcttgaattgcataaaattaagcatctattaattgttacgtcgacaattaatttagaagtctttaatgcgctcaaacttgaacagactaaattaacattagtcacaatgactatgcaggatcacgcaacattaaaagaaataaaagatttagcgaagaacataacactgcaatacggtacgccggatctttgtatagaggcgatgcgtaaaaagaacctgaaaacgatgatatttatcagtcagttgaaagcaaaaacgaatttccaggtcgtcggtttaaccatgaagtgctattcccctttgtgtaagaacgcgtcccggatggatcagaatctccggactcctgtacccatgacatgggcatttatgatgcgtgaggcgggttttccggcagtcaggtcaatatatgaattgccattaagcgatgatgtactcgatgaggtacgcgaggaaatgcgatcgttaggatcttacattgcgctcaatttagacggtagctcgcaggaacgtacattttcattatcgattgcagaaaatctaatagcaaaaattcaaagtgaaacagatattccaatagtgatcgtttatggacccaaaggggaagataaagccagggcattagtggattgttataataatgtctaccgtttatccttatcaccctcgattaaacgttcagcagcaatcataaaagatgcttatattgcaataactcctgacacctcaatattacatatggcaagtgcctataatacccctgttgttgcaatttatgctgattacaaaacgcgatggcccgcaatggccgatgtttcggagtcagtcgtcgttgggcaaaaaattgacaatataagtctggatgaattcgcaaaggcattaaaaagtgttttggcgagaatttga

SEQ ID NO: 4756 - protein, 350 aa, Escherichia coli
MFLVSLLRRIAFSYYDYKAYNFNIEKTDFVVIHIPDQIGDAMAIFPVIRALELHKIKHLLIVTSTINLEVFNALKLEQTKLTLVTMTMQDHATLKEIKDLAKNITLQYGTPDLCIEAMRKKNLKTMIFISQLKAKTNFQVVGLTMKCYSPLCKNASRMDQNLRTPVPMTWAFMMREAGFPAVRSIYELPLSDDVLDEVREEMRSLGSYIALNLDGSSQERTFSLSIAENLIAKIQSETDIPIVIVYGPKGEDKARALVDCYNNVYRLSLSPSIKRSAAIIKDAYIAITPDTSILHMASAYNTPVVAIYADYKTRWPAMADVSESVVVGQKIDNISLDEFAKALKSVLARI

SEQ ID NO: 4757 - DNA, 1317 bp, Escherichia coli
atggactccacgctcatctccactcgtcccgatgaagggacgctttcgttaagtcgcgcccgacgagctgcgttaggcagtttcgctggtgccgtcgtcgactggtatgattttttactctatggcattaccgccgcactggtgtttaatcgcgagtttttcccgcaagtaagcccggcgatgggaacgctcgccgcatttgccacctttggtgtcggcttccttttccgaccgctcggcggtgtcattttcggtcactttggtgaccggctgggacgtaagcgcatgttaatgctgaccgtctggatgatgggcatcgcgacagccttgattggtattcttccttcattctcgaccattgggtggtgggcacctattttgctggtgacactgcgtgccattcagggatttgccgtcggcggcgaatggggaggcgcagcgttgctttccgttgaaagtgcgccgaaaaataaaaaagccttttacagtagcggtgtacaagttggctacggagtaggtttactgctttcaaccggactggtttcattgatcagtatgatgacgactgacgaacagtttttaagctggggctggcgcattcctttcctgtttagcatcgtactggtactgggagcattgtgggtgcgcaatggcatggaggagtccgcggaatttgaacaacagcaacataatcaagcggccgcgaaaaaacgcatcccggttatcgaagctctgttacgacatcccggtgctttcctgaagattattgcactacgactgtgcgagttgctgacgatgtacattgttactgcctttgcacttaattattcaacccagaatatggggttaccgcgcgaacttttccttaatattggtttgctggtcggtggattaagctgcctgacaattccctgttttgcctggcttgccgatcgttttggtcggcgcagggtttatatcacaggcgcgttgatcggaacgttgagcgcatttcctttctttatggcgcttgaagcacaatctattttctggatagttttcttctccataatgctggcaaacattgcgcatgacatggtggtgtgtgtgcaacaaccgatgtttaccgaaatgtttggtgccagttatcgctacagtggtgctggagtcggttatcaggttgccagtgtggttggcggtggatttacgccttttattgccgctgcactcatcacttactttgccgggaactggcatagcgtcgctatttatttgctggctggatgcctgatttccgcaatgaccgctttgttgatgaaagacaatcaacgcgcttaa

SEQ ID NO: 4758 - protein, 438 aa, Escherichia coli
MDSTLISTRPDEGTLSLSRARRAALGSFAGAVVDWYDFLLYGITAALVFNREFFPQVSPAMGTLAAFATFGVGFLFRPLGGVIFGHFGDRLGRKRMLMLTVWMMGIATALIGILPSFSTIGWWAPILLVTLRAIQGFAVGGEWGGAALLSVESAPKNKKAFYSSGVQVGYGVGLLLSTGLVSLISMMTTDEQFLSWGWRIPFLFSIVLVLGALWVRNGMEESAEFEQQQHNQAAAKKRIPVIEALLRHPGAFLKIIALRLCELLTMYIVTAFALNYSTQNMGLPRELFLNIGLLVGGLSCLTIPCFAWLADRFGRRRVYITGALIGTLSAFPFFMALEAQSIFWIVFFSIMLANIAHDMVVCVQQPMFTEMFGASYRYSGAGVGYQVASVVGGGFTPFIAAALITYFAGNWHSVAIYLLAGCLISAMTALLMKDNQRA

SEQ ID NO: 4759 - DNA, 1455 bp, Escherichia coli
atgaataataagggctccggtctgaccccagctcaggcactggataaactcgacgcgctgtatgagcaatctgtagttgctttacgcaacgccattggcaaatatattacaagtggcgaattacctgatgaaaacgcccgcaaacaaggtctttttgtctatccatcactgaccgtaacctgggacggtagcacaactaatccccccaaaacgcgcgcatttggtcgttttactcacgcaggcagttacaccaccacgattactcgccctactctctttcgttcgtatctcaatgaacaacttacgttgctgtatcaggattatggtgcgcatatctctgtgcaaccctcgcagcatgaaatcccttatccttatgtcatcgatggctctgaattaacacttgatcgctcaatgagcgctggtttaactcgctacttcccgacaacagaactggcgcaaatcggcgatgaaactgcagacggcatttatcatccaacggaattctccccgttatcgcattttgatgctcgccgggttgatttttccctcgcacggttgcgccattataccggtacgccagtagaacattttcaaccgttcgtcttgtttaccaactacacacgttatgtggatgaattcgttcgttggggatgcagccagatcctcgatcctgatagtccctacattgccctttcttgtgctggcgggaactggatcactgccgaaaccgaagcgccagaagaagccatttccgaccttgcatggaaaaaacaccagatgccagcatggcatttaattaccgctgatggtcggggtattactctggtgaatattggcgtgggaccgtccaatgctaaaaccatctgcgatcatctggcagtgctacgcccggatgtctggttgatgattggtcactgtggcggattacgtgaaagccaggccattggagattatgtccttgcacacgcttatttacgcgatgaccacgttcttgatgcggttctgccgcccgatattcctattccgagcattgctgaagtgcaacgtgcgctttatgacgctaccaagttagtcagcggcaggcctggtgaggaagtcaaacagcggctgcgtacaggtactgtggtaaccacagatgacaggaactgggagttacgttactcagcttctgcacttcgttttaacttaagccgggccgtagcaattgatatggaaagtgcaaccattgccgcgcaaggatatcgtttccgcgtgccatacgggacactactgtgtgtttcagataaaccgttacatggtgagattaagcttcccggccaggctaaccgtttttatgaaggcgctatttccgaacacctgcaaattggcattcgggcgatcgatttgctgcgcgcagaaggcgaccgactgcattcacgtaaattacgaacctttaatgagccgccgttccgataa

SEQ ID NO: 4760 - protein, 484 aa, Escherichia coli
MNNKGSGLTPAQALDKLDALYEQSVVALRNAIGKYITSGELPDENARKQGLFVYPSLTVTWDGSTTNPPKTRAFGRFTHAGSYTTTITRPTLFRSYLNEQLTLLYQDYGAHISVQPSQHEIPYPYVIDGSELTLDRSMSAGLTRYFPTTELAQIGDETADGIYHPTEFSPLSHFDARRVDFSLARLRHYTGTPVEHFQPFVLFTNYTRYVDEFVRWGCSQILDPDSPYIALSCAGGNWITAETEAPEEAISDLAWKKHQMPAWHLITADGRGITLVNIGVGPSNAKTICDHLAVLRPDVWLMIGHCGGLRESQAIGDYVLAHAYLRDDHVLDAVLPPDIPIPSIAEVQRALYDATKLVSGRPGEEVKQRLRTGTVVTTDDRNWELRYSASALRFNLSRAVAIDMESATIAAQGYRFRVPYGTLLCVSDKPLHGEIKLPGQANRFYEGAISEHLQIGIRAIDLLRAEGDRLHSRKLRTFNEPPFR

SEQ ID NO: 4761 - DNA, 678 bp, Escherichia coli
  n 651, 652, 653, 654, 655: n is any nucleotide
gtgggacgtaaatgggccaatattgttgctaaaaaaacggctaaagacggtgcaacgtctaaaatttatgcaaaattcggtgtagaaatctatgctgctgccaaacaaggtgaacccgatccagaattaaacacatctttaaaattcgttattgaacgtgcaaagcaggcacaagttccaaagcacgttattgataaagcaattgataaagccaaaggcggtggagatgaaacgttcgtacagggacgttatgaaggctttggtcctaatggctcaatgattattgctgagacattgacttcaaatgttaaccgtacgattgctaacgttcgcacaattttcaataaaaaaggcggcaatatcggagcggcaggttctgtcagctatatgtttgacaatacgggtgtgattgtatttaaaggaacagaccctgaccatatttttgaaattttgcttgaagctgaagttgatgttcgtgatgtaactgaagaagaaggtaatattgttatttatactgaacctactgaccttcataaaggaatcgcggcgctaaaagcagctggaatcactgagttctcaacaacagaattagaaatgattgctcaatctgaagttgagctttccccagaagatttagaaatcttgaagggnnnnncattccattcattaattaattaa

SEQ ID NO: 4762 - protein, 225 aa, Escherichia coli
  Xaa 218, 219: Xaa is any amino acid
MGRKWANIVAKKTAKDGATSKIYAKFGVEIYAAAKQGEPDPELNTSLKFVIERAKQAQVPKHVIDKAIDKAKGGGDETFVQGRYEGFGPNGSMIIAETLTSNVNRTIANVRTIFNKKGGNIGAAGSVSYMFDNTGVIVFKGTDPDHIFEILLEAEVDVRDVTEEEGNIVIYTEPTDLHKGIAALKAAGITEFSTTELEMIAQSEVELSPEDLEILKGXXFHSLIN

SEQ ID NO: 4763 - DNA, 2397 bp, Escherichia coli
  n 12, 13, 14, 15, 16: n is any nucleotide
atgaatgaatgnnnnntacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacactggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaaatcgagcgctgcattgcgcgacatcccgatgtggagcagtcagtggtggtggcagtgggtaattctcaacatcgtcggctggtcgcttttgccaaactgcacgatcgccaccaggcgcaggcattgcaagctaaggaagcggaggcggcggcactggcgcagggtattattgtgaatccggcacagcgtctagcgttcaaactcaaggagccacatattcgcgcgctggatggtctgggcattgcactgacggcaccggcggatagcacacgttacatcaaacgccgcagctatcgtcatttcagcgcgcaaaaaaccacgctggcacagttggggcaattgctgtcgggcttggggcagatgcgtctacccggtctaccttttgccaagtatgcctatgcgtccgccggggggctatacccggtgcaaacctacgtgtacctgcatccagacaagatcgaagagggagtatccggtatttactacttcgacccgcgacagagctgtcttatgccggtagcaccagaagtcgagctgaacagtggttttcatgccggacctaatcagtctattgccgatcgggcggcattcacgctgtttatggtggctgatatggcggtgatctcgccattctatgggcaagaggcagcttggcacttctcggtgatggaagcaggtactctctgccatttactggaagaagatgcgccgcgctacggattggggctgtgccaacttgggatggcagacttttccgctgtggcatcgcattttcaattgtcgccacatcatcgctatgtccattgcaccgtggggggcgcgatagggcaagaggcggcaagtgctgcagcattgctgcgcgatttctccacctatgagaaaccgaaggaaaccgctgcgccgctggacatgcagagctacaaagatgccatgctgcgcggcctgcgtcagcaactgcctgactatatggtgccgagtgatctgatgttagcgaccgattttccgttaaccgctaacggcaagctagatcggcaaaaattacagctgcagggcgaacaaattgcccaccagcgtgacggcgtgggtccaatccaggtggacagtgcgttacaacagcggctggtggcgctctggcaggaggtactcggcgtgagccacgtgtcggccgaagacgatttcttctcgctggggggcagttctatagaattggtgcgtattcagcaggcacttgaggcgattatcgggcaggagattcccattgtcgatctgttccgtctgccaaccatcgcggatgtggcgcgttaccttgatgagcaactgcacaatctacccgccgcccacgatatcgtattagcgcaggctgaggtttcgcaggtcagcgctgcgcgcgagaatctggcgttgcggcgtaaacgtgcccaacagggagaaaagggcgatgagtga

SEQ ID NO: 4764 - protein, 798 aa, Escherichia coli
  Xaa 4, 5, 6: Xaa is any amino acid
MNEXXXQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEIERCIARHPDVEQSVVVAVGNSQHRRLVAFAKLHDRHQAQALQAKEAEAAALAQGIIVNPAQRLAFKLKEPHIRALDGLGIALTAPADSTRYIKRRSYRHFSAQKTTLAQLGQLLSGLGQMRLPGLPFAKYAYASAGGLYPVQTYVYLHPDKIEEGVSGIYYFDPRQSCLMPVAPEVELNSGFHAGPNQSIADRAAFTLFMVADMAVISPFYGQEAAWHFSVMEAGTLCHLLEEDAPRYGLGLCQLGMADFSAVASHFQLSPHHRYVHCTVGGAIGQEAASAAALLRDFSTYEKPKETAAPLDMQSYKDAMLRGLRQQLPDYMVPSDLMLATDFPLTANGKLDRQKLQLQGEQIAHQRDGVGPIQVDSALQQRLVALWQEVLGVSHVSAEDDFFSLGGSSIELVRIQQALEAIIGQEIPIVDLFRLPTIADVARYLDEQLHNLPAAHDIVLAQAEVSQVSAARENLALRRKRAQQGEKGDE

SEQ ID NO: 4765 - DNA, 1464 bp, Escherichia coli
atgagtgagcagagctatcgtagcgcagggacactgttggcacagttggcgtccggagaaaccacctcagtggcgttggtgaatcactatttttcacgtatggcgcagtttaacaagccgttgaatgcggtggtgcagcagcactatgcgttggcgttggaggccgccgcgcgcgccgatcgtgagcgactggaggggcgcgcaaggggcgtgttgcacggattaccttgtactgttaaggagtcgtttgacgtgcaagggtggttaaccacgtccggtgcccattatctgaaagataaccgggcgacgcaggatgctccttccatcgcacgcttacgcgctgccggggcgatcctgatgggaaaaaccaatgtgccgatgatgactgccgattggcaaacctataacgatctgtatggcaccacccataacctgtgggataggcaacgttcacccggcggatcgtccggaggagcggcggtggcggtggcggcggatttcacccccgtggaatttggcagcgatttgtttggctcactgcgcattcccgcacactacacaggtgtctatgcccatcgttgtagcttggggttgatgtcggtcagaggacatgtgcccggtggtggtccgcaagcgactgatgagccggatctctcgacggcgggccccatggcgcgcagcgcggcggatctgcgtctgatgatgcgcgcattgagcacattctgggtggaaccgccgcgtattcccgattttagccgttatcaggccaaagcaaactaccgcgtgtgcacgtggtttagtgcgccccaccatgagatagatcaacagatcgcacagcgttttcaatcgtttatcgacaagttacgcgcacagcctggcgtggaggttgatgatgctatgcccgccgatatcgatcccgacgcactgtttgatatagcagtcaaactcagtggtcggctggtaagtacggcgctcaatggacgccagcgtcttacagccgggctggctgcgctgggcttcaggcttgtgggcaagctggcggatgtgcctgaggggataacgagctattaccagggcatgctgaaagacagtggcgaacagcggaatacagacaaactccgccacgaatacagccgggtgatagaaacccttttcgcgcgttatgacgtgttgttgacacctgtcagcccggtgctggcgtttgcgcacatgcagcagccggtgcgtaagcgcaagcttatcgtcaatggcgaaccgcaagattacaacgaacatttgttctggaacatgttagcaacggtttttggtttgcctgccaccgtttacccattggcgaaaacgatggatgagcttccgtgcggcatacagatcatttccgggcattttcacgatgatgtgacgattaactttgctgagttctgcgaaagcatcagtggcggattcacggtaccggaagggtactag

SEQ ID NO: 4766 - protein, 487 aa, Escherichia coli
MSEQSYRSAGTLLAQLASGETTSVALVNHYFSRMAQFNKPLNAVVQQHYALALEAAARADRERLEGRARGVLHGLPCTVKESFDVQGWLTTSGAHYLKDNRATQDAPSIARLRAAGAILMGKTNVPMMTADWQTYNDLYGTTHNLWDRQRSPGGSSGGAAVAVAADFTPVEFGSDLFGSLRIPAHYTGVYAHRCSLGLMSVRGHVPGGGPQATDEPDLSTAGPMARSAADLRLMMRALSTFWVEPPRIPDFSRYQAKANYRVCTWFSAPHHEIDQQIAQRFQSFIDKLRAQPGVEVDDAMPADIDPDALFDIAVKLSGRLVSTALNGRQRLTAGLAALGFRLVGKLADVPEGITSYYQGMLKDSGEQRNTDKLRHEYSRVIETLFARYDVLLTPVSPVLAFAHMQQPVRKRKLIVNGEPQDYNEHLFWNMLATVFGLPATVYPLAKTMDELPCGIQIISGHFHDDVTINFAEFCESISGGFTVPEGY

SEQ ID NO: 4767 - DNA, 1440 bp, Escherichia coli
atgacggtgaataagcttgagccagacaacggcacgccgaacgatgagctgttcacggtggcgggtatgtttgacggctcgctgtataaattactcctgcgcatggcgttgccgatgtttgtcggtatgttaacgcaggtgacctatgccatcgccgatattttttggctgagccacattgatgtcaccaacagcggcatcattgccggtgtggggctggttttccccgttggaatggggttatttgccatcgccaacggcattcaaatcggtatgggatctttgctgtcccgcgccatcggcatgcagcggttggatcgtgcacagcggattttgtcggtcggtatcatcatcgcgctattctttgcgatcgtgatcaccgtacttggctatgtttatgcccagccgctattgcgctcactgggggccacgaagagcatcatcggctacgcaacggagttctattattattcgctgctgaccgtgttcagcatcatgttgattggcgtcatgatggggctgtttcaaggcgcgggtaagatcatggtcatcatgaaggcctcattgttgggggcgttggtaaatattatgctcgatccaatcatgatctttgtattcgattttggtgtgaaaggggtggcattggcgtcgtttctggcgcaactgagtatggtcgcctatttcatctacacattgatgggattacatatcgggttgagtatacgcatcgcgttacgcccattctcctggaaaatctaccgagagtttctctccgtcggcatggcgcagatgctgatgcaactgatcattgcggtcggcatagtgatttataatttttttatcgtcaggctggacgtaaacgcgatggcagcgtttacgctcactggtcgcatcgactatttcatcatcacgccgatgctggctatcgcgaccgcgttgctgactgtggtggggcaaaactggggacacggaaatgtcacccgcacgctgaatgcctattgggccgccgtcgcgctggccttctctattgtgctggtgttagccgttatgcatattgtactggcaccctggatgtatcccctgtttactcgtgttgttgccgtgagtgactatgcggtactgcaaacccgtatcatggcactggcactaccctttgtcgctatcagcctgttagcaagtgaatattatcaggccattggtaagccttggtattcggtgttgttgacgctgatgcgtcacgtgtttatatctgtccctgtcgtatacctgctggcgattgtgttagagatgcgtattaccggcgtctattttggggcgatgagcggcacttttgtggctgcgttgttggcgtggcgtctgctgcgtctttcacctcgtctgctgcgatggaatcaggaggcggtgcgctcccaacacttggatatggaggtggcaccatga

SEQ ID NO: 4768 - protein, 479 aa, Escherichia coli
MTVNKLEPDNGTPNDELFTVAGMFDGSLYKLLLRMALPMFVGMLTQVTYAIADIFWLSHIDVTNSGIIAGVGLVFPVGMGLFAIANGIQIGMGSLLSRAIGMQRLDRAQRILSVGIIIALFFAIVITVLGYVYAQPLLRSLGATKSIIGYATEFYYYSLLTVFSIMLIGVMMGLFQGAGKIMVIMKASLLGALVNIMLDPIMIFVFDFGVKGVALASFLAQLSMVAYFIYTLMGLHIGLSIRIALRPFSWKIYREFLSVGMAQMLMQLIIAVGIVIYNFFIVRLDVNAMAAFTLTGRIDYFIITPMLAIATALLTVVGQNWGHGNVTRTLNAYWAAVALAFSIVLVLAVMHIVLAPWMYPLFTRVVAVSDYAVLQTRIMALALPFVAISLLASEYYQAIGKPWYSVLLTLMRHVFISVPVVYLLAIVLEMRITGVYFGAMSGTFVAALLAWRLLRLSPRLLRWNQEAVRSQHLDMEVAP

SEQ ID NO: 4769 - DNA, 4368 bp, Escherichia coli
atgatgtcgggcaatccgttgtcgtggccacaggaacagtgccacatcattgatcaactgtatccttacagtgccgtaaacatcattggtggtgtggtcaccattgagggaattgtcgatctgccccgactacacgcggccatccagtccgccattcggcaatttgatgcgttgcgtatgtggtttgtgatgggagaggagagtgaagtggtcagccaagtgcagccttatcactggcgcgatatccgccatttgactttttccccagattatgacaaggagaacctacgcccagcggcgatcgaaacatttgttgatgagtggttccggcagccctttaccctgctggcgcacgatttgttcgagtttgtcacctttacgtgcggtgaacaatacagcggttatttatttaaagcccatcacggcattgctgatggttggtcaatggcgttgttgtcaaaccatgtcaagcgagcatacgaacagcaggacgtaccagatgatgcgtcaccagcctatagcgcatttctggcgcagcagcaatcttatcaggcgtcaacgcgctttgccgttgatcgtggctggtggcgtgactatatcgacgaataccgcgactgctttccagacagttcccccatcgttactactgagggcatcagttgttccacttggcttgagccagccatgattaaccgtctctacaggttgtgtaatcgttatggctgtacgcttaatacgctgtttattgcactcttcgctctctatcgcgccagagtatggggggaggaaaaaggcgtaataggcgtgccgttagccaatcggcatactcgcgaggcgcggcgttgctttggcatgtttactaatcaattgccgctggcctatcgactggtgcgcacggaacgattctgtgaacgggtggcctttttccagcgcgaactgaaacgcggttttaaacacagcaaatatcccattaccttattcaaccaggatttggcggaacaggggggagggaagttgcgggcgttcgattattgcgttaattattataactttacctatgaacgccacattgcaggtgccgcgcaacgcgtggagagttactacagcggcgagcagtcctataagctacagattgttttgcaaactgttaataatcataaagaaagccttaggttgagtctggaggcgctgcgtagcgctttcactccgcaccaactgacagcgatgaaaaatgggctgttggatttagtcactgcattggatcggcaacctgacgctcgtctaggcgatctcgaagtctatcctgcgccgcacgtcgcattggcatgtggctcactcaaaccctcatttacttcccgatttgcagcgcaagttgtggagcatggtgatcgcacagcactaattgataatgaacagtctttgacttatcggcagttggatgacgctgttgagcgggttgcgcgttatctgcgccaacaggggatcggacgcggtcaagtggttgggattatcgctgagcatagcgctcaaacggtgatggttatttatggtattttgcgctgcggcgcggcatttctgccgctaaatcccgcgttgccaacgacccgcctttacgccatgtgtcgtaaagcgcaggtagcgcatatcctttacgatccggcgatgcatgaattgacgcaggcgctggcgtttcccgcgtccagcttgctccaggccttagccacttcggcgcttgctagagaaccttggccagctattgaaccgcaggatctggcatatgtgctgtttacctccggatcgaccggcgagcctaagggcgtgcaagtctctcatggcaatctggctaactatctccatttcgccgccgaacgttactttacagcgcaggaccgggctgcgctctactcttcgctgtccttcgatttgaccatcactacgctgttcgcccccttatgtgtgggcgctagcatcagcgtttgtcggcacgccgagagcgaaacattgctgcgcatggccgtggttgatcagcccaacacagtgatcaaactgacgcctgcacacctgcggttgttgtgtgcggctggcataagcagtgagcagattcgtaccttggtggttggcggggaggatttcaagcgggatctggcgcgtaaggcggctgctctctttcctcaggccgtgatctataacgaatatgggccgacagaggccaccgttggttgcatgatctatcgctacaccgggcaagaaacgctgccttcattgcccatcggtatggcgatcgacggttgccaggtagcaatttgctccccttggggctgtccggtaccggaaggcgaaactggtgaattggtgatttatggcgcgtcagtgacgcagggctatatcgatgcgccgcaacaaacggccgccgcctaccttaaagataccaatggggtgatgattggctatcgcagcggtgatattggctacgccatcgctcctaatacgctggtttatcagggacgtaaagacgatcaggtcaaaattaatggctatcgtattgagctgtgcgaaatcgaacaagcgttgttgagcgcacctcaggtagaaagtgcggcggtggcggtgattgatgatgtgcaggggcagcacagcgggttgctagcctgcgtgacaccgtcatctgttgatgtagctaccgtaatgcaacatctgcgtcagcaattacccacctacatgcaacccaagcagtgctgtgctatcgcccaactgccgctatcgcacaatggcaaggtggacgtgcgtcagatggtcgcaacggtccgaaacaccgcgcctgcatcgggtagcgagcggctgggagatgcggcgataaggcattcagttcgggtatgtgtggaaggggcgctggagcaaactgagtttgatgataacgaaaatctttatgtcttggggttggactccatcaagagtatccagattgcagcgcagctcaggcaccacggctggacgatgtcagcggtgcaggtgatggagtgtggaacagtgaacgccatctgtgagtttctcgctagtcatacaacggtgtcacagctcgcgcagtatgctcataacacccgtatcgatctacccgcattgcgttggtttacgcagttggcgttgccagtgcccaatgtttataaccatgtcattgtgctgaaagtgttgccgggctgcccgctcgagcagttacacaacaggctgcatacattaatccagcagcagccagctttgcacagtgcgctggacgctgaggggcggttgctagtatgcgaccctaatgtgtgttatcccaacgaggtgctcacggaatattcgacggcgcagtggacgttggcagaggtgatcgctcagtgcaatagcatgcttgacgtgacaaatggtcgagtctttacggcagctctgttacacgccccgcagcctgcgtctagcacgctggtactctgtgcccatcacttgtgcgtcgatatgcactcttggtatttaatcctcagcacgctggacgccgtcagcactgtcaatggcaccagcaacagcggactgcatcgctggaatgactatctggcgagcaaaacggtagattccgccacacacgaaagctggcgcacagtatgtcaaacgctaccgctgcatttcccacccgtgtcattgccagatgactcattacctcgtacgcgcgcttggcgtgaagactttcgccatccttgcgtcaggaggttgtttgaatccagtggtaataccgcgtacagcgccgaaacctatgtgctaacggcattggcgctggtgctgcgttactacagcgaagagccttggtgtcgcatcgagatggaaggcatgggacgcggctgctggcccgatgagcctgacgttgcggatacggtcgggtggtttactctattttatccttgggcgatccctctgcatggcgatatggcgacactgttatctgcgatcgcttccgatttggcaaaacgcacgcatggtgggggagattacggtctgctgcaaatgcggcatgcaccggaagactctcttgcgcaagggatccgaatgaattacatcggtgtgcaggcgcaaccttcactccgctattttcatattgatcactttaatagtgatatctataccgcgcctgaaaacgcgctcggctgcgtgctggagtttaatattgcgcgctcggcagctgatggtctctccttccactgccgtttcgatcccacgcgcattgcgctgaatgatgtgcaactcctgctggcgcgctacaagaacagcctcactgatctggatgcctggctgtgccaacacagcgccacgctgacgggcgcgccgactttgtggacactataa

SEQ ID NO: 4770 - protein, 1455 aa, Escherichia coli
MMSGNPLSWPQEQCHIIDQLYPYSAVNIIGGVVTIEGIVDLPRLHAAIQSAIRQFDALRMWFVMGEESEVVSQVQPYHWRDIRHLTFSPDYDKENLRPAAIETFVDEWFRQPFTLLAHDLFEFVTFTCGEQYSGYLFKAHHGIADGWSMALLSNHVKRAYEQQDVPDDASPAYSAFLAQQQSYQASTRFAVDRGWWRDYIDEYRDCFPDSSPIVTTEGISCSTWLEPAMINRLYRLCNRYGCTLNTLFIALFALYRARVWGEEKGVIGVPLANRHTREARRCFGMFTNQLPLAYRLVRTERFCERVAFFQRELKRGFKHSKYPITLFNQDLAEQGGGKLRAFDYCVNYYNFTYERHIAGAAQRVESYYSGEQSYKLQIVLQTVNNHKESLRLSLEALRSAFTPHQLTAMKNGLLDLVTALDRQPDARLGDLEVYPAPHVALACGSLKPSFTSRFAAQVVEHGDRTALIDNEQSLTYRQLDDAVERVARYLRQQGIGRGQVVGIIAEHSAQTVMVIYGILRCGAAFLPLNPALPTTRLYAMCRKAQVAHILYDPAMHELTQALAFPASSLLQALATSALAREPWPAIEPQDLAYVLFTSGSTGEPKGVQVSHGNLANYLHFAAERYFTAQDRAALYSSLSFDLTITTLFAPLCVGASISVCRHAESETLLRMAVVDQPNTVIKLTPAHLRLLCAAGISSEQIRTLVVGGEDFKRDLARKAAALFPQAVIYNEYGPTEATVGCMIYRYTGQETLPSLPIGMAIDGCQVAICSPWGCPVPEGETGELVIYGASVTQGYIDAPQQTAAAYLKDTNGVMIGYRSGDIGYAIAPNTLVYQGRKDDQVKINGYRIELCEIEQALLSAPQVESAAVAVIDDVQGQHSGLLACVTPSSVDVATVMQHLRQQLPTYMQPKQCCAIAQLPLSHNGKVDVRQMVATVRNTAPASGSERLGDAAIRHSVRVCVEGALEQTEFDDNENLYVLGLDSIKSIQIAAQLRHHGWTMSAVQVMECGTVNAICEFLASHTTVSQLAQYAHNTRIDLPALRWFTQLALPVPNVYNHVIVLKVLPGCPLEQLHNRLHTLIQQQPALHSALDAEGRLLVCDPNVCYPNEVLTEYSTAQWTLAEVIAQCNSMLDVTNGRVFTAALLHAPQPASSTLVLCAHHLCVDMHSWYLILSTLDAVSTVNGTSNSGLHRWNDYLASKTVDSATHESWRTVCQTLPLHFPPVSLPDDSLPRTRAWREDFRHPCVRRLFESSGNTAYSAETYVLTALALVLRYYSEEPWCRIEMEGMGRGCWPDEPDVADTVGWFTLFYPWAIPLHGDMATLLSAIASDLAKRTHGGGDYGLLQMRHAPEDSLAQGIRMNYIGVQAQPSLRYFHIDHFNSDIYTAPENALGCVLEFNIARSAADGLSFHCRFDPTRIALNDVQLLLARYKNSLTDLDAWLCQHSATLTGAPTLWTL

SEQ ID NO: 4771 - DNA, 2460 bp, Escherichia coli
atggcaaaggatgattttacctgtggctcactggatattgccattattggcatgagcgggcgtttttccggtgcggaatcggtgcccgagtggtgggataagttgctggcgggtgaggagttcactcaaccgacatgcacagaagacgataatgggaacccttggattaggctgcgcaatataatcaccgctccctatgacttcgatgctgcatttttcaatattccgcctggcgaagccctgttgatggatccgcaacaacgaatatttcttgaatgctgctacaacgctcttgagcatgcgggctatattcccacgcaacttaagcgagtcggcgtctatggggcgacctacgccaataactattttatcgatcgcgtctatccatacctgaagatgagcggcgatcaccattatcttcaggcgcagattggtaacgaaaaggattacttgtgtgctcaggttgcctacaagttggggtttaccggacccgctgtgagtgtacagaccgcctgttccagttcgttggtggcagcatatttagcatgcgaggggttattgacttttcaagccgatgttgcgttggcaggtggggtcaccttgggttttttacaggcgcacggctacagtccgcaaggtgataagctggtatcgcaagacggacactgcgccccgtttagcgctgaggcgaccggcacggtatacagcagcggtgcgggagttgtggtgctaaaacgtcttgaggatgcactacgcgaccaagacagagtgtatgcggtgattaaaggaggtgcggtaaataacgacggcgggcgtcggctggggtttgtcgcccccagcgtagaaggacaggtagaagcgatcaatacggcgcttgccgccgcagaagtcgtaccgactgatatcgcactgatcgaaacgcacggtaccggtaccccgttgggtgatgagattgagcttgaagctctgcaccgggttttcgcaccggcatgtgcgccgcacagcattcaattgggtgcggtaaaagccaacttgggtcacctgggagtcgcttccggtatcgtcagcttaatgaaaaccgcactgacgctatatactggtttagttcccccgcagatcaacctagtaaataaacataaaaaactgttgcagccagcctcgccattttatctcagtgatgtagtgacttctgtcccacaaacgaaaaggatccatgccaccgttagttcgtttgggctgggagggaccaatgctcatttggttctgcaaaactggtgcgagacgcctgcgcaagcggtgcaagaaaatgagcgccgcctgtttttcttcagcgccaaaacgccattagcccttagacaacagttggatgctcattatcacgctctggcgacctatgcggaagcagataaagatcgtatcgcctatactctcgcgcaacgccgggcacatttcccgtatcgctgtgcgctggcggcagacagtgtggtagcgttgcgtgcaagtttggcgaaactgcgggatgctgacatgtcttttacccctatcaatatggaaactaccttggtgttcctatatccggaccgggacgataagctggagagtgccctgacgcatttgctggcttgtcaacctaacttgcgccagcggcaccagcgcctgtctcaggatgttgcacaaatctgcgaaccagccgattggacgccagcattgcgtcagtttatccagcaggtgagtcttagtgaatggctgatcgaacaaagtatctcgcctgtgcagcacatcggttacctgacgggggctgcagcagcgcagtatgttgcgcgcatcatctcactggaaaacgctgttcagcaggtgattgtggctgaaacgacaccggagcagacgctggccggcaacagtgaactgagcgaaatattggctaatctggcggtgacggagggaacgctgatgctggaaatcggtcgcgcggggacgttttccatattgtatcaccagcatgcgcagtgggttgggcaaacagtattttcccccatgctgaatacggatacgcctgaggacatcctgccgctgttgggcactctttggcaacgaggagtgactatttgtttaccggaaatgccagccgtgcagactataggcttacccggttattcgtttgatcgcgtccggtatgaaattcagtccagtgatgcgagagagaacgctatgttaccagtgagttatttgtcggtcagcgactttgtggagaaaacctggcgttcattgttatgcatcgatcattatgacgaacacgcggttattttcgaatacggagcgacctcgatgcacgttatctctttcgtcgacagctgtaaccacatttataaaatcggactgactgccgccgatatttatgccagacccgctatccgtgagcacagtgaatttatctccgaatgtgttgatggtattttatga

SEQ ID NO: 4772 - protein, 819 aa, Escherichia coli
MAKDDFTCGSLDIAIIGMSGRFSGAESVPEWWDKLLAGEEFTQPTCTEDDNGNPWIRLRNIITAPYDFDAAFFNIPPGEALLMDPQQRIFLECCYNALEHAGYIPTQLKRVGVYGATYANNYFIDRVYPYLKMSGDHHYLQAQIGNEKDYLCAQVAYKLGFTGPAVSVQTACSSSLVAAYLACEGLLTFQADVALAGGVTLGFLQAHGYSPQGDKLVSQDGHCAPFSAEATGTVYSSGAGVVVLKRLEDALRDQDRVYAVIKGGAVNNDGGRRLGFVAPSVEGQVEAINTALAAAEVVPTDIALIETHGTGTPLGDEIELEALHRVFAPACAPHSIQLGAVKANLGHLGVASGIVSLMKTALTLYTGLVPPQINLVNKHKKLLQPASPFYLSDVVTSVPQTKRIHATVSSFGLGGTNAHLVLQNWCETPAQAVQENERRLFFFSAKTPLALRQQLDAHYHALATYAEADKDRIAYTLAQRRAHFPYRCALAADSVVALRASLAKLRDADMSFTPINMETTLVFLYPDRDDKLESALTHLLACQPNLRQRHQRLSQDVAQICEPADWTPALRQFIQQVSLSEWLIEQSISPVQHIGYLTGAAAAQYVARIISLENAVQQVIVAETTPEQTLAGNSELSEILANLAVTEGTLMLEIGRAGTFSILYHQHAQWVGQTVFSPMLNTDTPEDILPLLGTLWQRGVTICLPEMPAVQTIGLPGYSFDRVRYEIQSSDARENAMLPVSYLSVSDFVEKTWRSLLCIDHYDEHAVIFEYGATSMHVISFVDSCNHIYKIGLTAADIYARPAIREHSEFISECVDGIL

SEQ ID NO: 4773 - DNA, 1515 bp, Escherichia coli
atgacaataatggaacacgttagcattaaaacattatatcatctcctgtgctgtatgctgctctttatttccgctatgtgcgctttggcgcaagaacatgagcctatcggggcgcaagatgagcgcctgtcgacattaattcaccaacggatgcaggaggccaaggtcccagccctttccgtaagtgtgaccattaagggggtacgtcagcgatttgtctacggtgttgccgatgtggctagtcagaaagcgaatactctagacacagtttacgagctgggatcgatgagtaaggcgtttaccggacttgtggtgcaaatactgattcaggaaggcagactccggcaaggggatgatatcattacctatctgccggaaatgcgcttgaattatcagggaaaacctgcttccctgaccgtggctgatttcctttatcatacatcaggattgcctttttcaacactggctcggctggaaaaccctatgcctgggagcgctgtggcacagcaactgcgcaacgagaatctgctgtttgcgccgggtgcgaagtttagctatgcctccgccaattatgatgtgttgggcgcggtgattgaaaatgtgacgggaaaaacctttacagaggtcattgcggaacgactcacgcagccgctgggcatgtcggcgactgtggcagttaagggggatgagattattgtcaacaaggcaagcggctataaactgggattcggcaaacccgttctgtttcatgcgcctctggcccggaaccatgttcctgccgcctatatccatagcactctgcctgatatggaaatatggatagacgcctggttgcacagaaaggctttgccggcaacgctgcgtgaggcgatgagtaacagttggcgtggtaatagtgatgttccgcttgccgcagacaatcgtatcctctatgccagcggttggtttatcgaccagaatcaaggcccttacatcagtcacggtgggcagaatccaaacttttcttcttgcattgcgttgcgaccggatcagcagattggcattgttgcgctggcaaatatgaattcgaatctgatactacagctttgcgcggatatcgataattatctgcgcattggcaaatatgctgacggcgctggtgatgcaattacagccaccgatacccttttcgtctacctcacgttgttgctgtgtttttggggggcggtggttgtagtgcgcggtgctttccgtgtttatcgcgcaacggcgcatggccctggaaaacagcagaggttacgtttacgcgtacgtgactatatcatcgccttggcggttcctgggctcgtggccgccatgctctatgtcgcaccgggtatactatctccaggacttgactggcgttttatcttggtatggggtccatcgagcgtgttggcgataccgttcggaattatcctgttagctttcgttctgacattaaatcatcaaattaaacgaattctattacacaacaaggagtgggacgatgagtaa

SEQ ID NO: 4774 - protein, 504 aa, Escherichia coli
MTIMEHVSIKTLYHLLCCMLLFISAMCALAQEHEPIGAQDERLSTLIHQRMQEAKVPALSVSVTIKGVRQRFVYGVADVASQKANTLDTVYELGSMSKAFTGLVVQILIQEGRLRQGDDIITYLPEMRLNYQGKPASLTVADFLYHTSGLPFSTLARLENPMPGSAVAQQLRNENLLFAPGAKFSYASANYDVLGAVIENVTGKTFTEVIAERLTQPLGMSATVAVKGDEIIVNKASGYKLGFGKPVLFHAPLARNHVPAAYIHSTLPDMEIWIDAWLHRKALPATLREAMSNSWRGNSDVPLAADNRILYASGWFIDQNQGPYISHGGQNPNFSSCIALRPDQQIGIVALANMNSNLILQLCADIDNYLRIGKYADGAGDAITATDTLFVYLTLLLCFWGAVVVVRGAFRVYRATAHGPGKQQRLRLRVRDYIIALAVPGLVAAMLYVAPGILSPGLDWRFILVWGPSSVLAIPFGIILLAFVLTLNHQIKRILLHNKEWDDE

SEQ ID NO: 4775 - DNA, 723 bp, Escherichia coli
atgagtaatatcagtttgtattgtttgccatattcaggtggttctgccgccatgtattataaatggcgtagcgtgctgtcggacaatattactttgcggcctttagaacctgcggggaggggaactagaatacgccagccgctgtgtcttacgatggtggatgccgtcgctgacctttatcaacaatttgtgaaacactacacaggtggagactacgccatttttgggcatagtctcggagggatcatggccttcgaactggtgcattatattctcgatcatggacatgacatgccatgcgcgctgtttttttccggctgtcgcccacccgatcgggcctctcatgaagtaatactgcataccttgcccgatcaggcgtttatggaagagatcgtcaagctgggcggaactccggttgatgtctttcgtaataaagagttaatgacaattttcacccccatcattaaaaacgattatcggctctatgagcagtatgtatttcaggccaaggcgcgcacattaacctgtccgatcgtgctatttcatggcgatgctgacaatctggtaatgcaggatgaattacttgcatgggaaaaattcaccacacgaaagacgcggactattatatttcctgctgccgatcatttttttgtcgataagcattttgaacaggtggtaggttatgtgaaccagacgattgaatcactcgaaatagtagggtag

SEQ ID NO: 4776 - protein, 240 aa, Escherichia coli
MSNISLYCLPYSGGSAAMYYKWRSVLSDNITLRPLEPAGRGTRIRQPLCLTMVDAVADLYQQFVKHYTGGDYAIFGHSLGGIMAFELVHYILDHGHDMPCALFFSGCRPPDRASHEVILHTLPDQAFMEEIVKLGGTPVDVFRNKELMTIFTPIIKNDYRLYEQYVFQAKARTLTCPIVLFHGDADNLVMQDELLAWEKFTTRKTRTIIFPAADHFFVDKHFEQVVGYVNQTIESLEIVG

SEQ ID NO: 4777 - DNA, 1272 bp, Escherichia coli
atgtcccttaacgacgcaaaaatccgtagtctcaagcccactgataaaccctttaaagtctccgattcccacggtctgtatctgctggtcaaaccaggcggttcccgtctctggtatcttaaataccgtattaatggcaaagaatcccgtattgcactgggtgcctaccctgccgtctccctgtctgacgcccgccagcagcgcgaaggcatccgtaagatgctggcgctgaacatcaacccggcgcagcaacgtgccgctgaacgcggctcgcgcatgcaggagaaaatgtttaaatccgtggcactggagtggcacagtagcaagaaaaaatggtcgcagaataccgcagatcgcgtgcttgcccgtctgaacagacatgtctttccgaccatcgggcatctaccagttaccgagcttaaatcacgtcatttcattgaattactgaaaggcattgaggaaaagggcttgcttgaagttgcgtcccgctcgcggcaacacctcagcaacattatgcgttatgctgttcatcaggggttaatcgaaatcaacccagctgcaaatcttgacggcgtgacggcttctcccgccagacgacattatcccaccctgccactggagcgccttcctgagctgcttgaacggattgacagttatcaccaaggacgggaactcaccaggcttgcagtcctgctgacgttgcatgtgttcattcgctcaagtgaactgcgctatgctcgttggacagagattaacttcagaaatcggatctggacgatacctgccacacgcgaagcgattgcaggcgtacgttattccagtcgaggtgccaaaatgcgtacaccgcatattgtgcccctttctgagcaggttatctctattctgaaaaggattaaggaaatatctggcgggtatgaactggtgttccccggctatcatgacccctacaagccgatgagtgaaaatactatcaataaggcacttcgccagatgggatacaacacgaaacaagatatctgcggtcatggtttccgggcaatggcgtgtagcgcgctgatggaatccggtttatggtcgcaagatgcagtggagcgtcagatgagtcaccaagagcgcaacactgtgcgtctggcttacattcataaggccgaacatatggaagcccgcatggacatgatgcagtggtggtcggattatctggatatgtgcagtgaaatctgggtgcccccgtacatctggagtcagcaaaacattaatctcgcagtaacctga

SEQ ID NO: 4778 - protein, 423 aa, Escherichia coli
MSLNDAKIRSLKPTDKPFKVSDSHGLYLLVKPGGSRLWYLKYRINGKESRIALGAYPAVSLSDARQQREGIRKMLALNINPAQQRAAERGSRMQEKMFKSVALEWHSSKKKWSQNTADRVLARLNRHVFPTIGHLPVTELKSRHFIELLKGIEEKGLLEVASRSRQHLSNIMRYAVHQGLIEINPAANLDGVTASPARRHYPTLPLERLPELLERIDSYHQGRELTRLAVLLTLHVFIRSSELRYARWTEINFRNRIWTIPATREAIAGVRYSSRGAKMRTPHIVPLSEQVISILKRIKEISGGYELVFPGYHDPYKPMSENTINKALRQMGYNTKQDICGHGFRAMACSALMESGLWSQDAVERQMSHQERNTVRLAYIHKAEHMEARMDMMQWWSDYLDMCSEIWVPPYIWSQQNINLAVT

SEQ ID NO: 4779 - DNA, 102 bp, Escherichia coli
atgcagattatttcagcaaacgatttcaaatttaaaaaacaggctttgacattgtgggtgggcatcgctaatattcgcctcgttctcacgattcctctgtag

SEQ ID NO: 4780 - protein, 33 aa, Escherichia coli
MQIISANDFKFKKQALTLWVGIANIRLVLTIPL

SEQ ID NO: 4781 - DNA, 1488 bp, Escherichia coli
atgtggtttcactttctgcaattaaggtcggctttgaatatctcctctgctttacgccaggttgttcacggcactcgctggcactctaaacgcaagagctacaaagtgttgttctggcgcgagataaccccgcttgctgttcctatcttcatggagaacgcctgtgtcctgttgatgggggtcctgagcacttttctggtcagctggctgggaaaagatgcgatggccggcgtggggttggcggacagcttcaatatggtcattatggctttttttgcagctatcgatcttggtactactgtcgttgtagcatttagtctcggtaagcgagatcgacgacgagcgagggtggcgacgcggcagtcattggtgatcatgacgttgtttgccgtactgttggcaacgctaattcatcattttggcgaacaaattattgatttcgtcgcgggtgatgccacgacagacgttaaagcactggcgttgacttatctggagctgaccgtactcagttatccagcagctgccatcactcttattggtagcggggcacttcgtggtgcagggaatacgaaaataccgctactgattaacggtagcctgaatattcttaatattattattagcggcatattgatttacggccttttctcctggccgggactgggatttgtcggggctgggttgggtttaaccatttctcgttatattggcgcagttgcaattttgtgggtgctggcgattggttttaatcctgcgctaaggatttcgttaaagagctattttaaaccgctgaattttagcattatctgggaagtcatggggattggtattccagcgagtgtcgaatcagtgttatttaccagtggtcggttattaacccaaatgttcgttgccgggatggggaccagcgttattgccggaaattttatcgcgttctcaattgcggctcttatcaacttacccggaagtgcgctcggttctgcttctacgatcattacaggccgaaggttgggggtagggcagatagcgcaagcagagattcagttgcggcatgtgttctggctgtccactcttggattaacggccatcgcctggctaacggctccctttgccggggttatggcatcgttttacacccaggatccacaggttaaacacgtcgttgtgattctgatttggctaaatgctttatttatgcctatttggtccgcctcatgggtgctacccgctggatttaaaggtgctcgtgatgcccgttacgccatgtgggtttcgatgttgagcatgtggggttgtcgggttgtagtcggttatgtgctgggaatcatgcttggctggggtgtggttggcgtctggatgggaatgtttgccgactgggctgtgcgggccgtgctgttttactggcgaatggttactggacgttggctatggaaataccctcgatccgagccgcaaaagtgtgaaaaaaagccagttgtatcggaataa

SEQ ID NO: 4782 - protein, 495 aa, Escherichia coli
MWFHFLQLRSALNISSALRQVVHGTRWHSKRKSYKVLFWREITPLAVPIFMENACVLLMGVLSTFLVSWLGKDAMAGVGLADSFNMVIMAFFAAIDLGTTVVVAFSLGKRDRRRARVATRQSLVIMTLFAVLLATLIHHFGEQIIDFVAGDATTDVKALALTYLELTVLSYPAAAITLIGSGALRGAGNTKIPLLINGSLNILNIIISGILIYGLFSWPGLGFVGAGLGLTISRYIGAVAILWVLAIGFNPALRISLKSYFKPLNFSIIWEVMGIGIPASVESVLFTSGRLLTQMFVAGMGTSVIAGNFIAFSIAALINLPGSALGSASTIITGRRLGVGQIAQAEIQLRHVFWLSTLGLTAIAWLTAPFAGVMASFYTQDPQVKHVVVILIWLNALFMPIWSASWVLPAGFKGARDARYAMWVSMLSMWGCRVVVGYVLGIMLGWGVVGVWMGMFADWAVRAVLFYWRMVTGRWLWKYPRSEPQKCEKKPVVSE

SEQ ID NO: 4783 - DNA, 5028 bp, Escherichia coli
  n 5010, 5011, 5012, 5013, 5014: n is any nucleotide
atgacttacagtgaaagcgatattgccattgttggcatgaactgccggtaccccggcgtgcacagcgttgcggcattcgaaacggtgcttcgcaccggatgcaacattttggaccccaaagtgaccccgagcaacggccacaatcacattacgctgaacaacgtctatgagcacatggcggagttcgatgccaacttttttggctacagccgtgcagaagcagaaatcatggatccacagcagcgcgtatttctgacctgtgcttgggagatgtttgaacaaagcggttacaacccgaagcagcacgatgcgcgcgtcggcctatatgcgggcgtgagtaccagcttctatttgcttactcacctgatgaacaacccagacaagcttgcacaactcggtggtctccaaatcatggtcggcaatgacaaagatcatttgacgtcccaactggcttaccgcctgaatattaccggcccttgcgtgacggttcaggccagttgtgccacctcgctggtggcagtgcatctggcctgcgaagggctgctgagcggtcagtgcgatatggcgctagcgggtggcgtcacgtttcgcatggaggagcagcgcagctatgaatcgcacggtgatgggctgcaagcagaggatggcctgattcatacttttgatgcgcaggcgagcggtacggtctacagcagtggtttgggcatggtgctgctcaaacgggctacagacgcgcaggtgcaaggggataacatccttgccgtcatcaagggaagcgccatcaacaatgatggcggtgcgcgcagtggttataccgtgccgggtgttgatggtcaggaagctgtgatgattgaggcgcatagcttggcggaggtgacgccgcagcaaattcagtatctagaactgcatggcagcggcacgccgttgggtgacgctatcgaattcgcggccatcaaacgtgtgtttgggacgccagcgccgaatgcgacaccgtggcgtctgggggctgtgaaacctaacgtgggtcacgtagaaatggcatctggcatcaccagtctcataaaaacggtgctgagtcttactaaccgggtgttttaccctacgctgaattttcaacgggctaatccgcaactggggttggaggacagcccgtttgaagtggtgtcccgtttaacgccttggccggagggcaccacgccacgcaccgctggtgtgagtgcgttcggattgggcggcaccaacgcacatctggtggtacaagcgccgttatcgacgccgcaggcgagggcgcagcagatggggccttgtgtcgttgtactctcggcaaaaaaccacaatgccctggaacagatgcaaaacgccctgctggcgaaactggccgcacatccagagatacgcttacaggacgtggcttacaccctgcgtcacgggcgtttctccgccccggtacgtaagtgtgtcatcgcagagaattgcacccagctagcccgacaactccgcgacgcaccgatggtggaggcaaccacgggttgcacgatctactggagattggggcaccgtttcgttgttgcactcgagacgcttagtgactggctggcgtgctctgaggtgttgtcacaggcggtgggacaactgctcgagcattttccgctcgaaccagcctgtctgcaagatctctcccctgcgcaacggacgtttatcagccagtatgcgctgatcgcgttgattgacgaacgggaaacgttgaatgtggtgctatgcggcgacggtgatggtggctatgctgccgccgtactacgaggagactgcacactagagcaagcatggcacaggttgaatgcgggccaaccgtttgatgatgtgccgacgaatcccctcttgcagcccgatgtctgctctttgatgctggacgacgcggcgagtgatgccaatcgcaccgcgctagaggcgttagggcagttatggttggctggcgtcagcctagattggcgctgggtggatgcggcggagcgtatgttgggcagtcaacgcatcgccctgccggggaccgtttttacaccgcagcgctattgggtcgaggccgtacggcctgccacgttctcccacgaatcgtcgaataatctcttatcccgcgcaacaaaatccgatattattgcagtggtgacggagatatgggaacgcacgcttggtgtcagcattgatgatcaccacgccagcttcttcgaactgggtgggcattcgctgttagcgtcaaccattttatatgatattcagcaacgttacggcatcacctgtacgctaagcgcattctttgccgatcccaccatcgagggattaagttgctatctgctcgaacaaggcggcagtgagacagcggtttcagcattgcctgatacggtctttgcccctgaccagcagcacctaccttttccgctgactgacgtgcaacaggcctattgggttgggcggcgaaaatccttgggattgggcaatatttccacccatatctatgtggaatatgaactacaggggctagatgaaacagcgttcaaccgcgcgctcaatgcggtgattgcgcggcacagcatgttgcgtgcaattgtcaacgatgacggtatgcagcagatattgccaaacgtgccggaataccacgttgccttctataccacccagtgcgaggatgcgtttcaacagcgttgccgtgagctgcgtgacaccctctcacatcagatgattgattgtagtcgctggcctctgtttcagatggaggtcgtggttgatccgcagcaaaaagcccggctacatgtatctatcgacctgctgatagccgatgcatggagtctggagttgttcattcgggaactagcttatcactaccgccatccgcaggcggcattgcctacattgacgtacagtttccgcgactatgtgctgaccttaaaatcctacgagaaaacgccgcagtttgaacgggcacgtgactactggcgcgcccgcatcgaaactctgccgccggggccacgattgccgctgcgtaccgaccccacgaagctggaaaaccccacattcgtgcgccgtagctattgtctatctcgtgctatctggcagcgcttgaaaacgcaggcgggtcagatgagtatcacgcctactacactgctgctcacggggtttgctcaggtgttggcgcgctttagttcctcgccgcactttagccttaacctgacgctgtttaatcgtctgccgttgcacgcagatatcaatcacttaattggcgattttactgcactgacgttgctggagattgatatgtcgcagggagaaaccttgcaggcgcgggcaaacgtgatccactctcaactgtggcgcgatttggataaccgcttgtttggcggtatccaggtctctcgactgctggtacaaactcaccgcgatccggcgaaatcggtgattcctatcgtgttcaccagcttgctcaatcaatatgaggcgagctgggaaacggatgatacgctgttcaaccaaccgcaggatgatctgtacagtatttcacagacaccgcaggtgtggctcgatcatcaggtaatggagcgtaacggggaattgcactttaattgggacgtggtggaacaattgtttgaaccggcgctaatggatcagatgttccagtgttattgccaactcctgcacgccctagcccagcgaccacagctctggcatgagactcaagatgtgctggcgctgcccaccgttagtgcaccggtcacgcaggctcctgcacctacggccttgttgcaccatgggttactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacactggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgannnnncattcattcattaa

SEQ ID NO: 4784 - protein, 1675 aa, Escherichia coli
  Xaa 1670, 1671, 1672: Xaa is any amino acid
MTYSESDIAIVGMNCRYPGVHSVAAFETVLRTGCNILDPKVTPSNGHNHITLNNVYEHMAEFDANFFGYSRAEAEIMDPQQRVFLTCAWEMFEQSGYNPKQHDARVGLYAGVSTSFYLLTHLMNNPDKLAQLGGLQIMVGNDKDHLTSQLAYRLNITGPCVTVQASCATSLVAVHLACEGLLSGQCDMALAGGVTFRMEEQRSYESHGDGLQAEDGLIHTFDAQASGTVYSSGLGMVLLKRATDAQVQGDNILAVIKGSAINNDGGARSGYTVPGVDGQEAVMIEAHSLAEVTPQQIQYLELHGSGTPLGDAIEFAAIKRVFGTPAPNATPWRLGAVKPNVGHVEMASGITSLIKTVLSLTNRVFYPTLNFQRANPQLGLEDSPFEVVSRLTPWPEGTTPRTAGVSAFGLGGTNAHLVVQAPLSTPQARAQQMGPCVVVLSAKNHNALEQMQNALLAKLAAHPEIRLQDVAYTLRHGRFSAPVRKCVIAENCTQLARQLRDAPMVEATTGCTIYWRLGHRFVVALETLSDWLACSEVLSQAVGQLLEHFPLEPACLQDLSPAQRTFISQYALIALIDERETLNVVLCGDGDGGYAAAVLRGDCTLEQAWHRLNAGQPFDDVPTNPLLQPDVCSLMLDDAASDANRTALEALGQLWLAGVSLDWRWVDAAERMLGSQRIALPGTVFTPQRYWVEAVRPATFSHESSNNLLSRATKSDIIAVVTEIWERTLGVSIDDHHASFFELGGHSLLASTILYDIQQRYGITCTLSAFFADPTIEGLSCYLLEQGGSETAVSALPDTVFAPDQQHLPFPLTDVQQAYWVGRRKSLGLGNISTHIYVEYELQGLDETAFNRALNAVIARHSMLRAIVNDDGMQQILPNVPEYHVAFYTTQCEDAFQQRCRELRDTLSHQMIDCSRWPLFQMEVVVDPQQKARLHVSIDLLIADAWSLELFIRELAYHYRHPQAALPTLTYSFRDYVLTLKSYEKTPQFERARDYWRARIETLPPGPRLPLRTDPTKLENPTFVRRSYCLSRAIWQRLKTQAGQMSITPTTLLLTGFAQVLARFSSSPHFSLNLTLFNRLPLHADINHLIGDFTALTLLEIDMSQGETLQARANVIHSQLWRDLDNRLFGGIQVSRLLVQTHRDPAKSVIPIVFTSLLNQYEASWETDDTLFNQPQDDLYSISQTPQVWLDHQVMERNGELHFNWDVVEQLFEPALMDQMFQCYCQLLHALAQRPQLWHETQDVLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIXXXFIH

SEQ ID NO: 4785 - DNA, 6501 bp, Escherichia coli
atgacgatacatcatgccgcattggcgcgaatgttaccggcggaaaaaaaggaaaagctattacgacagttggcgcaatcaggcgtgtcgcccagccgcattcccatcatcaaagcggatccggcgcaggcaatcccgctgtcgtttaatcaggagcggttgtggtttttgcaaaaatacgacagtaccgccactaactacaacctttatgtggtgtatcgtttgcatggcgtggtggatatgccgatgctcacggaggcattgcgccatgtgcaagcacgccacgccatcttgcgtacccgtatcatagtacgtaacgatcggccttgccaggtgatagatgatgcgtcttcgttagttctcgatacggtcacgctggcagcgcaggccccaacttcagcgctagatgcggtaattcagcaggtgataaacacccggttcgatctggcacgcggtcctctgtggggggtaactcagattattcaacccgatcaaggttgtcatttggtgttttgcgcgcaccatatcatcatcgacggtatctcgttacggctattgttcgatgagttacagcagcagtatgctcgattgcatgctggtaatgaaacgtcgctgcctccgccgccgctgcaatatgccgattatgccttctggcagcgcgaatggttccaggataccttgctggcgaacgaacttgcctactggcgtgcgcgtttgcaagacgcgcctctgctgtcgacatttccatcgctgcacccgcgcccggcacaaccctctacacatggttcccggttcagcatcaccctggatgaaacattaagcctcgcgttgaaacacgtagcccgcacgcaggaaacaacgccgttcgtgctgatgctgactgccttccaactggtgctgatgcgttacgctcagcaacagcgattggtgataggcatgccagtatcggggcgcattcgcccggaattgcagagtagcattggttattatgccagcactgcggttatctacaccgattttaatggggttgaggtagggcgcgaggcgctccagcgtgtgaaggccagcgtgaaagagacgcaggggcgccagcaactgccgtttgaaaacttggtgaatatgctggatctccctcgcagcctttcccattcaccgttgttccagatcctctatatctaccataaccacgtgaccccacgcgcttttaccttggctggtgcgtattgggagcaggtgacgtatcacaatcagaccgtcaaatacgacatgacagtcgaggtgttccaaaacgacgccacgttcgacgtctcctttgagtacgatttggggttatacgatgctgatgtggtgaagcagattgccgaggcgctgcgtcagcactgcttatcgttgacatcatcactggagaccccgataggggcgatccctctgcatgcaccggagaccgcaacgccgcggcgtgatccgctcaacgccactaacgtcccgtggctcgggccgcaggatgtgctgcgtatcattgaacagcgctgtgtgcagcacccaaagcaactggcaatacagcagcatgacggcacactgacctacgctgagctctgggcgcgtgtgcagttcatcgcgatgcgttttcgagcgcatggcatacaaccgggcgatcgtattggcgtgctgttgccacgtcacagggatgtgattgcaaccatgttggcgacgtggtttgtgggggcgtgctacgtgccgttcgatattcatcagcctgccgcgcgtttgcaacgccttatgcaacgcgcgcgtttggtctgtctggtggtccgtcagccgggagagtggggtgaaattgtacaactgtcgttgccggaattgatgcaggacatgtcgaatgcgatccggtattctacaccttgcgcgctgttgccggatatgcaggcctacctgttgtttacctccggcagtaccggtgaacctaaaggcgtgtgcgttgttcaccgcgggttgctgaacttgttgttggatatgcagcgtacctttgcggttggctcgcaagaccggctgctctcggtgacgacgccaacatttgatatctcattcttggagtatctgttgccgctgatctccggtgcgagtctctatctgacagaggcggaacgcgccgcagacagcttccgtatgattccgctgattgccgactatcgaccaacgctgatgcaggcgacgccctcgttctggcacgggctgttgatggcgggttggcgtggcgacccggaactatgtgtgctggcaggcggtgaagcgctgccaacgaaagtggcggaagaactgttgcgctgttgtggttcattgtggaacctctacggtcccaccgaaacaaccatttggtcgctgaaatcgcagataacccaagcggaaaacatcaccctcggcgctcccattgccaatacccgtatatacattctggacaatgagggccatccagtgccgcaaggcgttgacggcgagctttacatcgccggggatggtgtggcgcaagggtatgatgggcagcctgagttgaacgcacagttcttcttgtcagaaccaggggtccccggtggcaggatgttccgcactggcgatctggtcaggagtgatgcgcaggggcagttgttttttgttgggcgcaaagatagccagatcaaactgcgcggttatcgtattgagttaggcgaaattgaacggacgttggcacggcatccgcatgtggacgccgcggtggtggcctgtattgaaagagcaccgttacacaaagcactggcagcattcatcatcaccagtgagcctccctcgctattcgagcaactgaaaaacgagcttcggcagcaactgccagactatatggtgccaacgctgtggcagagggtggccgacttcccgaacactgacaacggtaaaatcgatcgtaagcggttagcggaaaatttcgttgccgatagctcccttgtgtcgccgcagacgcaagcgctgagcgacacggaacagatgttgctggcgctgtggatgcgctatttgccgataaaaaacgtcgatcctgagtgcgatttctttcgcttggggggacattcgctgttggcggtaacgttggtagcagagatcaaccgcacttttcactgcgccttgaccctgaaggacattttccactactccacactacgggcactgagtgcgcgtattgcacagcaatctatcacggacgctgccgcgtctcaggatgactgggtgatagtgcacgaccctgagcatcgtcatcaaccgttcccattgacggatgttcagcgcgcctactggcttggacgacagacgggtgctacctcgatcgcgacccacatctaccatgaatttgacgtagaacactttaatgttacgcgttttacccatgcggtgaatgcgctgatcgctcgccatgaaatgctacgtgcgcgggtactccccgacggtactcagcagattctggcgcaagtgccggcgtatcagttagagcagcgcgatctgagtgctttgtcccctaacgcacgaaacgatgccttgatggcgatccgcgatcggctgtcgcatcatgtgcatcccgcagatcgttggccgctgtttgatttcagttattcggcttgcacggcgcaacatggccgcttgcatttcagtctcgatctgctgattgccgatgctctgagtatgcgcacgctacagcaggagttgatgatgctgtaccgtgagccccatgtgtcactgccgttgctaccgttctcttttcgtgactacgtgcaggcgctgttggtagagcaggcgagtgaagcctatgcacgcgatcaggcctattggcaacgggcgctgccgcagctgtatggcccaccaacgctgcccgtacagggcgatttggcgcaactgtctgcgatcaggttcgtacgtcgccgtcatcggctgtcagcccacaactggggagtgctgagcgcgctggcccaacgcacacgtatcaccaagacggcattgttgttgacagtctttagccaagtgctggcacgttggagccttagcccgacgtttacgctcaatctgacgttgttcaaccgcccgcagggttaccccaacgcagaggcagttattggtgattttaccgctgtcagcttgctgaatgtttgttacgacagccagcactcttatgcccacaacgctcagcgtattcaggtgcaactgtgggaagatctcgaacatcgtcgtttcagtgggatccgcgccagcgaggcgctgatccatagcggtcgtttccatgcgccgatgccggtggtattcactagtatgttggatatcgacggggagacgactgcgcaagaccctcgggacacaacccgttttactctgtgtccggacgccaatattacccaaacaccgcaggtgtggctcgatcaccaggtgatcgagttggctggggagttgcatttcaactgggacgcggtcgagcaactgtttgataccacgctgctggatcagatgtttggtgcttattgtcatgcgctgcaggcgctggttgccatgccgcaaagttggtggggggtaaatagttctctggcgctgcccaccgttagtgcaccggtcacgcaggctcctgcacctacggccttgttgcaccatggattactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacgctggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaagtcaaaagccaccttgaacagctcgacagcgtagggagtgccgccgtggtgtgccaccagggacagctgtatgcctttatcactgccgcagaaaacctgcatcctgacgatactgacgccctgttagcgcgtgttcgtgctcagttagccgtgcagttgccgtattacctgctgccccaacatttctttcttctcaaggtgctgccgatgacaggcaacggcaaaattgatcaggcggcaatggttcaagaggttatccaacgtatgtcgcaatctacatcacagaagtcgagggccctcgcgcacgcctcgccctatgaacagcaggtggccgctctctggtgcgaggtactacaacgagaacagatcggactgaatgacaacttttttgaagcggggggcggctcaatccagatcgtgctgttgcatcgccgtattgaggagatttttaaggttacggtacctattgctgagctatttcgcttaaccaccgtgaaaagaattgccggttatttgcaggctatgcaggacaatgcacgggcggtgaatcaaacacagcagcgtgatgcttcccgatcccgcgcccagcaacgacttgtacgtcgtcaccagcgtcagcgttaa

SEQ ID NO: 4786 - protein, 2166 aa, Escherichia coli
MTIHHAALARMLPAEKKEKLLRQLAQSGVSPSRIPIIKADPAQAIPLSFNQERLWFLQKYDSTATNYNLYVVYRLHGVVDMPMLTEALRHVQARHAILRTRIIVRNDRPCQVIDDASSLVLDTVTLAAQAPTSALDAVIQQVINTRFDLARGPLWGVTQIIQPDQGCHLVFCAHHIIIDGISLRLLFDELQQQYARLHAGNETSLPPPPLQYADYAFWQREWFQDTLLANELAYWRARLQDAPLLSTFPSLHPRPAQPSTHGSRFSITLDETLSLALKHVARTQETTPFVLMLTAFQLVLMRYAQQQRLVIGMPVSGRIRPELQSSIGYYASTAVIYTDFNGVEVGREALQRVKASVKETQGRQQLPFENLVNMLDLPRSLSHSPLFQILYIYHNHVTPRAFTLAGAYWEQVTYHNQTVKYDMTVEVFQNDATFDVSFEYDLGLYDADVVKQIAEALRQHCLSLTSSLETPIGAIPLHAPETATPRRDPLNATNVPWLGPQDVLRIIEQRCVQHPKQLAIQQHDGTLTYAELWARVQFIAMRFRAHGIQPGDRIGVLLPRHRDVIATMLATWFVGACYVPFDIHQPAARLQRLMQRARLVCLVVRQPGEWGEIVQLSLPELMQDMSNAIRYSTPCALLPDMQAYLLFTSGSTGEPKGVCVVHRGLLNLLLDMQRTFAVGSQDRLLSVTTPTFDISFLEYLLPLISGASLYLTEAERAADSFRMIPLIADYRPTLMQATPSFWHGLLMAGWRGDPELCVLAGGEALPTKVAEELLRCCGSLWNLYGPTETTIWSLKSQITQAENITLGAPIANTRIYILDNEGHPVPQGVDGELYIAGDGVAQGYDGQPELNAQFFLSEPGVPGGRMFRTGDLVRSDAQGQLFFVGRKDSQIKLRGYRIELGEIERTLARHPHVDAAVVACIERAPLHKALAAFIITSEPPSLFEQLKNELRQQLPDYMVPTLWQRVADFPNTDNGKIDRKRLAENFVADSSLVSPQTQALSDTEQMLLALWMRYLPIKNVDPECDFFRLGGHSLLAVTLVAEINRTFHCALTLKDIFHYSTLRALSARIAQQSITDAAASQDDWVIVHDPEHRHQPFPLTDVQRAYWLGRQTGATSIATHIYHEFDVEHFNVTRFTHAVNALIARHEMLRARVLPDGTQQILAQVPAYQLEQRDLSALSPNARNDALMAIRDRLSHHVHPADRWPLFDFSYSACTAQHGRLHFSLDLLIADALSMRTLQQELMMLYREPHVSLPLLPFSFRDYVQALLVEQASEAYARDQAYWQRALPQLYGPPTLPVQGDLAQLSAIRFVRRRHRLSAHNWGVLSALAQRTRITKTALLLTVFSQVLARWSLSPTFTLNLTLFNRPQGYPNAEAVIGDFTAVSLLNVCYDSQHSYAHNAQRIQVQLWEDLEHRRFSGIRASEALIHSGRFHAPMPVVFTSMLDIDGETTAQDPRDTTRFTLCPDANITQTPQVWLDHQVIELAGELHFNWDAVEQLFDTTLLDQMFGAYCHALQALVAMPQSWWGVNSSLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEVKSHLEQLDSVGSAAVVCHQGQLYAFITAAENLHPDDTDALLARVRAQLAVQLPYYLLPQHFFLLKVLPMTGNGKIDQAAMVQEVIQRMSQSTSQKSRALAHASPYEQQVAALWCEVLQREQIGLNDNFFEAGGGSIQIVLLHRRIEEIFKVTVPIAELFRLTTVKRIAGYLQAMQDNARAVNQTQQRDASRSRAQQRLVRRHQRQR

SEQ ID NO: 4787 - DNA, 3033 bp, Escherichia coli
atggcagagaatgattttggtatagctatcattgggatggcggggcgtttccctcaagccgatacggtacaggcgttttgggaaaatcttctggcaagccgagagtgcatttccttttacagcgatgaggaactgctggcgatgggaatcagtcctgaatttgttcagcacccagattacgtcaaggccaaaggggaggtagctgacatcgataaatttgatgctgctttcttcggtatcgcaccccgagaggcggagctgatggatcctcagcaccgtgtcctgttggaaaccgcgtgggcagccttcgaagatgcgggctatgtggctgccgattatccgggggatgtgggtatttttgctggcaaaagcatggattcctatttgatgctgaacttgatgccgcactttaaacgcgttttctcttctggcagtttgcaggcggccattggtaacgacaaagacagtatcactactaccatcgcctatcacctcaacctgcgcggcccggcgatcacggtgcagacttcctcatcgacatccttggtggcggtgtgcgtggcatgccaaagtctgttgacttggcagtgtgacatggcgattgctggcggagtaacgctggggccaccagcaaaaaccggctacttgtcgcaggaaggtgggatcaccgccgccgatggccactgtcgggcgttttccgataacagcagcggatttgtgcccggcaccggcgcggggctggtggtgttaaagcgtgttgatgaagcgctgcgtgatggcgataacatctatgcggtcatcaaaggatttgccgtcaacaacgacggttcggagaagatcagttataccgcgccgagcgtggatgcccaagcgcgcgccattgctcaggcacagcggttggcaggtttgacaccgcaggatatcacttatgtggaagcccacggtaccggtacgcgtttgggcgatccggttgagttttctgcgctaagccaagcctttgcgggcgcgtcacaaaagcagtactgtgcgctggggtcggtaaaaaccaatatcggccatttggatacggcagcgggcgtcgcagggttgataaaaaccgcgctggcagtgcagcagggaataattcccgcaacattgcactttgaacggcccaatgcacagatcgatctgaccaatagtccgttttacatcaacactacctgtcaaccgtggcaaccggaaagcggcatccgtcgcgcgggcgtcacctcgcttggcatgggcggcaccaatgcccatgttgtgctggaacaagcgccagccgttgacttgcaagcgcgagcgcctgtacctgcctacagtattttgccgttttctgccaagaccgacagtgccttatcctcggggctggcgcgttttgccgattttctgcaacatgaatcgctgccggataggcgggatctggcgtggacactctcacagggacgtaaagccttcgcacatcgcgccgcgctcgtaaccagagatctacatgctgccgggacgctgttgcagcaggccgcgacagcgccgtttgctcgtggtgtagcgcagacacagctcgggctggggctgttgttttccgggcagggtagccaatatcagcgcatgggccatcagctctatcaggtttggccggcctacgccgatgccttcgaccgttgcgcgacgttactcgagcgtgaataccaactggatatccgccatgagttgttcagagcagaagtctcgttagcccaaggcgaacgccttgcgcaaacctgcctcacacaaccgctgctgttcagcgtcgagtatgccttagcccaattgtggctcagttggggaatcacgccaacggtaatgattggtcattcgctgggcgaatgggtggcagcgacgttggcaggcgtgttctctttagaggatgcgttgcgcttggtggcgcgtcgagcagagctgatgcatcaggcaccaagcggtgccatgttgatggtggcgctgcccgaagcacagattcgcgcactgattaccgccccgctggcgattgccgctgttaacgcccctgactattcggttatcgccgggcctacgtcggagatcctcgccgtcagccagcgtctgacggagcagaacatcatcaacaaacgattgcatacctctcatgccttccactctagcatgatgcaagatgcggcgcaggcgctacgtcaggcatttgagaatgtacgactgaacccgccgacgctcaccatcatctctaccgtaaccggcgcgcacgtcagtgccgacactctcaccacaccggactactggattgaacagatgctgatgcctgtgcagttctccgctgcactgcaagaggcgcaagctacatttgatgtcgattttctggaaatcgggccaggtgccaccctgacccagctgaccaacggtcatgcattaggtgatcgtctcgcgttcagctcgctgccagcaggtgcccgcagcagcgatgagcacaaacatatcttagataccgtggcagcgctttgggtgcgagggcataacatcgatttgtctgcgtttgcaggtgagcaaccgcgccgtgtctctctaccgacctacgcctttgacaaaatccgttactgggtcgacagtccagaagaacagaggagcgccgtaacgccggtggcggacgcgggaagtgtcatccctagcgaaccgtcggtgcgccgtcagccgcgtccggcgttttcggtgccttacgcggctccagagagcaaaacgcagcgcggcttagtggcgatttgtgaagcattgctgggaattgacggcttgggcattgacgacaacttcttcgaagctggcggacattcattgatgctgggcatgttgctggcgcaggtacaggaacggttcgccgtcactctttcctttttcgacgtgatggaggatgccagcgtgcgcgcgttagcgcagttggtcgagcaggagcagcaggatgatggagggtccgcacttgccgtgctagttaacgacatgattaatgagtga

SEQ ID NO: 4788 - protein, 1010 aa, Escherichia coli
MAENDFGIAIIGMAGRFPQADTVQAFWENLLASRECISFYSDEELLAMGISPEFVQHPDYVKAKGEVADIDKFDAAFFGIAPREAELMDPQHRVLLETAWAAFEDAGYVAADYPGDVGIFAGKSMDSYLMLNLMPHFKRVFSSGSLQAAIGNDKDSITTTIAYHLNLRGPAITVQTSSSTSLVAVCVACQSLLTWQCDMAIAGGVTLGPPAKTGYLSQEGGITAADGHCRAFSDNSSGFVPGTGAGLVVLKRVDEALRDGDNIYAVIKGFAVNNDGSEKISYTAPSVDAQARAIAQAQRLAGLTPQDITYVEAHGTGTRLGDPVEFSALSQAFAGASQKQYCALGSVKTNIGHLDTAAGVAGLIKTALAVQQGIIPATLHFERPNAQIDLTNSPFYINTTCQPWQPESGIRRAGVTSLGMGGTNAHVVLEQAPAVDLQARAPVPAYSILPFSAKTDSALSSGLARFADFLQHESLPDRRDLAWTLSQGRKAFAHRAALVTRDLHAAGTLLQQAATAPFARGVAQTQLGLGLLFSGQGSQYQRMGHQLYQVWPAYADAFDRCATLLEREYQLDIRHELFRAEVSLAQGERLAQTCLTQPLLFSVEYALAQLWLSWGITPTVMIGHSLGEWVAATLAGVFSLEDALRLVARRAELMHQAPSGAMLMVALPEAQIRALITAPLAIAAVNAPDYSVIAGPTSEILAVSQRLTEQNIINKRLHTSHAFHSSMMQDAAQALRQAFENVRLNPPTLTIISTVTGAHVSADTLTTPDYWIEQMLMPVQFSAALQEAQATFDVDFLEIGPGATLTQLTNGHALGDRLAFSSLPAGARSSDEHKHILDTVAALWVRGHNIDLSAFAGEQPRRVSLPTYAFDKIRYWVDSPEEQRSAVTPVADAGSVIPSEPSVRRQPRPAFSVPYAAPESKTQRGLVAICEALLGIDGLGIDDNFFEAGGHSLMLGMLLAQVQERFAVTLSFFDVMEDASVRALAQLVEQEQQDDGGSALAVLVNDMINE

SEQ ID NO: 4789 - DNA, 4812 bp, Escherichia coli
ttgaaggccagagttatggaacagcaagggattatgagacagttgcctaccgacgaccaaacgatagtcgactatttgtatcgtatcgccggagaatatggggaaaaagccgctgtattgatgggggacgcggcgctgagctatcacgatcttaatgcacgctctaaccaactggcgcattatctgcgtgggctggggatcggcgaggatcgtgtggtagctatccgcctgccgcgcggcatggcaatgctgattgccattttcgctattgtaaaagctggtggtgcctatttaccgctggcgtacaatgcaccgcgcagccgcattgaaaatatactgagcaacagcggcgctgtttgtctgatcggtactgacgatggtgatcgctggccgattcctcgcgtcgaaatcgacagcgcggcggtcagtgccatgccaacgacggatctgcgttaccgaccacatgcgcggcaactggcgtatattatttacacctccggttccaccggtgtccctaaaggggtggcgacggaacatgcagcgctgctaaaccgaattgtctggatgcagaacgcttatcctatcagttctcaggacgtgctgtttcagaagacggtgtacacctttgacgtctctgtctgggagatgttctggtgggcgatgtacggcgcatctgtagtgctgttaccgtccggactggagagcgatccgcgaaccttggctcgactgattcagcgtcaccgcgtgtcggttgtgcactttgtcccttcgatgctgaacctgtttgtcgagtatctggagatgaaacaggatcctcgtttgaccgcctcattgcgattagtgttttccagcggtgagaaactcacggtccacagtgtggctcgcttttatcaatcggtggcgcagggtgatcttataaatctctatggcccgaccgaagcagcaatcgatgtcagtcatcaccgctgcctgcgcgggtacgactacgacgatatccctatcggtcaagcgattgacggttgccgactctatgtgctggatgaccatggtaatccggtagcagacggcgaagagggcgaactgtatctcgctggtatcgggctggcacgtggctatctcaacaacgtggcgttaactgatcgctgttttactatacatccaactttgcgccatttagggaaaccggagcggctgtataaaactggagatctggtgtggcgcgacggggaaagccaacaaattcattacattggccgtaatgattttcagattaaaattagagggttgcgcgttgaattgggagaaatcgaagcccatgcgatgcgtttcccgggggtacagcaggcagtcgtggtggcggatcaggatgatcccgacaatcagttgatttacgcttttgtcgtcagtagcgtgccgctcaatttggcggccttaatggacgcactgtccaaaaacttgcctgcctacatgctgccgaaccgtttgttggcaatgtcagagttaccactctccgacaatggcaagtgctgtcgtaaaacgttgctcgacttggcgcgggcgtactcagccagtcgcgtcgatttacgtgaaactcccgccgtgcgctacctaccgttgtcatcggctcaatcgtcgatgtggtttatgcaacaattggcgccgcatactgcactatacaataaccccaccgccttgctgcttgaaggagaactggatcgcacgcggatggacggcgcgattcgtcaattgatgagtcggcatactctgttacgtgctatggcggaaacccacaatggacaaccagtattggcggtgcctcagtgcgtatcgtcgcaggcgttgctgaccatagtgccactcccctcggtgagtgatgataacgcgctacaggcgatgatcaaccagcgtgcggcacaccccatgcccttaacgtcaggcacaccgctgtgccggtttgaactgttgacgctcgatgacgatcgtagcgtattgttgattcatctgcaccacatcatcagtgatggctggtcgaaaggcgttttgttacgcgaattgcaggccgcatataacggtgaatcgctgacgccagaaccgttgttggagtatgccgactacatggagtaccaagaagagtggcgtcagagtgacgcctatcaggacgcgatgcgttactggcaaaataccctggcggggacgttgccgattcttgatatccccaccgatcaaccgcgtcagaaggtggcacgttaccaaggcgcgtttgttgccttcgcattgtctgccaacacatgcgagcgagtgttggcggcggcgcgtgcgcagcgcgtgtcgttgtataactatctgctgaccgccttcgtcctcctgctgcatcgtaatgcgcgtcaacaggaatacatcgtcggtatgccgattgctgcgcggctgacgaaagaacaggagcatatgatcgcgccgctggtcaacgtactaccgctgcgcttacctcttgacgaagcggcatcgttttccgagttagtacagacgatcagaggtattctgtttgccgctttcaggcaccagcgtctcgaatttaccgacatagtgcgcgcagtgaatgtggatcgcagcgccggacatttcccaatatatcagtgcatgttccaactcgacaatatgcctctggcgagcccgacactaaacggtgtcaacgttacaccattattgttggataccagtgcatctcaggtggatatttcgctaagtatgcagcatatcgatgggcgcatcaccggcactttcgaatacgacgctgggttatacagtgcggatcgtattcagcacctggtggcgcagtggagagaactgctagatgaggccagcagccaacccacgcagttagtccgcgatttgattcgtttcacccctcgagagcacgcttggctggcgcggcacaacgccactgaagttgctctgccgcccgtagataacctgctggcgctagtgttaccgcactgccagcagcgccctacacaggtggctttgcgccacgctgacgacgccatgacctatggcgaattgcaacaggccacgatgcagatgtgtacttggctgcgtgcgcaaggcgtaaaacgcggagaatctgtcgcactgcaactgcctttttgtttcgaattgattatcgcacaattggcgatcctctctttgggggcgagctatgtgccgctggatggtaacgcgccagcggcccgcaatgccctgatcttggcgcaggcaacgccgtgcatgctgctggtggcgcaaccgctggaatcccctcatgggctgacgataccttgggtgctagtgcctgactggcgtagcctgctgacagaaataccgaacctgccagttagtgttgcgccagatgctttagattgcgatgcggtggtgatctttacctccggtactaccgggcagcccaaaggcgtccgactcagccaacgtaatctggtcaacttaaccgcatcctttatatccagctatcaagtgacgcatcaggatgttttgctacccattacctcagtcgcgtctgctagctttgtcggggaggtactgccgctgctcgccgctggcggtaccttagtattggcgcaaaaagcgcagagtttggatagtgatgcgctcattgcgctgctggcatctcagcgggtgactatcctgagcaccaccccatcgctttctgccagcctctctgtgctggctcagtcgatgggatcgctgcgcttgtttctgtgcggtggtgaagcgttagagtatgagcagatagcgccgcttctgccgcacatggcagtggttaacggttatggcctgaccgaaagcggtatctgctcgacctactttcctgtcgcaaagcgtagggagcaagaaacgggagcattgcccattggccgcccgattcagaacacccaagcttatgtggtggatgcatataatcgtttggtaccgccaggtgcctgtggagaactctgtttctctggtctgggcatttcgcccggctaccttgatgcacgacaggatcccgagcgctttgtcgagttgccggaataccctggcgttcgggtgctgaaaactggcgatcgtgctcgttgggcaaccgacgggatgttgttctatctcggcagacaagatcgccaagtgcagatccgtggataccgagttgaactgggcgacatcgaaagcctactgaaacagcatccggatattgctgatgcgtgggtcgatgtgcgacgcaatgcggcggcaacgccgctactagtggccttctattgcagcgtcaacggcgttgcgctggatgctcagcaattgcgcgtatggctcagcctgcggcttccgttgcatatgctgccgttgctctacgtgccgctgagcgccatgccgctaggtgtaaacggcaaaatcgatccccagtgcctgccgctggtcgatctgcggcagttggaagggccgggcgagtatgtccctccggcaaccgaactggaacagcgtctggcggagatctggcagcagttgcttggcctggagcgtgtcggcaccaccacaaatttcttcgatctcggtggacactcacttctgctagtacagatgcagcaatacatcgggcagcagtgcggtcagcacgtggcgttggttgacctgctgcgcttcactaccatcaaacgcttggcggaatttctgctggccccggacgcagcgcaagggaccacaggagatcagacacaactgcgtgcggcgaagcagcgtttggcctttggtcacacgcgctgggcagccacaaccgacagtcatcactga

SEQ ID NO: 4790 - protein, 1603 aa, Escherichia coli
MKARVMEQQGIMRQLPTDDQTIVDYLYRIAGEYGEKAAVLMGDAALSYHDLNARSNQLAHYLRGLGIGEDRVVAIRLPRGMAMLIAIFAIVKAGGAYLPLAYNAPRSRIENILSNSGAVCLIGTDDGDRWPIPRVEIDSAAVSAMPTTDLRYRPHARQLAYIIYTSGSTGVPKGVATEHAALLNRIVWMQNAYPISSQDVLFQKTVYTFDVSVWEMFWWAMYGASVVLLPSGLESDPRTLARLIQRHRVSVVHFVPSMLNLFVEYLEMKQDPRLTASLRLVFSSGEKLTVHSVARFYQSVAQGDLINLYGPTEAAIDVSHHRCLRGYDYDDIPIGQAIDGCRLYVLDDHGNPVADGEEGELYLAGIGLARGYLNNVALTDRCFTIHPTLRHLGKPERLYKTGDLVWRDGESQQIHYIGRNDFQIKIRGLRVELGEIEAHAMRFPGVQQAVVVADQDDPDNQLIYAFVVSSVPLNLAALMDALSKNLPAYMLPNRLLAMSELPLSDNGKCCRKTLLDLARAYSASRVDLRETPAVRYLPLSSAQSSMWFMQQLAPHTALYNNPTALLLEGELDRTRMDGAIRQLMSRHTLLRAMAETHNGQPVLAVPQCVSSQALLTIVPLPSVSDDNALQAMINQRAAHPMPLTSGTPLCRFELLTLDDDRSVLLIHLHHIISDGWSKGVLLRELQAAYNGESLTPEPLLEYADYMEYQEEWRQSDAYQDAMRYWQNTLAGTLPILDIPTDQPRQKVARYQGAFVAFALSANTCERVLAAARAQRVSLYNYLLTAFVLLLHRNARQQEYIVGMPIAARLTKEQEHMIAPLVNVLPLRLPLDEAASFSELVQTIRGILFAAFRHQRLEFTDIVRAVNVDRSAGHFPIYQCMFQLDNMPLASPTLNGVNVTPLLLDTSASQVDISLSMQHIDGRITGTFEYDAGLYSADRIQHLVAQWRELLDEASSQPTQLVRDLIRFTPREHAWLARHNATEVALPPVDNLLALVLPHCQQRPTQVALRHADDAMTYGELQQATMQMCTWLRAQGVKRGESVALQLPFCFELIIAQLAILSLGASYVPLDGNAPAARNALILAQATPCMLLVAQPLESPHGLTIPWVLVPDWRSLLTEIPNLPVSVAPDALDCDAVVIFTSGTTGQPKGVRLSQRNLVNLTASFISSYQVTHQDVLLPITSVASASFVGEVLPLLAAGGTLVLAQKAQSLDSDALIALLASQRVTILSTTPSLSASLSVLAQSMGSLRLFLCGGEALEYEQIAPLLPHMAVVNGYGLTESGICSTYFPVAKRREQETGALPIGRPIQNTQAYVVDAYNRLVPPGACGELCFSGLGISPGYLDARQDPERFVELPEYPGVRVLKTGDRARWATDGMLFYLGRQDRQVQIRGYRVELGDIESLLKQHPDIADAWVDVRRNAAATPLLVAFYCSVNGVALDAQQLRVWLSLRLPLHMLPLLYVPLSAMPLGVNGKIDPQCLPLVDLRQLEGPGEYVPPATELEQRLAEIWQQLLGLERVGTTTNFFDLGGHSLLLVQMQQYIGQQCGQHVALVDLLRFTTIKRLAEFLLAPDAAQGTTGDQTQLRAAKQRLAFGHTRWAATTDSHH

SEQ ID NO: 4791 - DNA, 1269 bp, Escherichia coli
atgacgaaggatgtcgcactgatgttccctggctccggttcgcaatatgtaggcatggcacggtggctgtatgagcgttatccgcaggtgcgtactctgtttgatgaagctagccagatcacggaacgggacatggcagcgctgtgcctgtcgggtactttggtacaacttgctgagccgacggcaatggcgctggctatctataccaccagcgtggcccactttgtcgcgtggcagcagtttttggcgcaaaccggtgtccatgtcaacctacgttatatgttgggtcatagtttgggcgaatatgctgcgctgacctgtagtggtgcgctgagcttttcccaagcactggcgctggtggcgatgcgtagccgtttagccagtgagatcgcccgcgaaatggacgcgagtaccactatcatcaagcaagggaatcaggcactggtggcagcggcgtgcgaggtggcggagcgtgaaacccgacagcaggtcggtattgcctgcttcaattcgccgcaacagtttatgttatccggacaaaactcggccattatcgccgccgagcaatacctgctggatcatgatcgccaagtcgaagtagtgccgctgattggtggtgttccttaccacagcccactattgaaaccttgcggacagcaattgcgcaaggcgctggatcgctgcgaatggcgacgtccgtgctgcccagtgatctccaatgtcaacgctcaaccctatcccgatacggtcacgccagtccagtggctagaacaacagctctctcagccagtgcagtggcagcgctctctcacctacctgacaggacacttgtcaccgatcgcgatagagatcggtccgcaaagtgtgctgaaaaacctgctgctggagaatcgctatccagcaccagtttacgcatttgacaatcgtcatgatcgtgcgcaactagcattggtgctgggggataacatggcggtgaagaccgatccggaagccgtgcgccgccaacgcatcacgctgctcactaacgccctgacagccacacgccatcaccgcgccgccgatgtggctgccagtgcgcaattgaaagaattgctcagtcgtttttttgagcgcatccagcagattgagcagcgcggcacatccagcgaagaggacattgcttttttgcatgagcttcttgaacagggatttcaactcaaaggcagtagtcaggcagaaatcgacgcctgccacgcgcggttggcttccgacaacggcggacaggcgtaa

SEQ ID NO: 4792 - protein, 422 aa, Escherichia coli
MTKDVALMFPGSGSQYVGMARWLYERYPQVRTLFDEASQITERDMAALCLSGTLVQLAEPTAMALAIYTTSVAHFVAWQQFLAQTGVHVNLRYMLGHSLGEYAALTCSGALSFSQALALVAMRSRLASEIAREMDASTTIIKQGNQALVAAACEVAERETRQQVGIACFNSPQQFMLSGQNSAIIAAEQYLLDHDRQVEVVPLIGGVPYHSPLLKPCGQQLRKALDRCEWRRPCCPVISNVNAQPYPDTVTPVQWLEQQLSQPVQWQRSLTYLTGHLSPIAIEIGPQSVLKNLLLENRYPAPVYAFDNRHDRAQLALVLGDNMAVKTDPEAVRRQRITLLTNALTATRHHRAADVAASAQLKELLSRFFERIQQIEQRGTSSEEDIAFLHELLEQGFQLKGSSQAEIDACHARLASDNGGQA

SEQ ID NO: 4793 - DNA, 1131 bp, Escherichia coli
atgtgcactgaaaattatgagctggctcagcaagaggcagtcctgtttgccaaacaacatctcgccctggctgcacagaatattgaacgtcagcagtttattgtgccagacattatttcttgcgtggcgcaggccgggtacttaggtgcgtcaatcccccaaaaatatggcggacgaggttacgattcttatcaactgtgcgctttgcatgaagtgatggctggggttcacggttcgttagaaaatctcataacagtgactggcatggtcagcacgctgctgcaacgcgtgggcagcgcagcgcaaaaagcccattatttgccaaagctggcaacgggggaattgatcggcgcgattgccctcacagagccgaatatcggcagtgacttagtgaacgtggaaacagaattacagcaggatggcgacggttggcggctgaacgggaaaaagaaatggatcacgctagggcagattgctgatttttttattgttttaatccactgtggtaatcaattagcgacagtgcttatcgatcgcaataccgacggctttactatcactccactcaacgacatgttggggttacgcggcaatatgttggcagagctgcattttaatgactgccgcctgaaggaggatgcattgctcggtccgctcacccctggggtaccgctggcggtgaattttgcgctcaatgaagggcggttcaccaccgcttgtggcagcctaggattatgtcgggccgctgtggatgtggcagcgcgctacatccgccagcgtaaacagttcaagcggcggttattttctcatggcattgttcagcacttgtttgccacaatgctgacccaaacgcgcagtgcgcaactaatgtgcttcagcgcggcggaataccgcgaaacgctgcacccggccatgataaaccaaatcctgatggcgaagtatgtcgcttccaaagctgcggtggacgtggccgggaaggcggtgcaactgctcggtgcgaatggttgccatgccgattatgccgtcgaacgttactaccgcgacgccaaaatcatggaaatcatcgaagggacatcgcaaattcatgaaatccaaattgcgatgaattacatgatggggagtgaagcatga

SEQ ID NO: 4794 - protein, 376 aa, Escherichia coli
MCTENYELAQQEAVLFAKQHLALAAQNIERQQFIVPDIISCVAQAGYLGASIPQKYGGRGYDSYQLCALHEVMAGVHGSLENLITVTGMVSTLLQRVGSAAQKAHYLPKLATGELIGAIALTEPNIGSDLVNVETELQQDGDGWRLNGKKKWITLGQIADFFIVLIHCGNQLATVLIDRNTDGFTITPLNDMLGLRGNMLAELHFNDCRLKEDALLGPLTPGVPLAVNFALNEGRFTTACGSLGLCRAAVDVAARYIRQRKQFKRRLFSHGIVQHLFATMLTQTRSAQLMCFSAAEYRETLHPAMINQILMAKYVASKAAVDVAGKAVQLLGANGCHADYAVERYYRDAKIMEIIEGTSQIHEIQIAMNYMMGSEA

SEQ ID NO: 4795 - DNA, 249 bp, Escherichia coli
atgaaaaagcaagatatgaaagccgccattcgggaatttctttcacgctcattacgtgggcatacgttgaacgatgatgacgatattttttctctcgggcttgtccattcgttatttactgtgcaaatcatactgtttatagaaaaaaattttcaggttgagctggaagtgagtgagttgaaaacagaacagattgctaccgtcaataaaatagtggagctcattcagcgacaaacaggcctggagtaa

SEQ ID NO: 4796 - protein, 82 aa, Escherichia coli
MKKQDMKAAIREFLSRSLRGHTLNDDDDIFSLGLVHSLFTVQIILFIEKNFQVELEVSELKTEQIATVNKIVELIQRQTGLE

SEQ ID NO: 4797 - DNA, 867 bp, Escherichia coli
atgaacgtggcggtaataggtgcaggagtaatgggaactggcgtcgctcataacatggcgcaatacggcatatcaactaacgttgtggatatttctcaatctcagttggataaatgccgacagatgatcgaagcgaacttacgcttatataattttcacccgcagcataaaaaaaagacgcatagcacagcggagataatggaaaatatccgtttcacaactgagttggacgacattgtagaatgtgatttggtgattgagaatattactgaggatatagagaaaaaaaatgcactatacacacggatgaatacgatctgcggcgcgtcgacagtgtttggtgttaatacgtccgccatatctatcactgcgttgtcaaaattaatgcgacatccggagaatgtagtcggcgtccattttatgaacccggtaccgctgatgcacaccgtcgaattaatccgtggtgtacatactgcagagcgtacactgaacatatttcaccacttatttgctcagttgaataaaaccggcatcgtggtcaatgattctccgggctttgtcactaatcgtgccatgatgatttttgttaacgaagccatatttatggtgcaggagcagatcgcccgtgctgaggatatcgatacgttgtttaaaacctgcttcgggcacaagatggggccactacaaactgccgatttgattggcttggatacgattttgcaatcgttgcaggtgctatatgaaagttttaatgatgataagtatcgccccagctttttattaaagaaaatggtcgatgcagggtatttgggcgtgaaatcagggcaggggttttatcgctatcaacagacgtacgccgagcagtga

SEQ ID NO: 4798 - protein, 288 aa, Escherichia coli
MNVAVIGAGVMGTGVAHNMAQYGISTNVVDISQSQLDKCRQMIEANLRLYNFHPQHKKKTHSTAEIMENIRFTTELDDIVECDLVIENITEDIEKKNALYTRMNTICGASTVFGVNTSAISITALSKLMRHPENVVGVHFMNPVPLMHTVELIRGVHTAERTLNIFHHLFAQLNKTGIVVNDSPGFVTNRAMMIFVNEAIFMVQEQIARAEDIDTLFKTCFGHKMGPLQTADLIGLDTILQSLQVLYESFNDDKYRPSFLLKKMVDAGYLGVKSGQGFYRYQQTYAEQ

SEQ ID NO: 4799 - DNA, 2610 bp, Escherichia coli
atgaagtttatggaatacgcaagcgaaatgaacggcatggaaatcgccattattggtatggcggtccgtttcccgcagtcccggacgttacacgaattctggcataacatcgttcagggtaaagagtgcgtcaccttctttagcgaggaggagttgctggccgaaggcgtcgaacagagtactctggacaacccggcctatgtacgggccaagccctatatcgagggcatatgcgactttgatgctgcatttttcggttacagtcacaaagaggcgcagactctggatccgaaatcccgcgtattacatgaagttgcctaccatgcgctggaagatgcaggctatgcccaacgtaccagcgatctgatcaccggggtattcgtgggggcgtcagaagatgtggattggctacggcgttcgctgtcacagattggcggcgatgcgctgaatcgttttgagtctggcatctatggtcataaggatctgctcgcacatctcattgcctacagtctcaatctcaacggtccggtgtatagtctctacaccagttgttcgacttctctgagtgcaacgcatatcgcttgccgcagcttgttgtttggcgaatgtgatctggcgttggcgggtggaattactatcgatttaccgcagaagtcaggctacttctgtcaacagggcatgatccactccaccgatggccactgccgtccttttgacagtcaggcttctggcaccctgtttggcgatggcgcgggtgtggttgtgcttcggcgtttggaagatgctctggcagcgggcgatcgcatctatgcggtgatccggggtagcgcggtcaacaatgacggtaaacaaaaaatcggttttgtcgcgcctggtcatgagggacagaaggcggtcatttgtgcggcctgtcatctggcagaagtaagcccagaaagcatcggctacgttgaaacccacggtaccggcacccgtattggcgatcctatcgagttcgctgcgttgacggaggcgttcgatacttcacaccgccaatactgtgcactaggggctgtaaaggcgaatattggccacacccacgcggcggcgggcgtggctgggttaatcaagacggcgctggtacttcatcaccggaccattccgccgctcgccaactatcaaatgcctaactcgaagctggatctggcgcattcaccgttttatatcccgatacagccgcaggagtggcccgcatcgcggatgccgccccgcgctggcgtcagttcttttggcattggcggtactaatgtgcatatgattttggaagggctgaatcctgcggtgcgcgatgaccatgaccaagtgcgagcaccggtgtttatccctctctccgcgccgtctttcgagcagttggatgagctgacgcaacagcttaccccgttgctggctacccttgatgcgtcaacgctagcctacacacaacaagtggcgcgccccgtgtttgattgccgccgagtgatacaagtggaaaacgatggtacgcaagcgatgctggcatcgctggataacctaatgcccgacgctccttggggcctacactgtccagatctacgtactacgaacgattgtacttacgcacagtggctggcgcattcggcacattatcaacgcgaagcgactgctctgacggcattactcgacggcatgaatattccacccgcttattgccacgctgaaacgtgggcggcacaagcgaacagcagcctgctaatcagaggctgccagactatcgccgcgctaaaaacctggatgaacctgctaccgacattaacactgctgtcgggtgctggaacaggccttttgcctgccgctgcagccagtggcatgattgcgacgcaagacgtgttgcatttgctgtgggaaatggagcaaaaggcgcttcatctctggcttcctgagcgccatgaacctatccccggctacgtgctggcttggcaaggaaatcccatcaccgatgcacagcgtaacgacagagggttttggagtgaagcgctgttggcagatacccgagaactgggggagggcgttcacagtatcaactgggttaggctgccgccggaaataagagaagacgttgatgtattgcgctacgtggcgcaactgtggtgtgcaggtatcaatgtggattgggccgtgtggtacggcactccgctgccgcaacgcgggagcgcatcagcatatcccttcgcacacaaccactacccattgcctggacgggtaatgggtagtgtggagacccaacccgaagcaggacccgaaacgcaccacccttatcaggcacgtcccgtgttaagcgtacctttcgtagccgcacactcgcggggtatgcagtatatcacaggtctgatggaactgttgctggaaatatcgccggtcggggtggacgacgacttttttgaattaggcgggcattcgctgctggtgacgcaattgacctcccgtttagaacgcgatttcaacgtacatatcgatcttttgaccctgatggaaaaccccaatccgcgcaatatctacgcgcatatcgcggcgcaactggggggcgaagacaacctcgaaatagcctgtcagtaa

SEQ ID NO: 4800 - protein, 869 aa, Escherichia coli
MKFMEYASEMNGMEIAIIGMAVRFPQSRTLHEFWHNIVQGKECVTFFSEEELLAEGVEQSTLDNPAYVRAKPYIEGICDFDAAFFGYSHKEAQTLDPKSRVLHEVAYHALEDAGYAQRTSDLITGVFVGASEDVDWLRRSLSQIGGDALNRFESGIYGHKDLLAHLIAYSLNLNGPVYSLYTSCSTSLSATHIACRSLLFGECDLALAGGITIDLPQKSGYFCQQGMIHSTDGHCRPFDSQASGTLFGDGAGVVVLRRLEDALAAGDRIYAVIRGSAVNNDGKQKIGFVAPGHEGQKAVICAACHLAEVSPESIGYVETHGTGTRIGDPIEFAALTEAFDTSHRQYCALGAVKANIGHTHAAAGVAGLIKTALVLHHRTIPPLANYQMPNSKLDLAHSPFYIPIQPQEWPASRMPPRAGVSSFGIGGTNVHMILEGLNPAVRDDHDQVRAPVFIPLSAPSFEQLDELTQQLTPLLATLDASTLAYTQQVARPVFDCRRVIQVENDGTQAMLASLDNLMPDAPWGLHCPDLRTTNDCTYAQWLAHSAHYQREATALTALLDGMNIPPAYCHAETWAAQANSSLLIRGCQTIAALKTWMNLLPTLTLLSGAGTGLLPAAAASGMIATQDVLHLLWEMEQKALHLWLPERHEPIPGYVLAWQGNPITDAQRNDRGFWSEALLADTRELGEGVHSINWVRLPPEIREDVDVLRYVAQLWCAGINVDWAVWYGTPLPQRGSASAYPFAHNHYPLPGRVMGSVETQPEAGPETHHPYQARPVLSVPFVAAHSRGMQYITGLMELLLEISPVGVDDDFFELGGHSLLVTQLTSRLERDFNVHIDLLTLMENPNPRNIYAHIAAQLGGEDNLEIACQ

SEQ ID NO: 4801 - DNA, 9621 bp, Escherichia coli
atggataatacctctggagattttccatgtaataagatggacacgcgtaagcagttaccgctaacaccaagtcaacaggggtttttattccattccttaaaggataagaaaaggagtaactaccatgagcattttacatgcattttttctcagcatgtagatagcgcccacttcaagtgggcgctggaaacgttatttcgaaagcatgagtgttttcgcactgattataactgggagattgatgagcgcccttgtcaggtggtgaagaccgatgtgttgccggatatatatgtgttagactgtgagcaagaggaaatacgttttctactagctaatgatgacattatcattcctgtcccgcaggatgacggtattgatgctataattcctcaactgctacaggctgatttaaaatacccattttccttgaaaacgatcccagtccgggcctaccttattcagtcaacgaaagaaagtgcttttatactatcataccatcatattgtgatggatggctggagcttatcccttttcattaaacagttgctccaactctatggagcggctgtggtcagtggtgtgagggatgatagcgccattatcccctcatctctgaaaccccttgtagacacactgtcggcccgacgtcacacctttcagcacgactattgggctgcatatcttcgggagggaacaccaacttgtatcgtgccgctgtcacaatatcacacagatactgaagccgagaacaattcttacgttaatcaaacaaatcatgtggagatcaatttgtctccggatgtgtgtcagaaaatacagacgctatgcagcgattatcgtatcacccccgcagtaatcttctatgtggcctggggcatcctgctacaacgttggtgctatgctgacgatgtgttattcggcgcgacaatatcagggcgaaatataccaattgatggtatagaagaaacactagggctatttattaacacgttgccgctgcgtctgcgtgatgatggggcgacactgttgcaacacttacaacgtatgcaccaaacactaatagctcactacagcaatgaacatgatgccttagccagcatacaacggttggtacataaagaaggtcatgctggggatctttttaataccttagtggtgttggagaattatcccgttgatatgacattattgtcatgcgcgtcgcccgtggcaattcgccatctcagtgtacatgaacaaacgcactatccgctgaccttgaccatcactcaacagaagggattccgtttcagtattgcatatgcccttaactacctgaccaacaacatggcgcaagcgttgctgatgcacctgagttatctgcttgaacaactggtggacaatccgcagcgccccattgctgcgttggtaaacttgtccccatgccagcaggcgcaggtacttcaaccctatctggaacgcatggcatgccgggattgggatagtcaatccaacgtcatcgaacaatttcatcaagttgctgcgacttcgccagcacaggtcgcagtggttgatgaattgtgcgcgttgacctattcggagttggcagcacaagctgagcagctcgcggcttatttggtacagcagggtgttatggttggcgatactgtaggcataattagcgaacgccgggtaaacaccgtggttgccatcatcgccatcatgttgatcggggctgcttatgtgcccatcagccccgactacccagtgggtaggatgcaggaaattattgatgacagcggcttggcgctgttgctggtacatggcaaaccgctagatgcattaaacgttgcgcagagtgacctctgtgcatttcccgtcgcgccctcggtggtatttccggttatcacaccagattctcgcgcttatgtgatttattcatcggggtcgacgggtaagccaaaaggtatcgcggtggcgcaccgcggtttattgcgcctgatacaaggcgacagcccgctgaaggtggagagcggtgagacaacgctgctgacctgcccatttgagtttgatgtttcggtgtttgagatgtggtctaccttgctcaaccacggcaaactagtattactcagcaaacaggcattacttgatatcaatcacattcgccgcacgatcgctgatgaacaggtggcgcgcgcctggtttacctcatccttgtttaactcctatgtggcagaaggtgccgatttcttcggtatgttacaacacattacggtgggcggcgaagcagtatctgcgtggcatgtcaacgacgtgatgcaaaaatacccgcatctggtggtgacaaacggttatgggccgacggaaaacactatttttaccaccgcatatcgtttcaacgggttgcaacccgcccgagtcccgataggatacgcggtaccgggcacctcgctctacattaccgatctccatgggcatttgttgcctatcggtgccaccggtgaactagtggcgggtggagtgggggtcgccatcggctatcagaacaacccggcgctaagtgcgacggtttttgtccctgatccttttattcccggcggtatgatgtacaaaactggcgattatgcccggttgctggatgatggctgtgttgactgttttgggcgtaaagacggtcaaattaagatcaatggacaacgaattgaaaccggagagatcgagcagcgcctgctggagtgctccggcattatcgaggcggtagtggttccttaccgcgtacgtgaaacgctgcatattgcggcagtggtctgcgtcaatgatagctatgatgaggtggaagttcgagggcaattggctgacagattgccgccattcgctattccggaatccttggtggtggtgacggagattgcaaaaagccatagtggcaaggccgacttggcgcagttgcggtatctcctgcccgcaactcagtgcaacgccgtgtccaccacgatatcagaggtgcatagtgacatggaacatgcgctgcatgctatctggcaacgcgtacttgatagacaagacattgatagcaatgcctcctttttcgccctcggtggcacctcattggataccatcagggttaaaggggatattaagcggcaacttggcttggagattgatattaccgatctctttaagtacccaacgctcacggcgttagcacattttctcgatactgccgtatcgccggaggatgcaattccaacgcgtgctgttgtctacagcgacatgccggtggcgattgtcggtatggcgggacgtttccccggtgcggcgaatattgcagcgttgtggacgctggttgtaggaggggaatcgggattaacactgttcagtgatgaagagttgcgcgcgcatggtgtgacacctgacacgcttaaacaagcgaattatataaaaaccaaagggattgttgatgatcacgaatggtttgatgcggatttctttggttatactcccaacgaggcggaatgtatggatccgcaaattcgcttattgcatcagtgctgctggcaaactctggaacacgctgggtgcgatcctgccacctttactggtgcgattggcatttatgccggactgctgacatccccccactggcttaatgcggtaatgcaagacactaccgactctaccgccctgtacaaggccagtatcctgaatatccattccgtcacagcattgattgcccatgcgcttaacctcaccggccctgccgtgacgcttgacaccgcctgctccacttcggcagtggctatccaccaggcctgcatcgcactacgtaaccgggattgcgatgcggcattggcgggcggcgtttctatcgagatgcctgcgtaccggggctatgaatatcatgaaggcatgatcaatgcgcgagatggtgtctgtcgtcctttcgatagccaagcctctggcacagtcaccggtgatggcttaggaatgctgctgctaaaacgtctggacgacgcgctggcggatcgggactgcatctatggtgtgatcaaaggttcggcggtcaataatgatggcaataacaaaatcggctataccgcgccgagtgtgatcgggcaatcaacggtaatccgcaccagtttgcgccgtgccggttttgatagcgacagtatcggattggtggaagcgcacggcaccggtacggtgctgggtgatcctattgagttacgtgcgcttaatgaggtgtttggcccaacacctgttccgttttgtgtggtttcagcgctgaaaagtaatattggccacctcaactccgctgcgggagtggcgggcgtcatcaaaacaacgctcgccctgcatcatcaagtgttgccaccaacagcgcactttcgccaactcaatcctgctatagatctatcgcgttctgcattgtacgttaaccagcaagtccaaccgtggccgtcgacgcgtcctcgtcgtgcactggtgagctccttcggcatcggcggcaccaatgccagcatcgcactagaagcacatcaacatgaggacgacccttcagcgacgggggtacgcgacagctatctgttgttgttctccgctaaaacacccgctgcgttagagttgcgcgtggcctccacactggaatatgtcaagcatggagtaggggtgcgcctgccggatgtggcttatacattgcaaactggacgcacagcctttgaccatcggcgggcttatttggtgagtcgtgggtcgaaaatcgatctctcctgtgccacgatattgcaagcggaaatcttcaatggtcagcgcacgacagcggagatctgcttcatgtttcctggtcaaggtagccaatatcacggcatggccagcgcgctctatgctcatcaacccatgtttcgccagcacatggatcgctgctttgctgcattccaacgctattcgacggtcgatctcaaggcgttgttgtttgacgatgaggatacgcgggatattgatcaaacgcagttcacacaaccggcgttgttctgtgtcgaatacagcctagcgcgcaccttgattgatctggggattacgccggacagtatgatcgggcacagtctgggcgagtatgttgcggcctgtattgctggcgtatttactcttgaggatgcgctgcacgtcattgaggcgcgcggacgtttgatgcagtccatgcgtcccggtagcatgatggcggtctaccttagtcgcgaacagttgaccccatggctagctgcagaacggggtattgaactggcagctaataatagcgcgcatttttgcgtagtcgcgggcgagcaggcggccatttcccgtttgagcacacgcttagtcgagggcgggatacagcacaggcgcctgaaaacctctcacgcattccactcggccatgatgacgccgatgctgcacgattttgcacagttgctggggcaaatcccgatgcacgcgccgcacaagcgctttatatctaatgtaagcggtacatggattactgaggagcaagctacctcgccggattactgggtgcagcaagtgcgcaacgcggtgctgtttagcgaaggtgcggcgcaactgttggtacaacccacgctgtttatcgaatgtgggccgggtaatacgctctctacctttattcaaggacataaccaatacagcgatcagccgaccctgttgacgctacgcaaagccaacgcggcgatcgatgatgagcacatgttgcatcgtacgctggcggcgctgtgggtcaggggggagaatattgattggagacgctttaaccagacggcactcggcaagcacattccattgccggattaccccttcgaacagacttattactatcgctatggtgctgcactttccggttatcgccagtatccaaatcctctgcgccgtccgcaagatgagtggctccagcgtgtgctgtggcggatgcacgacacatccttgcgggaggcgttctatgcgccgggcgaattgatcatcattattagtgctgacggcgacaagttacagcagacgctgatgagtagtggtgtcgacagcatcacaatgccgctgccgatatcgtcagaggacgacgtgtgggataatgaccgtattctgacgcatttccacgacatctgcgcacttttagcacacaaaacctaccgacagttacattgcttgtatgctcccggtgcggaggcaggatcatcgttgacacagtcgctctcgggactttatcgtgttgctcgctggtgtatgcacagcaccacgccgctggcgtccttaacagtattgacccatggtgcgtttcgcgtacaggaagaggataatcccgaaccgacgctggcagcgttgtcgggcgcagtaaacgtgtttgcccaagagctgcacccgaccgaagtacgattgatcgatatcgatgcgcagagcagtgatgagaatctgaacttgctaacccagcgtctggccccgaaacaagaaacggtaatggcgctcaggcaggggatgctttacctgcgacgctttatcccgacacggctgttggcgcacttaccccctcaaacagggtgtataccgggcaacgtactgtggattatcggcggtgaaaaggggattggccgcatgatcggcgaagcgcttgctcagcgtgagggagtccgtgtggtactgagcagccgcacaggttatcaccatgaagcggtgcagcaggacgcattagacgttatccactgcgacgtgacgcaggcggaggcggttagagcttgtctggcaactctgctcgaacgctatggacggttggatggcgtgatttttgctgccgacgctaccaccacattgacactgcatcaattgagcgaatctgcgctacgcgacacgctaacggtgaaagaacggggtactgctaatgtgctgcatgcgttagcgcaacggaatctgctggatgagcgtctgctactgctgttctgtaactcgttggctgccgtgaatgcggagattggccagacaggctatgctaccgccagcgcctatttggatgcactggcacagcaactgcgtacccgctacaaggtgaatgcgctcagtatcgggttggatgcattgcgtgagcagggcatgttgttggatgctataaacggcagtgaatacgatgtcttgcgtggactgcgcccattgatgacgggaacgttgctacaggcttataaacaacaaggggctgacaccagctactacgcgcgattatcccccgagtccgattggctgctggatgagcaccggatatccggtatcgccacgctgccgggaaccggctatctggcgctggcgtatgaagctctgcgccattactttgtgcaagaccaaatctgcattgatgaattggtctttttggcaccgttgactgtgatggacaactgcagtgttgacgtttttgttgacatttcacctaacgggcaaggagttagtgtcgaggtgaaatcaatgacggagcgctttagtggcacgttaacaacccatgccagaggcagggcgacgcgtctgatggtagacgataatgttgtgtgcgatctcacggggctgatgcgcgagatgcacactatcactcctccaacaaaggaattatcgagcacgcacttccactatgggccgcgctggcacagcgtacaacaactgtatggcaataccgcccagactcaggttttcgcaacgctggccctgcccaccgttgccgctaatgatacgatcgcactgcaccctgcgctgttggacatcgccagcagtgttgtcgaacaactgcctggttttcatactgattcggtacctttcctttatcaggatttacgcctgtaccgcccgttgccgaacaccttacatgtggcgctgactgtcaatcggcacgatgaggagggtgacagctacgctttcacgctctacgacatggcaggcgagatggttgcccgctgtgcggcaatggtgaagcgcaaggtacagctccacatacaagatgtcgatgacgacacgcgactgcgcgtgcccagtgccgataactaccaactgcggctggccgctgagggggagggggcaggaaagctagcgttgtgccctacgccgcgcttagcgctgggggattcacaagtagagattgaggtactggccaccggactgaactttaaggatgtgctgttcaccacgggattgctccggcagcagccgggtgaggctccgctgcaattgggactggagtgcgccggacgcattactcgcgtgggtaaaaatgtcactgaatttgccccgggagaggatgttatggcggtgctaaacggtggttttgtccagtacgcacgggtagaaagcgattgcgtagtgagaaaaccagcccattgtcgcatcgaacaggcggctgcgctgcctatcgcatacctcaccgcctattacgcactggtggtgcgcgctaatttgcaacccggagaacgagtattgatccacagtgcggcggggggcgttggcttggctgcgctacatattgccaaacgctgcggagcacagattttcgccacagcaggtagcgagcagaaacgcgattacttgctttcgctaggcgtacatgccgtagctgattcacacgacgaacagttcgctgccactctgctgaccgcatcggacggacaggggatggatgtgatccttaactccctcacaggccgtctgcttgacgctagcctcgcgctgctggcaccgctgggccgttttcttgagctgggcagcaaggacattgtggaagacaaagcgctaccgatgcgtttcttcgcccaaggcggcacctttattccgattaattttcacgcggcgcatggtgcgtttagtcgctacctgcaacagattgtcgcttggatagatgataacacgctaccgctccttccatgcaaatccgtaccattgcccgaggttgcacgcgccttcgccaccctgaccacgccgcagcatattggcaaggtggtggtaacgcatcgcactgcggcaggcatggaccggctgaacgccatgatagcagaaaggcgcctcggcggctatgcgctcagcatgagcaatgccgaggtgatgcgccaattgtggccgatactgaacactcgcagtccgtgggcgcaactgctgctctcacctcgggcgatcgatagattagcgcggggcaaccgggtggatcgcggtgtaccgtctgccgctaacgatacgattactcagcagacagtgaaaaagcggccccgtccggaaattggcgtgccttacagccccgcgacacgtgaagtggaacgcgtgctctgccaaatcctggaagagtatctgggtctggatagagtaggcattgacgacaactatgccgaattaggggcaacctcactcgatatggtgcaactgagtgggcaaatggcgcgtcactatccgcaagtgagcgtggtgtcgctgtacaaccacgccaccgtgcgccagctggcgacgttttgccagcccccggagggcgagtcaaatgcgccatcaccacagcctgcagtacagacgaatacgcgcgcgaatcagatagcaaaacgtgctttgcaaattgcgaaaaatactgcgcgcagtcacacgtctttgcattaa

SEQ ID NO: 4802 - protein, 3206 aa, Escherichia coli
MDNTSGDFPCNKMDTRKQLPLTPSQQGFLFHSLKDKKRSNYHEHFTCIFSQHVDSAHFKWALETLFRKHECFRTDYNWEIDERPCQVVKTDVLPDIYVLDCEQEEIRFLLANDDIIIPVPQDDGIDAIIPQLLQADLKYPFSLKTIPVRAYLIQSTKESAFILSYHHIVMDGWSLSLFIKQLLQLYGAAVVSGVRDDSAIIPSSLKPLVDTLSARRHTFQHDYWAAYLREGTPTCIVPLSQYHTDTEAENNSYVNQTNHVEINLSPDVCQKIQTLCSDYRITPAVIFYVAWGILLQRWCYADDVLFGATISGRNIPIDGIEETLGLFINTLPLRLRDDGATLLQHLQRMHQTLIAHYSNEHDALASIQRLVHKEGHAGDLFNTLVVLENYPVDMTLLSCASPVAIRHLSVHEQTHYPLTLTITQQKGFRFSIAYALNYLTNNMAQALLMHLSYLLEQLVDNPQRPIAALVNLSPCQQAQVLQPYLERMACRDWDSQSNVIEQFHQVAATSPAQVAVVDELCALTYSELAAQAEQLAAYLVQQGVMVGDTVGIISERRVNTVVAIIAIMLIGAAYVPISPDYPVGRMQEIIDDSGLALLLVHGKPLDALNVAQSDLCAFPVAPSVVFPVITPDSRAYVIYSSGSTGKPKGIAVAHRGLLRLIQGDSPLKVESGETTLLTCPFEFDVSVFEMWSTLLNHGKLVLLSKQALLDINHIRRTIADEQVARAWFTSSLFNSYVAEGADFFGMLQHITVGGEAVSAWHVNDVMQKYPHLVVTNGYGPTENTIFTTAYRFNGLQPARVPIGYAVPGTSLYITDLHGHLLPIGATGELVAGGVGVAIGYQNNPALSATVFVPDPFIPGGMMYKTGDYARLLDDGCVDCFGRKDGQIKINGQRIETGEIEQRLLECSGIIEAVVVPYRVRETLHIAAVVCVNDSYDEVEVRGQLADRLPPFAIPESLVVVTEIAKSHSGKADLAQLRYLLPATQCNAVSTTISEVHSDMEHALHAIWQRVLDRQDIDSNASFFALGGTSLDTIRVKGDIKRQLGLEIDITDLFKYPTLTALAHFLDTAVSPEDAIPTRAVVYSDMPVAIVGMAGRFPGAANIAALWTLVVGGESGLTLFSDEELRAHGVTPDTLKQANYIKTKGIVDDHEWFDADFFGYTPNEAECMDPQIRLLHQCCWQTLEHAGCDPATFTGAIGIYAGLLTSPHWLNAVMQDTTDSTALYKASILNIHSVTALIAHALNLTGPAVTLDTACSTSAVAIHQACIALRNRDCDAALAGGVSIEMPAYRGYEYHEGMINARDGVCRPFDSQASGTVTGDGLGMLLLKRLDDALADRDCIYGVIKGSAVNNDGNNKIGYTAPSVIGQSTVIRTSLRRAGFDSDSIGLVEAHGTGTVLGDPIELRALNEVFGPTPVPFCVVSALKSNIGHLNSAAGVAGVIKTTLALHHQVLPPTAHFRQLNPAIDLSRSALYVNQQVQPWPSTRPRRALVSSFGIGGTNASIALEAHQHEDDPSATGVRDSYLLLFSAKTPAALELRVASTLEYVKHGVGVRLPDVAYTLQTGRTAFDHRRAYLVSRGSKIDLSCATILQAEIFNGQRTTAEICFMFPGQGSQYHGMASALYAHQPMFRQHMDRCFAAFQRYSTVDLKALLFDDEDTRDIDQTQFTQPALFCVEYSLARTLIDLGITPDSMIGHSLGEYVAACIAGVFTLEDALHVIEARGRLMQSMRPGSMMAVYLSREQLTPWLAAERGIELAANNSAHFCVVAGEQAAISRLSTRLVEGGIQHRRLKTSHAFHSAMMTPMLHDFAQLLGQIPMHAPHKRFISNVSGTWITEEQATSPDYWVQQVRNAVLFSEGAAQLLVQPTLFIECGPGNTLSTFIQGHNQYSDQPTLLTLRKANAAIDDEHMLHRTLAALWVRGENIDWRRFNQTALGKHIPLPDYPFEQTYYYRYGAALSGYRQYPNPLRRPQDEWLQRVLWRMHDTSLREAFYAPGELIIIISADGDKLQQTLMSSGVDSITMPLPISSEDDVWDNDRILTHFHDICALLAHKTYRQLHCLYAPGAEAGSSLTQSLSGLYRVARWCMHSTTPLASLTVLTHGAFRVQEEDNPEPTLAALSGAVNVFAQELHPTEVRLIDIDAQSSDENLNLLTQRLAPKQETVMALRQGMLYLRRFIPTRLLAHLPPQTGCIPGNVLWIIGGEKGIGRMIGEALAQREGVRVVLSSRTGYHHEAVQQDALDVIHCDVTQAEAVRACLATLLERYGRLDGVIFAADATTTLTLHQLSESALRDTLTVKERGTANVLHALAQRNLLDERLLLLFCNSLAAVNAEIGQTGYATASAYLDALAQQLRTRYKVNALSIGLDALREQGMLLDAINGSEYDVLRGLRPLMTGTLLQAYKQQGADTSYYARLSPESDWLLDEHRISGIATLPGTGYLALAYEALRHYFVQDQICIDELVFLAPLTVMDNCSVDVFVDISPNGQGVSVEVKSMTERFSGTLTTHARGRATRLMVDDNVVCDLTGLMREMHTITPPTKELSSTHFHYGPRWHSVQQLYGNTAQTQVFATLALPTVAANDTIALHPALLDIASSVVEQLPGFHTDSVPFLYQDLRLYRPLPNTLHVALTVNRHDEEGDSYAFTLYDMAGEMVARCAAMVKRKVQLHIQDVDDDTRLRVPSADNYQLRLAAEGEGAGKLALCPTPRLALGDSQVEIEVLATGLNFKDVLFTTGLLRQQPGEAPLQLGLECAGRITRVGKNVTEFAPGEDVMAVLNGGFVQYARVESDCVVRKPAHCRIEQAAALPIAYLTAYYALVVRANLQPGERVLIHSAAGGVGLAALHIAKRCGAQIFATAGSEQKRDYLLSLGVHAVADSHDEQFAATLLTASDGQGMDVILNSLTGRLLDASLALLAPLGRFLELGSKDIVEDKALPMRFFAQGGTFIPINFHAAHGAFSRYLQQIVAWIDDNTLPLLPCKSVPLPEVARAFATLTTPQHIGKVVVTHRTAAGMDRLNAMIAERRLGGYALSMSNAEVMRQLWPILNTRSPWAQLLLSPRAIDRLARGNRVDRGVPSAANDTITQQTVKKRPRPEIGVPYSPATREVERVLCQILEEYLGLDRVGIDDNYAELGATSLDMVQLSGQMARHYPQVSVVSLYNHATVRQLATFCQPPEGESNAPSPQPAVQTNTRANQIAKRALQIAKNTARSHTSLH

SEQ ID NO: 4803 - DNA, 195 bp, Escherichia coli
aaaaacccgttatctctgcgtgaaagacaagtattgcgcatgctggcacaaggtgatgagtactctcaaatatcacataatcttaacatatcaataaacacagtaaagtttcatgtgaaaaacatcaaacataaaatacaagctcggaatacgaatcacgctatacacattgctaacaggaatgagattatctaa

SEQ ID NO: 4804 - protein, 64 aa, Escherichia coli
KNPLSLRERQVLRMLAQGDEYSQISHNLNISINTVKFHVKNIKHKIQARNTNHAIHIANRNEII

SEQ ID NO: 4805 - DNA, 408 bp, Escherichia coli
cttggtgtcgatattgaacaaataagagatttagacaactcttatctgaatatcagtcagcatttttttactccacaggaagctactaacatagtttcacttcctcgttatgaaggtcaattacttttttggaaaatgtggacgctcaaagaagcttacatcaaatatcgaggtaaaggcctatctttaggactggattgtattgaatttcatttaacaaataaaaaactaacttcaaaatatagaggttcacctgtttatttctctcaatggaaaatatgtaactcatttctcgcattagcctctccactcatcacccctaaaataactattgagctatttcctatgcagtcccaactttatcaccacgactatcagctaattcattcgtcaaatgggcagaattga

SEQ ID NO: 4806 - protein, 135 aa, Escherichia coli
LGVDIEQIRDLDNSYLNISQHFFTPQEATNIVSLPRYEGQLLFWKMWTLKEAYIKYRGKGLSLGLDCIEFHLTNKKLTSKYRGSPVYFSQWKICNSFLALASPLITPKITIELFPMQSQLYHHDYQLIHSSNGQN

SEQ ID NO: 4807 - DNA, 267 bp, Escherichia coli
atgcgtaaagcccgttttactgagcatcagatcatcgccgtgattaagtcggttgaagccggacgaactgttaaagatgtctgtcgcgaggccggaatctctgaagccacctattacaactggaagtccaaatacggcggcatggaggcttctgatattaagaaaatcaaggatcttgaggacgagaaccgccgtctaaaacaaatgtttgccgacctgagtctggagaaccgggcgctgaaagacgttatcgaaaaaaagctttaa

SEQ ID NO: 4808 - protein, 88 aa, Escherichia coli
MRKARFTEHQIIAVIKSVEAGRTVKDVCREAGISEATYYNWKSKYGGMEASDIKKIKDLEDENRRLKQMFADLSLENRALKDVIEKKL

SEQ ID NO: 4809 - DNA, 480 bp, Escherichia coli
atgcatgatgccctggtctgtggccgtcgttttcgcatgttcaatgtcgttgatgattttaaccgtgaggcattgtcgattgaaatcgatctgaatctgccagctcagcgagtggtccgtgtactcgacaggatcgcggcaaaccgtggctatccggccatgcttcgtctggataacggcccggaatttatctccctggcactggctgaatgggcagagaaacatgcaataaaactggagtttatccagccgggtaagccgacgcagaacgctttcattgagcgctttaaccggacataccgaacagaaatactcgatttttatctgttcagaacgctgaatgaagtacgggaaatcactgaaaaatggttatcaaaatataactgtgaacgcccgcatgaatcgctgaataatatgacaccggaggaataccgacagcgccattatttggccgggatctcaaaaagtgtatggaactaa

SEQ ID NO: 4810 - protein, 159 aa, Escherichia coli
MHDALVCGRRFRMFNVVDDFNREALSIEIDLNLPAQRVVRVLDRIAANRGYPAMLRLDNGPEFISLALAEWAEKHAIKLEFIQPGKPTQNAFIERFNRTYRTEILDFYLFRTLNEVREITEKWLSKYNCERPHESLNNMTPEEYRQRHYLAGISKSVWN

SEQ ID NO: 4811 - DNA, 936 bp, Escherichia coli
atgatgcgtcgtgtaaatattctttgctcatttgctctgctttttgccagccaaaatagcctggcggtaacttatccattacctccagagggtagccgtttagtggggcagtcgcttactgtaactgttcctgatcacaatactcagccgctggagacttttgccgcacaatacgggcaagggttaagtaatatgctggaagcgaatccgggcgctgatgtttttttgccgaagcctggctcacaactcaccattccgcagcaactgattttgcccgccactgttcgtaaagggattgtggttaacgtcgctgaaatgcgtctttattactatccgccagacagtaatacagtggaagtctttcctattggtatcggccaggctgggcgagaaaccccgcgtaactgggtgactaccgttgaacgtaaacaagaagcaccaacctggacgccaacgccgaacacccggcgcgaatatgcgaaacgaggggagagtttgcccgcatttgttcctgcggggcccgataaccccatggggctgtacgcgatttatattggcaagttgtatgccatccacggtaccaatgccaattttggtattgggctccgtgtaagtcagggctgtattcgtctgcgtaatgacgatatcaaatatctgtttgataatgttcctgtaggcactcgtgtacaaattattgatcagccagtgaaatacacaacggaaccggatggttcaaagtggctggaagttcatgagccgctgtcgcgcaatcgtgcagaatatgagtctgaccgaaaagtgccattgccggtaaccccatctttgcgggcgtttatcaacgggcaagaagttgatgtaaatcgcgcaaatgctgcgttgcaacatcgatcgggaatgcctgtgcaaattagttctggttcaagacagatgttttaa

SEQ ID NO: 4812 - protein, 311 aa, Escherichia coli
MMRRVNILCSFALLFASQNSLAVTYPLPPEGSRLVGQSLTVTVPDHNTQPLETFAAQYGQGLSNMLEANPGADVFLPKPGSQLTIPQQLILPATVRKGIVVNVAEMRLYYYPPDSNTVEVFPIGIGQAGRETPRNWVTTVERKQEAPTWTPTPNTRREYAKRGESLPAFVPAGPDNPMGLYAIYIGKLYAIHGTNANFGIGLRVSQGCIRLRNDDIKYLFDNVPVGTRVQIIDQPVKYTTEPDGSKWLEVHEPLSRNRAEYESDRKVPLPVTPSLRAFINGQEVDVNRANAALQHRSGMPVQISSGSRQMF

SEQ ID NO: 4813 - DNA, 1080 bp, Escherichia coli
atgcaaatacttgccgatttactgaatacgatcccagccatcaattctgccgctatgtcgcgtgcacaacggcatgttgacgggttactcaaacctgttggtagcctgggaaagctggaggcgcttgccatacaactggcaggaatgccggggttgaatggcataccgcatgtgggcaaaaaagcagtactggttatgtgtgccgatcacggcgtctgggaggaaggggtcgctatttctccaaaagaagtgacagccatacaggctgaaaatatgacccgtggaacaaccggcgtgtgtgtgctggcagcacaagcgggcgctaacgtccacgtaattgatgttggtattgatactgctgagcctatccccgggcttatcaacatgcgtgtcgcacgaggtagcggcaatattgcttcagctccggcaatgagtcgccgtcaggctgaaaagttgcttttggacgtcatatgttatacgcgggagctggcaaaaaacggtgtcacgctgtttggtgtaggtgaactggggatggcaaacacgacaccggcagcggcaatagtcagcacaatcactggccgggatcctgaagaagtggttgggattggcgcaaacctgccgacagataaactggctaataaaattgatgttgtgcgtcgggcgattacgttgaatcaaccaaatcctcaggatggtgttgatgtcctggcaaaagtgggtggatttgatttggtcggaatagctggagtgatgttaggtgctgcttcctgcggtttacccgtgttgctggatggatttctttcttatgctgctgcgctcgcagcctgccagatgtctcctgcaatcaaaccgtatctcattccttctcacttgtcggcagaaaaaggcgcgcgtatagcgctctcgcatttggggctggagccttatctcaatatggatatgcgtttaggtgaggggagtggtgcagctctggcgatgtccatcatcgaagctgcttgtgcgatatacaacaacatgggcgaacttgctgccagtaatattgttctaccggggaatacgacttctgatttgaacagctaa

SEQ ID NO: 4814 - protein, 359 aa, Escherichia coli
MQILADLLNTIPAINSAAMSRAQRHVDGLLKPVGSLGKLEALAIQLAGMPGLNGIPHVGKKAVLVMCADHGVWEEGVAISPKEVTAIQAENMTRGTTGVCVLAAQAGANVHVIDVGIDTAEPIPGLINMRVARGSGNIASAPAMSRRQAEKLLLDVICYTRELAKNGVTLFGVGELGMANTTPAAAIVSTITGRDPEEVVGIGANLPTDKLANKIDVVRRAITLNQPNPQDGVDVLAKVGGFDLVGIAGVMLGAASCGLPVLLDGFLSYAAALAACQMSPAIKPYLIPSHLSAEKGARIALSHLGLEPYLNMDMRLGEGSGAALAMSIIEAACAIYNNMGELAASNIVLPGNTTSDLNS

SEQ ID NO: 4815 - DNA, 744 bp, Escherichia coli
atgagtaaattattttgggcgatgctctcatttattacgcgtctgcctgtaccgcgtcgctggtcccagggactggatttcgagcattattctcgcggtattattacttttcctttgattggattattgcttggcgcgattagcgggctggtcttcatggtgctgcaggcatggtgtggcgtaccactggcggcactgtttagcgtacttgtgctggcgctgatgaccgggggattccatctggacggcctcgctgatacctgtgatggcgtattttctgcacgtagccgcgatcgcatgttggaaatcatgcgtgatagccgtttaggcacccacggcggtctggcattgatttttgtggtactggcaaagattctggtgttaagcgagttggctctgcgtggcgaaccgatccttgcatcgctggcggcagcatgtgcggtcagccgcgggactgccgcattattgatgtatcgtcatcgttatgcgcgggaagaagggcttggcaatgtgttcattggcaaaattgatgggcgacaaacctgcgtcacactcggcttagccgctatttttgctgccgtattattgccgggtatgcatggtgtggctgctatggtggtgacgatggtggcgattttcatcctcggtcagcttctcaaacgtacgctgggcgggcaaacgggcgatacgctgggagcagccatagagtttggtgaactggttttcctgctggcactgctataa

SEQ ID NO: 4816 - protein, 247 aa, Escherichia coli
MSKLFWAMLSFITRLPVPRRWSQGLDFEHYSRGIITFPLIGLLLGAISGLVFMVLQAWCGVPLAALFSVLVLALMTGGFHLDGLADTCDGVFSARSRDRMLEIMRDSRLGTHGGLALIFVVLAKILVLSELALRGEPILASLAAACAVSRGTAALLMYRHRYAREEGLGNVFIGKIDGRQTCVTLGLAAIFAAVLLPGMHGVAAMVVTMVAIFILGQLLKRTLGGQTGDTLGAAIEFGELVFLLALL

SEQ ID NO: 4817 - DNA, 546 bp, Escherichia coli
atgatgattttggtgacgggaggcgcacggagcgggaagagtcgccacgcagaggtgcttattggggactcttcacaggttctgtatatcgctacctcgcaaatccttgatgatgagatggctgcacggatagaacatcatcggcaaagccgcccggagcactggcgcacagtggagcgctggcaacatcttgatgaattaattcatgcagacattaacccgaatgaggctgtgttgctggaatgcgttaccacaatggtgactaatctgttgtttgattatggcggcgataaagaccctgatgaatgggattatcaggcgatggaacaggcgattaatgctgagattcagtcgttgattgctgcctgccaacgttgccccgcaaaggttgtattagtgactaacgaagtgggaatggggattgtgccggagagtcgtctggcacgacattttcgtgatattgccgggcgggtaaatcagcagttggccgctgcggcaaatgaagtatggctggtggtttcgggtattggagtaaaaatcaaatga

SEQ ID NO: 4818 - protein, 181 aa, Escherichia coli
MMILVTGGARSGKSRHAEVLIGDSSQVLYIATSQILDDEMAARIEHHRQSRPEHWRTVERWQHLDELIHADINPNEAVLLECVTTMVTNLLFDYGGDKDPDEWDYQAMEQAINAEIQSLIAACQRCPAKVVLVTNEVGMGIVPESRLARHFRDIAGRVNQQLAAAANEVWLVVSGIGVKIK

SEQ ID NO: 4819 - DNA, 123 bp, Escherichia coli
ttgctggttggtccggcagtagcattaattcattatctgaatgaaatgtgtcaatccacagaaaccgctgtcaatgacgcattttgtcggacgttaacacgagaaagtctggctattccgtaa

SEQ ID NO: 4820 - protein, 40 aa, Escherichia coli
MLVGPAVALIHYLNEMCQSTETAVNDAFCRTLTRESLAIP

SEQ ID NO: 4821 - DNA, 165 bp, Escherichia coli
atgcctttaataacacatcttttaaatgttgaagaattatcccgcctgctgaagaacgttgctctgagtgtgataaacctttttattcttgatgatgtcagcgagaagatggaatatatccccgactgggtcgtggttacccggttaaacatctggtggcgctaa

SEQ ID NO: 4822 - protein, 54 aa, Escherichia coli
MPLITHLLNVEELSRLLKNVALSVINLFILDDVSEKMEYIPDWVVVTRLNIWWR

SEQ ID NO: 4823 - DNA, 2148 bp, Escherichia coli
atgttatataatataccttgtcgaatttatatcctttccactctgtcattatgcatttctgggatagtttctactgcaaccgcaacttcttcagaaacaaaaatcagcaacgaagagacgctcgtcgtgaccacgaatcgttcggcaagcaacctttgggaaagcccggcgactatacaggttattgaccaacaaacattgcagaactccaccaatgcctccatagccgataatttgcaggacatccccggagtagagataacagacaactccttggcaggccgtaaacaaatccgcattcgtggcgaagcatcctcccgtgttttaattctcattgatggtcaggaggtaacttatcagcgcgccggagataattatggtgtgggactgttgatagatgagtctgcgctggagcgtgttgaggtagtgaaaggtccatattccgtactgtacggttcacaggcaattggcggtattgttaacttcataaccaaaaagggaggtgacaaacttgcatctggagttgtgaaagctgtttataattccgcaacagcaggctgggaagaatcaatcgcggtccaggggagcatcggtggatttgattatcgcatcaacggtagttattctgatcagggcaatcgtgatacgccggatggacgtctgccgaataccaactatcgtaacaatagtcagggtgtatggttgggttataactccggaaaccatcgttttggcctctcgcttgatcgctacagactcgcgacgcaaacttactatgaggatccagacggaagctatgaggcatttagtgtcaaaatacctaaacttgaacgagagaaagttggggtattctatgacacagacgtggacggtgactatctaaaaaaaattcatttcgacgcgtatgagcagaccatccagcgccaatttgccaacgaagtaaaaacgacacagcctgttcccagtccgatgattcaggctctgaccgttcataacaagactgacacccatgataagcaatacactcaggcggtcacattgcagagtcacttttcgctgcctgctaataatgaacttgttaccggtgcacagtacaaacaagacagggtcagccaaaggtccggtggcatgacctcaagcaaatctctgaccggcttcattaataaggaaacacgaactcgctcctattatgagtcagagcaaagtacagtctcactattcgcacaaaatgactggcgattcgccgatcactggacatggacaatgggagttcgccaatactggctttcttcaaagttgacgcgtggtgacggagtatcatataccgcaggcattataagcgatacctctcttgccagagagtctgcgagtgatcacgaaatggtaacatctacaagcctgcgctattcaggtttcgataacttggagttacgcgctgcgttcgcgcaaggctacgtatttcccacactctcccagctttttatgcagacatctgcgggcggcagtgtcacatacggaaatcctgatcttaaggctgaacactccaataactttgaattaggtgcacgatataatggtaatcagtggctgattgacagcgcagtttactactcagaagctaaagattatattgcaagtctgatctgtgatggcagtatagtttgcaatggtaacaccaactcctcccgtagtagctactattattatgacaatattgatcgggcaaaaacatggggactggaaataagcgcggaatataatggctgggttttctcgccatatatcagtggcaatttaattcgtcggcaatatgaaacttcaacattaaaaacaactaatacaggagaaccagcgataaacggacgtatagggctgaaacatactcttgtgatgggtcaggccaacataatctctgatgtttttattcgtgctgcctctagtgcaaaagatgacagtaacggtaccgaaacaaatgttccgggctgggccactctcaactttgcagtaaatacagaattcggtaacgaggatcagtaccggattaacctagcactcaataacctgacagacaaacgctaccgtacagcacatgaaactattcctgcagcaggttttaatgcagctataggttttgtatggaatttctga

SEQ ID NO: 4824 - protein, 715 aa, Escherichia coli
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWRFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 4825 - DNA, 129 bp, Escherichia coli
atggaatttctgatgacaaaaacaatcgttatggaattctttgtcctgatctgcccgctttgcgggcaggctaacgaacgtattgtgtttgttgaaggtttttcgacgttgttttccatctgggggtga

SEQ ID NO: 4826 - protein, 42 aa, Escherichia coli
MEFLMTKTIVMEFFVLICPLCGQANERIVFVEGFSTLFSIWG

SEQ ID NO: 4827 - DNA, 645 bp, Escherichia coli
atgggggattctgtgacacctgaggtggaagtattgagcaacatgattcgacagtacttcagtcaggaacgatctgaagaagagaccatacgagcccttaatcatctgcgcagggtgttgcatgaggtcagcccttttgcacaggagcctgtggactgtgtgttgtgggtgaaagcggatgaggtggtggccaacgattacaatcccaatgtcatgtcttccagtgaaaaaaaactgcttaaacattcactggagcaggatggattcacgcagcctgtggtggtttcggaagagaaggagcattatctggtcgtggatggttttcatcgtcagttgctgggcaggaaagcggatacgagaaaacgtctgaagggctggctgccagtgacctgtattaatccggaaagaaagggacaggcatcacgtattgccgcaaccatacggcataaccgtgccaggggaaaacaccagataacgtcaatgtctgacattgtcagggacctttcgcgtctgggctggacagatgagcgtattggcacagagttgggcatggaccaggatgaagtgctgaggctgaaacagattagcgggctgacagagctgtttcaggaagagaatttcagcccttcatggacggttcgttga

SEQ ID NO: 4828 - protein, 214 aa, Escherichia coli
MGDSVTPEVEVLSNMIRQYFSQERSEEETIRALNHLRRVLHEVSPFAQEPVDCVLWVKADEVVANDYNPNVMSSSEKKLLKHSLEQDGFTQPVVVSEEKEHYLVVDGFHRQLLGRKADTRKRLKGWLPVTCINPERKGQASRIAATIRHNRARGKHQITSMSDIVRDLSRLGWTDERIGTELGMDQDEVLRLKQISGLTELFQEENFSPSWTVR

SEQ ID NO: 4829 - DNA, 1290 bp, Escherichia coli
ttgatgagaaggtttaagtttgtagttcagaatattactgccaagatagtttatactaggatatgtatgggaaccatacagaagataagaacagatgttaatgtattacatgcggccattcaccgtattgagtggttgtttgagacattttcatctgtttgtttgtctttttctggaggaaaagactctactgtgctgctccatcttacggccgatgtggctcgcaggaagaaacgtcgtttctctgtattattcattgactgggaagctcagtaccagtgcacaattgcacacattctgaagatgagggagatgtatcgggatgtgacggagactttttactgggtggcactccccctgactacggtaaacggtgtctctcagtttcagccggaatggatatgctgggaaccaggtgtggagtgggttcgtcagccaccagatgacgctattacagatatgtcgtatttcccattttatcggtatgccatgacgtttgaagaatttgttccggcattttcttcctggtttgccggtaaccggtgtggagtggcaatactgactggtgttcgtgctgatgaatcgctcaatcgctttatgggactggtgtctcagcgcaaactgagatatgcagatgataaaccctggaccacagcgtcacctgaagggttttattacaccttgtatccgttgtatgactggaaagcccgtgatatatggatatataacgccagaacccgagctatctacaatcccctgtatgacctgatgtaccgtgccggcgtgccgttacgcaacatgcgggtctgtgagccttttggcccggaacagcgtaagggactgtggctttaccatgttctggagccggaaacttgggccaggatgtgtgagcgggtgtcgggtgctgccagcggggcgctttatgccaatgagagcggtgcctattttgccctgcgtaagcgtatcacgaagccgcctcatcatacctggcgtagctatgcgatgttcctgctggatgtgatgccggaaagaacggcagaacattaccgtaataaaattgctgtctacctgcgctggtatcagacgcggggcttcccggatgacatcccggatgaacaggagaatgacctggggagccgggatatcccgtcttggcgacgtatctgtaagacactcataaagaatgatttctggtgccggaccctctccttcagtccgaacaaaccccggcactatgaacgttatctgcagcgtatgaaagaaaggaggaaggaatgggggattctgtga

SEQ ID NO: 4830 - protein, 429 aa, Escherichia coli
MMRRFKFVVQNITAKIVYTRICMGTIQKIRTDVNVLHAAIHRIEWLFETFSSVCLSFSGGKDSTVLLHLTADVARRKKRRFSVLFIDWEAQYQCTIAHILKMREMYRDVTETFYWVALPLTTVNGVSQFQPEWICWEPGVEWVRQPPDDAITDMSYFPFYRYAMTFEEFVPAFSSWFAGNRCGVAILTGVRADESLNRFMGLVSQRKLRYADDKPWTTASPEGFYYTLYPLYDWKARDIWIYNARTRAIYNPLYDLMYRAGVPLRNMRVCEPFGPEQRKGLWLYHVLEPETWARMCERVSGAASGALYANESGAYFALRKRITKPPHHTWRSYAMFLLDVMPERTAEHYRNKIAVYLRWYQTRGFPDDIPDEQENDLGSRDIPSWRRICKTLIKNDFWCRTLSFSPNKPRHYERYLQRMKERRKEWGIL

SEQ ID NO: 4831 - DNA, 1197 bp, Escherichia coli
atgaaaactttgttatttatcttcatgaccatagcaatgttgctatggtttttaagtacgctaagacgtaaaccctgtcaaaagaaaggctgtattgacgccattataccagcttataacgaaggcccgtgtctggcgcagtcactggataatctgctgcgtaacccttatttttgccgggtaatttgcgttaacgacggatccacggacaataccgaagcggtcatggcggaagtcaaacgcaaatggggcgaccgctttgttgccgtcacgcaaaaaaacaccggtaaaggtggcgcactaatgcatggactaaaatacgccacgtgtgatcaagtatttttaagtgatgcagatactttcgttccacctgataatgatggaatgggctatatgctggcagaaattgagcgcggcgctgatgccgttggcggaattccctccaccgcgttaaaaggggcaggtctgctgccacatatccgcgccaccgtaaagttgccgatgattgttatgaagcgcacgctacagcagtttctgggcggtgcaccgtttattatcagcggtgcctgcgggatgttccgtactgatgtattgcgtaagttcggtttctctgatcgtactaaagtcgaagaccttgatctcacctggacgttggtggcaaacggctaccgtattcggcaggcgaatcgctgcatcgtatacccacaggaatgtaacagtccgcgtgaggagtggcgccgctggcggcgttggattgtgggctacgcggtctgtatgcgcctgcataaaagacttttatttagccgcttcggtatcttcagtatatttcctatgctgttggttgtgctttatggcgttggtatttatctcactacctggtttaatgaattcatcaccaccgggccacatggtgtggtgttggcaatgttcccgcttatctgggtcggcgtagtttgtgttattggtgcatttagcgcctggtttcatcgttgctggttgttggtgcctttagcaccgctttccgttgtgtatgtattattagcttatgccatctggattatttatggacttattgccttttttactggacgcgaacctcagcgcgacaaacccacccgctattccgcactggtggaagcgtcaaccgcttattcccaaccttctgtcacaggaactgaaaaactatctgaagcttaa

SEQ ID NO: 4832 - protein, 398 aa, Escherichia coli
MKTLLFIFMTIAMLLWFLSTLRRKPCQKKGCIDAIIPAYNEGPCLAQSLDNLLRNPYFCRVICVNDGSTDNTEAVMAEVKRKWGDRFVAVTQKNTGKGGALMHGLKYATCDQVFLSDADTFVPPDNDGMGYMLAEIERGADAVGGIPSTALKGAGLLPHIRATVKLPMIVMKRTLQQFLGGAPFIISGACGMFRTDVLRKFGFSDRTKVEDLDLTWTLVANGYRIRQANRCIVYPQECNSPREEWRRWRRWIVGYAVCMRLHKRLLFSRFGIFSIFPMLLVVLYGVGIYLTTWFNEFITTGPHGVVLAMFPLIWVGVVCVIGAFSAWFHRCWLLVPLAPLSVVYVLLAYAIWIIYGLIAFFTGREPQRDKPTRYSALVEASTAYSQPSVTGTEKLSEA

SEQ ID NO: 4833 - DNA, 441 bp, Escherichia coli
gtgattggcgcaaactgcctgataggtaattatgcgtttattcgtcctggcacaataatcagcaatggcgtaaaaattggttttgccaccgaaattaaaaatgcggttattgaagcggaagcaacgattggtccgcaatgctttattgccgactcggtagttgcaaaccaggcatatttgggcgcacaagtacgtaccagtaatcatcgtctggatgaacaacccgtgtctgttcgaactccagagggaattatcgctaccggatgcgataaattaggttgttatatcgggaagcgttcacgccttggtgtacaagttattattttgcctgggcgaattatttctccgaacacacaacttggcccgcgcgtgattgtagaacgtaatttacctagtggaacttactcactccgacaagaacttatccgtacaggagattaa

SEQ ID NO: 4834 - protein, 146 aa, Escherichia coli
MIGANCLIGNYAFIRPGTIISNGVKIGFATEIKNAVIEAEATIGPQCFIADSVVANQAYLGAQVRTSNHRLDEQPVSVRTPEGIIATGCDKLGCYIGKRSRLGVQVIILPGRIISPNTQLGPRVIVERNLPSGTYSLRQELIRTGD

SEQ ID NO: 4835 - DNA, 774 bp, Escherichia coli
atgataaagcatacgttattagtgccgtttttttttagtgcattgcccgcttatgccgggttaacttccattaccgcgggctacgattttaccgattattctggcgaacatggcaaccgtaatttagcgtatgctgaactggtagcaaaagttgaaaacgcaacgctgctttttaatctttcccaggggcgtcgtgattatgaaactgaacatttcaatgccactcgcggccagggtgcagtctggtacaaatggaataactggctgacaacccgaacgggtattgcctttgcggataatacgccggtctttgcccgccaggattttcgacaggatattaacctagccctgttgccaaaaacgcttttcacgaccggttatcgctacactaaatattacgatgatgtcgaagtcaatgcctggcaaggcggcgtatcactctatactggcccggtgatcaccagttaccgctatacccattatgactccagcgatgcaggtagtagttatagcaatatgatttccgtgcgtctgaaggacccgcgcggtgctggttatacgcaactatggctaagccgcggaacaggtgcttacacctacgactggacgccagaaacacgctacggcagcatgaagagcatcagtttgcaacgaattcaaccgctgactgagcaacttaatctcgggttgacggcaggtaaagtgtggttcaacaccccaaccgatgattataacggtctgcaacttgcagcccacctgatctggaaattctag

SEQ ID NO: 4836 - protein, 257 aa, Escherichia coli
MIKHTLLVPFFFSALPAYAGLTSITAGYDFTDYSGEHGNRNLAYAELVAKVENATLLFNLSQGRRDYETEHFNATRGQGAVWYKWNNWLTTRTGIAFADNTPVFARQDFRQDINLALLPKTLFTTGYRYTKYYDDVEVNAWQGGVSLYTGPVITSYRYTHYDSSDAGSSYSNMISVRLKDPRGAGYTQLWLSRGTGAYTYDWTPETRYGSMKSISLQRIQPLTEQLNLGLTAGKVWFNTPTDDYNGLQLAAHLIWKF

SEQ ID NO: 4837 - DNA, 1122 bp, Escherichia coli
  n 1100, 1101, 1102, 1103, 1104: n is any nucleotide
gtggataacggggcgcactttgacggcgaccagagcggcacggtgaatggtgtcacgccgccagcagtgcagcatctgaccgccgaagtcactgcagacagcggggaatatcaggtgctggcgcgatgggacacaccgaaggtggtgaagggcgtgagcttcatgctccgtctgaccgtgacagcggatgacggcagtgagcggctgatcagcacagccaggacgacggaaaccacataccgcttcacacaactggcgctggggaactacaggctgacagtccgggcggtaaatgcatgggggcagcagggcgatccggcatcggtatcgttccggattgccgcaccggcagcgccgtcgcagattgagctgacaccggggtattttcagataaccgccacgccgcatcttgcggtttatgatccgacggtacagtttgagttctggttctcggaaaagcggattgcggatatcaggcaggttgaaaccacagcacgctatcttggcacggcgctgtactggatagccgccagtatcaatatcaaaccgggccatgattattatttttatatccgcagtgtgaacaccgttggcaaatcggcatttgtggaggccgttggccgggcgagtgatgatgcatccggctatctggattttttcaaaggagagatagggaaaacccatctggctcaggagttgtggacgcagattgataacggtcagcttgcgcctgacctggctgaaatcaggacgtccattacgggtgtcagcaatgaaatcacgcagaccgtcaataagaaactggaagaccagagtgcagcaattcagcagatacagaaggttcaggttgatacaaataataacctgaacagcatgtgggctgtgaagctgcagcagatgcaggacggacgcctttatatcgcgggtattggtgccggtgttgagaatactcctgacggtatgcagagtcaggtgctgctggcggcggacaggattgcgatgattaatcctgcgaatggcaacacaaaaccgatgtttgttggtcagggcgatcagatattcatgaacgacgtgttcctgaaacgcctgacggctcccannnnncattcattcattaattaa

SEQ ID NO: 4838 - protein, 373 aa, Escherichia coli
  Xaa 367, 368: Xaa is any amino acid
MDNGAHFDGDQSGTVNGVTPPAVQHLTAEVTADSGEYQVLARWDTPKVVKGVSFMLRLTVTADDGSERLISTARTTETTYRFTQLALGNYRLTVRAVNAWGQQGDPASVSFRIAAPAAPSQIELTPGYFQITATPHLAVYDPTVQFEFWFSEKRIADIRQVETTARYLGTALYWIAASINIKPGHDYYFYIRSVNTVGKSAFVEAVGRASDDASGYLDFFKGEIGKTHLAQELWTQIDNGQLAPDLAEIRTSITGVSNEITQTVNKKLEDQSAAIQQIQKVQVDTNNNLNSMWAVKLQQMQDGRLYIAGIGAGVENTPDGMQSQVLLAADRIAMINPANGNTKPMFVGQGDQIFMNDVFLKRLTAPXXHSFIN

SEQ ID NO: 4839 - DNA, 126 bp, Escherichia coli
gtggaggttcagtccgtcaccgacggcgtgaaggtgaaagtgagccgtgttcctgacggcgttgccggatacagcgtgtgggggctgaagctgccgacgctgcgccagcgctgttccgctgcgtga

SEQ ID NO: 4840 - protein, 41 aa, Escherichia coli
MEVQSVTDGVKVKVSRVPDGVAGYSVWGLKLPTLRQRCSAA

SEQ ID NO: 4841 - DNA, 102 bp, Escherichia coli
  n 4, 5, 6, 7, 8: n is any nucleotide
atgnnnnncagcaccggcgggcgtgtgctggcggtgaacagccagacccggacgctgacgctcgaccgtgaaatcacgctgccatctccggtaccacgctga

SEQ ID NO: 4842 - protein, 33 aa, Escherichia coli
  Xaa 2, 3: Xaa is any amino acid
MXXSTGGRVLAVNSQTRTLTLDREITLPSPVPR

SEQ ID NO: 4843 - DNA, 453 bp, Escherichia coli
  n 431, 432, 433, 434, 435: n is any nucleotide
atgaaggttaataaaaagaggcttgccgaaattttcaacgtggacccgcggacgattgaacgctggcagtctcagggactcccttgcgcctccaaaggtagtaagggcattgaatctgtatttgatactgccatggcaattcagtggtatgcgcagagggaaactgatatcgaaaacgaaaagctccgcaaagaactggacgatttgcgtgcggcagcggagtcagatttacaacccggcaccattgactatgaacgctaccggctcacaaaagcgcaggcagatgcgcaggaactgaaaaatgcccgtgaagacggagtggtgctggaaactgaactgtttaccttcattctgcaacgtgtggcacaggagatttcggggatacttgtgcgtgtgccgttgacattacagcgtaaatatcccggacattnnnnncattcattcattaattaa

SEQ ID NO: 4844 - protein, 150 aa, Escherichia coli
  Xaa 144, 145: Xaa is any amino acid
MKVNKKRLAEIFNVDPRTIERWQSQGLPCASKGSKGIESVFDTAMAIQWYAQRETDIENEKLRKELDDLRAAAESDLQPGTIDYERYRLTKAQADAQELKNAREDGVVLETELFTFILQRVAQEISGILVRVPLTLQRKYPGHXXHSFIN

SEQ ID NO: 4845 - DNA, 183 bp, Escherichia coli
atgctggcagttttccaactggtcaaaaatacctgctctcgtctgttgcaatgcctgcagcatgcggcggcaatgcgccttgcttttactaaccatctttccttcctctatcagtcgctgcgtgaactcatcatggaataccaggtaaatgcggatgttatcggttttggctacgcagcatag

SEQ ID NO: 4846 - protein, 60 aa, Escherichia coli
MLAVFQLVKNTCSRLLQCLQHAAAMRLAFTNHLSFLYQSLRELIMEYQVNADVIGFGYAA

SEQ ID NO: 4847 - DNA, 228 bp, Escherichia coli; identical to SEQ ID NO: 1311

SEQ ID NO: 4848 - protein, 75 aa, Escherichia coli; identical to SEQ ID NO: 1312

SEQ ID NO: 4849 - DNA, 99 bp, Escherichia coli; identical to SEQ ID NO: 1309

SEQ ID NO: 4850 - protein, 32 aa, Escherichia coli; identical to SEQ ID NO: 1310

SEQ ID NO: 4851 - DNA, 342 bp, Escherichia coli
ttgttgtcacataggattctgccgtttttaacaatgcaggataataagatgaaaaaaatgttgttttctgccgctctggcaatgcttattacaggatgtgctcaacagacgtttactgttggaaacaaacctacagcagtaacaccaaaggaaaccatcacccatcatttcttcgtttcgggaattgggcagaagaaaactgtcgatgcagcaaaaatttgtggtggtgcagaaaatgttgttaaaacagaaacccagcaaacattcgtaaatggattgctcggttttattactttaggcatttatactccgctggaagcgcgtgtgtattgctcacaataa

SEQ ID NO: 4852 - protein, 113 aa, Escherichia coli
MLSHRILPFLTMQDNKMKKMLFSAALAMLITGCAQQTFTVGNKPTAVTPKETITHHFFVSGIGQKKTVDAAKICGGAENVVKTETQQTFVNGLLGFITLGIYTPLEARVYCSQ

SEQ ID NO: 4853 - DNA, 297 bp, Escherichia coli
atgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcagtgcagatag

SEQ ID NO: 4854 - protein, 98 aa, Escherichia coli
MRQRDVAALDAKYTKELADAKAENDALRDDVAAGRRRLHIKAVCQSVREATTASGVDNAASPRLADTAERDYFTLRERLITMQKQLEGTQKYINEQCR

SEQ ID NO: 4855 - DNA, 183 bp, Escherichia coli; identical to SEQ ID NO: 1303

SEQ ID NO: 4856 - protein, 60 aa, Escherichia coli; identical to SEQ ID NO: 1304

SEQ ID NO: 4857 - DNA, 96 bp, Escherichia coli
gtgaaatctgtttgtggggtcagcaatgaacagagtaaccgcgattatctccgctctggttatctgcatcatcgtctgcctgtcatgggctgttaa

SEQ ID NO: 4858 - protein, 31 aa, Escherichia coli
MKSVCGVSNEQSNRDYLRSGYLHHRLPVMGC

SEQ ID NO: 4859 - DNA, 498 bp, Escherichia coli
atgcctccatcattacgaaaagccgttgctgctgctattggtggcggagcaattgctatagcatcagtgttaatcactggcccaagtggtaacgatggtctggaaggtgtcagctacataccatacaaagatattgttggtgtatggactgtatgtcacgggcatacaggaaaagacatcatgctcggtaaaacgtataccaaagcagaatgcaaagccctcctgaataaagaccttgccacggtcgccagacaaattaacccgtacatcaaagtcgatataccggaaacaatgcgcggcgctctttactcattcgtttacaacgtgggtgctggcaatttcagaacatcgacgcttcttcgcaaaatcaaccagggcgatatcaaaggcgcatgtgatcagctacgtcgctggacatatgctggcggtaagcaatggaaaggtctcatgactcgtcgtgagattgagcgtgaaatctgtttgtggggtcagcaatga

SEQ ID NO: 4860 - protein, 165 aa, Escherichia coli
MPPSLRKAVAAAIGGGAIAIASVLITGPSGNDGLEGVSYIPYKDIVGVWTVCHGHTGKDIMLGKTYTKAECKALLNKDLATVARQINPYIKVDIPETMRGALYSFVYNVGAGNFRTSTLLRKINQGDIKGACDQLRRWTYAGGKQWKGLMTRREIEREICLWGQQ

SEQ ID NO: 4861 - DNA, 216 bp, Escherichia coli
atgaaatccatggataagttaacaacgggtgtcgcctatggtacctcagcaggtagtgccgggtactggtttttacagttgctcgataaagtcacgccctcacagtgggcggcaataggtgtgctgggtagcctggtatttggcctgctgacgtacctgacaaacctttatttcaagattaaagaagataagcgcaaggctgcgagaggtgaataa

SEQ ID NO: 4862 - protein, 71 aa, Escherichia coli
MKSMDKLTTGVAYGTSAGSAGYWFLQLLDKVTPSQWAAIGVLGSLVFGLLTYLTNLYFKIKEDKRKAARGE

SEQ ID NO: 4863 - DNA, 96 bp, Escherichia coli
gtgttcaaaacaccaccacaaatgcataagaaaacttcaacaaataaccagttaataatttccgatgttatttttagtttgtttaaattaagctaa

SEQ ID NO: 4864 - protein, 31 aa, Escherichia coli
MFKTPPQMHKKTSTNNQLIISDVIFSLFKLS

SEQ ID NO: 4865 - DNA, 1143 bp, Escherichia coli
atgaatatttatcgcgcagtgacatcattttttaataatagttcaaaaaaagggcgtacaatgaaaaaattaacagtggcaatttctgctgtagctgcatcagtactgatggcgatgtctgctcaggcagctgaaatttataataaagacagtaacaagctggatctatacgggaaagttaatgccaagcactacttctcctctaatgatgcagatgatggtgatactacttatgcccgtcttggcttcaaaggtgaaacccaaatcaacgatcaactgactggtttcggtcagtgggaatatgaattcaaaggcaaccgtgctgaatctcaaggttcttccaaagacaaaacccgtcttgcatttgcaggcctgaaatttggtgattacggctcaatcgattacggccgtaactacggtgtagcatacgacatcggtgcgtggactgacgttctgccagaattcggtggtgatacctggacccaaacagatgtgttcatgactggtcgcactactggtgttgcaacttatcgtaacaacgacttctttggtctggtcgatggcctgaactttgctgctcagtatcagggtaaaaatgaccgcactgacgtaactgaagccaatggtgatggtttcggtttctccactacttatgagtatgaaggattcggcgtgggtgcaacctatgctaaatcagatcgcactgacggtcaggtcgcctatggtaagagcaaattcaatgcctccggcaaaaatgcggaagtatgggctgcaggcctgaaatatgatgcgaacaatatctatctggctaccacatattctgaaactcagaatatgaccgtttttggtaataaccatattgcaaacaaagcacaaaactttgaagcagtagcacaatatcagtttgacttcggtctgcgtccatctgttgcttaccttcagtcaaaaggtaaagaccttggtgttcatggtgaccgagacttagtcaagtatgtcgatgtcggtgctacttactactttaataaaaacatgtccacttttgttgattacaaaatcaacttaattgacgatagtaagtttaccaaaacagctggtattgataccgacgacatcgtcgctgtaggtctggtttatcagttctaa

SEQ ID NO: 4866 - protein, 380 aa, Escherichia coli
MNIYRAVTSFFNNSSKKGRTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 4867 - DNA, 384 bp, Escherichia coli
atgcgtgatattcagatggttcttgagcgttggggtgcgtgggcggctaataatcatgaagatgtgacctggtcgtccattgccgccggttttaagggattaattccttcaaaagtaaaatctcgcccgcaatgttgtgacgatgacgcgatgatcatttgcgggtgcatggcccgtctgaaaaagaacaacagcgatttacacgatttattagtagattattatgtatgtggtatgacattcatgtcactggcaagtaagcattgctgctcggatggttatatcgggaaaaggttacagaaggctgagggcataattgaagggatgttaatggcattagatatccggttagatatggatatcgttgctaataattctaattga

SEQ ID NO: 4868 - protein, 127 aa, Escherichia coli
MRDIQMVLERWGAWAANNHEDVTWSSIAAGFKGLIPSKVKSRPQCCDDDAMIICGCMARLKKNNSDLHDLLVDYYVCGMTFMSLASKHCCSDGYIGKRLQKAEGIIEGMLMALDIRLDMDIVANNSN

SEQ ID NO: 4869 - DNA, 363 bp, Escherichia coli
gtgaatacctacagcatcacattaccctggcctccgagcaataatcgctattaccgccataatcgcgggcgcacgcacgtcagcgcagaggggcaggcataccgcgataacgtcgcccgaatcattaaaaacgcaatgctggatatcggcctggctatgcctgtgaaaatccgcattgagtgccacatgccggatcgccgtcgccgtgacctggataatctgcaaaaagccgcttttgacgcactcactaaagcaggtttctggctggatgatgctcaggtcgttgattaccgcgttgtgaagatgcctgttaccaaaggtgggaggctggaactgaccatcaccgaaatggggaatgaatga

SEQ ID NO: 4870 - protein, 120 aa, Escherichia coli
MNTYSITLPWPPSNNRYYRHNRGRTHVSAEGQAYRDNVARIIKNAMLDIGLAMPVKIRIECHMPDRRRRDLDNLQKAAFDALTKAGFWLDDAQVVDYRVVKMPVTKGGRLELTITEMGNE

SEQ ID NO: 4871 - DNA, 177 bp, Escherichia coli
atgagacgacagcgacgaagcatcaccgacataatctgcgaaaactgcaaataccttccaacgaaacgctccagaaataaacgcaagctaatcccaaaagaatctgacgtaaaaaccttcaattacacagcccacctgtgggatatccggtggctaagatatcgtgcgaggaaatga

SEQ ID NO: 4872 - protein, 58 aa, Escherichia coli
MRRQRRSITDIICENCKYLPTKRSRNKRKLIPKESDVKTFNYTAHLWDIRWLRYRARK

SEQ ID NO: 4873 - DNA, 528 bp, Escherichia coli
atgactatcaaatcaaatacgccagcacacgacaaggactgctggcaaacgccgctttggctttttgatgcactggatattgagtttggattctggctggattcggcagcgagcgacaaaaatgctctgtgcgctcactggctaactgaggacgacgacgcgctcaattctgagtgggtaagccacggtgcaatctggaataacccaccgtacagcaatatcaggccgtgggtggaaaaagccgctgagcagtgtatacaacagcgacagacggtagtgatgcttgtgccagaggatatgtctgtcggatggttcagcaaggctctggagagtgttgacgaagttcgtattatcactgatggacggattaattttatcgaaccatcgacagggctggagaagaagggaaacagcaaaggctccatgctgctgatttggcgaccgttcatcagtcctcgacggatgtttactaccgtatccaaagcggcattgatggcgatcgggcagggcgtcaggagggctgcatga

SEQ ID NO: 4874 - protein, 175 aa, Escherichia coli
MTIKSNTPAHDKDCWQTPLWLFDALDIEFGFWLDSAASDKNALCAHWLTEDDDALNSEWVSHGAIWNNPPYSNIRPWVEKAAEQCIQQRQTVVMLVPEDMSVGWFSKALESVDEVRIITDGRINFIEPSTGLEKKGNSKGSMLLIWRPFISPRRMFTTVSKAALMAIGQGVRRAA

SEQ ID NO: 4875 - DNA, 441 bp, Escherichia coli
atgaaaaaactaacctttgaaattcgatctccggcacatcagcaaaacgctattcacgcagtacagcaaatccttccagacccaaccaaaccaatcgtagtaaccattcaggaacgcaaccgcagcttagaccaaaacaggaagctatgggcctgcttaggtgacgtctctcgtcaggttgaatggcatggtcgctggctggatgcagaaagctggaagtgtgtgtttaccgcagcattaaagcagcaggatgttgttcctaaccttgccgggaatggctttgtggtaataggccagtcaaccagcaggatgcgtgtaagcgaatttgcggagctattagagcttatacaggcattcggtacagagcgtggcgttaagtggtcagacgaagcgcgactggctctcgaatggaaagcgcgatggggagatcgggctgcatga

SEQ ID NO: 4876 - protein, 146 aa, Escherichia coli
MKKLTFEIRSPAHQQNAIHAVQQILPDPTKPIVVTIQERNRSLDQNRKLWACLGDVSRQVEWHGRWLDAESWKCVFTAALKQQDVVPNLAGNGFVVIGQSTSRMRVSEFAELLELIQAFGTERGVKWSDEARLALEWKARWGDRAA

SEQ ID NO: 4877 - DNA, 282 bp, Escherichia coli
  n 9, 10, 11, 12, 13: n is any nucleotide
atggaatgnnnnntcttatccgtggaatcgaacgcgcactactggctggttaccaacctgtaccagaacatgcgggccaatgcgctgactgacgcggaattacgacgcaaggctgccgatgaactgacctgtatgacagcgcgaattaaccgtggtgagacgatacctgaaccagtaaaacaacttcctgtcatgggcggcagacctctaaatcgtgttcaggcgctggcgaagatcgcagaaattaaagctaagttaggactgaaaggagcaagtgtatga

SEQ ID NO: 4878 - protein, 93 aa, Escherichia coli
  Xaa 3, 4, 5: Xaa is any amino acid
MEXXXLSVESNAHYWLVTNLYQNMRANALTDAELRRKAADELTCMTARINRGETIPEPVKQLPVMGGRPLNRVQALAKIAEIKAKLGLKGASV

SEQ ID NO: 4879 - DNA, 1134 bp, Escherichia coli
atgcattcggaaaatattgcggcttacgtcgggctggatgtgcataaagaaacgttggcggttgctattgctgcacctgaacggcttggcgaagttcgttattatggtacgattaacaacgaagcccaggctgtacgtcgattatttcagaaattgcagggactttacggaaacattctttcctgctatgaggctggcccctgtggttttgggctatatcatcaactcacagcgatgaatataaaatgccaggttattgccccttcccgcataccaaaatcaccgacagacagaatcaaaaatgatcatcgggacgcaatttctctcgccaggttactgcgggctggagaacttacccctgtctggatccctgacctgactcatgaagctatgcgggatctaatcagagcccgtgcagcagctaaacgagacagcagagttgcccgacagcgaattctgagcatgctattgcgaacagacaaacattatgcaggaaagcactggacaggaaaacatcgaacctggttagctaatcaatcatttagtcagccatctcaacagattgcttttcaacactattgtcaaagtctggagcagattgaagatcgcatacttcaactcgaccaggaaatatctcgcctgttacctgagtggtctctgtgcaatctggtctgccagttgcaggctcttaaaggtgttggtcagctaattgcaataactctggttgctgaactgggtgatttttcgcgattttccaatcccaaacagctcatggcttttctgggactggtgccaggtgaatattccagtggaaacagtattcgtcccagaggaataacaaaagttggaaacagcgaactgagacgtctgctttacgaagccgcctggtcttatcgtacacctgcaaaagttggggcatggcttatatattaccgaccggactctgtaacacaatattccaaagatattgcatggaaagctcaacaacgattgtgttctcgttaccgaagtctgacagcaaaagggaaaaaatcacaagtagccattacggcggtggctcgtgagttgactggatttatgtgggatattgcacttgctgcccaatcatcattcagtcagcagaagcaaaattaa

SEQ ID NO: 4880 - protein, 377 aa, Escherichia coli
MHSENIAAYVGLDVHKETLAVAIAAPERLGEVRYYGTINNEAQAVRRLFQKLQGLYGNILSCYEAGPCGFGLYHQLTAMNIKCQVIAPSRIPKSPTDRIKNDHRDAISLARLLRAGELTPVWIPDLTHEAMRDLIRARAAAKRDSRVARQRILSMLLRTDKHYAGKHWTGKHRTWLANQSFSQPSQQIAFQHYCQSLEQIEDRILQLDQEISRLLPEWSLCNLVCQLQALKGVGQLIAITLVAELGDFSRFSNPKQLMAFLGLVPGEYSSGNSIRPRGITKVGNSELRRLLYEAAWSYRTPAKVGAWLIYYRPDSVTQYSKDIAWKAQQRLCSRYRSLTAKGKKSQVAITAVARELTGFMWDIALAAQSSFSQQKQN

SEQ ID NO: 4881 - DNA, 117 bp, Escherichia coli
atgttcttcggcggcgagcgcagtgcactgttgtatgggcttatcggcacttgccttctgaacgacattgatccggaagcgtatctgcgccatatcctgagcgtactgccggaataa

SEQ ID NO: 4882 - protein, 38 aa, Escherichia coli
MFFGGERSALLYGLIGTCLLNDIDPEAYLRHILSVLPE

SEQ ID NO: 4883 - DNA, 726 bp, Escherichia coli
atgaattcgtctaagatttataaaagtataatttatcaaacgaaagaaacgcaaaccggaactgccacgatccttgttaatgaaggtactggcgataatgttattgcgatctatcccggtgccaacatgacaatgtcgtccgatgaaataactattcagaaagaagcgattattaattctgatgtcatacttctgcagctcgaaacaaattataccgctctgcaacaagcgatcacattggcgcaaaaaaacagtatcccggtcattattaacccggcaccctataatgatatcgtcaacgaacttattcaggatgttgattatatcacccccaatgaaacagaagctggtttactgtccggcatagacgtacacgatcttgaatcagctaaacgagctgcagaagctatccacaataaaggggtaaaaaacacggttatcacgctcggtagcaagggctcgctcgcatttgatggcaaaaaattcattcattcgccagcgtttccagcggtcgttaaaaatacggcaggagccggggatgcttttaacggcgctctggcatcaggacttgcgaaaggaaaatcactggaatcagcactgtgttatgccagcgcctttgcatccctagcggtggagacaagcaatgcttccgacatgcctgaacatgaatctgtgatacatcgaattcagagtatacattatcagcaaactatttttacgcattaa

SEQ ID NO: 4884 - protein, 241 aa, Escherichia coli
MNSSKIYKSIIYQTKETQTGTATILVNEGTGDNVIAIYPGANMTMSSDEITIQKEAIINSDVILLQLETNYTALQQAITLAQKNSIPVIINPAPYNDIVNELIQDVDYITPNETEAGLLSGIDVHDLESAKRAAEAIHNKGVKNTVITLGSKGSLAFDGKKFIHSPAFPAVVKNTAGAGDAFNGALASGLAKGKSLESALCYASAFASLAVETSNASDMPEHESVIHRIQSIHYQQTIFTH

SEQ ID NO: 4885 - DNA, 759 bp, Escherichia coli
atgaataacaccaaaaaatcactaaaagtgctctttattggggaatcctggcatattcatatgattcattcaaaaggatatgacagttttacctcaagtaaatatgaagaaggtgcgacctggttactccaatgtctgaaaaatagtcaggtagatgtcacctatatgccagcacatacggtacaaattgccttccctgaagatgtggcacagttagaacaatatgatgccatcgttattagtgatattggtagtaatactttcctgctacaaaatgatactttttatcaacttcgcataaaaccaaacgctctcgaactgattaaagaatatgtgaataacggtggtgggttattgatgattggcggctatctctcattcatgggaattgaagcaaaagccaattataaaaatacagttctggctgatgtgctcccggttacgatgttagatggtgacgatcgtgtcgaaaaaccagagggtgttattgcacagccatcacaacctgaacatccagttattaaagggttctctgaatatccttttttcctaggttataaccgggcgatcgctaaagaaaatgctgaggtggtattaacaataaacaacgatccattactggtctttggtaactatcacaacgggaaaatagcctgctttatgagtgactgttcaccgcactggggtacacagcagtttatgtcctggccgttctataccgcgttgtgggtaaatatactgactcatattgcaagataa

SEQ ID NO: 4886 - protein, 252 aa, Escherichia coli
MNNTKKSLKVLFIGESWHIHMIHSKGYDSFTSSKYEEGATWLLQCLKNSQVDVTYMPAHTVQIAFPEDVAQLEQYDAIVISDIGSNTFLLQNDTFYQLRIKPNALELIKEYVNNGGGLLMIGGYLSFMGIEAKANYKNTVLADVLPVTMLDGDDRVEKPEGVIAQPSQPEHPVIKGFSEYPFFLGYNRAIAKENAEVVLTINNDPLLVFGNYHNGKIACFMSDCSPHWGTQQFMSWPFYTALWVNILTHIAR

SEQ ID NO: 4887 - DNA, 885 bp, Escherichia coli
gtgaatggtcaattaggtcactggttacaggatggtaatgcatgcgcagttatctcctttgccagtggtttagtcgtgatgttttttattattatggcgcgaaaagaaacccggcaacaatttgcggcaattccttctctgattaaaaaccgaaaagttcctctctggaactggtttgccggtctctgtggagcgatggtggtattttctgaaggcgcatcagccagcgcactcggggtcgcaacgtttcaaaccgcactgatctccgcgctattgctgtctggtttactttgcgatcgctttggtatcggtgtcgacgagaaaaaatactttaccccttatcgcatcatcggtgcattatttgcggttattgctacgatttttgttgtgtcaccgcagtggcattctacctctttcatcttacttgccattcttccgttcttagctggtttgcttgcaggatggcagcccgctggaaatgcaaaagtagctgaagctacgggatccatgctggtttcaatcacctggaatttcatcgttggattttgtgttttaggcacagcgctagctattcgtgtcgcattagggcacgtcactgttcaattaccagatgtctggtggatgtatcttggcggcccgcttggactaatgtctatcggtttaatggccattttggtcagaggtctggggttactgatgctgggggttgcttcaacggcgggccagttactgggatcagtattgattgacgtattaattccatctctgggcaataccgtttatctggtcacgatcatcggaacactgtttgcactggtcggtgcaattgttaccactattccggaatacagaacctcgaaaacaatgaagaaaatggaggtataa

SEQ ID NO: 4888 - protein, 294 aa, Escherichia coli
MNGQLGHWLQDGNACAVISFASGLVVMFFIIMARKETRQQFAAIPSLIKNRKVPLWNWFAGLCGAMVVFSEGASASALGVATFQTALISALLLSGLLCDRFGIGVDEKKYFTPYRIIGALFAVIATIFVVSPQWHSTSFILLAILPFLAGLLAGWQPAGNAKVAEATGSMLVSITWNFIVGFCVLGTALAIRVALGHVTVQLPDVWWMYLGGPLGLMSIGLMAILVRGLGLLMLGVASTAGQLLGSVLIDVLIPSLGNTVYLVTIIGTLFALVGAIVTTIPEYRTSKTMKKMEV

SEQ ID NO: 4889 - DNA, 1035 bp, Escherichia coli
atgaaagattatctacaaactgtgacgggccccgtcgcccgtgaagatatggggctaacacttcctcatgaacatctgttcaacgatctttcctctgttgtggatgctccttgctatcctttttcacaacggcttgttgataaaaaagtcacggcagaaatccagtgggcattaaaacacgatccttattgctgcgctgataatatggaccgcaaacctattgaagatgtgatcttcgaaattaataactttatctcgctcggtggtcgcaccattgttgatgccacagggtctgagtctatcggacgagatgcgcaggcattacgagaagtcgcattaaaaacaggtctgaatattgttgcttcctccggtccctacctggaaaaatttgaaagccagagaattcataaaacggttgatgaactggcggcaacgatcgataaagaattgaatcaagggattggcgatacggatattcgtgccggaatgatcggtgaaataggtgtctcaccgacatttaccgaagccgagcataacagcttgcgggctgcctcgctggcacagattaacaatcctcatgtggcgatgaatattcacatgccgggctggcttcgtcgcggtgatgaagtactcgacattgtgttaggtgaaatgggcgtctcgccaaataaagtctctctcgcacactcggatccgtcaggaaaagacgtggcgtatcagcggaaaatgcttgataagggtgtctggctggaattcgacatgattggcctagacattaccttcccgaaagagggaatagcgccaggggtgcaggagactgccgatgccgtcgctcatctcattgagttgggatacgccgatcagcttgttctcagccacgatgtcttccttaaacaaatgtgggctaaaaatggcggtaatggctggggatttgttccagatgtttttctggcctatctggcggagcgcggcgtcgataaaacgatcctcaaaaaactctgtatcgataatcccggacgattattgaccgcataa

SEQ ID NO: 4890 - protein, 344 aa, Escherichia coli
MKDYLQTVTGPVAREDMGLTLPHEHLFNDLSSVVDAPCYPFSQRLVDKKVTAEIQWALKHDPYCCADNMDRKPIEDVIFEINNFISLGGRTIVDATGSESIGRDAQALREVALKTGLNIVASSGPYLEKFESQRIHKTVDELAATIDKELNQGIGDTDIRAGMIGEIGVSPTFTEAEHNSLRAASLAQINNPHVAMNIHMPGWLRRGDEVLDIVLGEMGVSPNKVSLAHSDPSGKDVAYQRKMLDKGVWLEFDMIGLDITFPKEGIAPGVQETADAVAHLIELGYADQLVLSHDVFLKQMWAKNGGNGWGFVPDVFLAYLAERGVDKTILKKLCIDNPGRLLTA

SEQ ID NO: 4891 - DNA, 114 bp, Escherichia coli
gtggcgctgaatgaggcgatgggcagcacgcaaagcattatggttgggtcggatggtgagttgtacggcgcatccgactcgcgcttggtggatgatttaacggcggggtattaa

SEQ ID NO: 4892 - protein, 37 aa, Escherichia coli
MALNEAMGSTQSIMVGSDGELYGASDSRLVDDLTAGY

SEQ ID NO: 4893 - DNA, 96 bp, Escherichia coli
gtgctgcaaatggtggtgaacagcatcaattgtggaatgaatgttgccgaagcgaccaatgcgcctcgtttccaccatcagtggttgccggactag

SEQ ID NO: 4894 - protein, 31 aa, Escherichia coli
MLQMVVNSINCGMNVAEATNAPRFHHQWLPD

SEQ ID NO: 4895 - DNA, 858 bp, Escherichia coli
atgttaatagtcaatcttgatactcaccgtcccctcgtcctgcttcccggccgtgatcagcgtacgctggcgacctggttcagaaaatatccggaaatacaggttgtctcgcgtgatcgcagtggagtctatgcgacagcagcacgtgaaggtgcacctcaggccagacaggtggccgatcgatggcacctgctaaaaagtattggtgatgagcctgaacgaatgatgtacagacatatgcctctgatacgtcttgttgtcagagagttatcactgaataaatcacctgagccagaaatatctgtgcctgtagcatcgctccgtcgtccggaacgccttaaacagcaaacccgcaaaaaacggcatcagcattggacagaggttatggccctgcataacaagggatgtagtttcagggaaatatcccgtattacaggcctgtcgcgagtgacagtcagtcgctgggtgcgttcaggaacattccctgaaatgtcaacccggcctccaaagcgagggcttctggacccatggagggagtggttaaaagagcaacgagaaagtggtaattataatgccagccggatatggcgggaaatggtggcccagggggggacaggcagtgaaaccatcgtcagggatactgttgccaaatggcgtaaaggctggaacccaccggttactactgccgcaagacttccttcagtgtcccgggtaagccgctggttgatgccctggagaataatcaggggcgaagaaaattatgcatcccgatttattagtctgatgtgtgaaaaagaaccggagttgaaaatagcacagcaactggtactcgagttctaccgtattctgaaaacctaa

SEQ ID NO: 4896 - protein, 285 aa, Escherichia coli
MLIVNLDTHRPLVLLPGRDQRTLATWFRKYPEIQVVSRDRSGVYATAAREGAPQARQVADRWHLLKSIGDEPERMMYRHMPLIRLVVRELSLNKSPEPEISVPVASLRRPERLKQQTRKKRHQHWTEVMALHNKGCSFREISRITGLSRVTVSRWVRSGTFPEMSTRPPKRGLLDPWREWLKEQRESGNYNASRIWREMVAQGGTGSETIVRDTVAKWRKGWNPPVTTAARLPSVSRVSRWLMPWRIIRGEENYASRFISLMCEKEPELKIAQQLVLEFYRILKT

SEQ ID NO: 4897 - DNA, 411 bp, Escherichia coli
atgcgaattctgaactgttatatggcgaatgacagcaaaggccattttgttacggcgaaagaagcagcgaagcacaaccgccaggacgttttgtgctgtgtgtcctgtggatgcccgttaacacttcagcggggcaatgacggacaaccaccgtggtttgaacatgaccagatgactgtcgctgagaaaatcctgctgcgatgcacctggcttgacccggcagagaaagaggcccgtcgtttgcatctgcagggtatgacggttccggattatacggtgaaggtgagaaagtggttttgtgtgatgtgtgacgaagattatgaaggagaaaagtgctgcccgcgttgtggtaccggggtatacagcagggagggggggctgcaggaaggcaactggaaggataggaactga

SEQ ID NO: 4898 - protein, 136 aa, Escherichia coli
MRILNCYMANDSKGHFVTAKEAAKHNRQDVLCCVSCGCPLTLQRGNDGQPPWFEHDQMTVAEKILLRCTWLDPAEKEARRLHLQGMTVPDYTVKVRKWFCVMCDEDYEGEKCCPRCGTGVYSREGGLQEGNWKDRN

SEQ ID NO: 4899 - DNA, 570 bp, Escherichia coli
atgacctacaaatacaaccccttctggcagcaacgtattcgtgagacagtgcggcacgcactgaatgttcatccccgcctgacggcattgcgggttgacctgcgttttccggatgtaccggcagcaacggacgcagctgtgatatcccgcttcatcaatgccctgaaagcccgaatcgacgcttaccagaaacgtaagcatcgggaaggtaaacgcgtgcatcccaccactctgcattacgtctgggcccgggagtttggggagtgcaaaggtaaaaaacactatcatctgatgctgctggtcaaccgggatacctggtgtcgtgccggtgattaccgcgctccgggatcactggccggaatgattgaacaggcctggtgcagtgccctgggggtggatgccggatgccatgccacgctggtgcattttccggcctggccggcggtgtggctggcgcgtaatgatgacaccggctttcagcaagtgctggaacgtgctgactatctggcgaaggagcataccaaagctcactgcaccggtgagcgcaactttggctgcagtcgtggctga

SEQ ID NO: 4900 - protein, 189 aa, Escherichia coli
MTYKYNPFWQQRIRETVRHALNVHPRLTALRVDLRFPDVPAATDAAVISRFINALKARIDAYQKRKHREGKRVHPTTLHYVWAREFGECKGKKHYHLMLLVNRDTWCRAGDYRAPGSLAGMIEQAWCSALGVDAGCHATLVHFPAWPAVWLARNDDTGFQQVLERADYLAKEHTKAHCTGERNFGCSRG

SEQ ID NO: 4901 - DNA, 1197 bp, Escherichia coli
atgaccgaatccagcgattacgaatccgtccaggtctttatcggcgttgatgtcggtaaagatacgcatcacgctgtagccattaatcgttcaggtaaacgcctgttcgataaagcattacccaacgacgaaaacaaactcaggtcgctaatatctgacctgaaacaacatggtcagatactgctggttgttgatcagccagctaccatcggtgcgttacctgtcgccgttgcccgctcagaaggagtccttgtcggatacctccctggactggccatgcgccgcatagccgacttacacgccggtgaagctaaaactgatgctcgtgacgctgccatcattgccgaagctgcccgtaccctgcctcacgcgctacgcacgctgaaactggctgacgagcaaatcgccgaactctccatgctctgcggcttcgatgatgatcttgccgcacagacaacgcaggccagcaaccgtatccgcggccttctgacccagatacatccggcactggagcgcgttctcggtccgagacttgatcacccggcggtactcgatcttctccagcgatatccctcaccagaaaaactcgcttcgctgggtgagaagaagctggcagcccagctctgcaaacttgcgcctcgtctgggtaaacgccttgcagcagacatagctcaggcactggccgaacaaaccgtcgtcgttcccggcacgaatgccgctgccgtagtactgccacgtctggcactccagctcatcacgctgcgtaagcaaagagacgaggtggcgcttgcggtagaacagcgagttcttgctcaccctctttacccggtcctgaccagtatgcccggagtcggtgtcaggaccgcagccagactcctcaccgaggtcgcctgccgcgccttcgcctctgtcgcacatctcgctgcttatgctggccttgcgccggtaactcggcgatccggctcgtcaatacgcggtgagcatccctcgcgacggggtaataaagctctcaaacgggcgttgttcctgtcggccttcgccgcgctcagggatccgctctccagggcttactacacccgcaaaatgagtcagggaaaacgacacaatcaggcgcttatcgccctggcgagacgacgctgcgacgttctgttcgccatgatgcgcgacgggactttttataccccgcaggcgtcataa

SEQ ID NO: 4902 - protein, 398 aa, Escherichia coli
MTESSDYESVQVFIGVDVGKDTHHAVAINRSGKRLFDKALPNDENKLRSLISDLKQHGQILLVVDQPATIGALPVAVARSEGVLVGYLPGLAMRRIADLHAGEAKTDARDAAIIAEAARTLPHALRTLKLADEQIAELSMLCGFDDDLAAQTTQASNRIRGLLTQIHPALERVLGPRLDHPAVLDLLQRYPSPEKLASLGEKKLAAQLCKLAPRLGKRLAADIAQALAEQTVVVPGTNAAAVVLPRLALQLITLRKQRDEVALAVEQRVLAHPLYPVLTSMPGVGVRTAARLLTEVACRAFASVAHLAAYAGLAPVTRRSGSSIRGEHPSRRGNKALKRALFLSAFAALRDPLSRAYYTRKMSQGKRHNQALIALARRRCDVLFAMMRDGTFYTPQAS

SEQ ID NO: 4903 - DNA, 279 bp, Escherichia coli
atgccggtgaaggtggcgcgctgttttcatgaccacaccggctggtttaacaacatccggaggaacattctcatggctaccccagtttcgctgatggatgaccagatggtcgacatggcgtttatcactcaactgaccggcttaaccgataagtggttttacaaactcatcaaagttgggggctttcctgcccccatcaaaatggggcgcagctcccgctggctgaaaagtgaagtggaagcctggctgcaggcgcgtattgcacagtcccgtccgtaa

SEQ ID NO: 4904 - protein, 92 aa, Escherichia coli
MPVKVARCFHDHTGWFNNIRRNILMATPVSLMDDQMVDMAFITQLTGLTDKWFYKLIKVGGFPAPIKMGRSSRWLKSEVEAWLQARIAQSRP

SEQ ID NO: 4905 - DNA, 111 bp, Escherichia coli
atgtacgccgctattactgtattttaccacagggctggttttctgctgccagccctgtggttatcagacatcaactgtgagcggcatcaaccgatgtacggtatgccataa

SEQ ID NO: 4906 - protein, 36 aa, Escherichia coli
MYAAITVFYHRAGFLLPALWLSDINCERHQPMYGMP

SEQ ID NO: 4907 - DNA, 603 bp, Escherichia coli
atgaaacaacagtatcagacccgttacgagctgctccatgaaaactaccagaaatggctgaccggcttcacccggcacgccgtatcatggggcgtgtgtcatccgaatatctactatttccataatctgacgcccgggtgggtgtcattcaatggcgaaaaaccggagattgccatcgttccccagagtctgcaccggctgatttatggtccggacaaacggagctccccgtccctggatgatgatctggtggtgaatttatgcaccagcgaacacctgctgattcatcatccgatgctggaagggatcctgctgtctgaatgtgagcgcctgaagcaacattctctggcaaacaaactgatcagcctcttccgtcagtttggcggcacggagttacgtctcaaactggtctggctctgctggcttgacttaatgaccggaaacagccttgacgactggacgaaaaacctgaaacacaaatcagaaaaagatctggagcaatggatcattgcacgtcagggtcagagtgaaccactgacaaatctgatggatcagtacgtgcttatggcataccgtacatcggttgatgccgctcacagttga

SEQ ID NO: 4908 - protein, 200 aa, Escherichia coli
MKQQYQTRYELLHENYQKWLTGFTRHAVSWGVCHPNIYYFHNLTPGWVSFNGEKPEIAIVPQSLHRLIYGPDKRSSPSLDDDLVVNLCTSEHLLIHHPMLEGILLSECERLKQHSLANKLISLFRQFGGTELRLKLVWLCWLDLMTGNSLDDWTKNLKHKSEKDLEQWIIARQGQSEPLTNLMDQYVLMAYRTSVDAAHS

SEQ ID NO: 4909 - DNA, 99 bp, Escherichia coli
gtgaagatggaggcacctggttgtgaagaacgtttctgcccgtggctgcttcgcatcatcaatggtattcatacccgctcagaaatgaccgggtgctga

SEQ ID NO: 4910 - protein, 32 aa, Escherichia coli
MKMEAPGCEERFCPWLLRIINGIHTRSEMTGC

SEQ ID NO: 4911 - DNA, 780 bp, Escherichia coli
atgatggaactgcaacatcaacgactgatggcgctcgccgggcagttgcaactggaaagccttataagcgcagcgcctgcgctgtcacaacaggcagtagaccaggaatggagttatatggacttcctggagcatctgcttcatgaagaaaaactggcacgtcatcaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagccgtccgtgcaggtatcaaagttcgcttcacaacagcagcagatctgttacttcagttatctacggaacaacgtcagggccgttataaaacgacgcttcagcgtggagtaatggccccccgcctgctcatcattgatgaaataggctatctgccgttcagtcaggaagaagcaaaactgttcttccaggtcattgctaaacgttacgaaaagagcgcaatgatcctgacatccaatctgccgttcgggcagtgggatcaaacgttcgccggtgatgcagcactgacctcagcgatgctggaccgtatcttacaccactcacatgtcgttcaaatcaaaggagaaagctatcgactcagacagaaacgaaaagccggggttatagcagaagctaatcctgagtaa

SEQ ID NO: 4912 - protein, 259 aa, Escherichia coli
MMELQHQRLMALAGQLQLESLISAAPALSQQAVDQEWSYMDFLEHLLHEEKLARHQRKQAMYTRMAAFPAVKTFEEYDFTFATGAPQKQLQSLRSLSFIERNENIVLLGPSGVGKTHLAIAMGYEAVRAGIKVRFTTAADLLLQLSTEQRQGRYKTTLQRGVMAPRLLIIDEIGYLPFSQEEAKLFFQVIAKRYEKSAMILTSNLPFGQWDQTFAGDAALTSAMLDRILHHSHVVQIKGESYRLRQKRKAGVIAEANPE

SEQ ID NO: 4913 - DNA, 1023 bp, Escherichia coli
atggtcacttttgagacagttatggaaattaaaatcctgcacaagcagggaatgagtagccgggcgattgccagagaactggggatctcccgcaatacggttaaacgttatttgcaggcaaaatctgagccgccaaaatatacgccgcgacctgctgttgcttcactcctggatgaataccgggattatattcgtcaacgcatcgccgatgctcatccttacaaaatcccggcaacggtaatcgctcgcgagatcagagaccagggatatcgtggcggaatgaccattctcaggggattcattcgttctctctcggttcctcaggagcaggagcctgccgttcggttcgaaactgaacccggacgacagatgcaggttgactggggcactatgcgtaatggccgctcaccgcttcacgtgttcgttgctgttctcggatacagccgaatgttgtacatcgaattcactgacaatatgcgttatgacacgctggaaacctgccatcgtaatgcgttccgcttctttggtggtgtgccgcgcgaagtgttgtatgacaatatgaaaactgtggttctgcaacgtgacgcatatcagaccggtcagcaccggttccatccttcgctgtggcagttcggcaaggagatgggcttctctccccgactgtgtcgccccttcagggcacagactaaaggtaaggtggaacggatggtgcagtacacccgtaacagtttttacatcccactaatgactcgcctgcgcccgatggggatcactgtcgatgttgaaacagccaaccgccacggtctgcgctggttgcacgatgtcgctaaccaacgaaagcatgaaacaatccaggcccgtccctgcgatcgctggctcgaagagcagcagtccatgctggcactgcctccggagaaaaaagagtatgacgtgcatcctagtgaaaatctggtgaacttcgacaaacaccccctgcatcatccactctccatctacgactcattctgcagaggagtggcgtga

SEQ ID NO: 4914 - protein, 340 aa, Escherichia coli
MVTFETVMEIKILHKQGMSSRAIARELGISRNTVKRYLQAKSEPPKYTPRPAVASLLDEYRDYIRQRIADAHPYKIPATVIAREIRDQGYRGGMTILRGFIRSLSVPQEQEPAVRFETEPGRQMQVDWGTMRNGRSPLHVFVAVLGYSRMLYIEFTDNMRYDTLETCHRNAFRFFGGVPREVLYDNMKTVVLQRDAYQTGQHRFHPSLWQFGKEMGFSPRLCRPFRAQTKGKVERMVQYTRNSFYIPLMTRLRPMGITVDVETANRHGLRWLHDVANQRKHETIQARPCDRWLEEQQSMLALPPEKKEYDVHPSENLVNFDKHPLHHPLSIYDSFCRGVA

SEQ ID NO: 4915 - DNA, 1173 bp, Escherichia coli
atgtgggaagagcaggtgaggtgtattgtgggaaaggaactggatgatatctgcaccagctgtccgtatatcgatgctataaaacggcacaaacaacagctcggtgccatagaggaatatacacagtggttaaaaaaagaaccacgggcatcttatttttttctgttccggctgtatacccgcattcacaatacatttttccccaaaaagcaacaactcccgttcactcccggtggcactcactgcccggaacctgatgtcacccttcgggacttaacgctttccccgggctaccacagtgattatgcccctcaacccattccggagatggacagttctgctgttgttcccccaactaatgaaaacacctcgcctccggaagatactcccgacaacactccggccggaggcaataccggacaagcggaaaagaccagaaactcaggactcacacccattcctgaaaaacgttcaggaatgcccccggaacatctgcggtttgccacagggtttccaccgcaaccgaagattgccggtcccaaaggaaagccgatgcgcaccgtgcatccggataaaatctaccgtgaaattatatggttctgctccggttacctgcggaaatccggaccagaggctacgaggacgatcatcaactcaatattctgtgaatgggccagcatcttcaatgattactcctcccccttttcgtgggtggacagcagggacagtgaacagtgtgactggttatggaacgccatgcaggtccggtgtgtgggaaccccgctgaatccccttaccccggagcagaaatactggttcgcctgcgccacgtttgataactgggaaggctggaatgagcaacaggtacagtttttactggaaagtaatcccagacggaacagagcgaagtttacgcaggcctccttccaggcccccaggattcagcataaagcgattcttcttgatgagctgaaaagtgcccgggagcaacaaaaaaggcgtgatgaacgtgctgatggttccgtcccgctgaaactgtccggaaaaatccacaaacagcttgaaagtattgcccgaagtcgtggtgtcctcccaaaaaaactgctgaatgaaatgattgagcaggcgtaccaggactttgtggcaaatgagcaacacaagacactgagttaa

SEQ ID NO: 4916 - protein, 390 aa, Escherichia coli
MWEEQVRCIVGKELDDICTSCPYIDAIKRHKQQLGAIEEYTQWLKKEPRASYFFLFRLYTRIHNTFFPKKQQLPFTPGGTHCPEPDVTLRDLTLSPGYHSDYAPQPIPEMDSSAVVPPTNENTSPPEDTPDNTPAGGNTGQAEKTRNSGLTPIPEKRSGMPPEHLRFATGFPPQPKIAGPKGKPMRTVHPDKIYREIIWFCSGYLRKSGPEATRTIINSIFCEWASIFNDYSSPFSWVDSRDSEQCDWLWNAMQVRCVGTPLNPLTPEQKYWFACATFDNWEGWNEQQVQFLLESNPRRNRAKFTQASFQAPRIQHKAILLDELKSAREQQKRRDERADGSVPLKLSGKIHKQLESIARSRGVLPKKLLNEMIEQAYQDFVANEQHKTLS

SEQ ID NO: 4917 - DNA, 768 bp, Escherichia coli
atgagcgggcttacgattaatgcgctgtgcgccggttacggcaaacggcggattattgagcatctgtcgatttctacgctgccgcgcggcgaagtcactgtactgctggggcctaatggctgcggtaaatcaacgctactgcgcgccctggccgggctaaatcgcgccagtggcgaagcctggctgaatgaagagaatctcttatcgctgccgtttgctcgtcgggctgaaaaagttgtgttcctgccgcagtccctgccgcagggcgtgcatttacaggtgctggagtcggtggttgtcgcccagcgcgcctccggcgccgggcaaaatcaggcgcaggctatagcgctgctcgaagagctaggcatcgcacatctggcaatgaactacctcgatagcctgtccggcggtcagaagcagctggtggggcttgcacagtcgcttattcgccgccccgcattattattgctggatgaaccactgagcgcgctggatctcaattatcagttccatgtgatggatgttgtatcgcgcgaaacgcgaagacgcaatatggttacgctggtcgtcttacacgatatcaatatcgcactgcggcatgccgcccaggtcatcatgctgaaagaggggaaacttatcgacagcggcgacccgcaaacggtgatccatgcagagagccttgcgcaggtatacggcgtacgcgggagagttgaacgttgtgctcagggaagatcgatggtgatagtggatggtgcaatcgaaaaatag

SEQ ID NO: 4918 - protein, 255 aa, Escherichia coli
MSGLTINALCAGYGKRRIIEHLSISTLPRGEVTVLLGPNGCGKSTLLRALAGLNRASGEAWLNEENLLSLPFARRAEKVVFLPQSLPQGVHLQVLESVVVAQRASGAGQNQAQAIALLEELGIAHLAMNYLDSLSGGQKQLVGLAQSLIRRPALLLLDEPLSALDLNYQFHVMDVVSRETRRRNMVTLVVLHDINIALRHAAQVIMLKEGKLIDSGDPQTVIHAESLAQVYGVRGRVERCAQGRSMVIVDGAIEK

SEQ ID NO: 4919 - DNA, 1059 bp, Escherichia coli
atgactgtattggaaagtacgctgtcggtcgagaaccgctatcgccagctttttcgccagcgtctggtaatactggcggttatttttatcgctatcattgcttcgctgctgctcgatttcaccctcggcccctcagggctccctttacattcgctgataaagactttgatgcatccgtccggggcgactaacggcatgcgggttatcgtttgggacatccgtttgccctatgcgctgatggcgctcctggtaggaatggcgctgggtttggccggggcagagatgcaaactattctgaataactccctcgccagcccgtttacgcttggcgtttcgtcggcggcggcctttggcgcagcgctggcgattgttctgggcatcggtattcccggcgttcccgaaagcgggtttataccggcaaacgcttttctttttgcgctcctgtccgccctgctgctcgatagtctgacccgctggacgcgcgtgccgacgtcgggcgttgtgctgtttgggattgcgctggtgtttaccttcaatgcgctggtgtccattatgcagtttgtcgccgatgaagatactttgcagggcctggtgttctggacgatgggcagcctggctcgcgcatcatgggagaaactggcggtgctggcggcggcgatggcgattgttttaccctggtcgctgcgtcgtgcctggcagcttaccgcgctacgcctcggcgaagagcgggcgatgagttttggcattgatgttcgccgtttgcgcctgggttccctgctgcgcatcagcctgctggcggccctttcggttgcgtttgtggggccaattggctttattggcctggttgcaccgcatatttctcgcctgttgctgggagaagatcatcgcttttatttgcccggaagcatccttatcggtgggctggtgctatcgctggcctcggtagcgtcgaagaacatcattcccggtgtcattttaccggtaggaattgttacctcgctggtaggcgttccgttctttctgagcattgtaatgcgtcatcgagggagtatgtcatga

SEQ ID NO: 4920 - protein, 352 aa, Escherichia coli
MTVLESTLSVENRYRQLFRQRLVILAVIFIAIIASLLLDFTLGPSGLPLHSLIKTLMHPSGATNGMRVIVWDIRLPYALMALLVGMALGLAGAEMQTILNNSLASPFTLGVSSAAAFGAALAIVLGIGIPGVPESGFIPANAFLFALLSALLLDSLTRWTRVPTSGVVLFGIALVFTFNALVSIMQFVADEDTLQGLVFWTMGSLARASWEKLAVLAAAMAIVLPWSLRRAWQLTALRLGEERAMSFGIDVRRLRLGSLLRISLLAALSVAFVGPIGFIGLVAPHISRLLLGEDHRFYLPGSILIGGLVLSLASVASKNIIPGVILPVGIVTSLVGVPFFLSIVMRHRGSMS

SEQ ID NO: 4921 - DNA, 867 bp, Escherichia coli
atgctggggtacggcgataacattgtcggaacctcgatgattgcaaaaaggatccccctgtttcgccagagcctgccgcgcatagagaaagtcgcagcagttagcgtaaacagcgggcatgaaatcaatcccgaacagattatcgcgctgggggtcgatatgctttttgtaccgcagaatatggtagtgcctcaacaggcgttgctgaaacaggctggggtgcaggtgctggcgtttgaggcgaattcactgcgggcgttaacgcagcgcgtacagcaaacggcagcggtgctggggcccgatgcgcagcaaaaagcgctcgcctatcaacgctacttcgatcgcaacgtggccctggtcaccgggcgcctgaaagatcttcctgcgtcacagcgcgtgtcgctctatcacagtatgggcaatccgctgaccaccaccggtagaccctcgctaaaccaggactggattgacctggccggcggcaaaaatatcgctgaaaattggtttggcgagcatcaacaaaaccgttcgggtgaagtcgcgctggagaaaattgtcactgccaatccggcggttatcatcgcgatgaacaagcgcgacgcggatgccattctgagttctccgcagtgggcaagcgtggacgcggtcattcatcatcgcgtttacgttaatccgaaaggaatgttctggtggtgccgtgaaaccagcgaagaggcgctgcaatttttgtggctggcgaaaacgctttatcctgcgcgatttgctgatgtggatatacgcaaagagacgcgtgagttttatcggcagttctttggcctgacgttaagcgatgcgcagatgagcgatgtgctcaatccgccgcgctaa

SEQ ID NO: 4922 - protein, 288 aa, Escherichia coli
MLGYGDNIVGTSMIAKRIPLFRQSLPRIEKVAAVSVNSGHEINPEQIIALGVDMLFVPQNMVVPQQALLKQAGVQVLAFEANSLRALTQRVQQTAAVLGPDAQQKALAYQRYFDRNVALVTGRLKDLPASQRVSLYHSMGNPLTTTGRPSLNQDWIDLAGGKNIAENWFGEHQQNRSGEVALEKIVTANPAVIIAMNKRDADAILSSPQWASVDAVIHHRVYVNPKGMFWWCRETSEEALQFLWLAKTLYPARFADVDIRKETREFYRQFFGLTLSDAQMSDVLNPPR

SEQ ID NO: 4923 - DNA, 2166 bp, Escherichia coli
atgaaaactcaaataactttcgctgcgcttttgccagcattagcgtctttcataccgcttcatgctcatgcctcgtctacttctgaagatgaaatgattgtcacgggcaacaccgccgccgacaccaccgattctgccgccggtgccggtttcaaaacgaacgatatagatgtcggcccgctgggaacgaaatcctggatcgaaacaccatattccagcaccactgttactaaagagatgattgaaaatcagcaggcgcaaagcgtcagcgagatgctgaaatactctcccagtacgcaaatgcaggcgcgcggtggaatggatgtcgggcgtccgcaaagtcgggggatgcagggcagcgtggtggccaacagccgtctggacgggctgaatatcgtttcaacaaccgcgtttccggtggaaatgcttgagcgcatggatgtgcttaacagtttgaccggcgcgctgtacggcccggcgagcccagcagggcagtttaatttcgtggcgaagcgcccaaccgaagagacgctgcgtaaagtgacgctgggctatcaaagccgcagtgcgtttaccggccatgccgatctgggtggccattttgatgaaaacaaacggtttggctatcgcgtgaacctgcttgatcaggaaggggaaggcaatgtggatgacagcacgctgcgtcgcaaactcgtttccgttgcgctcgactggaatattcagccgggcactcagctacagctcgacgccagccattacgaatttatccagaaaggctatgtcggtagctttaactatgggccgaacgtcaaactgccgtctgcgccgaatccgaaggacaaaaatctggcgctcagcactgcgggcaacgacctcactaccgataccatcagcactcgcctgatccactactttaacgacgactggtccatgaacgctggcgtgggctggcagcaggctgaccgcgcgatgcgtagtgtttccagtaaaatactcaacaatcagggcgatatctctcgttcgatgaaggattccaccgctgccggacgttttcgcgtcctgagcaacaccgccgggctgaatggtcatattgataccggctctatcggccacgatctgtcactttctaccacgggatatgtctggtcgctttatagtgccaaaggaacaggttccagctatagctggggtacaacaaatatgtatcacccggatgcgatagatgagcagggcgatggcaaaatccgcaccggcgggccgcgataccgctccagcgtaaatactcagcagagcgttacgctcggcgatacggtgacatttacgccgcagtggtcggcaatgttctatctcagccagagctggctgcagactaaaaactacgataagcacggtaatcaaacgaaccaggttgatgaaaatggtttaagtccgaacgccgcgctgatgtataaaattacccctaacacaatggcctacgttagctatgccgattcgctggagcagggcggtaccgcaccgacggatgagagcgtaaaaaatgccggtcaaacgctaaacccgtatcgcagcaagcagtatgaagtggggctaaaatcggacatcggcgagatgaatctaggcgccgcgctgttccgactggaacgtccgtttgcctatcttgatacggataacgtgtataaagagcagggtaaccaggttaacaacggccttgagttaaccgctgccgggaatgtgtggcaggggctgaatatttacagcggcgtgaccttcctcgacccgaaactgaaagatacggcgaatgcctcaaccagcaataaacaggttgtcggcgtgccgaaagtgcaggccaatctgttggcggaatacagtttgccgtccataccggaatgggtttacagcgctaacgtccattatacgggcaaacgcgcggcgaacgataccaacacctcttacgccagcagctataccacatgggatttgggaacgcgttacaccacgaaagtgagcaacgtcccaaccactttccgcgtggtggtaaacaacgtgtttgataaacattactgggcttctatcttcccatcgggtaccgatggcgataacggttccccaagtgcgtttatcggcggcggccgcgaagtgcgtgcatccgtcaccttcgatttctga

SEQ ID NO: 4924 - protein, 721 aa, Escherichia coli
MKTQITFAALLPALASFIPLHAHASSTSEDEMIVTGNTAADTTDSAAGAGFKTNDIDVGPLGTKSWIETPYSSTTVTKEMIENQQAQSVSEMLKYSPSTQMQARGGMDVGRPQSRGMQGSVVANSRLDGLNIVSTTAFPVEMLERMDVLNSLTGALYGPASPAGQFNFVAKRPTEETLRKVTLGYQSRSAFTGHADLGGHFDENKRFGYRVNLLDQEGEGNVDDSTLRRKLVSVALDWNIQPGTQLQLDASHYEFIQKGYVGSFNYGPNVKLPSAPNPKDKNLALSTAGNDLTTDTISTRLIHYFNDDWSMNAGVGWQQADRAMRSVSSKILNNQGDISRSMKDSTAAGRFRVLSNTAGLNGHIDTGSIGHDLSLSTTGYVWSLYSAKGTGSSYSWGTTNMYHPDAIDEQGDGKIRTGGPRYRSSVNTQQSVTLGDTVTFTPQWSAMFYLSQSWLQTKNYDKHGNQTNQVDENGLSPNAALMYKITPNTMAYVSYADSLEQGGTAPTDESVKNAGQTLNPYRSKQYEVGLKSDIGEMNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLGTRYTTKVSNVPTTFRVVVNNVFDKHYWASIFPSGTDGDNGSPSAFIGGGREVRASVTFDF

SEQ ID NO: 4925 - DNA, 474 bp, Escherichia coli
gtgcacggggttttgtcttttttcactgggaatacatgtatgaatccgtctgatgccattgaggcaattgaaaaaccgctctcctccctgccttacccgatttcccgtcacatcctggaacatctgcgcaaactcacccgtcacgaacccgtgcctggcattatgggtaaaagcggggccggtaaatcctcactctgtaatgcactgtttcagggggaggtcaccccggtcagtgcactcatgacagtgcttcccggacatgccgccatccatctgatgacacgcctgcaggacgaactgcgcacggagtctgtccgcactcagacccgtgaacagtttaccggtgcggtggaccggatatttgacacggcggagagtgtctgcattgcctctgttgcacgcacggttctgcgcgccgtccgtgactcggtggtctctgttgcccgcgcggtatggaactggattttcttctga

SEQ ID NO: 4926 - protein, 157 aa, Escherichia coli
MHGVLSFFTGNTCMNPSDAIEAIEKPLSSLPYPISRHILEHLRKLTRHEPVPGIMGKSGAGKSSLCNALFQGEVTPVSALMTVLPGHAAIHLMTRLQDELRTESVRTQTREQFTGAVDRIFDTAESVCIASVARTVLRAVRDSVVSVARAVWNWIFF

SEQ ID NO: 4927 - DNA, 177 bp, Escherichia coli
gtgcaggctggtcacggtcgattcgatttgcgtcatcagttcaagggcttccctgcgatcactgaattttatttcggggctgtcgggatcaaagtcccgcatcctgtcatgctgatttccggttccgaaaatatcgtgaaagaaagcgaatgcgtttctctcccggggctgcgctga

SEQ ID NO: 4928 - protein, 58 aa, Escherichia coli
MQAGHGRFDLRHQFKGFPAITEFYFGAVGIKVPHPVMLISGSENIVKESECVSLPGLR

SEQ ID NO: 4929 - DNA, 2385 bp, Escherichia coli
atgcacgaaaagaacatcgccctgctttgtgatgaagccgaccgacttttgcaactgaacattaatctgctccggcaaatggttgaggagccagatgtgttatctgacagtaagaacgaaaacagactgctttttgataaacagaaagcactgaaaagaattgaggagctggagggcgaacaaatcaaaaccgcccgcagggagatggtgctggctgttgtcggcacgatgaaagcaggcaaatcaaccaccatcaacgccattgtggggcaggaaattctgcctaaccgtaaccgccccatgacctctgtaccgacgctcatccgccacgttcccggaaaaactgagccggttctccatctggaacatattcagcctgtccgcaatttattaatcacactgcaggaaaaactcgccaccccggcaggacagcaggtcgcacagaccctgcagcaaaccggggatacccgcgaactgctggatattctgacggatgatggctggctcaaaaatgaataccacggggaggaggaaatctttaccggactggcatcgttaaacgatctggttcgtcttgctgcggcaatggggactgaatttccttttgatgaatacgcagaagtgcagaaactgccggtgatcgacgtggaattcagccatctggtggggatggatgcatgccagggaacactcacactgctggatacccccggccctaatgaggccggacaaccgcagatggaagtgatgatgcgggatcaactgcagaaagcctctgcggttctggctgtgatggattacacccagatgaactcaaaagcggatgaagacgtccgtaaagagcttaatgccattgctgacgtatcaaccggccgcctgtttgtactggtcaataaatttgatgagaaagaccgcaatggcgatggggcagatgccgtacgccagaaagttccggcaatgctgaacagcgatgtgctgcccgcctcccgcgtttatcccggatcctcacgccaggcatacctggctaaccgtgcgcttcatgagttacggaaaaacggaacccttcctgttgatgaagcctgggtcgatgattttgtcagggaagccttcggtcgcatgaaaaaagattacgtctgtaaagacagcgaactggcaactgaaggggcgacagacctgtgggaatgctcacttatcgatcaactgataacggaagtcatactgagttcacactccagagctgcggcactggcggttgattctgccgccgcaaaactgatgcagaatgcagaaaatatcagtgaatacctgtcgttacgccatcaggggctgatgcaaagtattcagtcactgcaggcgcatatcaccagcctgcttgaggatatccgggaaatagcagactgtcaggagcaggtgaccgctgatgtcagaatggccatggaggagatcgatgccagaacccgggaattactgacgggggtctgcacctcactggaagaggagctgaatgactatttcagaagcggtaaacgcaaagaacagcaaatgctggaggaagaaaattcagcgcagccccgggagagaaacgcattcgctttctttcacgatattttcggaaccggaaatcagcatgacaggatgcgggactttgatcccgacagccccgaaataaaattcagtgatcgcagggaagcccttgaactgatgacgcaaatcgaatcgaccgtgaccagcctgcaccgtgaggctgaagcacagttccggcctgagctggagaaaatcgtcagcgggattgaaacaggttttcgtggcacggccctgtacgccacagaaaacattgccggtcgcatcaatacccgcctggaggatgagggctttaccgtaaaaatcagttttccggcagtcagtcagttacaaacccggctcgcggtaaaaacaaatctgagtgcgcttatggaggaaagaacggagaccgtcacccgtcgccgtcggcagagtggtttatggggaaagatttgtggagcgtttggcaccagtgactggggctgggaaacctataaagaggatgtgagccgcagtgttatcaatatcaacaccgtcaggaaggaagttatgtcactgacccgggcatatttcggggagctgcaggcatccattgagcaggatattaaccagcccgtccgccaggaaatcgatgcctttttctgcgcattcagggagaaagttgaacaactgcgtaacacgctgattcagagctctgaagatcataaacgcgatcagcaggcacaggaacggcttaccaggcgacttcaggcattaaatgaaagggttcctgagctcattactgacagtaaggcgctgagggaagagctggagacaatgctgtga

SEQ ID NO: 4930 - protein, 794 aa, Escherichia coli
MHEKNIALLCDEADRLLQLNINLLRQMVEEPDVLSDSKNENRLLFDKQKALKRIEELEGEQIKTARREMVLAVVGTMKAGKSTTINAIVGQEILPNRNRPMTSVPTLIRHVPGKTEPVLHLEHIQPVRNLLITLQEKLATPAGQQVAQTLQQTGDTRELLDILTDDGWLKNEYHGEEEIFTGLASLNDLVRLAAAMGTEFPFDEYAEVQKLPVIDVEFSHLVGMDACQGTLTLLDTPGPNEAGQPQMEVMMRDQLQKASAVLAVMDYTQMNSKADEDVRKELNAIADVSTGRLFVLVNKFDEKDRNGDGADAVRQKVPAMLNSDVLPASRVYPGSSRQAYLANRALHELRKNGTLPVDEAWVDDFVREAFGRMKKDYVCKDSELATEGATDLWECSLIDQLITEVILSSHSRAAALAVDSAAAKLMQNAENISEYLSLRHQGLMQSIQSLQAHITSLLEDIREIADCQEQVTADVRMAMEEIDARTRELLTGVCTSLEEELNDYFRSGKRKEQQMLEEENSAQPRERNAFAFFHDIFGTGNQHDRMRDFDPDSPEIKFSDRREALELMTQIESTVTSLHREAEAQFRPELEKIVSGIETGFRGTALYATENIAGRINTRLEDEGFTVKISFPAVSQLQTRLAVKTNLSALMEERTETVTRRRRQSGLWGKICGAFGTSDWGWETYKEDVSRSVININTVRKEVMSLTRAYFGELQASIEQDINQPVRQEIDAFFCAFREKVEQLRNTLIQSSEDHKRDQQAQERLTRRLQALNERVPELITDSKALREELETML

SEQ ID NO: 4931 - DNA, 906 bp, Escherichia coli
gtgacttcaccatttattcaacaaattgctgataaccgggtatgtcaggtactcacctgtcttcctgaaaaatttgtggttgatttcgcaaacggaatcgatgttgcacaggagcatatccgcacggccggagagcgcacgttcttccggcgtttaaaagagggactgaccggcgaaggcgctgcacggcagaatgccatcaatgcttcggttgcacagggccttgaggcgtccctgcgctggctgacggagctgacaacgtcacttgccaccacaaactacgcgattacccgggtaaacgacagggtcagttcactggtcagtgatactgccaggctggcgcattattccgcagatacacgggagcagttactcatcctggccgatcaggttcaccataaactgaatcatcttgaagaaaaactccaccgtgttgaccaggttcagcgggcgcagttacatcttgagcagatattctcatggtggagcgccgggcgatatgcgtcattttcccctgccggacgttgttatgtggcgcttgaagagcttcgctggggcgcgtttggtgatgtgatacgtcagggcgaaacaggccaggttaaccagctactggatattctcagacataaagcattaacgcagatggcacaggagagtggcggtagtgcaaccgtgcgtctgaacactctggactggcttggtggtcagggccgggagcaggcagataacgagtggcatgacgcgattaactggctgggagactggtgcagtgaagagcagcatccggtgatctggtcaaccacgcaggctgcagaacacttaccggttcgcatgcctcgcctctgctctgcagaacgcctctctgaaagtatggtcgatgaaatatttcagaagggggctgcatga

SEQ ID NO: 4932 - protein, 301 aa, Escherichia coli
MTSPFIQQIADNRVCQVLTCLPEKFVVDFANGIDVAQEHIRTAGERTFFRRLKEGLTGEGAARQNAINASVAQGLEASLRWLTELTTSLATTNYAITRVNDRVSSLVSDTARLAHYSADTREQLLILADQVHHKLNHLEEKLHRVDQVQRAQLHLEQIFSWWSAGRYASFSPAGRCYVALEELRWGAFGDVIRQGETGQVNQLLDILRHKALTQMAQESGGSATVRLNTLDWLGGQGREQADNEWHDAINWLGDWCSEEQHPVIWSTTQAAEHLPVRMPRLCSAERLSESMVDEIFQKGAA

SEQ ID NO: 4933 - DNA, 1071 bp, Escherichia coli
atgagtacagaaatgaaaacggggctggtgctgtccggtggcggggcggtgggcgcttatcaggcgggagtggttaaggcactggcagagtgtggtacacagatcagcatggtttcaggggccagcattggcgcattcaatggtgccattatcgcggcctctcccgatctgtcagaagctgccgtacgcctggaggcgctctgggatcatctggggaataatcaggtgctgtcggtaaaccgattggtttacttttcattgctgaaaaaattgttccaggcaatgaacctctgccagatccccggacgtgcaggagcactgcttacgacgcttcttcgccatatatcgatactcaacgggtttgacaatctgatggctcagccgttgttgtcagatgagcccctgacagcgctgttggatcattatcttgatactgatgctctggcagacgggctaccgctgtatgtgtcgctgtaccccacagaagggggcatgcaggatattattgactgcattcgtgctgaactgggtgccggaaccacgaaaaacgccgtttttcagcatatccagagcctgccccgcggacagcagaaagaggctctgcttgcgtcagccgcgctgcccctgctgttccgtccccgtgaggttcaggggacaatgttcggtgatggtggtatgggaggatggcgaaatatgcagggaaatacccctgtgacgcctctggtcgatgccggatgcaatatggtgattgtgacgcatctgagtgacggttctttatgggatcgccaggcttttccggacaccacaatccttgagatccgtccccggaaaaggctgaaatatgcaggtgatggtgacaacagcggcggtctgctcagtttcacgttggcacataccgacgcctggcgtcagcagggctatgaagacacgatgctgacgatggagcatatccggaaaccgctggcagcacgtcaggtactgtcccggtcagaaacggtgttgcagaaaagtctggagataacggaagaggcagatttggcactgagaaacgcgatggcccggattaaataa

SEQ ID NO: 4934 - protein, 356 aa, Escherichia coli
MSTEMKTGLVLSGGGAVGAYQAGVVKALAECGTQISMVSGASIGAFNGAIIAASPDLSEAAVRLEALWDHLGNNQVLSVNRLVYFSLLKKLFQAMNLCQIPGRAGALLTTLLRHISILNGFDNLMAQPLLSDEPLTALLDHYLDTDALADGLPLYVSLYPTEGGMQDIIDCIRAELGAGTTKNAVFQHIQSLPRGQQKEALLASAALPLLFRPREVQGTMFGDGGMGGWRNMQGNTPVTPLVDAGCNMVIVTHLSDGSLWDRQAFPDTTILEIRPRKRLKYAGDGDNSGGLLSFTLAHTDAWRQQGYEDTMLTMEHIRKPLAARQVLSRSETVLQKSLEITEEADLALRNAMARIK

SEQ ID NO: 4935 - DNA, 786 bp, Escherichia coli
gtggtggtgtttttcctggctggtgttattgaaaatattttcagatatatattacctgagagaaagttttacccctcacctgtcaattcactcactggaaatttaattatgcaattacctgtaaagttattaatgagccttatatctctggtcagcgttattgcacgtgccgggaaatataaaaattacatccgggatgaaataaaatactggcgatatacatcatacaaggggggggaatttccggaaggtttcactgatgagaaattttccagcgccatttacaacggaagaatatttacaatgaaacgtttacataccctgatgttatttctggcggttctgtttactggctttaacgtggaagcagcgagcgtgaaacaagcgctcagctgcgacccaaacgcccgggctgaacaacctggagcgtgtccaacaacgtacgagttgtacgaaggtgacgctgcctacaaagctgcgcttgacaaagcattaaaaccggtcggactgagcggcatgttcggtaaaggcgggtatatggatggccctggcggaaacgtaacgccagtaaccattaacggtacagtctggctccagggcgacggttgcaaagccaatacctgcggctgggactttatcgtaacactctataacccaaaaacccatgaagtcgttggctaccgctactttggtttagatgacccggcctacctggtttggttcggcgaaattggcgtgcatgaattcgcgtatctggtgaaaaactacgtagctgcggttaactaa

SEQ ID NO: 4936 - protein, 261 aa, Escherichia coli
MVVFFLAGVIENIFRYILPERKFYPSPVNSLTGNLIMQLPVKLLMSLISLVSVIARAGKYKNYIRDEIKYWRYTSYKGGEFPEGFTDEKFSSAIYNGRIFTMKRLHTLMLFLAVLFTGFNVEAASVKQALSCDPNARAEQPGACPTTYELYEGDAAYKAALDKALKPVGLSGMFGKGGYMDGPGGNVTPVTINGTVWLQGDGCKANTCGWDFIVTLYNPKTHEVVGYRYFGLDDPAYLVWFGEIGVHEFAYLVKNYVAAVN

SEQ ID NO: 4937 - DNA, 411 bp, Escherichia coli
atgaaaacttttatcaaaactttactcgttgctgtaactattctgttctctgtcttcgctacggcgaaacaagtaaaactgccaaacaacatcaaatacgttaatactacagaggcgttttcctgtactgagattgacggtatgaattgccagacgaagaatccgtttaactataaagataacagctatgttttcgtgcttgaacgtggtggtgcctggtgttacgactacactgtctcggtacttaacctgaaaaccgggaaagcacagatgctcgaatacaaagacaaccagctgtgctcaggtagcaacaaaccgttcttcgaaatcaaaaatggcgtaccgacggtaggagtcatcgacacatccggaaaacctgtcgttgtggctctggacaaacttaaaacctga

SEQ ID NO: 4938 - protein, 136 aa, Escherichia coli
MKTFIKTLLVAVTILFSVFATAKQVKLPNNIKYVNTTEAFSCTEIDGMNCQTKNPFNYKDNSYVFVLERGGAWCYDYTVSVLNLKTGKAQMLEYKDNQLCSGSNKPFFEIKNGVPTVGVIDTSGKPVVVALDKLKT

SEQ ID NO: 4939 - DNA, 858 bp, Escherichia coli
gtgattctggtgcctgaatcacgccttcagggacagattgcatcagcgcaggctctccagcatcgtttctgccatcacccacaatgcacggttgagcttaatgtcggtatcaatgctgtgaatggcccgggtatggatacgttttccttttgcactgcgaccggaaatcccgcctttcagcatattctcctggatggtctgataagcactccacaggtccttaccgtaatcctcccggcgtcgtggcgtcagaatgtcggcggtggtgacgggctgatgttcgtcaccataacggtaagtcagtgccgcctgtgccagcgcctggcgtgccggtggcggcaggaccagcgactgcatggcatcacgcttctcctctatccggtcaaacacgcccaccacctcgtaagccccttcaataactttctccactacgtctccccggtgtggaacacgcacttcccccagagactgaccacagacgcagccgttctggcagacgaacctgaagtaacccggcagcatctggtagctggaggtaccgtcatgagagttgagcagaataatttcagggacatgctctccgtttatctctccgttacggcgcaggcgcagcatgtgttttgtgtatccccggcggcccgggtcgcgcacacaggtctggcaggcgaagaatggctgaaaaccttcctgctgcaggctttccagtacggtgatggtggggatgtacgtatagttctggcttcgggacgtgtgtttctcttccccgaaaatccccggcacatggtgcatcagctcttcatgtgtcagtggacggtcacggcgtatctggtttgcagcataaccaaaacgacttgctaa

SEQ ID NO: 4940 - protein, 285 aa, Escherichia coli
MILVPESRLQGQIASAQALQHRFCHHPQCTVELNVGINAVNGPGMDTFSFCTATGNPAFQHILLDGLISTPQVLTVILPASWRQNVGGGDGLMFVTITVSQCRLCQRLACRWRQDQRLHGITLLLYPVKHAHHLVSPFNNFLHYVSPVWNTHFPQRLTTDAAVLADEPEVTRQHLVAGGTVMRVEQNNFRDMLSVYLSVTAQAQHVFCVSPAARVAHTGLAGEEWLKTFLLQAFQYGDGGDVRIVLASGRVFLFPENPRHMVHQLFMCQWTVTAYLVCSITKTTC

SEQ ID NO: 4941 - DNA, 822 bp, Escherichia coli
atgcgattagcaagtcgttttggttatgctgcaaaccagatacgccgtgaccgtccactgacacatgaagagctgatgcaccatgtgccggggattttcggggaagagaaacacacgtcccgaagccagaactatacgtacatccccaccatcaccgtactggaaagcctgcagcaggaaggttttcagccattcttcgcctgccagacctgtgtgcgcgacccgggccgccggggatacacaaaacacatgctgcgcctgcgccgtaacggagagataaacggagagcatgtccctgaaattattctgctcaactctcatgacggtacctccagctaccagatgctgccgggttacttcaggttcgtctgccagaacggctgcgtctgtggtcagtctctgggggaagtgcgtgttccacaccggggagacgtagtggagaaagttattgaaggggcttacgaggtggtgggcgtgtttgaccggatagaggagaagcgtgatgccatgcagtcgctggtcctgccgccaccggcacgccaggcgctggcacaggcggcactgacttaccgttatggtgacgaacatcagcccgtcaccaccgccgacattctgacgccacgacgccgggaggattacggtaaggacctgtggagtgcttatcagaccatccaggagaatatgctgaaaggcgggatttccggtcgcagtgcaaaaggaaaacgtatccatacccgggccattcacagcattgataccgacattaagctcaaccgtgcattgtgggtgatggcagaaacgatgctggagagcctgcgctga

SEQ ID NO: 4942 - protein, 273 aa, Escherichia coli
MRLASRFGYAANQIRRDRPLTHEELMHHVPGIFGEEKHTSRSQNYTYIPTITVLESLQQEGFQPFFACQTCVRDPGRRGYTKHMLRLRRNGEINGEHVPEIILLNSHDGTSSYQMLPGYFRFVCQNGCVCGQSLGEVRVPHRGDVVEKVIEGAYEVVGVFDRIEEKRDAMQSLVLPPPARQALAQAALTYRYGDEHQPVTTADILTPRRREDYGKDLWSAYQTIQENMLKGGISGRSAKGKRIHTRAIHSIDTDIKLNRALWVMAETMLESLR

SEQ ID NO: 4943 - DNA, 546 bp, Escherichia coli
gtgatgaacgtgatgttgtcagcccccggcctttactccctctcatttattcacattacaaggatttcatacatgaaaacattgtctcagaacaccacctcttcggcctgtgcaccggagactggcctgcaacaactggttgccaccatagtccctgatgaacagcgcatcagcttctggccgcagcattttggcctcattccacagtgggtgaccctggagccccgggtcttcggctggatggaccgtctgtatgaagactactgcggtggtatctggaatctgtacaccctgaacaacggtggcgcatttatggcacccgaaccggatgacgatgatgacgaaacatgggtactgttcaatgccatgaacggtaaccgcgctgaaatgagcccggaagccgccggcattgctgcctgtctgatgacgtacagtcatcacgcctgccgtacggagtgttatgccatgacggttcattattaccgtctgcgggattacgccctgcaacatccggaatacgacgccattatgcgcatcattgactga

SEQ ID NO: 4944 - protein, 181 aa, Escherichia coli
MMNVMLSAPGLYSLSFIHITRISYMKTLSQNTTSSACAPETGLQQLVATIVPDEQRISFWPQHFGLIPQWVTLEPRVFGWMDRLYEDYCGGIWNLYTLNNGGAFMAPEPDDDDDETWVLFNAMNGNRAEMSPEAAGIAACLMTYSHHACRTECYAMTVHYYRLRDYALQHPEYDAIMRIID

SEQ ID NO: 4945 - DNA, 477 bp, Escherichia coli
atgcaacagatttcctttctgcccggagagatgacgcccggcgagcgcagtctcattctgcgggccctgaaaaccctggaccgtcatcttcatgaacccggtgtggccttcacctccacccgtgcggcacgggaatggctgattctgaacatggcgggactggagcgtgaagaattccgggtgctatatctgaataaccagaatcagctgattgccggtgaaaccctcttcaccggcaccatcaaccgcacggaagtccatccccgggaagtgattaaatgcgccctgtatcacaatgccgcagccgtggtgctggcacacaatcacccgtccggtgaagtcacacccagtaaggcagaccggcttatcaccgaacgtctggtacaggcactgggcctggtggatatccgggtgccggaccatctgatagtcggtggcagccaggttttctcctttgcggaacacggcctgctttaa

SEQ ID NO: 4946 - protein, 158 aa, Escherichia coli
MQQISFLPGEMTPGERSLILRALKTLDRHLHEPGVAFTSTRAAREWLILNMAGLEREEFRVLYLNNQNQLIAGETLFTGTINRTEVHPREVIKCALYHNAAAVVLAHNHPSGEVTPSKADRLITERLVQALGLVDIRVPDHLIVGGSQVFSFAEHGLL

SEQ ID NO: 4947 - DNA, 222 bp, Escherichia coli
atgaaaattatcacccgtggtgaagccatgcgtattcaccaacaacatccgacatcccgtctttttccgttctgtaccggtaaataccgctggcacggcagtgctgaagcgtataccggtcgtgaagtgcaggatattcccggtgtgctggccgtgtttgctgaacgccgtaaggacagttttggcccgtatgtccgactgatgagcgtcaccctgaactga

SEQ ID NO: 4948 - protein, 73 aa, Escherichia coli
MKIITRGEAMRIHQQHPTSRLFPFCTGKYRWHGSAEAYTGREVQDIPGVLAVFAERRKDSFGPYVRLMSVTLN

SEQ ID NO: 4949 - DNA, 369 bp, Escherichia coli
gtgtcagacacactccccgggacaacacttcccgacgacaatcacgaccgcccctggtgggggctaccctgcaccgtgacgccctgtttcggcgcccgtctggtgcaggagggtaaccggttgcattaccttgccgaccgtgccggtatcagaggcctgttcagcgatgcagatgcgtaccacctggaccaggcctttccgttgctgatgaaacaactggagctcatgctcaccagtggtgaactcagcccccgctatcagcataccgtcacgctgtatgcgaaaggactgacctgcgaagccgataccctgggctcctgtggttacgtttatctggctgtttatccgacgcccgaaatgaaaaattaa

SEQ ID NO: 4950 - protein, 122 aa, Escherichia coli
MSDTLPGTTLPDDNHDRPWWGLPCTVTPCFGARLVQEGNRLHYLADRAGIRGLFSDADAYHLDQAFPLLMKQLELMLTSGELSPRYQHTVTLYAKGLTCEADTLGSCGYVYLAVYPTPEMKN

SEQ ID NO: 4951 - DNA, 375 bp, Escherichia coli
atgaaaacattacctgtattacccgggcaggcggccagttctcgcccgtctcctgttgaaatctggcagatactgctgtcccgactgctggaccagcactacggcctcacactgaatgacacaccgtttgccgatgaacgtgtgattgagcagcatattgaggcaggcatttcactgtgtgatgcggtgaactttctcgtggaaaaatacgcgctggtgcgtaccgaccagccgggattcagcgcctgtacccgctctcagttaataaacagcatcgatatcctccgggctcgcagggcgaccggcctgatgacccgcgacaattacagaacggtaaataacattaccctgggtaagtatccggaggcgaaatga

SEQ ID NO: 4952 - protein, 124 aa, Escherichia coli
MKTLPVLPGQAASSRPSPVEIWQILLSRLLDQHYGLTLNDTPFADERVIEQHIEAGISLCDAVNFLVEKYALVRTDQPGFSACTRSQLINSIDILRARRATGLMTRDNYRTVNNITLGKYPEAK

SEQ ID NO: 4953 - DNA, 195 bp, Escherichia coli
atgatgacactggaagccgacagcgttaacgtacaggcgctggatatggggcacattgtcgttgacattgatggtgttaatatcactgaactgattaataaggccgctgaaaacggttattcactccgcgtggtggatggccgtgactctaccgaaacaccggcaacttatgccagccctcaccagttgctgtaa

SEQ ID NO: 4954 - protein, 64 aa, Escherichia coli
MMTLEADSVNVQALDMGHIVVDIDGVNITELINKAAENGYSLRVVDGRDSTETPATYASPHQLL

SEQ ID NO: 4955 - DNA, 330 bp, Escherichia coli
atggaaactaccaagccttcattccaggacgtactggaatttgttcgtctgttccgtcgtaagaacaaactgcaacgtgaaattcaggacgttgagaaaaagatccgtgacaaccagaagcgcgtcctgttgctggacaacctgagcgattacatcaagccagggatgagcgttgaagcaatccagggcatcatcgccagcatgaaaggtgactatgaagatcgcgttgacgattacatcatcaaaaatgccgagctctccaaagaacgccgcgatatctccaaaaagctgaaagctatgggcgaaatgaaaaacggcgaagcgaagtaa

SEQ ID NO: 4956 - protein, 109 aa, Escherichia coli
METTKPSFQDVLEFVRLFRRKNKLQREIQDVEKKIRDNQKRVLLLDNLSDYIKPGMSVEAIQGIIASMKGDYEDRVDDYIIKNAELSKERRDISKKLKAMGEMKNGEAK

SEQ ID NO: 4957 - DNA, 1059 bp, Escherichia coli
gtgcgtgccgataagtcattaagcccgtttgaaatccgggtataccgccattaccgcattgtgcatggtactcgggtcgcgctggcattcctgctcacttttctcattatccgcctgtttactatcccggaaagcacctggccgctggtcaccatggtggtgattatggggccaatctcgttctgggggaacgttgtccctcgtgccttcgaacgtattggcggtacggtgttgggttcgattttaggtcttatcgctctgcaactggagttaatttcgttaccgctgatgttagtctggtgcgcggcggcgatgtttctttgcggttggctggcgctgggcaagaaaccgtatcaaggattattgattggggtgacgctggcaattgttgtgggttccccgacaggtgaaattgatacggcgttatggcgaagcggcgatgtgatcctcggctctttactggcaatgttgtttaccggtatctggccacaacgggcgttcatccactggcgcattcaactggcgaaaagtctgaccgagtataatcgggtctatcaatctgcattctcaccgaacttactcgaacgcccacgtctggaaagccatctacaaaaactgctgaccgatgccgtgaaaatgcgtgggctgattgcgcccgccagcaaagaaacccgtattcccaaatcgatatatgaaggtatccagaccattaatcgcaatctggtttgtatgctggagttgcaaatcaatgcatactgggccacgcgccccagccatttcgtgttattgaacgcgcaaaaacttcgtgatacccagcacatgatgcagcaaatactgctgagccttgttcatgcgctgtacgaaggtaatccgcagccggtttttgccaatacggaaaaattgaacgatgctgtggaagagctgcgtcagttgctcgataaccaccatgatctgaaagtcgtggaaacaccaatctatggttatgtgtggctgaacatggaaacggcacatcagcttgagttgctatcgaatctgatttgccgggccttgcgcaaataa

SEQ ID NO: 4958 - protein, 352 aa, Escherichia coli
MRADKSLSPFEIRVYRHYRIVHGTRVALAFLLTFLIIRLFTIPESTWPLVTMVVIMGPISFWGNVVPRAFERIGGTVLGSILGLIALQLELISLPLMLVWCAAAMFLCGWLALGKKPYQGLLIGVTLAIVVGSPTGEIDTALWRSGDVILGSLLAMLFTGIWPQRAFIHWRIQLAKSLTEYNRVYQSAFSPNLLERPRLESHLQKLLTDAVKMRGLIAPASKETRIPKSIYEGIQTINRNLVCMLELQINAYWATRPSHFVLLNAQKLRDTQHMMQQILLSLVHALYEGNPQPVFANTEKLNDAVEELRQLLDNHHDLKVVETPIYGYVWLNMETAHQLELLSNLICRALRK

SEQ ID NO: 4959 - DNA, 474 bp, Escherichia coli
atgaactacgagattaagcaggaagataaacgtaccgttgcaggtttccatctcgttggcccgtgggaacagacggtaaagaaaggctttgagcagttgatgatgtggatagatagcaaaaatattgtgccgaaggagtgggttgctgtctattacgacaatccagatgaaacacccgccgaaaaattacgctgcgacaccgtcgtgacggtgccgaataactttacgctccccgaaaacagtgagggcgtcattctgacagaaatttcaggtggtcagtatgcggtggcggtggctcgtgtagtcggtgatgattttgctaaaccctggtatcagttctttaatagcctcttgcaggacagtgcctatgaaatgttaccaaagccctgcttcgaggtttacttgaacaatggcgcggaagatgggtactgggatatcgaaatgtatgttgcggtgcagccaaaacatcactaa

SEQ ID NO: 4960 - protein, 157 aa, Escherichia coli
MNYEIKQEDKRTVAGFHLVGPWEQTVKKGFEQLMMWIDSKNIVPKEWVAVYYDNPDETPAEKLRCDTVVTVPNNFTLPENSEGVILTEISGGQYAVAVARVVGDDFAKPWYQFFNSLLQDSAYEMLPKPCFEVYLNNGAEDGYWDIEMYVAVQPKHH

SEQ ID NO: 4961 - DNA, 966 bp, Escherichia coli
atgacgggctatgtcgtggatcgcgctatcgatagtcatcgcattacgccagacgatattgtcaccgtggggcgtgatgcgtgggcgaaagataatccggtgtttgtcggttcttcactgatgtttttgaaagagggcgatcgcgtatcggtacgtgatttaagccgtggtttaattgtggattccggaaatgacgcttgtgttgcactggctgactatattgccggtgggcaacggcagtttgttgaaatgatgaacaactatgccgagaagctgcatctcaaggatacgcattttgaaacagtgcatggtctggatgcacctggccagcatagctcggcttatgatttagctgtgctttctcgcgctatcatccacggcgagcccgagttttatcatatgtacagtgagaaaagcctcacctggaacggtatcacccagcaaaaccgtaacgggttattgtgggataaaaccatgaatgttgacggcctgaaaacgggtcatacttctggtgccgggtttaatctcattgcttcggctgtagatgggcagcgtcgtctcattgcagtggtaatgggggctgacagcgcaaaaggtcgtgaggaagaggcaagaaaattactgcgttggggtcaacaaaactttactacggtgcaaattttgcaccgtgggaaaaaggttggtacggaacgcatctggtatggcgataaagaaaatatcgccctgggaacggaacaagagttctggatggtgctaccgaaagccgaaattccacatatcaaagccaaatatacccttgatggtaaagaactcaccgcgccaattagcgcccatcagcgggtaggggaaattgaactttacgaccgtgataaacaggtggcgcactggccgctggttaccctggaatctgtcggggaaggcagcatgttttcccggctgagtgattatttccaccataaggactga

SEQ ID NO: 4962 - protein, 321 aa, Escherichia coli
MTGYVVDRAIDSHRITPDDIVTVGRDAWAKDNPVFVGSSLMFLKEGDRVSVRDLSRGLIVDSGNDACVALADYIAGGQRQFVEMMNNYAEKLHLKDTHFETVHGLDAPGQHSSAYDLAVLSRAIIHGEPEFYHMYSEKSLTWNGITQQNRNGLLWDKTMNVDGLKTGHTSGAGFNLIASAVDGQRRLIAVVMGADSAKGREEEARKLLRWGQQNFTTVQILHRGKKVGTERIWYGDKENIALGTEQEFWMVLPKAEIPHIKAKYTLDGKELTAPISAHQRVGEIELYDRDKQVAHWPLVTLESVGEGSMFSRLSDYFHHKD

SEQ ID NO: 4963 - DNA, 198 bp, Escherichia coli
ttgctgttgaaacgccgtcttattattgctgcttctttgttcgtttttaatttatcgtctggttttgcggcggaaaacattcctttttcacctcaacctccagagattcatgccgggtcctgggtattgatggattacaccaccggtcagattctcaccggggtaatgagcatcaacagcgcaatcccgccagcctga

SEQ ID NO: 4964 - protein, 65 aa, Escherichia coli
MLLKRRLIIAASLFVFNLSSGFAAENIPFSPQPPEIHAGSWVLMDYTTGQILTGVMSINSAIPPA

SEQ ID NO: 4965 - DNA, 1476 bp, Escherichia coli
gtgatatttgatactctggcagacagcagaaacaacggatttaacctaatgatgaatgacggtaagcaacaatctacctttttgtttcacgattacgaaacctttggcacgcaccccgcgttagatcgccctgcacagttcgcagccattcgcaccgatagcgaattcaatgtcatcggcgaacccgaagtcttttactgcaagcccgcggatgactatttaccccagcctggagcagtattaattaccggtattaccccgcaggaagctcgggcgaaaggagaaaacgaagccgcatttgccgcccgtattcactcgctttttaccgtaccgaagacctgtattctgggctacaacaatgtgcgtttcgacgacgaagtcacacgcaacgttttttatcgtaatttctacgatccttacgcctggagctggcagcatgataactcgcgctgggatttactggatgttatgcgtgcctgttatgccctgcgcccggaaggaataaactggcctgaaaatgatgacggtctaccgagctttcgccttgagcatttaaccaaagcgaatggtattgaacatagcaacgcccacgatgcgatggctgatgtgtacgccactattgcgatggcgaaactggtaaaaacgcgtcagccacgcctgtttgattatctctttacccatcgtaataaacacaaactgatggcgttgattgatgttccgcagatgaaacccctggttcacgtttccggaatgtttggggcatggcgcggcaataccagctgggtggcaccgctggcgtggcatcctgaaaatcgcaatgccgtaattatggtggatttggcaggagacatttcgccattactggagctggatagcgacacattgcgcgagcgtttatataccgcaaaagccgatcttggcgataacgccgccgttccggttaagctggtgcatatcaataaatgtccggtactggcccaggcgaatacgctacgcccggaagatgccgaccgactgggaattaatcgtcagcattgcctcgataacctaaaaattctgcgtgaaaatccgcaagtgcgtgaaaaagtggtggcgatattcgcggaagccgaaccgtttacgccttcagagaacgtggatgcacagctttataatggctttttcagtgacgccgatcgtgcagcaatgaaaattgtgctggaaaccgagccgcgtaatttaccggcactggatatcacttttgttgataaacgaattgaaaaactgttgttcaattatcgagcgcgcaacttcccggggacgctggattatgccgagcagcaacgctggctggagcaccgccgccaggtcttcacgccagagtttttgcagggctacgctgatgaattgcagatgctggcacaacagtatgccgatgacaaagagaaagtggcgctgttaaaagcgctttggcagtacgcggaagagatcgtctga

SEQ ID NO: 4966 - protein, 491 aa, Escherichia coli
MIFDTLADSRNNGFNLMMNDGKQQSTFLFHDYETFGTHPALDRPAQFAAIRTDSEFNVIGEPEVFYCKPADDYLPQPGAVLITGITPQEARAKGENEAAFAARIHSLFTVPKTCILGYNNVRFDDEVTRNVFYRNFYDPYAWSWQHDNSRWDLLDVMRACYALRPEGINWPENDDGLPSFRLEHLTKANGIEHSNAHDAMADVYATIAMAKLVKTRQPRLFDYLFTHRNKHKLMALIDVPQMKPLVHVSGMFGAWRGNTSWVAPLAWHPENRNAVIMVDLAGDISPLLELDSDTLRERLYTAKADLGDNAAVPVKLVHINKCPVLAQANTLRPEDADRLGINRQHCLDNLKILRENPQVREKVVAIFAEAEPFTPSENVDAQLYNGFFSDADRAAMKIVLETEPRNLPALDITFVDKRIEKLLFNYRARNFPGTLDYAEQQRWLEHRRQVFTPEFLQGYADELQMLAQQYADDKEKVALLKALWQYAEEIV

SEQ ID NO: 4967 - DNA, 1359 bp, Escherichia coli
atgtcgcataacgttactccaaacacctctcgcgtggaattgcgtaaaacgcttacgttagttccggttgtaatgatgggtctagcctatatgcagccgatgacgctgtttgatacatttggtatcgtttcaggcctcacggatggtcatgtgccgacagcctatgcgttcgcattgattgcgatcctgtttacggctctgagctacgggaagctggttcgccgctatccttctgctggctctgcatacacttacgcccagaaatccattagcccgactgtcggctttatggtgggttggtcttctctgctcgactatctgttcgcgccgatgatcaacattctgctggcgaaaatctattttgaagctctggtgccttccattccatcgtggatgtttgtggtggctctggtggcctttatgaccgcctttaacctgcgtagtctgaaatccgtagcgaacttcaacactgtaatcgtcgtgttgcagatagtgctgatcgcggtgattctgggcatggttgtttatggcgtatttgaaggtgaaggcgctggtacgctggcgagcactcgtccgttctggtctggcgatgcgcatgttatcccgatgattaccggggcgacaatcctgtgcttctcctttaccggttttgacggcatcagcaacctgtcggaagaaaccaaagatgcagagcgcgtgatcccgcgtgcgattttcctgaccgcgctgatcggcggcatgatcttcatctttgcaacttacttcctgcagctgtacttcccggatatctctcgttttaaagatccggatgcgtcacagcctgaaatcatgctgtacgttgcgggtaaagcgttccaggttggcgcgctgatcttctccaccattaccgtactggcgtccggtatggcggcgcacgcaggcgttgcgcgtctgatgtacgtaatgggtcgtgacggcgtgttcccgaaaagcttcttcggttatgtacacccgaaatggcgtactccggcgatgaatatcatcctggttggcgcgattgccctgctggcaatcaacttcgacctggtaatggctacggcgctgattaactttggtgcgttggtggcgttcaccttcgttaacctgtcggtcatctcgcagttctggatccgtgagaagcgtaacaaaacgctgaaagatcacttccagtatctgttcctgccgatgtgtggtgcgctgaccgttggtgcgctgtgggttaacctggaagaaagctcaatggttctgggtctgatctgggctgctatcggtctgatttacctggcttgcgtaaccaagagtttccgtaacccggttccgcagtacgaagacgtagcgtaa

SEQ ID NO: 4968 - protein, 452 aa, Escherichia coli
MSHNVTPNTSRVELRKTLTLVPVVMMGLAYMQPMTLFDTFGIVSGLTDGHVPTAYAFALIAILFTALSYGKLVRRYPSAGSAYTYAQKSISPTVGFMVGWSSLLDYLFAPMINILLAKIYFEALVPSIPSWMFVVALVAFMTAFNLRSLKSVANFNTVIVVLQIVLIAVILGMVVYGVFEGEGAGTLASTRPFWSGDAHVIPMITGATILCFSFTGFDGISNLSEETKDAERVIPRAIFLTALIGGMIFIFATYFLQLYFPDISRFKDPDASQPEIMLYVAGKAFQVGALIFSTITVLASGMAAHAGVARLMYVMGRDGVFPKSFFGYVHPKWRTPAMNIILVGAIALLAINFDLVMATALINFGALVAFTFVNLSVISQFWIREKRNKTLKDHFQYLFLPMCGALTVGALWVNLEESSMVLGLIWAAIGLIYLACVTKSFRNPVPQYEDVA

SEQ ID NO: 4969 - DNA, 930 bp, Escherichia coli
atgaaaccactgctggatgtgttgatgatcctcgatgccttagaaaaagaaggcagttttgcggcggcgtcagccaaactctacaagacgccgtccgctctgagttacaccgttcacaagctggaaagcgaccttaatattcaattgcttgatcgtagcggacaccgcgctaaattcacccgtaccggaaaaatgttattagagaaagggcgggaagttctgcataccgtgcgagaactggaaaagcaggcgatcaaactgcatgaaggctgggaaaacgagctggtgattggcgtggacgacacgtttcctttttctctgcttgcgcctctcattgaagctttttatcaacatcatagcgtgacgcgcctgaagtttatcaatggcgtactcggtggttcctgggatgccctgactcaggggcgagcggatattatcgttggcgcgatgcatgagccaccatcttccagtgagtttggtttctcgcggttgggcgatcttgaacaagtctttgcggtcgcgcctcatcatccgttagcccaggaagaagaaccgttaaaccgtcgtatcattaaacgatatcgggcgattgtggtgggggacactgcgcaggcaggcgcttctacggcctcacaacttctcgacgaacaagaagccattaccgttttcgattttaaaaccaagctggagctgcaaattagcggccttggctgcggctatttaccacggtatctggcgcaacgttttctcgatagtggcgcgttaatcgagaagaaagtggtcgcccaaactctctttgaacccgtctggattggctggaatgaacagaccgcagggcttgccagcggctggtggcgagatgaaattttagcaaatagtgcgatcgccggtgtttatgcaaaatctgatgacggaaaatcagccatttaa

SEQ ID NO: 4970 - protein, 309 aa, Escherichia coli
MKPLLDVLMILDALEKEGSFAAASAKLYKTPSALSYTVHKLESDLNIQLLDRSGHRAKFTRTGKMLLEKGREVLHTVRELEKQAIKLHEGWENELVIGVDDTFPFSLLAPLIEAFYQHHSVTRLKFINGVLGGSWDALTQGRADIIVGAMHEPPSSSEFGFSRLGDLEQVFAVAPHHPLAQEEEPLNRRIIKRYRAIVVGDTAQAGASTASQLLDEQEAITVFDFKTKLELQISGLGCGYLPRYLAQRFLDSGALIEKKVVAQTLFEPVWIGWNEQTAGLASGWWRDEILANSAIAGVYAKSDDGKSAI

SEQ ID NO: 4971 - DNA, 825 bp, Escherichia coli
atgaaaaaggtcgcaattgtcgggttagggtggttaggcatgccgctggcgatgtcactttcagcgcgaggctggcaagtcaccgggagtaaaaccacacaagatggtgtcgaagcggcccgaatgagtggcattgatagctatctgcttcgcatggagcctgagttagtttgcgattctgacgatctggatgccctgatggatgccgatgcgctggtcattacgcttccggcacgtcgtagcggccccggcgatgagttctatttacaagcggtacaagagttagtggatagcgcgctggcccatcgtattccccgcattatttttaccagctcgacatctgtctatggcgacgcgcaaggcacggtgaaagaaaccaccccgcgtaatccggtgaccaacagtggacgagtattagaagaactcgaagactggctgcacaatttacccggtacttcggtcgatattctgcgtcttgcgggcctggtcggaccgggacgtcatcccggacgcttctttgccggaaaaaccgcccctgatggtgaacatggtgttaatttagtccatttagaagatgttattggcgctatcactctgttgttacaggcacctaaaggcggacacatctataatatatgtgcgctagctcaccctgcgcgtaatgttttctatccgcagatggcccgtttactggggctggaacctccgcagttcagaaatagtctggacagcggcaaaggtaagattattgatggcagtcggatttgtaatgaactgggatttgaataccagtatcccgatccgctggtaatgccgctggagtaa

SEQ ID NO: 4972 - protein, 274 aa, Escherichia coli
MKKVAIVGLGWLGMPLAMSLSARGWQVTGSKTTQDGVEAARMSGIDSYLLRMEPELVCDSDDLDALMDADALVITLPARRSGPGDEFYLQAVQELVDSALAHRIPRIIFTSSTSVYGDAQGTVKETTPRNPVTNSGRVLEELEDWLHNLPGTSVDILRLAGLVGPGRHPGRFFAGKTAPDGEHGVNLVHLEDVIGAITLLLQAPKGGHIYNICALAHPARNVFYPQMARLLGLEPPQFRNSLDSGKGKIIDGSRICNELGFEYQYPDPLVMPLE

SEQ ID NO: 4973 - DNA, 255 bp, Escherichia coli
gtgaaactaatctggtctgaggaatcatgggatgattatctgtactggcaggaaacagataagcgaattgttaaaaagatcaatgaaattatcaaagatacacgcagaacaccatttgaaggtaaggggaagccagaacccctgaaacataatttgtcaggcttctggtcccgacgcattacagaggagcaccgtctggtatacgcggttaccgacgattcactgctcattgcagcatgtcgttatcattattga

SEQ ID NO: 4974 - protein, 84 aa, Escherichia coli
MKLIWSEESWDDYLYWQETDKRIVKKINEIIKDTRRTPFEGKGKPEPLKHNLSGFWSRRITEEHRLVYAVTDDSLLIAACRYHY

SEQ ID NO: 4975 - DNA, 252 bp, Escherichia coli
atgcgtacaattagctacagcgaagcgcgtcagaatttgtcggcaacaatgatgaaagccgttgaagatcatgccccgatcctcattactcgtcagaatggagaggcttgtgttctgatgtcactcgaagaatacaactcgctggaagagacggcttatctactgcgttcccccgctaacgcccggagattgatggactcaatcgatagcctgaaatcaggcaaaggaacggaaaaggacattattgagtga

SEQ ID NO: 4976 - protein, 83 aa, Escherichia coli
MRTISYSEARQNLSATMMKAVEDHAPILITRQNGEACVLMSLEEYNSLEETAYLLRSPANARRLMDSIDSLKSGKGTEKDIIE

SEQ ID NO: 4977 - DNA, 900 bp, Escherichia coli
atgacagacaacactcgtttacgcatagctatgcagaaatccggccgtttaagtgatgactcacgcgaattactggcgcgctgcggcattaaaattaatcttcacacccagcgcctgatcgcgatggcagaaaacatgccgattgatattctgcgcgtgcgtgacgacgacattcccggtctggtaatggacggcgtggtagatcttgggattatcggcgaaaacgtgctggaagaagagctgcttaaccgccgagcccagggtgaagatccgcgctactttaccctgcgtcgtctggatttcggcggctgccgactttcactggcaacgccggttgatgaagcctgggacggtccgctctccttaaacggtaaacgtatcgccacctcttatcctcacctgctcaagcgttatctcgatcagaaaggtatctcttttaaatcctgcttactgaacggttctgtcgaagttgcgccgcgtgccggactggcggatgcgatttgcgatctggtttccaccggtgccacgctggaagctaacggcctgcgcgaagtcgaagttatctaccgctcgaaagcctgcctgatccagcgcgatggcgaaatggaagaatccaaacagcaactgatcgacaaactgctgacccgtattcagggtgtgatccaggcgcgcgaatcaaaatacatcatgatgcacgcaccgaccgaacgcctggatgaagtcatcgccctgctgccaggtgccgaacgcccaaccattctgccgctggcgggtgaccaacagcgcgtagcgatgcacatggtgagtagcgaaaccctgttctgggaaacgatggaaaaactgaaagcgttgggtgccagttcaatcctggtcctgccgattgagaagatgatggagtga

SEQ ID NO: 4978 - protein, 299 aa, Escherichia coli
MTDNTRLRIAMQKSGRLSDDSRELLARCGIKINLHTQRLIAMAENMPIDILRVRDDDIPGLVMDGVVDLGIIGENVLEEELLNRRAQGEDPRYFTLRRLDFGGCRLSLATPVDEAWDGPLSLNGKRIATSYPHLLKRYLDQKGISFKSCLLNGSVEVAPRAGLADAICDLVSTGATLEANGLREVEVIYRSKACLIQRDGEMEESKQQLIDKLLTRIQGVIQARESKYIMMHAPTERLDEVIALLPGAERPTILPLAGDQQRVAMHMVSSETLFWETMEKLKALGASSILVLPIEKMME

SEQ ID NO: 4979 - DNA, 1305 bp, Escherichia coli
atgagctttaacacaatcattgactggaatagctgtactgcggagcaacaacgccagctgttaatgcgcccggcgatctccgcttctgaaagcattacccgcaccgttaacgatattctcgataacgtgaaaacgcgtggcgatgaggccctgcgtgaatacagcgcgaagtttgataaaaccacggttaccgcgctgaaggtgtctgctgatgagatcgccgccgccagcgaacgcctgagcgacgagctaaaacaggcgatggcggtggcagtaaagaatattgaaaccttccacactgcgcaaaaactgccgccggtagatgtagaaacgcagccaggcgtacgttgccagcaagtcacgcgtccggtagcttcagttgggttgtatattcctggcggctccgccccgctcttctcaacggtattaatgctggcgactccggcgcgtattgcgggctgtaaaaaagtggtgctgtgctcaccgccgccgatagccgatgagatactttacgcggcgcagctgtgcggtgtgcaggacgtgtttaacgtcggcggtgcacaggccattgccgcgctggcgtttggtacggaatctgtgccgaaagtggacaaaatcttcgggccgggtaacgcctttgtcaccgaagcaaaacgccaggtaagccagcgtctggacggtgcggcgatcgatatgcccgcaggcccgtcggaagtgctggtgattgctgacagcggcgctacgccggatttcgtggcttctgatttgctttctcaggctgaacacggccctgactcacaggtaattttactgacccccgacgccgatatggcgcgtcgcgttgccgaggccgtcgaacgccaactggcagaactgccgcgtgccgaaaccgcccgccaggcactgaacgccagccgcctgatcgtgactaaagatttagcgcagtgcgtggagatctccaaccagtacggcccggagcacctgatcattcagacccgcaacgcccgcgaactggtcgatggcatcaccagcgccggttcggtatttcttggtgactggtcaccggaatcggcaggcgactacgcctccggcaccaaccacgttctaccgacttacggctacaccgccacctgttccagcctcgggctggcagatttccagaagcgcatgaccgtacaggaactgtcgaaagaaggcttttccacgctggcttcgaccattgaaacactggccgccgccgagcgcctgaccgcccacaaaaatgccgttactttgcgtgttaacgcccttaaggagcaagcatga

SEQ ID NO: 4980 - protein, 434 aa, Escherichia coli
MSFNTIIDWNSCTAEQQRQLLMRPAISASESITRTVNDILDNVKTRGDEALREYSAKFDKTTVTALKVSADEIAAASERLSDELKQAMAVAVKNIETFHTAQKLPPVDVETQPGVRCQQVTRPVASVGLYIPGGSAPLFSTVLMLATPARIAGCKKVVLCSPPPIADEILYAAQLCGVQDVFNVGGAQAIAALAFGTESVPKVDKIFGPGNAFVTEAKRQVSQRLDGAAIDMPAGPSEVLVIADSGATPDFVASDLLSQAEHGPDSQVILLTPDADMARRVAEAVERQLAELPRAETARQALNASRLIVTKDLAQCVEISNQYGPEHLIIQTRNARELVDGITSAGSVFLGDWSPESAGDYASGTNHVLPTYGYTATCSSLGLADFQKRMTVQELSKEGFSTLASTIETLAAAERLTAHKNAVTLRVNALKEQA

SEQ ID NO: 4981 - DNA, 1071 bp, Escherichia coli
atgagcaccgtgactattaccgatttagcgcgtgaaaacgtccgcaacctgacgccgtatcagtcagcgcgtcgtctgggcggtaacggcgatgtctggctgaacgccaacgaatatcccactgccgtggagtttcagctcactcagcaaacgctcaaccgctatccggaatgccaaccgaaagtggtgattgaaaattacgcgcaatatgcaggcgtaaaaccggaacaggtgctggtcagccgtggcgcggacgaaggcattgaactgctgattcgcgctttttgcgaaccgggtaaagacgccatcctctactgcccgccaacgtacggcatgtacagcgtcagcgctgaaaccattggcgtcgagtgccgcacagtgccgacgctggacaactggcaactggacttacagggcatttccgacaagctggatggcgtaaaagtggtctatgtttgcagccccaacaaccccaccgggcaactgatcaacccgcaggattttcgcaccctgctggagttaacccgcggtaaggcgattgtggttgccgatgaagcctatatcgagttttgcccgcaggcatcgctggctggctggctggcggaatatccgcacctggctattttgcgcacactgtcgaaagcttttgctctggcggggcttcgttgcggatttacgctggcaaacgaagaagtcatcaacctgctgatgaaagtgatcgccccctacccgctctcgacgccggttgccgacattgccgcacaggcgttaagcccgcagggaatcgtcgccatgcgcgaacgggtggcgcaaattattacagaacgcgaatacctgattgccgcactgaaagagatcccctgcgtggagcaggttttcgactctgaaaccaactacattctggcgcgctttaaagcctccagtgcggtgtttaaatctttgtgggatcagggcattatcttacgtgatcagaataaacaaccctctttaagcggctgcctgcgaattaccgtcggaacccgtgaagaaagccagtgcgtcattgacgccttacgtgcggagcaagtttga

SEQ ID NO: 4982 - protein, 356 aa, Escherichia coli
MSTVTITDLARENVRNLTPYQSARRLGGNGDVWLNANEYPTAVEFQLTQQTLNRYPECQPKVVIENYAQYAGVKPEQVLVSRGADEGIELLIRAFCEPGKDAILYCPPTYGMYSVSAETIGVECRTVPTLDNWQLDLQGISDKLDGVKVVYVCSPNNPTGQLINPQDFRTLLELTRGKAIVVADEAYIEFCPQASLAGWLAEYPHLAILRTLSKAFALAGLRCGFTLANEEVINLLMKVIAPYPLSTPVADIAAQALSPQGIVAMRERVAQIITEREYLIAALKEIPCVEQVFDSETNYILARFKASSAVFKSLWDQGIILRDQNKQPSLSGCLRITVGTREESQCVIDALRAEQV

SEQ ID NO: 4983 - DNA, 1068 bp, Escherichia coli
atgagtcagaagtatctttttatcgatcgcgatggaaccctgattagcgaaccgccgagtgattttcaggtggaccgttttgacaaactcgcctttgaacctggcgtgatcccggagctgctgaggctgcaaaaagcgggctacaagctggtgatgatcactaatcaggatggtcttggaacacaaagtttcccgcaggcggatttcgatggcccgcacaacctgatgatgcagatcttcacctcgcaaggcgtacagtttgatgaagtgctgatttgcccacacctgcccgccgatgagtgcgactgccgtaagccgaaagtaaaactggtggagcgttatctcgctgagcaagcgatggatcgcgccaacagttatgtgattggcgatcgcgcgaccgacattcaactggcggaaaacatgggcattaatggtttacgctacgaccgtgaaatcctgaactggccgatgattggtgagcaactcactaaacgagaccgttacgcccatgtagtgcgcaacaccaaagagacgcaaattgacgtccaggtgtggctggatcgcgagggtggcagcaagattaacaccggcgttggcttctttgatcacatgctggatcagatcgctacccacggcggtttccgtatggaaatcaacgtcaaaggcgacctctatatcgacgatcaccacaccgtcgaagataccggcctggcgctgggggaagcgttaaaaattgccctcggcgataaacgcggtatttgccgctttggttttgtgctgccgatggacgaatgccttgcccgctgcgcgctggatatctctggtcgcccgcacctggaatataaagctgaatttacctaccagcgcgtgggcgatctcagcaccgagatgatcgagcacttcttccgttcgctttcatacaccatgggcgtgacgctacacctgaaaaccaaaggtaaaaacgatcaccaccgtgtagagagcctgttcaaagcctttggtcgtaccctgcgccaggccatccgcgtcgaaggcgacaccctgccctcgtcgaaaggagtgctgtaa

SEQ ID NO: 4984 - protein, 355 aa, Escherichia coli
MSQKYLFIDRDGTLISEPPSDFQVDRFDKLAFEPGVIPELLRLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGINGLRYDREILNWPMIGEQLTKRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 4985 - DNA, 261 bp, Escherichia coli
atgaacgtggtgatccttgatactggctgcgccaacctgaactctgtgaagtctgccattgcgcgccacggttatgaacccaaagtcagccgtgacccggacgtcgtgttgctggccgataaactgtttttacccggcgttggcaccgcacaagcagcgatggaccaggtgcgtgagcgcgagctatttgatctcatcaaagcctgtacccaacccggtgctgggcatctgcttagggatgcaactgctcgggcgacgtag

SEQ ID NO: 4986 - protein, 86 aa, Escherichia coli
MNVVILDTGCANLNSVKSAIARHGYEPKVSRDPDVVLLADKLFLPGVGTAQAAMDQVRERELFDLIKACTQPGAGHLLRDATARAT

SEQ ID NO: 4987 - DNA, 354 bp, Escherichia coli
atgcaactgctcgggcgacgtagcgaagagagcaatggcgtcgacttgctgggcatcatcgacgaagacgtgccgaaaatgaccgactttggtctgccactgccacatatgggctggaatcgcgtttacccgcaggcaggcaaccgcctgtttcaggggattgaagacggcgcgtacttttactttgttcacagctacgcaatgccggtcaatccgtggaccatcgcccagtgtaattacggcgaaccgttcaccgcggcggtacaaaaagataacttctacggcgtgcagttccacccggagcgttctggtgccgctggagctaagttgctgaaaaacttcctggagatgtga

SEQ ID NO: 4988 - protein, 117 aa, Escherichia coli
MQLLGRRSEESNGVDLLGIIDEDVPKMTDFGLPLPHMGWNRVYPQAGNRLFQGIEDGAYFYFVHSYAMPVNPWTIAQCNYGEPFTAAVQKDNFYGVQFHPERSGAAGAKLLKNFLEM

SEQ ID NO: 4989 - DNA, 738 bp, Escherichia coli
atgattattccggcattagatttaatcgacggcaccgtggtgcgtctccatcagggcgattacggcaaacaacgcgattacggtaacaacccgctgccgcgcttacaggattacgctgcgcaaggtgccgaagtgttgcacctggtggatctgaccggggcaaaagatccggctaagcgtcaaatcccgctgattaaaaccctggtcgcgggcgttaacgtcccggtgcaggttggcggcggtgtgcgtagtgaaaaagacgtagcggcgttactggaagcgggcgttgcgcgcgtggtggtcggctccaccgcggtgaaatcaccagaaatggtgaaaggttggtttgaacgtttcggtgcggatgccttagtgctggcgctggatgtccgtattgacgagcaaggcaacaagcaggtggcggtcagcggctggcaagagaactcgggcgtttcactggaacaactggtggaaacctatctgcccgtcggcctgaaacatgtgctatgtaccgatatctcgcgcgacggcacgctggcgggatctaacgtctctttatatgaagaagtgtgcgccagatatccacaggtggcatttcagtcctccggcggtattggcgacattaacgatgtggcggccctgcgtggtactggtgtacgcggcgtaatagttggtcgtgcattactggaaggtaaattcaccgtgaaggaggccatcgcatgctggcaaaacgcataa

SEQ ID NO: 4990 - protein, 245 aa, Escherichia coli
MIIPALDLIDGTVVRLHQGDYGKQRDYGNNPLPRLQDYAAQGAEVLHLVDLTGAKDPAKRQIPLIKTLVAGVNVPVQVGGGVRSEKDVAALLEAGVARVVVGSTAVKSPEMVKGWFERFGADALVLALDVRIDEQGNKQVAVSGWQENSGVSLEQLVETYLPVGLKHVLCTDISRDGTLAGSNVSLYEEVCARYPQVAFQSSGGIGDINDVAALRGTGVRGVIVGRALLEGKFTVKEAIACWQNA

SEQ ID NO: 4991 - DNA, 777 bp, Escherichia coli
atgctggcaaaacgcataatcccttgtctcgacgttcgtgatggtcaggtggtgaaaggcgtacagtttcgcaaccatgaaatcattggcgatatcgtgccactggcaaaacgctacgccgaagaaggtgcagatgaactggtgttctacgatatcaccgcttccagcgatggccgtgtggtagataaaagctgggtatctcgcgtggcggaagtgatcgacattccgttctgtgtggcgggtgggattaagtctctggaagatgccgcgaaaattctttcctttggcgcggataaaatctccattaactcccctgcgctggcggacccgacgttaattactcgcctggcggatcgctttggcgtgcagtgtattgtggtcggcattgatacctggtacgacgccgaaaccggtaaatatcatgtgaatcaatataccggcgatgaaagccgcacccgcgtcactcagtgggaaacactcgactgggtgcaggaagtgcaaaaacgcggcgccggagaaatcgtcctcaacatgatgaatcaggacggcgtgcgtaacggttacgacctcaagcagctgaaaaaagtgcgtgaagtttgccacgtcccgctgattgcctccggtggcgcgggcaccatggaacacttcctggaagccttccgcgatgccgacgttgacggtgcgctggcagcttccgtattccacaaacaaataatcaatattggcgaattaaaagcgtacctggcaacacagggcgtggagatcaggatatgttaa

SEQ ID NO: 4992 - protein, 258 aa, Escherichia coli
MLAKRIIPCLDVRDGQVVKGVQFRNHEIIGDIVPLAKRYAEEGADELVFYDITASSDGRVVDKSWVSRVAEVIDIPFCVAGGIKSLEDAAKILSFGADKISINSPALADPTLITRLADRFGVQCIVVGIDTWYDAETGKYHVNQYTGDESRTRVTQWETLDWVQEVQKRGAGEIVLNMMNQDGVRNGYDLKQLKKVREVCHVPLIASGGAGTMEHFLEAFRDADVDGALAASVFHKQIINIGELKAYLATQGVEIRIC

SEQ ID NO: 4993 - DNA, 612 bp, Escherichia coli
atgttaacagaacaacaacgtcgcgaactggactgggaaaaaaccgacggtctgatgccggtgattgtgcaacacgcggtatccggcgaagtgttaatgctgggctacatgaacccggaagccttagacagaaccatcgaaagcggtaaagttaccttcttctcgcgcactaaacagcgactgtggaccaaaggcgaaacctcgggcaatttcctcaatgtggtgagcattgcgccggactgcgacaacgacacgttactggtgctggcgaatcccatcgggccaacctgccacaaaggcaccagcagctgcttcggcgacaccgctcaccagtggctgttcctgtatcaactggaacaactgctcgccgaacgtaaatctgccgacccggaaacctcctacaccgccaaactgtatgccagcggctccaaacgcattgcgcagaaagtgggcgaagaaggcgtggaaaccgcactggcagcaacggtacatgaccgctttgagctgaccaacgaggcatctgacttgatgtatcacctgctggtgttgttgcaggatcaggatctggatttaacaacggtaattgagaacctgcgtaaacggcatcagtga

SEQ ID NO: 4994 - protein, 203 aa, Escherichia coli
MLTEQQRRELDWEKTDGLMPVIVQHAVSGEVLMLGYMNPEALDRTIESGKVTFFSRTKQRLWTKGETSGNFLNVVSIAPDCDNDTLLVLANPIGPTCHKGTSSCFGDTAHQWLFLYQLEQLLAERKSADPETSYTAKLYASGSKRIAQKVGEEGVETALAATVHDRFELTNEASDLMYHLLVLLQDQDLDLTTVIENLRKRHQ

SEQ ID NO: 4995 - DNA, 1014 bp, Escherichia coli
atgcggacttggaaatttccgtcagttagggtaatgatgagagtagaaaataataatgtttctggacaaaaccatgacccggaacagattgatttgattgatttactagtgcagttgtggcgtggcaagatgacaattatcatttccgtcattgtggctattgccctggctattggttatttggcagtagcgaaggagaaatggacgtcaacagcaattatcactcagcccgacgtggggcaaattgctggctataacaatgccatgaatgttatctatggtcaggctgcaccgaaagtatcggatttgcaggagacgttaattggtcgcttcagttctgccttctctgcattagcagaaacgctggataatcaggaagagccagaaaaacttaccatcgaatcttctgttaagaaccagcaattaccattgactgtttcttatgttgggcaaactgcagagggcgcacaaatgaagttggcccaatacattcagcaagttgatgataaagtgaatcaagagctagaaaaggatctcaaggacaacattgttctgggacggaaaaacttgcaggactctttaagaacccaggaagtggtcgcgcaggagcagaaagatctgcgtattcgtcagattcaggaagcgttgcagtatgcgaatcaggcgcaggtgacaaagccgcagattcaacagacacaggacgtaacccaggatactatgtttcttttggggagcgaagcgctggagtcgatgattaagcacgaagcgacccgtccgttggtgttctcatcaaactactatcagactcgtcaaaacctgctggatattgacaatcttgacgttgataaacttgatattcatgcttaccgctatgtaatgaaaccgacgttacctattcgtcgcgatagcccgaagaaagcaattaccttgattctggctgtgctgctgggcggcatggttggcgcggggattgtgcttgggcgtaacgcgctgcgtaattacaacgcgaaataa

SEQ ID NO: 4996 - protein, 337 aa, Escherichia coli
MRTWKFPSVRVMMRVENNNVSGQNHDPEQIDLIDLLVQLWRGKMTIIISVIVAIALAIGYLAVAKEKWTSTAIITQPDVGQIAGYNNAMNVIYGQAAPKVSDLQETLIGRFSSAFSALAETLDNQEEPEKLTIESSVKNQQLPLTVSYVGQTAEGAQMKLAQYIQQVDDKVNQELEKDLKDNIVLGRKNLQDSLRTQEVVAQEQKDLRIRQIQEALQYANQAQVTKPQIQQTQDVTQDTMFLLGSEALESMIKHEATRPLVFSSNYYQTRQNLLDIDNLDVDKLDIHAYRYVMKPTLPIRRDSPKKAITLILAVLLGGMVGAGIVLGRNALRNYNAK

SEQ ID NO: 4997 - DNA, 1167 bp, Escherichia coli
atgaaaattaccatttccggtactggctatgtaggcttgtcaaacgggcttctaatcgcacaaaatcatgaggttgtggcattagatattttaccgtcacgcgttgctatgctgaatgatcggatatctcctattgttgataaggaaattcagcagtttttgcaatcagataaaatacactttaatgccacattagataaaaatgaagcctaccgggatgctgattatgtcattatcgccactccaaccgactatgatcctaaaactaattatttcaatacatccagtgtagaatcagtaattaaagacgtagttgagataaatccttatgcggttatggtaatcaaatcaacggttcccgttggttttaccgcagcgatgcataagaaatatcgcactgaaaatattattttctctccggaatttctccgtgaaggtaaagctctttacgataatctccatccttcacgtattgtcattggcgagcgttcagaacgcgcagaacgttttgcttcgttgttacaggaaggcgcgattaagcaaaatatcccgaccctgtttaccgactccactgaagcagaagcgattaaactgtttgctaatacctatctggcgatgcgcgtagcatactttaatgaactggatagctatgcagaaagtttaggtctgaatactcgtcagattatcgaaggtgtttgtctcgatccgcgtattggcaaccattacaacaatccgtcgtttggctatggtggttattgtctaccgaaagataccaagcagttactggcgaactaccagtctgtgccgaataacctgatctcggcaattgtcgatgcaaaccgcacgcgtaaagactttattgccgatgccattttgtcacgcaagccgcaagtggtgggtatttatcgtctgattatgaagagcggttcagataacttccgcgcgtcttccattcaggggattatgaaacgtattaaggcgaaaggcgttgaagtgatcatctacgagccggtgatgaaagaagactcattcttcaactctcgcctggaacgtgatctcgccaccttcaaacaacaagccgacgtcattatctccaaccgtatggcagaagagcttaaggatgtggcagataaggtctacacccgcgatctctttggcagcgactaa

SEQ ID NO: 4998 - protein, 388 aa, Escherichia coli
MKITISGTGYVGLSNGLLIAQNHEVVALDILPSRVAMLNDRISPIVDKEIQQFLQSDKIHFNATLDKNEAYRDADYVIIATPTDYDPKTNYFNTSSVESVIKDVVEINPYAVMVIKSTVPVGFTAAMHKKYRTENIIFSPEFLREGKALYDNLHPSRIVIGERSERAERFASLLQEGAIKQNIPTLFTDSTEAEAIKLFANTYLAMRVAYFNELDSYAESLGLNTRQIIEGVCLDPRIGNHYNNPSFGYGGYCLPKDTKQLLANYQSVPNNLISAIVDANRTRKDFIADAILSRKPQVVGIYRLIMKSGSDNFRASSIQGIMKRIKAKGVEVIIYEPVMKEDSFFNSRLERDLATFKQQADVIISNRMAEELKDVADKVYTRDLFGSD

SEQ ID NO: 4999 - DNA, 1407 bp, Escherichia coli
atgtcaaagcaacagatcggcgtcgtcggtatggcagtgatgggacgcaacctcgcgctcaacatcgaaagccgtggttataccgtctctattttcaaccgttcccgtgaaaagacggaagaagttattgccgaaaatccaggcaagaaactggttccttactatacggtgaaagagttcgttgaatctcttgaaacgcctcgtcgcatcctgttaatggttaaagcaggtgcaggcacggatgctgctattgattccctgaaaccatatctcgataaaggcgatatcatcattgatggtggtaataccttcttccaggacaccattcgtcgtaaccgcgagctttctgcacaaggctttaacttcatcggtacgggtgtttccggtggtgaagagggcgcgctgaaaggaccttctatcatgcctggtgggcagaaagaggcctatgaactggttgctcctatcctgaccaaaatcgccgccgtggctgaagatggtgaaccatgcgttacctatattggtgccgatggcgcaggtcactatgtgaagatggttcacaacggtattgaatacggtgatatgcaactgattgctgaagcctattctctgctgaaaggtggtctgaatctctctaacgaagaactggcacaaacctttaccgagtggaataacggtgaactgagcagttacctgatcgacatcactaaagacatcttcaccaaaaaagatgaagacggtaactacctggttgatgtgatcctggatgaagcagcaaacaaaggtacgggtaaatggaccagtcagagcgcgctggatctcggtgagccactgtcgctgattactgagtctgtgtttgcacgctacatctcttcactaaaagatcagcgcgtggctgcgtctaaagtactgtcgggtccacaagcgcagccagcaggcgacaaagcagagttcattgaaaaagttcgccgtgcgctttatctgggtaagattgtttcttacgcgcagggcttctctcagctgcgtgctgcgtctgaagagtacaactgggatctgaactacggtgaaatcgcgaagattttccgtgctggctgcatcatccgtgcgcagttcctgcagaaaatcaccgatgcttatgccgaaaatccgcagatcgctaacctgctgctggctccgtacttcaagcaaattgccgatgactaccagcaggctctgcgtgatgtcgttgcttatgcagtacagaacggtatcccggttccgaccttcgccgctgcggttgcctattacgatagctaccgtgccgctgttctgcctgcgaacctgatccaggcacagcgtgactatttcggtgcacatacttataagcgcattgataaagaaggtgtgttccatactgaatggctggattga

SEQ ID NO: 5000 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAQGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 5001 - DNA, 1104 bp, Escherichia coli
atgacagctagaacaactaaagttttgcacttacaattactcccactcttaagtggcgttcaaagggtaacattaaacgaaattagtgcgttatatactgattatgattatacactagtttgctcaaaaaaaggtccactaacaaaagcattgctggaatatgatgtcgattgtcattgtatccccgaacttacgagagaaattaccgtaaagaatgattttaaagcattgttcaagctttataagttcataaaaaaagaaaaatttgacattgtgcatacacattcttcaaaaacaggtattttggggcgagttgctgccaaattagcacgtgttggaaaggtgatccacactgtacatggtttttcttttccagccgcatctagtaaaaaaagttattacctttattttttcatggaatggatagcaaagttctttacggataagttaatcgtcttgaatgtagatgatgaatatatagcaataaacaaattaaaattcaagcgggataaagtttttttaattcctaatggagtagacactgataagttttctcctttagaaaataaaatttatagtagcaccttgaatctagtaatggttggtagattatccaagcaaaaagatcctgagacattattgcttgctgttgaaaaactgctgaatgaaaatgttaatgttaagctgacacttgtaggagatggtgaactaaaagaacagttagaaagcaggttcaaacggcaagatggacgtataatttttcatggatggtcagataacattgttaatattttaaaagttaatgatctttttatattaccttctctttgggagggtatgccattagcaattttagaagcattgagctgtggacttccatgtatagtcactaatattccaggtaataatagcttaatagaagatggctataatggttgtttgtttgaaattagagattgtcagttattatctcaaaaaatcatgtcatatgttggtaagccagaactgattgcacagcaatctaccaatgcacgatcatttattctgaaaaattatggattagttaaaagaaataataaggtcagacagctatatgataattaa

SEQ ID NO: 5002 - protein, 367 aa, Escherichia coli
MTARTTKVLHLQLLPLLSGVQRVTLNEISALYTDYDYTLVCSKKGPLTKALLEYDVDCHCIPELTREITVKNDFKALFKLYKFIKKEKFDIVHTHSSKTGILGRVAAKLARVGKVIHTVHGFSFPAASSKKSYYLYFFMEWIAKFFTDKLIVLNVDDEYIAINKLKFKRDKVFLIPNGVDTDKFSPLENKIYSSTLNLVMVGRLSKQKDPETLLLAVEKLLNENVNVKLTLVGDGELKEQLESRFKRQDGRIIFHGWSDNIVNILKVNDLFILPSLWEGMPLAILEALSCGLPCIVTNIPGNNSLIEDGYNGCLFEIRDCQLLSQKIMSYVGKPELIAQQSTNARSFILKNYGLVKRNNKVRQLYDN

SEQ ID NO: 5003 - DNA, 1107 bp, Escherichia coli
atgaaaatactatttgtcattacaggtttaggccttggaggtgctgagaagcaggtttgtcttttagctgataaattaagtttaagcgggcaccatgtaaagattatttcacttggacatatgtctaataataaagtctttcctagcgaaaataatgttaatgtcattaatgtaaatatgtcaaaaaacatttctggagttataaaaggttgtgtcagaattagagatgttatagctaatttcaaaccagacattgtacacagtcatatgtttcatgcaaacattatcactagattgtctgtaattggaatcaaaaacagacctggtattatatcaactgcacataataaaaatgaaggtgggtatttcagaatgctcacatatagaataaccgattgtttaagtgattgttgtacaaatgttagcaaagaagcagtggatgagtttttacggataaaagcctttaatcccgctaaagcaattactatgtataatgggatagataccaataaatttaaatttgatttattggcaaggagggaaattcgagacggtattaatataaaaaatgatgatatattattacttgctgcaggtcgtttaacgttagctaaagattatcctaatttattgaatgcaatgactctgcttcctgaacactttaaacttattattattggtgatggtgaattgcgtgacgaaattaatatgcttataaaaaaattgcaattatctaatagggtgtccttgttgggagttaaaaaaaatattgctccctatttttctgcatgtgatatttttgttctctcttctcgttgggaaggatttggattagtcgtggcagaagctatgtcatgtgagcgaattgttgttggcacggattcagggggagtaagagaagttattggtgacgatgattttcttgtacccatatctgattcaacacaacttgcaagcaaaattgaaaaattgtctttgagccagatacgtgatcacattggttttcggaatcgtgagcgtattttaaaaaatttctcaatagatactattattatgcagtggcaagaactctatggaactataatttgctcaaaacatgaaaggtag

SEQ ID NO: 5004 - protein, 368 aa, Escherichia coli
MKILFVITGLGLGGAEKQVCLLADKLSLSGHHVKIISLGHMSNNKVFPSENNVNVINVNMSKNISGVIKGCVRIRDVIANFKPDIVHSHMFHANIITRLSVIGIKNRPGIISTAHNKNEGGYFRMLTYRITDCLSDCCTNVSKEAVDEFLRIKAFNPAKAITMYNGIDTNKFKFDLLARREIRDGINIKNDDILLLAAGRLTLAKDYPNLLNAMTLLPEHFKLIIIGDGELRDEINMLIKKLQLSNRVSLLGVKKNIAPYFSACDIFVLSSRWEGFGLVVAEAMSCERIVVGTDSGGVREVIGDDDFLVPISDSTQLASKIEKLSLSQIRDHIGFRNRERILKNFSIDTIIMQWQELYGTIICSKHER

SEQ ID NO: 5005 - DNA, 789 bp, Escherichia coli
atgatttcaatacttacacctacttttaatcggcaacatactttatcaaggctattcaattctcttatattacaaactgataaagattttgagtggataataattgatgatggtagtatagatgcaacagcggtacttgtagaagattttagaaaaaaatgtgattttgacttgatttattgctatcaggaaaataatggtaagcccatggctttaaacgctggtgttaaagcttgtagaggcgattatatctttattgttgacagtgatgatgcactaactcccgatgccataaaattaattaaagaatcaatacatgattgcttatctgagaaggaaagtttcagcggagtcggttttagaaaagcatatataaaaggggggattattggtaatgatttaaataattcttcagaacatatatactatttaaatgcgactgagattagcaatttaataaatggtgatgttgcatattgttttaaaaaagaaagtttggtaaaaaatccattcccccgtatagaagatgaaaaatttgttccagaattatatatttggaataaaataactgacaaggcgaagattcgatttaacataagcaaagttatatatctttgtgagtatcttgatgatggtctttctaaaaatttccataaccagcttaaaaaatacccaaaggggtttaagatttattacaaagatcaaagaaaacgagagaaaacttatataaaaaaaacaaagatgctaattagatatttgcaatgttgttattatgagaaaataaaatga

SEQ ID NO: 5006 - protein, 262 aa, Escherichia coli
MISILTPTFNRQHTLSRLFNSLILQTDKDFEWIIIDDGSIDATAVLVEDFRKKCDFDLIYCYQENNGKPMALNAGVKACRGDYIFIVDSDDALTPDAIKLIKESIHDCLSEKESFSGVGFRKAYIKGGIIGNDLNNSSEHIYYLNATEISNLINGDVAYCFKKESLVKNPFPRIEDEKFVPELYIWNKITDKAKIRFNISKVIYLCEYLDDGLSKNFHNQLKKYPKGFKIYYKDQRKREKTYIKKTKMLIRYLQCCYYEKIK

SEQ ID NO: 5007 - DNA, 969 bp, Escherichia coli
atgtaccatcttactatggcgatttacagtaatatgcaaaccagtacagtaaccattctaatggccacctacaatggcgaggccttcatcaaaaatcagattttgtcactacaacaacaaacattttctaactggcggttatttattcaggatgatgggtctacagacaatactatatctataataaaaaacttccaaaaatctgactccagaattcggctagttgatgataatttgaaaggtcaaggtgcaggaaaaaattttttatcgctgataaagtacagcgagacagattatacaatttattgtgaccaagatgatatttggttagaaaacaaaatatttgaattagtaaagtatgcaaatgaaattaaattgaatgtatcagatgcgccttcgctagtttatgctgatggctatgcttatatggatggtgagggtacaatcgatttttctgggatatctaacaatcatgctgatcaattaaaggattttcttttttttaatggtggataccaaggatgttctattatgttcaatcgtgcaatgaccaaatttcttctgaattatcgaggatttgtatatctacatgacgatatcacaacattagctgcatacgctcttggtaaagtttattttctcccgaaataccttatgttatatagacagcacacgaatgcggtaactggtatcaaaacattccgcaatggattgacttctaaatttaaatcaccagtaaactatcttttatcacgaaaacattatcaggtaaaaaaatctttttttgaatgtaacagctctatcttatcagagacgaataaaaaagtttttttggattttatttcattttgtgaatcaaataataaatttacagatttttttaagttatggcgaggtgggtttagattaaataacagtagaactaaattattattaaaattcttaatacggagaaaatttagcgaatga

SEQ ID NO: 5008 - protein, 322 aa, Escherichia coli
MYHLTMAIYSNMQTSTVTILMATYNGEAFIKNQILSLQQQTFSNWRLFIQDDGSTDNTISIIKNFQKSDSRIRLVDDNLKGQGAGKNFLSLIKYSETDYTIYCDQDDIWLENKIFELVKYANEIKLNVSDAPSLVYADGYAYMDGEGTIDFSGISNNHADQLKDFLFFNGGYQGCSIMFNRAMTKFLLNYRGFVYLHDDITTLAAYALGKVYFLPKYLMLYRQHTNAVTGIKTFRNGLTSKFKSPVNYLLSRKHYQVKKSFFECNSSILSETNKKVFLDFISFCESNNKFTDFFKLWRGGFRLNNSRTKLLLKFLIRRKFSE

SEQ ID NO: 5009 - DNA, 1191 bp, Escherichia coli
atgatatatatattaactttaactcttcttctagttatagccataatgttttctcttctcggcacaaaaagtaggatcacatctccattacctttgcattttttaccatggttactaactttaattgtcgggataagtaattacgatcaattttacgagtttaatgaaagaagcttttactctttgttgatttggtttacagttatttttatattttatttcataggggaactggttaattataaacgtgaaaatataaatgtttattatggtctttcacatattaaatatgaatgtaaaaaatattggatcattgtcatcccaatttcattatataccattttcgaaatatatatggttggtatggggggagcagatggattctttctcaatttacgtcttgcaaatacattggagggctatacgggtaaaaaatttatcttaatgcctgctgtatatcctctaatgatggctatgttcgcaattgtttgtctaacaaaaacttccaaattaaataaatactccatttatttctggatgtttttgtattgtattggcacaatgggaaaattttcaatattaacgccaatattgacatatttaattatttatgacttcaaacatagattaaaagtaaaaaaaacaataaagtttacattgttgataattatattagctttaactttgcattttacacgtatggctgagaatgaccactcaacatttttatctattttagggctctatatttattcaccaataattgctttaggccagttgaatgaagtaaatagtagtcattttggtgagtatacgtttagattcatatatgctataactaataaaattggccttattaaagaattgccagtaaatactattcttgactattcatacgttcctgtaccaacaaatgtatatactgcacttcaaccattttaccaggattttggttatactggcatcatatttggagcagtattatacggactaatatatgtgagtttatacacggccggtgttcgtggaaataatacacaggcattactgatttacgcattgttttcagttagcagtgcaacggctttcttcgctgaaacgctagtaacgaatttagctggaaatgtgaagttagtattatgtaccatcttactatggcgatttacagtaatatgcaaaccagtacagtaa

SEQ ID NO: 5010 - protein, 396 aa, Escherichia coli
MIYILTLTLLLVIAIMFSLLGTKSRITSPLPLHFLPWLLTLIVGISNYDQFYEFNERSFYSLLIWFTVIFIFYFIGELVNYKRENINVYYGLSHIKYECKKYWIIVIPISLYTIFEIYMVGMGGADGFFLNLRLANTLEGYTGKKFILMPAVYPLMMAMFAIVCLTKTSKLNKYSIYFWMFLYCIGTMGKFSILTPILTYLIIYDFKHRLKVKKTIKFTLLIIILALTLHFTRMAENDHSTFLSILGLYIYSPIIALGQLNEVNSSHFGEYTFRFIYAITNKIGLIKELPVNTILDYSYVPVPTNVYTALQPFYQDFGYTGIIFGAVLYGLIYVSLYTAGVRGNNTQALLIYALFSVSSATAFFAETLVTNLAGNVKLVLCTILLWRFTVICKPVQ

SEQ ID NO: 5011 - DNA, 1248 bp, Escherichia coli
atgagtttaatcaaaaacagtttttggaacctttgcgggtatgtacttccagctattgtgacactaccagctttgggtattatggggcgaaaattaggcccagaattatttggtgtattcactttggcattagctgttgtgggttatgcaagcatttttgatgcaggccttactcgcgcagtgatacgagaagtcgcaattgaaaaagataatgaagaaaataagttgaaaattatttcttcagcgacagttgtaattatttatttgagtttggccgcctcactcttattatttttttttagtggtcatatcgcattgctactgaacattagtgagactttttttcataatgtaagtgtctcgcttaaaattctcgcagcatccataccattatttttgattactcaaatatggttgtcaattttagaaggtgaagaaagatttggtttacttaatatctacaaatcaattacgggagtgatattagcaatctcaccggcattatttatacttattaaaccctctttgatgtatgcgataataggcttagttctagcaaggtttttatgttttattttggcttttataatttgtcacgataaagtgcttaaagctaaactaacaatcgatataccaacaattaaaagattgtttatgttcggtggttggattacagtaagtaatatcatcagccctgtgctatcatattttgataggtttattgtttcaaatcaacttggggctgctaatgttgctttttatactgcaccatcagaaattatttctcggcttagtataattccaggtgcgttttcaagagccttatttccaagattagctaatgcaaataattccgctgaaagatataaaacgaaaagattaattacaatttcacttttaataatcatcacccctattttttgtattggcgtgttattttcagagaagataatggttttatggatgggggcatcattttttggtgagcctggtttggtattatcaatattactgattggctttatttttaatggattggcacaagtaccatttgccagtattcaatcccgaggtcatgctaagataactgcatttgttcatctcttagagttgtttccttatttattacttttattttacctcataaaagcacatggggttgttggcgcgggtattgcgtggtcagtgaggatgatagtagattatatagcattaagtcttttggacggtaagtatattaataaataa

SEQ ID NO: 5012 - protein, 415 aa, Escherichia coli
MSLIKNSFWNLCGYVLPAIVTLPALGIMGRKLGPELFGVFTLALAVVGYASIFDAGLTRAVIREVAIEKDNEENKLKIISSATVVIIYLSLAASLLLFFFSGHIALLLNISETFFHNVSVSLKILAASIPLFLITQIWLSILEGEERFGLLNIYKSITGVILAISPALFILIKPSLMYAIIGLVLARFLCFILAFIICHDKVLKAKLTIDIPTIKRLFMFGGWITVSNIISPVLSYFDRFIVSNQLGAANVAFYTAPSEIISRLSIIPGAFSRALFPRLANANNSAERYKTKRLITISLLIIITPIFCIGVLFSEKIMVLWMGASFFGEPGLVLSILLIGFIFNGLAQVPFASIQSRGHAKITAFVHLLELFPYLLLLFYLIKAHGVVGAGIAWSVRMIVDYIALSLLDGKYINK

SEQ ID NO: 5013 - DNA, 558 bp, Escherichia coli
atgaatgttattaaaacagaaattccagacgtactgatttttgaaccgaaagtttttggtgacgagcgcggtttctttttcgaaagctataaccagagggtttttgaggaagctgtaggtcgcaaagttgagtttgttcaggataaccattctaaatcgagaaaaggagtattgcggggattgcattatcaattagagccgtatgcgcaagcaaaacttgtgcgttgcattgagggtgaagtatttgatattgctgtagatatacggaagtcatctccattttttggtaaatgggttggtgtaacattatccgctgaaaataaacgtcaattatggatccctgaagggtttgctcatggttttgtggtgattagtgatactgcggaatttgtctataaaacgaacaattattacagtcaacaagcagagcgaagcataatttttgatgataaagacttagggattgcttggccattgaatactcattatattctttcagaaaaagatttaaatgcgccaacatttaagaaaatatcgagtaatgagtattttaaatga

SEQ ID NO: 5014 - protein, 185 aa, Escherichia coli
MNVIKTEIPDVLIFEPKVFGDERGFFFESYNQRVFEEAVGRKVEFVQDNHSKSRKGVLRGLHYQLEPYAQAKLVRCIEGEVFDIAVDIRKSSPFFGKWVGVTLSAENKRQLWIPEGFAHGFVVISDTAEFVYKTNNYYSQQAERSIIFDDKDLGIAWPLNTHYILSEKDLNAPTFKKISSNEYFK

SEQ ID NO: 5015 - DNA, 876 bp, Escherichia coli
atgaaaacgcgtaaaggtattattttagcgggtggttctggtacacgtctttatcctgtgactatggctgtcagtaaacagctgttaccgatttatgataaaccgatgatctattacccgctctctacactgatgttggcgggtattcgcgatattttgattatcagcacgccacaggatactcctcgttttcaacaactgctgggtgatgggagccagtgggggctaaatcttcactacaaagtgcaaccgagtccggatggtcttgcgcaggcatttatcatcggtgaagagtttatcggtggtgatgattgtgctttggtacttggtgataatatcttctacggtcacgacctgcctaagttaatggatgccgctgttaacaaagaaagtggtgcaacggtatttgcctatcacgttaatgatcctgaacgctatggtgtcgttgagtttgataaaaacggtacggcaattagcctcgaagaaaaaccgctacaaccaaaaagtaattatgcagtaaccgggctttatttctatgataactacgttgtggaaatggcgaaaaatcttaagccttctgcccgcggtgaactggaaattaccgatattaaccgtatttatatggaacaggggcatttatctgttgccatgatgggacgtggttatgcatggctggacacggggacacatcagagtcttattgaagcaagcaacttcattgccaccattgaagagcgccagggactaaaggtttcctgcccagaagaaattgcttatcgtaaaggatttattgacgcagagcaggttaaggtattagccgaaccgctgaagaaaaacgcttatggtcagtatttgctgaaaatgattaaaggttag

SEQ ID NO: 5016 - protein, 291 aa, Escherichia coli
MKTRKGIILAGGSGTRLYPVTMAVSKQLLPIYDKPMIYYPLSTLMLAGIRDILIISTPQDTPRFQQLLGDGSQWGLNLHYKVQPSPDGLAQAFIIGEEFIGGDDCALVLGDNIFYGHDLPKLMDAAVNKESGATVFAYHVNDPERYGVVEFDKNGTAISLEEKPLQPKSNYAVTGLYFYDNYVVEMAKNLKPSARGELEITDINRIYMEQGHLSVAMMGRGYAWLDTGTHQSLIEASNFIATIEERQGLKVSCPEEIAYRKGFIDAEQVKVLAEPLKKNAYGQYLLKMIKG

SEQ ID NO: 5017 - DNA, 900 bp, Escherichia coli
atgaatatcctcctttttggcaaaacagggcaggttggttgggaactacagcgtgctctggcacctctgggtaatttgattgctcttgatgttcactccactgattactgtggtgattttagtaaccctgaaggtgtggctgaaaccgttagaagcattcggcctgatattattgtcaacgcagccgctcacaccgcagtagacaaagcagaatcagaaccggagtttgcacaattactgaacgcgacgagtgtcgaagcgatcgcgaaagcagccaatgaagtcggcgcttgggttattcactactctactgactacgtatttccggggaccggtgaaataccatggcaggaggaggatgcaaccgcaccgctaaatgtttacggtgaaaccaagttagcaggagaaaaagcattacaagagcattgtgcgaagcaccttattttccggaccagctgggtctatgcaggtaaaggaaataacttcgccaaaacgatgttgcgtctggcaaaagagcgtgaagaattagccgttattaatgatcagtttggtgcgccaactggcgcagagttgctggctgattgtacggcacatgccattcgtgtggcactgaataaaccggaagtcgcaggtttgtaccatctggtagccagtggtaccacaacctggcacgattatgctgcgctggtttttgaagaggcgcgcaaagcaggcattccccttgcactcaacaagctcaacgcagtaccaacaacagtctatcctacaccagctcgtcgtccacataactctcgccttaatacagaaaaatttcagcagaactttgcgcttgtcttgcctgactggcaggttggtgtgaaacgcatgctcaacgaattatttacgactacagcaatttaa

SEQ ID NO: 5018 - protein, 299 aa, Escherichia coli
MNILLFGKTGQVGWELQRALAPLGNLIALDVHSTDYCGDFSNPEGVAETVRSIRPDIIVNAAAHTAVDKAESEPEFAQLLNATSVEAIAKAANEVGAWVIHYSTDYVFPGTGEIPWQEEDATAPLNVYGETKLAGEKALQEHCAKHLIFRTSWVYAGKGNNFAKTMLRLAKEREELAVINDQFGAPTGAELLADCTAHAIRVALNKPEVAGLYHLVASGTTTWHDYAALVFEEARKAGIPLALNKLNAVPTTVYPTPARRPHNSRLNTEKFQQNFALVLPDWQVGVKRMLNELFTTTAI

SEQ ID NO: 5019 - DNA, 1086 bp, Escherichia coli
gtgaaaatacttgttactggtggcgcaggatttattggttctgctgtagttcgtcacattataaatgatacgcaggatagtgttgttaatgtcgataaattaacgtacgccggaaacctggaatcacttgcagatgtttctgattctgaacgctatttctttgaacatgcggatatttgtgatgcagctgcaatggcacgggtttttgctcagcatcagccggatgcagtgatgcacctggcagctgaaagccatgttgaccgttcaattacaggccctgcggcatttattgaaaccaatattgttggtacttatgtccttttagaagcggctcggaattactggtctgcacttgatggcgacaagaaaaacagcttccgttttcatcatatttctactgacgaagtctatggtgatttgcctcatcctgacgaggtaaataataaagaaggattacccttatttactgagacgacagcctacgcaccaagcagcccttattctgcatcaaaagcgtccagcgatcatttagtccgtgcgtggaaacgtacctatggtttaccgaccattgtgactaattgctctaacaattatggtccttatcatttcccggaaaaattgattccattggttattctgaatgctctggaaggtaaaggattacctatttatggaaaaggcgatcaaattcgcgactggctgtatgttgaagatcatgcgcgtgcgttatataccgtcgtaaccgaaggtaaagcgggtgaaacttataacattggtggacacaacgaaaagaaaaacatcgatgtagtgctcactatttgtgatttgttggatgagattgtcccgaaagagaaatcttaccgcgagcaaattacttatgttgccgatcgtccgggacacgatcgacgttatgcgattgatgctgagaagattggtcgcgaattgggatggaaaccacaggaaacgtttgagagcgggattcgtaaaactgtggaatggtatctgtccaatacaaaatgggttgataatgtgaaaagtggtgcctatcaatcgtggattgaacagaactatgagggccgccactaa

SEQ ID NO: 5020 - protein, 361 aa, Escherichia coli
MKILVTGGAGFIGSAVVRHIINDTQDSVVNVDKLTYAGNLESLADVSDSERYFFEHADICDAAAMARVFAQHQPDAVMHLAAESHVDRSITGPAAFIETNIVGTYVLLEAARNYWSALDGDKKNSFRFHHISTDEVYGDLPHPDEVNNKEGLPLFTETTAYAPSSPYSASKASSDHLVRAWKRTYGLPTIVTNCSNNYGPYHFPEKLIPLVILNALEGKGLPIYGKGDQIRDWLYVEDHARALYTVVTEGKAGETYNIGGHNEKKNIDVVLTICDLLDEIVPKEKSYREQITYVADRPGHDRRYAIDAEKIGRELGWKPQETFESGIRKTVEWYLSNTKWVDNVKSGAYQSWIEQNYEGRH

SEQ ID NO: 5021 - DNA, 894 bp, Escherichia coli
atgacgaatttaaaagcagttattcctgtagcgggtcttgggatgcatatgttgcctgccactaaggcgattcccaaagagatgctaccgatcgtcgacaagccaatgattcagtacatcgttgacgagattgtggctgcagggatcaaagaaatcctcctggtaactcacgcgtccaagaacgcggtcgaaaaccacttcgacacctcttatgaattagaatctctccttgaacagcgcgtgaagcgtcaactgctggcggaagtacagtccatttgcccgccgggcgtgacaattatgaacgtgcgtcagggcgaacctttaggtttgggccactccattttatgtgcacgacctgccattggtgacaatccatttgtcgtggtgctgccagacgttgtgatcgacgacgccagcgccgacccgctgcgctacaaccttgctgccatgattgcgcgctttaacgaaactggccgcagccaggttctggcaaaacgcatgccgggcgatctctctgaatactccgtcatccagactaaagaaccgcttgatcgcgaaggtaaagtcagccgcattgttgaatttatcgaaaaaccggatcagccgcagaccctggactcagacatcatggctgtagggcgttatgtgctttctgccgatatttggcctgaactggagcgtactcaacctggagcatggggacgtattcagttgactgatgccattgctgagttggcaaaaaaacaagcagttgacgcaatgctgatgactggggacagttacgactgcggaaagaaaatgggttatatgcaagcgtttgtgaagtatgggctgcgtaacctaaaagaaggggcgaagttccgtaaagggattgagaagctgttaagcgaataa

SEQ ID NO: 5022 - protein, 297 aa, Escherichia coli
MTNLKAVIPVAGLGMHMLPATKAIPKEMLPIVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQAVDAMLMTGDSYDCGKKMGYMQAFVKYGLRNLKEGAKFRKGIEKLLSE

SEQ ID NO: 5023 - DNA, 1395 bp, Escherichia coli
atgccatttaaaaaactctcccgacgcaccttcctgacggcaagctcggcgcttgccttccttcatacccctttcgctcgtgcacttcccgcccgacaaagcgttaacattaacgactacaaccctcacgactggatcgcctcatttaaacaagccttcagcgaagggcaaacggtcgtcgtgcccgccggattggtttgtgacaatatcaacaccggcatcttcattccttctggcaaaacgttacacatccttggaagcctgcgcggcaacggcagagggcgatttgtcttacaggatggcagccgggtgacaggggaggggggcggcagtatgcataacatcaccctggatgtgcgcggctctgactgcaccatcaaagggctggcgatgagcggctttggtccggtaacgcagatttatatcggcggcaaaaacaaacgggtcatgcacaacctgaccatcgataacctgaccgttagccacgctaattacgccatcttacgccagggatttcataaccagataatcggtgccaacatcaccaactgtaagttcagcgacttacagggcgacgctattgaatggaacgtggcgattaacgacagtgatattttgatatccgaccatctcattgagcgcattaactgtaccaacggcaaaatcaactggggcatcggcataggccttgcgggaagtacctacgataataattatccggaaaaccaggcagtgaaaaactttgtcgtggcgaatatcacgggatcggattgtcggcaactgatccatgttgaaaatggtaaacattttgttatccgtaatatcaaagctcgtaatatcacgccggatttcagtaagaaagcaggtattgataacgccacagttgctatttatggttgtgacaactttgtgattgataatattgaaatgattaatagtgccgggatgttaatcggctatggggtaattaaaggcaaatatctctcgataccgcagaatttccgagtgaatgatattcaactggataatactcatcttgcttataaattgcgcggcattcaaatctccgccgggaatgctgtctcctttgtggcgctgactaacattgagatgaagcgtgcgtcgctggagttacacaacaaaccgcaacatctttttatgcgaaatatcaatgtgatgcaggaatcctcagttggacccgcattgagcatgaactttgacatgcgcaaagacgttcgaggcgtttttatggcaaagcgtaaaacgctgctttcactcacgaatattcatgcagtgaatgaaaaagggcaaagctccgtcgatatcgacaggattaatcaccatattgttaatgtggagaagattaactttagattgccggaacggagggagtag

SEQ ID NO: 5024 - protein, 464 aa, Escherichia coli
MPFKKLSRRTFLTASSALAFLHTPFARALPARQSVNINDYNPHDWIASFKQAFSEGQTVVVPAGLVCDNINTGIFIPSGKTLHILGSLRGNGRGRFVLQDGSRVTGEGGGSMHNITLDVRGSDCTIKGLAMSGFGPVTQIYIGGKNKRVMHNLTIDNLTVSHANYAILRQGFHNQIIGANITNCKFSDLQGDAIEWNVAINDSDILISDHLIERINCTNGKINWGIGIGLAGSTYDNNYPENQAVKNFVVANITGSDCRQLIHVENGKHFVIRNIKARNITPDFSKKAGIDNATVAIYGCDNFVIDNIEMINSAGMLIGYGVIKGKYLSIPQNFRVNDIQLDNTHLAYKLRGIQISAGNAVSFVALTNIEMKRASLELHNKPQHLFMRNINVMQESSVGPALSMNFDMRKDVRGVFMAKRKTLLSLTNIHAVNEKGQSSVDIDRINHHIVNVEKINFRLPERRE

SEQ ID NO: 5025 - DNA, 1221 bp, Escherichia coli
atgaaggtcggcttctttttactgaaatttccgctgtcgtcggaaaccttcgttcttaaccaaatcactgcgtttattgatatgggctttgaggtggagattatcgcgctgcaaaaaggcgacacacaaaacacccacgcggcatggacgaaatacaaccttgccgccagaacccgttggttacaggacgaacctgcgggcaaagtggcgaaactgcgccaccgcgccagccagaccttacgcggcattcatcgtaaaaatacctggcaggcgctcaacctcaaacgctatggtgctgagtcgcggaacctgattttgtctgccatttgtggtcaggtcgcaacaccgtttcatgccgatgtgtttatcgctcattttggccctgctggggtaaccgcggcaaaactacgcgaactgggtgtcattcgcggcaaaattgccactatcttccacggtattgatatctccaggcgggaagtgctcaaccactacactcccgaatatcagcaactgttccgccgtggcgatctgatgctaccgataagcgatctgtgggccggaaggctgcaaaaaatgggctgcccgagggaaaaaatcgtcgtatcgcgcatgggcgtggacatgacgcgttttagcccgcgtccggtgaaagcacccgcaacaccgctggaaatcatttccgtcgcacgcttaaccgagaaaaaaggcctgcatgtggcgattgaagcctgccgtcagttgaaagagcagggcgtggcatttcgctatcgcatcctcggcattggcccgtgggaacgacgcctgcgcaccctcatcgaacaatatcaactggaagatgtggtagagatgccgggctttaaaccgagccacgaagtgaaagcgatgctagacgacgcggatgtcttcctgttgccatcggttacaggtgcggatggcgatatggaaggtattccggtggcgctgatggaagcgatggcggtcggcattccggtagtttccactctgcatagcggaataccggaactggtggaggccgataaatccggctggctggtgcctgagaacgatgctcgcgcactggcgcaacgactggcgacgtttagccaactggacaccgacgaactggctcctgtcgtcaaacgtgctcgcgaaaaagtcgaacacgattttaaccagcaggtgattaatcgagaactcgccagcttgctgcaagctttatag

SEQ ID NO: 5026 - protein, 406 aa, Escherichia coli
MKVGFFLLKFPLSSETFVLNQITAFIDMGFEVEIIALQKGDTQNTHAAWTKYNLAARTRWLQDEPAGKVAKLRHRASQTLRGIHRKNTWQALNLKRYGAESRNLILSAICGQVATPFHADVFIAHFGPAGVTAAKLRELGVIRGKIATIFHGIDISRREVLNHYTPEYQQLFRRGDLMLPISDLWAGRLQKMGCPREKIVVSRMGVDMTRFSPRPVKAPATPLEIISVARLTEKKGLHVAIEACRQLKEQGVAFRYRILGIGPWERRLRTLIEQYQLEDVVEMPGFKPSHEVKAMLDDADVFLLPSVTGADGDMEGIPVALMEAMAVGIPVVSTLHSGIPELVEADKSGWLVPENDARALAQRLATFSQLDTDELAPVVKRAREKVEHDFNQQVINRELASLLQAL

SEQ ID NO: 5027 - DNA, 1281 bp, Escherichia coli
atgaaattacttattctgggcaaccacacttgcggcaatcgtggcgacagcgccatcctgcgcggcttacttgatgccatcaatatcctcaatccacacgccgaagtggacgtgatgagccgctatccggtcagttcttcctggctgctcaaccgcccggtaatgggcgatccgctgttcctgcaaatgaaacaacacaacagcgcagcgggcgttgtcgggcgcgttaaaaaagtcctccgtcgccgttaccaacatcaggtactgctctcacgcgtcaccgacactggcaagttgcgtaatatcgccatcgcccagggattcaccgacttcgtgcgcttgctgtcaggttacgacgccattattcaggtcggcggatcgttttttgtcgatctctatggcgtgccgcagtttgaacatgcgctttgcacgtttatggcgaaaaagccgctgtttatgattggtcacagtgttggcccgttccaggatgagcaatttaaccaactggcgaaatacgtattcggtcgctgcgacgcgctgatcctgcgcgaatcggtcagcctcgatctaatgaaacgcagcaatatcaccactgcaaaagtggaacatggcgtcgataccgcgtggctggtcgatcaccacattgaagacttcactgccagctatgccgttcaacactggctggacgttgccgcacaacagaaaacggtggcaattaccctgcgcgaactggcaccgttcgacaaacgtctcggcaccacccaacaagcgtatgaaaaagcctttgccggggtggtcaatcgcattctcgatgaagggtatcaggtgattgcgctctccacctgtacgggcattgacagctataacaaagacgaccgcatggtggcgctcaatctgcgccagcacatcagcgatcctgcccgttaccacgtagtgatggatgaactcaacgatctggaaatgggcaaaattctcggtgcctgtgaactcaccgtcggcacgcgtctgcactctgccattatctcgatgaactttgccactccggcgattgccatcaactatgaacataaatccgccgggattatgcaacaactggggctaccagagatggcaattgatatccgtcatttattagacggcagcctgcaagcgatggttgcggataccttaggtcagcttccggcgctgaacgcacgacttaacgaagctgtcagtcgcgaacgtcagacgggaatgcagatggtgaaatctgtgcttgaacgcatcggggaggcaaaatga

SEQ ID NO: 5028 - protein, 426 aa, Escherichia coli
MKLLILGNHTCGNRGDSAILRGLLDAINILNPHAEVDVMSRYPVSSSWLLNRPVMGDPLFLQMKQHNSAAGVVGRVKKVLRRRYQHQVLLSRVTDTGKLRNIAIAQGFTDFVRLLSGYDAIIQVGGSFFVDLYGVPQFEHALCTFMAKKPLFMIGHSVGPFQDEQFNQLAKYVFGRCDALILRESVSLDLMKRSNITTAKVEHGVDTAWLVDHHIEDFTASYAVQHWLDVAAQQKTVAITLRELAPFDKRLGTTQQAYEKAFAGVVNRILDEGYQVIALSTCTGIDSYNKDDRMVALNLRQHISDPARYHVVMDELNDLEMGKILGACELTVGTRLHSAIISMNFATPAIAINYEHKSAGIMQQLGLPEMAIDIRHLLDGSLQAMVADTLGQLPALNARLNEAVSRERQTGMQMVKSVLERIGEAK

SEQ ID NO: 5029 - DNA, 1479 bp, Escherichia coli
atgagcttacgtgaaaaaaccatcagcggcgcgaagtggtcggcgattgccacggtgatcatcatcggcctcgggctggtgcagatgaccgtgctggcgcggattatcgacaaccaccagttcggtttgcttaccgtgtcgctggtgatcatcgcgctggcagatacgctttctgacttcggtatcgctaactcgattattcagcgaaaagaaatcagccaccttgaactcaccacgctgtactggctgaacgttgggctggggcttgtggtgtgtgtggcggtgtttttgttgagtgatgtcatcggtgacgtgttgaataacccggacctggcaccgttgattaaaacattgtcgctggcgtttgtggtgatcccccacgggcaacagttccgcgcgttgatgcaaaaggagctggagttcaacaaaatcggcatgatcgaaaccagcgcggtgctggcgggcttcacttttacagtggttagcgcccatttctggccgctggcgatgaccgcgattctcggttatctggtcaatagtgcggtgagaacgctgctgtttggctactttggccgcaaaatttatcgccccggtctgcatttctcgctggcgtcggtggcaccgaacttacgctttggtgcctggctgacggcggacagcatcatcaactatctcaacaccaacctttcaacgctggtgctggcgcgtattctcggcgctggcgtggctgggggatacaacctggcgtacaacgtggccgttgtgccaccgatgaagctgaacccgatcatcacccgcgtgttgtttccggcgttcgccaaaattcaggacgacacagaaaagctgcgcgtcaacttctacaagctgctgtcggtagtggggattatcaactttccggcgctgctcgggctgatggtggtgtcgaataactttgtaccgctggtatttggcgaaaagtggagcagcattattccggtgctgcaattgctgtgtgtggtggggctgctgcgttccgtgggtaacccgattggttcgctgctgatggcgaaagcgcgggtcgatatcagctttaaattcaacgtattcaaaacctttctgtttattccggcaatcatcattggtgggcagatggcgggcgcaatcggcgtcacgctcggtttcctgctggtgcagattatcaacaccattctgagctatttcgtgatgattaaaccggtgctcggttccagttatcgccagtacatcctgagtttgtggctgccgttttatctctcgctgccgacgctggtggtcagttatgcgctgggcattgtgctgaaagggcaactggcgctggggatgctgctggcggtgcaaatagccgcgggcgtgctggcgtttgtggtgatgattgtgctgtcgcgccatccgctggtggtggaagtgaagcgtcagttttgtcgcagcgaaaaaatgaaaatgcttttacgggcggggtga

SEQ ID NO: 5030 - protein, 492 aa, Escherichia coli
MSLREKTISGAKWSAIATVIIIGLGLVQMTVLARIIDNHQFGLLTVSLVIIALADTLSDFGIANSIIQRKEISHLELTTLYWLNVGLGLVVCVAVFLLSDVIGDVLNNPDLAPLIKTLSLAFVVIPHGQQFRALMQKELEFNKIGMIETSAVLAGFTFTVVSAHFWPLAMTAILGYLVNSAVRTLLFGYFGRKIYRPGLHFSLASVAPNLRFGAWLTADSIINYLNTNLSTLVLARILGAGVAGGYNLAYNVAVVPPMKLNPIITRVLFPAFAKIQDDTEKLRVNFYKLLSVVGIINFPALLGLMVVSNNFVPLVFGEKWSSIIPVLQLLCVVGLLRSVGNPIGSLLMAKARVDISFKFNVFKTFLFIPAIIIGGQMAGAIGVTLGFLLVQIINTILSYFVMIKPVLGSSYRQYILSLWLPFYLSLPTLVVSYALGIVLKGQLALGMLLAVQIAAGVLAFVVMIVLSRHPLVVEVKRQFCRSEKMKMLLRAG

SEQ ID NO: 5031 - DNA, 1395 bp, Escherichia coli
atgacaaatctaaaaaagcgcgagcgagcgaaaaccaatgcatcgttaatctctatggtgcaacgcttttcagatatcaccatcatgtttgccggactatggctggtttgcgaagtgagcggactgtcattcctctacatgcacctgttggtggcgctgattacgctggtggtgttccagatgctgggcggcatcaccgacttttatcgctcatggcgcggtgttcgggcagcgacagaatttgccctgttgctacaaaactggacgttaagcgtgattttcagcgctggactggtggcgttcaacaatgatttcgacacgcaactgaaaatctggctggcgtggtatgggctgaccagcatcggactggtggtttgccgttcgtgtattcgcattggggcgggctggctgcgtaatcatggctataacaagcgcatggtcgcggtggcgggggatttagccgccggacaaatgctgatggagagcttccgtaatcagccgtggttagggtttgaagtggtgggcgtttaccacgacccgaaaccgggtggcgtttctaacgactgggcgggcaatctgcaacaactggtcgaggatgcgaaagcgggcaagattcataacgtctatatcgcgatgcagatgtgcgacggcgcgcgagtgaaaaaactggtccatcaactggcggacaccacctgttcggtgctgctgatccccgatgtctttaccttcaacattctccattcacgcctcgaagagatgaatggcgtaccggtggtgccgctgtatgacacgccgctttccggggttaaccgcctgctcaaacgtgcagaagacattgtgctggcgacgcttattctgctgctgatctccccggtgctgtgctgcattgcgctggcggtgaaactgagctcaccggggccggttattttccgccagactcgctacggcatggatggcaagccgatcaaagtgtggaagttccgttccatgaaagtgatggagaacgacaaagtggtgactcaggcgacacagaacgatccgcgcgtcaccaaagtggggaactttctgcgccgcacctcgctggacgaattgccgcagtttatcaatgtgctgactggcgggatgtcgattgtcggtccgcgtccgcacgcggtggcgcataacgaacagtatcgccagctcattgaaggctacatgctgcgccataaagtgaaaccgggcattaccggctgggcgcagattaacggctggcgcggcgaaaccgacacgctggagaaaatggaaaaacgcgtcgagttcgaccttgagtacatccgcgaatggagcgtctggttcgatatcaaaatcgttttcctgacggtattcaaaggcttcgttaacaaagcggcatattga

SEQ ID NO: 5032 - protein, 464 aa, Escherichia coli
MTNLKKRERAKTNASLISMVQRFSDITIMFAGLWLVCEVSGLSFLYMHLLVALITLVVFQMLGGITDFYRSWRGVRAATEFALLLQNWTLSVIFSAGLVAFNNDFDTQLKIWLAWYGLTSIGLVVCRSCIRIGAGWLRNHGYNKRMVAVAGDLAAGQMLMESFRNQPWLGFEVVGVYHDPKPGGVSNDWAGNLQQLVEDAKAGKIHNVYIAMQMCDGARVKKLVHQLADTTCSVLLIPDVFTFNILHSRLEEMNGVPVVPLYDTPLSGVNRLLKRAEDIVLATLILLLISPVLCCIALAVKLSSPGPVIFRQTRYGMDGKPIKVWKFRSMKVMENDKVVTQATQNDPRVTKVGNFLRRTSLDELPQFINVLTGGMSIVGPRPHAVAHNEQYRQLIEGYMLRHKVKPGITGWAQINGWRGETDTLEKMEKRVEFDLEYIREWSVWFDIKIVFLTVFKGFVNKAAY

SEQ ID NO: 5033 - DNA, 1419 bp, Escherichia coli
ttggccgtttcggtcagggccaactattgcctgaaaaagggtaacgatatgaaaaaattaacctgctttaaagcctatgatattcgcggaaaattaggcgaagaactgaatgaagatattgcctggcgcattggtcgcgcttatggcgaatttctcaaaccgaaaaccattgtgttaggcggtgatgtccgcctcaccagcgaaaccttaaaactggcgctggcgaaaggtttacaggatgcgggcgtcgatgtgctggatatcggtatgtccggcaccgaagaaatctatttcgccacgttccatctcggcgtggatggcggcatcgaagttaccgccagccataacccgatggattacaacggcatgaaactggtgcgcgaaggggctcgcccgatcagcggcgataccggactgcgcgacgtccagcgtctggcagaagccaacgactttcctcctgtcgatgaaagcaaacgcggtcgctatcagcaaatcaatctgcgtgacgtttacgttgatcacctgttcggttatatcaacgtcaaaaaccttacgccgctcaagctggtgattaactccgggaacggcgcggcgggtccggtagttgacgccatcgaagcccgctttaaagccctcggcgcaccggtggagttaatcaaagtgcacaacacgccggacggcaatttccccaacggtattcctaacccgttgctgccggaatgtcgcgacgacacccgcaatgcggtcatcaaacacggcgcggatatgggcattgcctttgatggcgattttgaccgctgtttcctgtttgacgaaaaagggcagtttatcgagggttactacattgtcggtttgctggcagaagcgttcctcgaaaaaaatcccggcgcgaagatcatccacgatccacgtctctcctggaacaccgttgatgtggtgactgccgcaggcggcaccccggtaatgtcgaaaaccggacacgcctttattaaagaacgtatgcgcaaggaagacgctatctacggtggcgaaatgagcgcccaccattacttccgtgatttcgcttactgcgacagcggcatgatcccgtggctgctggtcgccgaactggtgtgcctgaaaggaaaaacgctgggcgaactggtgcgcgaccggatgtcagcgtttccggcaagcggtgagatcaacagcaaactggcacaacctgttgaggcgattaaccgcgtggaacagcactttagccgcgaggcgctggcggtggatcgcaccgatggcatcagtatgacctttgccgactggcgctttaatctgcgcacctccaacaccgaaccggtggtgcggttgaatgtggaatcacgcggtgatgtgccgctgatggaagcgcgaacgcgaactctgctgacgttgctgaacgagtaa

SEQ ID NO: 5034 - protein, 472 aa, Escherichia coli
MAVSVRANYCLKKGNDMKKLTCFKAYDIRGKLGEELNEDIAWRIGRAYGEFLKPKTIVLGGDVRLTSETLKLALAKGLQDAGVDVLDIGMSGTEEIYFATFHLGVDGGIEVTASHNPMDYNGMKLVREGARPISGDTGLRDVQRLAEANDFPPVDESKRGRYQQINLRDVYVDHLFGYINVKNLTPLKLVINSGNGAAGPVVDAIEARFKALGAPVELIKVHNTPDGNFPNGIPNPLLPECRDDTRNAVIKHGADMGIAFDGDFDRCFLFDEKGQFIEGYYIVGLLAEAFLEKNPGAKIIHDPRLSWNTVDVVTAAGGTPVMSKTGHAFIKERMRKEDAIYGGEMSAHHYFRDFAYCDSGMIPWLLVAELVCLKGKTLGELVRDRMSAFPASGEINSKLAQPVEAINRVEQHFSREALAVDRTDGISMTFADWRFNLRTSNTEPVVRLNVESRGDVPLMEARTRTLLTLLNE

SEQ ID NO: 5035 - DNA, 1437 bp, Escherichia coli
atggcgcagtcgaaactctatccagttgtgatggcaggtggctccggtagccgcttatggccgctttcccgcgtactttaccccaagcagtttttatgcctgaaaggcgatctcaccatgctgcaaaccaccatctgtcgcctgaacggcgtggagtgcgaaagcccggtggtgatttgcaatgagcagcaccgctttattgtcgcggaacagctgcgtcaactaaataaacttaccgagaacattattctcgaacctgcagggcgtaacactgcaccggccattgcgctggcggcgctggcggcaaaacgtcatagcccggagaacgacccattaatgctggtgctggcggcggatcatgtgattgccgatgaagacgcgttccgtgccgccgtgcgtaatgccatgccatatgccgaagcgggcaagctggtgaccttcggcattgtgccggatctacctgaaaccggatatggctatattcgtcgcggtgaagtgtctgcgggtgagcaggatacggtggcctttgaagtggcgcagtttgtcgaaaaaccgaatctggaaaccgcgcaggcctatgtggcaagtggcgaatattactggaacagcggtatgttcctgttccgtgccggacgttatctcgaagaactgaaaaagtatcgtccggatattctcgatgcctgtgaaaaagcgatgagcgccgtcgatccggatctcgattttattcgtgtggatgaagaggcgtttctcgcctgtccggaagagtcggtggattacgcggtcatggaacgcacggcagatgccgttgtggtgccgatggatgcgggctggagcgatgtcggttcctggtcctctttatgggagatcagtgcccacaccgccgagggcaacgtttgccatggcgatgtgattaatcacaaaactgaaaacagctatgtgtatgccgaatctggcctggtcaccaccgtcggggtgaaagatttggtggtagtgcagaccaaagatgcagtgctgattgccgaccgtaacgcggtgcaggatgtgaaaaaagtggtcgagcagatcaaagctgatggtcgccatgagcatcgggtgcatcgcgaagtgtatcgtccgtggggcaaatatgactctatcgacgcgggcgaccgctaccaggtgaaacgcatcaccgtgaaaccgggcgaaggcttgtcggtacagatgcaccatcaccgcgctgaacactgggtggttgtcgcgggaacggcaaaagtcactatcgacggtgatatcaaactgcttggtgaaaacgagtccatttatattccgctgggggcgacgcattgcctggaaaacccggggaaaattccgctcgatttaattgaagttcgctccggctcttatctcgaagaggatgatgtggtgcgcttcgcggatcgctacggacgggtgtaa

SEQ ID NO: 5036 - protein, 478 aa, Escherichia coli
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPENDPLMLVLAADHVIADEDAFRAAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 5037 - DNA, 1224 bp, Escherichia coli
atgaaaatactggtctacggcattaactactcgccggagttaaccggcatcggcaaatacaccggcgagatggtggaatggctggcggcacaaggtcatgaggtgcgggtcattaccgcgccgccttactacccgcagtggcaggtgggcgagaactattccgcctggcggtacaaacgggaagagggggccgccatggtgtggcgctgcccgctgtacgtgccaaaacagccgagcactctgaaacgcctgttgcatctcggcagttttgccgtcagcagtttctttccgctgatggcgcaacgtcgctggaagccggatcgcattatcggcgtagtgccaacgctgttttgcacgccgggaatgcgcctgctggcgaaactctctggtgcgcgtaccgtgctgcatattcaggattacgaagtggacgccatgctggggctgggccttgccggaaaaggcaaaggcggcaaagtggcacagctggcgacggcgttcgaacgtagcggactgcataacgtcgataacgtctccacgatttcgcgttcgatgatgaataaagccatcgaaaaaggcgtggcggcggaaaacgtcattttcttcccaaactggtcggaaatcgcccgttttcagcatgtcgcagacgccgatgttgatgcccttcgtaaccagcttggcctgccggataacaaaaaaatcattctttactccggcaatattggtgaaaagcaggggctggaaagcgttattgaagctgccgatcgcctgcgcgatgaaccgctgatttttgccattgtcgggcagggcggcggcaaagcgcggctggaaaaaatggcgcagcagcgtggactgcgcaacatgcagttttttccgctgcaatcgtatgacgctttacccgcactgctgaagatgggggattgccatctggtggtgcaaaaacgcggcgcggcagatgccgtattgccgtcgaaactgaccaatattctggcggtaggcggtaacgcggtgattaccgcagaagcccacaccgaactggggcagctttgcgaaacctttccgggcattgcggtttgcgtagaaccggaatcggtcgaggcgctggtggcggggatttgccaggcgctcctgctgcccaaacacaacacggtggcacgtgaatatgccgaacgcacgctcgataaagagaacgtgttacgtcaatttataaatgatattcggggataa

SEQ ID NO: 5038 - protein, 407 aa, Escherichia coli
MKILVYGINYSPELTGIGKYTGEMVEWLAAQGHEVRVITAPPYYPQWQVGENYSAWRYKREEGAAMVWRCPLYVPKQPSTLKRLLHLGSFAVSSFFPLMAQRRWKPDRIIGVVPTLFCTPGMRLLAKLSGARTVLHIQDYEVDAMLGLGLAGKGKGGKVAQLATAFERSGLHNVDNVSTISRSMMNKAIEKGVAAENVIFFPNWSEIARFQHVADADVDALRNQLGLPDNKKIILYSGNIGEKQGLESVIEAADRLRDEPLIFAIVGQGGGKARLEKMAQQRGLRNMQFFPLQSYDALPALLKMGDCHLVVQKRGAADAVLPSKLTNILAVGGNAVITAEAHTELGQLCETFPGIAVCVEPESVEALVAGICQALLLPKHNTVAREYAERTLDKENVLRQFINDIRG

SEQ ID NO: 5039 - DNA, 480 bp, Escherichia coli
atgtttttacgtcaggaagactttgccacggtagtgcgctccactccgcttgtctctctcgactttattgtcgagaacagtcgcggcgagtttctgcttggcaaaagaaccaaccgcccggcgcagggttactggtttgtgccgggagggcgcgtgcagaaagacgaaacgctggaagccgcatttgagcggctgacgatggcggaactggggctgcgtctgccgataacagcaggccagttttacggtgtctggcagcacttttatgacgataacttctccggctcggattttaccactcactatgtggtgctcggttttcgcttcagagtagcggaagatgagctgttactgccggatgagcagcatgacgattaccgctggctgacgccggacgcgttgctcgccagtgacaatgttcacgctaacagccgcgcctattttctcgctgagaagcgtgccggagtacccggattatga

SEQ ID NO: 5040 - protein, 159 aa, Escherichia coli
MFLRQEDFATVVRSTPLVSLDFIVENSRGEFLLGKRTNRPAQGYWFVPGGRVQKDETLEAAFERLTMAELGLRLPITAGQFYGVWQHFYDDNFSGSDFTTHYVVLGFRFRVAEDELLLPDEQHDDYRWLTPDALLASDNVHANSRAYFLAEKRAGVPGL

SEQ ID NO: 5041 - DNA, 966 bp, Escherichia coli
atgagtagacaacgcatttttattgctggccatcgcgggatggtcggttccgccatcaggcggcagctcgaacagcgtggtgatgtggaactggtattacgcacccgcgacgagctgaacctgctggacagccgcgcggtgcatgatttctttgccagcgaacgtattgaccaggtctatctggcggcggcgaaagtgggcggcattgttgccaacaacacctatccggcggatttcatctatcagaacatgatgattgagagcaacatcattcacgccgcgcatcagaacgacgtgaacaaactgctgtttctcggatcgtcctgtatctacccgaaactggcaaaacagccgatggcagaaagcgagctgttgcagggcacgctggagccgaccaacgagccttatgccattgccaaaatcgccgggatcaaactgtgcgaatcttacaaccgccagtatggacgcgattaccgctcagtcatgccgaccaacctgtacgggccgcatgacaacttccacccgagtaactcccatgtgatacctgcattgctgcgtcgcttccacgaggcgacggcacagaatgcgccggacgtggtggtgtggggcagcggtacaccgatgcgcgaatttctgcacgtcgatgatatggcggcggcgagcattcatgtgatggagctggcgcatgaagtctggctggagaacacccaaccgatgctgtcgcacattaacgtcggcacgggcgttgactgcactatccgcgagctggcgcaaaccatcgccaaagtggtgggttacaaaggtcgggtggtttttgatgccagtaaaccggatggtacgccgcgcaaactgctggatgtgacgcgcctgcatcagcttggctggtatcacgaaatctcactggaagcggggcttgccagcacttaccagtggttccttgagaatcaagaccgttttcgggggtaa

SEQ ID NO: 5042 - protein, 321 aa, Escherichia coli
MSRQRIFIAGHRGMVGSAIRRQLEQRGDVELVLRTRDELNLLDSRAVHDFFASERIDQVYLAAAKVGGIVANNTYPADFIYQNMMIESNIIHAAHQNDVNKLLFLGSSCIYPKLAKQPMAESELLQGTLEPTNEPYAIAKIAGIKLCESYNRQYGRDYRSVMPTNLYGPHDNFHPSNSHVIPALLRRFHEATAQNAPDVVVWGSGTPMREFLHVDDMAAASIHVMELAHEVWLENTQPMLSHINVGTGVDCTIRELAQTIAKVVGYKGRVVFDASKPDGTPRKLLDVTRLHQLGWYHEISLEAGLASTYQWFLENQDRFRG

SEQ ID NO: 5043 - DNA, 1122 bp, Escherichia coli
atgtcaaaagtcgctctcatcaccggtgtaaccggacaagacggttcttacctggcagagtttctgctggaaaaaggttacgaggtgcatggtattaagcgtcgtgcatcgtcattcaacaccgagcgcgtggatcacatttatcaggatccgcacacctgcaatccgaaattccatctgcattatggcgacctgagtgatacctccaacctgacgcgcattttgcgtgaagtgcagccggatgaagtgtacaacctgggcgcaatgagccacgttgcggtttcttttgagtcaccggaatataccgcagacgtcgatgcgatgggtacgctgcgcctgctcgaggcgatccgcttcctcggtctggaaaagaaaacccgtttctatcaggcttccacctctgaactgtatggtctggtgcaggaaattccgcagaaagaaaccacgccgttctacccgcgatctccgtatgcggtcgccaaactgtacgcctactggatcaccgttaactaccgcgaatcctacggcatgtacgcctgtaacggtattctcttcaaccatgaatccccgcgccgtggcgagactttcgttacccgcaaaatcacccgcgcaatcgccaacatcgcccaggggctggaatcgtgcctgtacctcggcaatatggattccttgcgtgactggggccatgccaaagactacgtaaaaatgcagtggatgatgctgcaacaggaacagccggaagatttcgttattgctaccggcgttcagtactccgtacgtcagttcgtggaaatggcggcggcacagctgggcatcaaactgcgctttgaaggcacgggcgttgaagagaagggcattgtggtttccgtcaccggacatgacgcgccgggcgttaaaccgggtgatgtgattatcgccgttgacccgcgttacttccgtccggctgaagttgaaacgctgctcggcgacccgaccaaagcgcacgaaaaactgggctggaaaccggaaatcaccctcagagagatggtgtctgaaatggtggctaatgacctcgaagcggcgaaaaaacactctctgctgaaatctcacggctacgacgtggcgatcgcgctggagtcataa

SEQ ID NO: 5044 - protein, 373 aa, Escherichia coli [sequence omitted]

SEQ ID NO: 5045 - DNA, 549 bp, Escherichia coli
atgcaggatttaagtggattctcggtgccgaaagggttccggggtggcaacgctattaaagtgcaattgtggtgggcagtacaggcaacaatatttgcctggtcgccacaagtattgtatcgctggcgggcatttttattacgtttattcggcgcaaaaataggaaaaaacgtagttattcgtccgtcagtaaaaattacctatccgtggaaattaacgttaggtgattacgcgtgggtcggcgatgacgtcaatttatataccctcggtgaaataaccattggcgcacattcggtgatatcgcaaaaaagttatttatgcaccgggagccacgaccatgcaagtcaacatttcaccattaacgccacgcctgttgtgattggcgagaaatgctggctggcaaccgatgtctttgttgcccctggcgtcacgatcggcgacggcaccgtcgtgggtgcgcgaagcagtgtttttaaatcgcttccggcaaatgtggtttgccgggggaaccccgcagtggtgatacgcaaacgcgttgaaactgaataa

SEQ ID NO: 5046 - protein, 182 aa, Escherichia coli
MQDLSGFSVPKGFRGGNAIKVQLWWAVQATIFAWSPQVLYRWRAFLLRLFGAKIGKNVVIRPSVKITYPWKLTLGDYAWVGDDVNLYTLGEITIGAHSVISQKSYLCTGSHDHASQHFTINATPVVIGEKCWLATDVFVAPGVTIGDGTVVGARSSVFKSLPANVVCRGNPAVVIRKRVETE

SEQ ID NO: 5047 - DNA, 747 bp, Escherichia coli
atgttgcttagcataatcactgtcgcgtttcgtaacctcgaaggaatagtcaaaacacacgcctcgctggcgcatctggcgcaggcggacgatatcagcttcgaatggattgttgttgatggcggttccaacgacggcacccgtgagtatctggaaaatctcaatggtatctataacttacgctttgtcagcgaaccagataacggtatctacgacgccatgaacaaaggtattgaaatggcgcaaggcaagttcgcgttgtttctcaactcgggcgatatttttcatcaggatgccgcatattttgtccgtaagttaaaagtgcaaaaagataacgtgatgatcaccggcgatgcgctgctggattttggcgacgggcataaaattaaacgtagcgccaaaccgggttggtatatttaccacagcctgcccgccagtcatcaggcgatatttttcccggtgtccggcttgaagaaatggcgttatgacctggagtataaagtttcttccgattacgcgctggcggccaaaatgtataaagccggttatgcatttaaaaaactcaatggcctggtgtctgaattttctatgggtggggtatctaccaccaataatatggaattgtgtgctgacgccaaaaaagtccaacggcaaatattgcacgtgcctggcttttgggctgaattatcctggcatttacgccaacgtacgacctcaaagacgaaagccttatataacaaaagctga

SEQ ID NO: 5048 - protein, 248 aa, Escherichia coli
MLLSIITVAFRNLEGIVKTHASLAHLAQADDISFEWIVVDGGSNDGTREYLENLNGIYNLRFVSEPDNGIYDAMNKGIEMAQGKFALFLNSGDIFHQDAAYFVRKLKVQKDNVMITGDALLDFGDGHKIKRSAKPGWYIYHSLPASHQAIFFPVSGLKKWRYDLEYKVSSDYALAAKMYKAGYAFKKLNGLVSEFSMGGVSTTNNMELCADAKKVQRQILHVPGFWAELSWHLRQRTTSKTKALYNKS

SEQ ID NO: 5049 - DNA, 1221 bp, Escherichia coli
atgtcaacttctatcagaatctgtagctacctgctgctgccgctgatctacctgctggttaacgtcaaaatcgcccagcttggcgaaagtttccccatcaccatcgtcacttttttaccagtcttgttactgctgtttttagagcgcatcagcgttaaaaaattgatgattgccttagggattggcgcgggactcacggcgtttaattacctgtttggtcagtcgttggatgccagtaaatacgtcacttcaaccatgctgtttgtctatattgtgatcattattggcatggtgtggagtattcgctttaaaacgatttcgccacacaaccatcgcaagatattacgtttcttttatctggtggtcgggctggtggtggtgctggcggcggtggagatggcgcaaattatcctcaccggcggtagcagtattatggagtcgatttcgaaatatctgatttacagcaacagctatgtgctgaatttcattaaattcggcggcaagcgcacgacagcactttatttcgaaccggcatttttcgctctggcattaatctcaatttggctcagcatcaaacagtttggtatcaaaacgcctaaaacagatgctatgattctcgcagggataatattatccggttcattttcaggggttatgacctttatccttttttatttgctggagtgggcatttcaatatctgaataaagaggcgattaagaaaaagttaccgttagcattgatttctctggctgtattcctggttggtgtggtaatcgcgttcccttatatttccacccgtctgggcgatttaggtacagaaggatcgtcatcgtattatcgtattgtcggtccgctggtgatggtcggttattctttaacccatattgacggtgtagtcagatttggctcactttatgaatatgtcgcatcattcggaatatttaacggtgcggatgtcggaaaaaccatagacaatggtttgtatctgctgattatttatttttcctggttcgcagtgtttttatcgctgtggtacatgggaaaagtgataaaaatgatgatcaacgcttttggtgataaccgcaattttcgcgtgcaattatatctttttactccggtatcgctgttttttaccggttcgatatttagcccggaatatgcgtttttaatcgtctgcccgtttattttgcgaaaagcgttaaatatacaccctaaataa

SEQ ID NO: 5050 - protein, 406 aa, Escherichia coli
MSTSIRICSYLLLPLIYLLVNVKIAQLGESFPITIVTFLPVLLLLFLERISVKKLMIALGIGAGLTAFNYLFGQSLDASKYVTSTMLFVYIVIIIGMVWSIRFKTISPHNHRKILRFFYLVVGLVVVLAAVEMAQIILTGGSSIMESISKYLIYSNSYVLNFIKFGGKRTTALYFEPAFFALALISIWLSIKQFGIKTPKTDAMILAGIILSGSFSGVMTFILFYLLEWAFQYLNKEAIKKKLPLALISLAVFLVGVVIAFPYISTRLGDLGTEGSSSYYRIVGPLVMVGYSLTHIDGVVRFGSLYEYVASFGIFNGADVGKTIDNGLYLLIIYFSWFAVFLSLWYMGKVIKMMINAFGDNRNFRVQLYLFTPVSLFFTGSIFSPEYAFLIVCPFILRKALNIHPK

SEQ ID NO: 5051 - DNA, 1218 bp, Escherichia coli
atgaatattctgcaattcaatgtgcgactggcggaaggcggggcagcaggtgtggcgttagatctccaccagcgtgcgctgcaacaggggctggcatcacattttgtctacggctacggcaaaggcggcaaagagagcgtcagtcatcaaaactatccgcaggtcatcaaacatacgccgcggatgaccgcgatggcgaacattgcgttgtttcgtctgtttaatcgcgatctgttcggcaatttcaatgagttatatcgcaccattactcgcacaccgggtccggtggtcctgcattttcatgtgctgcacagctactggctaaatcttaagagcgtggtgcgcttttgcgaaaaagtgaaaaaccataaaccggacgtcactctggtctggacgctgcacgaccactggagtgttaccggacgctgcgcctttaccgacggttgcgaaggctggaaaacaggctgccagaaatgcccgaccttaaataactatccgccggtgaagattgatcgcgcacaccaactggtggcgggcaaacgccagttattccgcgagatgctggcactgggctgtcagtttatttcccccagccagcatgtggctgatgctttcaatagtctgtacgggccagggcgttgccggattatcaataatggcattgatatggcaaccgaagcgattctggcggacttgcctccggtgcgcgaaacccagggtaagccgaaaatcgcggtggtggcgcatgatctgcgttacgacggcaaaactaaccagcaactggtacgtgagatgatggcgctgggcgacaaaattgaactgcatacctttggtaagttctcgccgttcaccgctggcaacgtggttaatcacggctttgaaactgacaagcgcaagttgatgagcgcgctcaatcagatggatgcgctggtattcagttctcgcgtcgataactacccgctgattttgtgtgaggcgctatcgattggcgtgccggtgattgccacccatagcgacgcggcgcgtgaagtgttgcaaaaatccggcggtaaaaccgtcagcgaagaagatgtgctgcaactggtgcagttaagcaaaccggaaatcgcacaggcgatatttggtaccacgctggctgagttcagccagcgcagccgcgccgcctacagtggacaacagatgctggaggagtatgtcaacttctatcagaatctgtag

SEQ ID NO: 5052 - protein, 405 aa, Escherichia coli
MNILQFNVRLAEGGAAGVALDLHQRALQQGLASHFVYGYGKGGKESVSHQNYPQVIKHTPRMTAMANIALFRLFNRDLFGNFNELYRTITRTPGPVVLHFHVLHSYWLNLKSVVRFCEKVKNHKPDVTLVWTLHDHWSVTGRCAFTDGCEGWKTGCQKCPTLNNYPPVKIDRAHQLVAGKRQLFREMLALGCQFISPSQHVADAFNSLYGPGRCRIINNGIDMATEAILADLPPVRETQGKPKIAVVAHDLRYDGKTNQQLVREMMALGDKIELHTFGKFSPFTAGNVVNHGFETDKRKLMSALNQMDALVFSSRVDNYPLILCEALSIGVPVIATHSDAAREVLQKSGGKTVSEEDVLQLVQLSKPEIAQAIFGTTLAEFSQRSRAAYSGQQMLEEYVNFYQNL

SEQ ID NO: 5053 - DNA, 489 bp, Escherichia coli
atgctggaagatctgcgcgccaacagctggagtttacgtccgtgctgcatggttcttgcctatcgcgtcgctcatttttgttcggtgtggcgcaaaaagaacgtcctcaacaatctgtgggcggccccgctgctggtgctgtatcgcattatcaccgaatgctttttcggttatgaaatccaggccgccgcgaccattggccgccgtttcactatccatcacggttacgccgtggtgatcaataaaaacgtggtcgcgggggatgatttcaccattcgtcacggcgtcactatcggcaatcgtggtgccgataacatggcatgtccacacattggcaacggcgtcgaactcggtgccaacgtcattattcttggtgatatcacgcttggtaacaacgtcaccgtgggcgcgggcagcgtggtgctcgactctgtcccggacaacgcgctggtggtgggagaaaaagcgcgagtgaaggtaattaaatga

SEQ ID NO: 5054 - protein, 162 aa, Escherichia coli
MLEDLRANSWSLRPCCMVLAYRVAHFCSVWRKKNVLNNLWAAPLLVLYRIITECFFGYEIQAAATIGRRFTIHHGYAVVINKNVVAGDDFTIRHGVTIGNRGADNMACPHIGNGVELGANVIILGDITLGNNVTVGAGSVVLDSVPDNALVVGEKARVKVIK

SEQ ID NO: 5055 - DNA, 840 bp, Escherichia coli
atgaaagacaatccgctgatctcaatctatatgccgacctggaaccgccaacaactggcgattcgggcgataaaatcggtcctgcgccaggactacaacaactgggagatgattatcgtggatgattgctccacctcctgggaacaactacaacagtacgtcaccgccctcaacgatccgcgtatcacttacattcacaacgacattaacagcggggcgtgcgcggtacgtaaccaggcgattatgctggcgcaaggggaatatatcaccgggatcgatgatgatgatgaatggacccccaaccgtctgagcgtcttcctcgcccataaacagcaactggtcacacacgcctttttgtacgctaacgactacgtttgccagggcgaagtctattctcaaccggcaagtttgccgctgtatcccaaatcgccgtattcacgccgcctgttctacaaacgcaatatcattggcaatcaggtctttacctgggcgtggcgtttcaaagagtgtttgttcgataccgaactgaaagcagcacaggattacgacatcttcctgcggatggtggtggagtatggcgaaccgtggaaagtggaagaggcgacgcagatcctgcatatcaatcacggtgaaatgcagatcacctcgtcaccaaaaaaattctccggatacttccacttttaccgcaagcacaaagacaaattcgaccgcgccagtaaaaaatatcagctgtttaccctctaccagatccgcaataaacgtatgacctggcgcactttgctgacgctgctgtcggtgcgtaacggcaaacgtctggctgatggtattcgggggcgctaa

SEQ ID NO: 5056 - protein, 279 aa, Escherichia coli
MKDNPLISIYMPTWNRQQLAIRAIKSVLRQDYNNWEMIIVDDCSTSWEQLQQYVTALNDPRITYIHNDINSGACAVRNQAIMLAQGEYITGIDDDDEWTPNRLSVFLAHKQQLVTHAFLYANDYVCQGEVYSQPASLPLYPKSPYSRRLFYKRNIIGNQVFTWAWRFKECLFDTELKAAQDYDIFLRMVVEYGEPWKVEEATQILHINHGEMQITSSPKKFSGYFHFYRKHKDKFDRASKKYQLFTLYQIRNKRMTWRTLLTLLSVRNGKRLADGIRGR

SEQ ID NO: 5057 - DNA, 2163 bp, Escherichia coli
atgacagaaaaagtaaaacaacatgccgctccggtaacgggcagtgatgaaatcgatattggtcgcctggtcggcaccgtcattgaagcgcgctggtgggtgattggcatcaccgccgtattcgccctctgtgccgtggtttacaccttctttgccacgccgatttatagcgccgacgcactggtacaaatcgagcaaagcagcggcaattcgttagtgcaggatatcggatcggcattagccaacaaaccgcctgcatcggacgccgagatccagttgattcgttcgcgcctggtgcttggtaaaacggtggacgatctcgatctcgatattgcggtgagcaaaaacacgttcccgattttcggtgcgggctgggatcgcctgatgggacgtcagaacgagacggtaaaagtgaccacctttaaccgtccgaaagagatggcggatcaggtgtttacgcttaatgtgctggacaacaaaaactacaccctgagcagcgacggcggctttagcgcccgtgggcaagcgggccagatgctgaaaaaagaaggcgtcacgctgatggttgaaaccattcacgccagcccgggcagtgagtttaccgtcaccaaatactccacgctggggatgatcaaccaactgcaaaacagcctgacggtaacggagaacggcaaagacgcaggcgtactgagcctgacttataccggtgaagaccgcgaacagatccgcgacattcttaacagcatcgcccgtaactatcaggaacaaaatattgagcgcaaatcggcggaagcgtcgaaaagcctcgctttcctcgcgcaacagttaccggaagtacgtaaccgccttgatgttgccgaaaacaaactgaatgccttccgtcaggataaagattctgttgatctgccgctggaagcgaaagcggtgctcgattcgatggtgaacatcgacgcgcagttgaacgaactgacctttaaagaggcggaaatctccaagctgtacaccaaagttcacccggcgtatcgcacgctgctggagaaacggcaggcgctggaagacgaaaaagccaaacttaacggtcgcgtaacggcgatgccgaaaacccagcaggagattgtccgtctgacccgcgatgtcgagtctgggcagcaggtctatatgcagctgctgaataaagagcaggagctgaaaatcaccgaagccagcaccgtcggcgatgtgcgcattgttgacccggcaatcacccagccaggtgtactgaaaccgaagaaagggctgattatcctcggcgcgattatccttggcctgatgctctctatcgtgggtgtactgctgcgctcgttgtttaatcgtggcatcgaaagcccgcaggtgctggaagaacacggtatcagcgtctatgccagcatcccgttgtcggaatggcagaaagcgcgcgatagcgtcaaaaccatcaaaggagttaaacgctataaacagagccagctactggcggtagggaatccaaccgatctggcgattgaagccatccgcagtctgcgtaccagtctgcacttcgcgatgatgcaggcgcagaacaatgtgttgatgatgaccggggttagcccgtcaatcggtaaaacctttgtctgcgccaacctggcggcggtgatcagccagaccaataaacgggtgttgttgatcgactgcgatatgcgcaaaggttatacccacgagctgttgggcaccaataacgtcaatggcctgtcggaaattctgattggtcagggcgatattactaccgctgctaaaccgacctcgattgccaaatttgacctgatcccgcgcggtcaggtaccgccaaatccttctgaactgttgatgagcgaacgctttgccgaactggtgaactgggcgagtaaaaactatgacctggtgttgattgatacgccgccgattctggcagtgaccgatgcggcaattgttggtcgtcatgtcggaaccacgttaatggtggcgcgttatgcggtcaacacattgaaagaagtggaaaccagtctgagccgctttgagcaaaatggtattccggtgaaaggggtgattctgaactccatcttccgccgcgccagcgcgtatcaggattatggctattacgaatacgaatataagtcggatgcgaaataa

SEQ ID NO: 5058 - protein, 720 aa, Escherichia coli
MTEKVKQHAAPVTGSDEIDIGRLVGTVIEARWWVIGITAVFALCAVVYTFFATPIYSADALVQIEQSSGNSLVQDIGSALANKPPASDAEIQLIRSRLVLGKTVDDLDLDIAVSKNTFPIFGAGWDRLMGRQNETVKVTTFNRPKEMADQVFTLNVLDNKNYTLSSDGGFSARGQAGQMLKKEGVTLMVETIHASPGSEFTVTKYSTLGMINQLQNSLTVTENGKDAGVLSLTYTGEDREQIRDILNSIARNYQEQNIERKSAEASKSLAFLAQQLPEVRNRLDVAENKLNAFRQDKDSVDLPLEAKAVLDSMVNIDAQLNELTFKEAEISKLYTKVHPAYRTLLEKRQALEDEKAKLNGRVTAMPKTQQEIVRLTRDVESGQQVYMQLLNKEQELKITEASTVGDVRIVDPAITQPGVLKPKKGLIILGAIILGLMLSIVGVLLRSLFNRGIESPQVLEEHGISVYASIPLSEWQKARDSVKTIKGVKRYKQSQLLAVGNPTDLAIEAIRSLRTSLHFAMMQAQNNVLMMTGVSPSIGKTFVCANLAAVISQTNKRVLLIDCDMRKGYTHELLGTNNVNGLSEILIGQGDITTAAKPTSIAKFDLIPRGQVPPNPSELLMSERFAELVNWASKNYDLVLIDTPPILAVTDAAIVGRHVGTTLMVARYAVNTLKEVETSLSRFEQNGIPVKGVILNSIFRRASAYQDYGYYEYEYKSDAK

SEQ ID NO: 5059 - DNA, 444 bp, Escherichia coli
atgtttaacaacatcttagttgtctgtgtcggcaatatttgccgttccccgacggcggaacgcttactgcaacgttatcacccggagctgaaagtggagtccgctggactcggcgcgctggtcggtaaaggggctgatcctaccgctatcagcgtcgccgcagaacatcaactgtctctggaaggtcactgtgcccgtcaaatcagccgcagcctgtgtcgcaactacgacctgattttgaccatggaaaagcgccatatcgaacgcttatgcgagatggcacctgagatgcgcggcaaagtgatgctgtttggtcactgggataacgaatgtgaaatccccgatccgtatcgcaaaagccgggaaacgtttgccgcggtgtacacattacttgaacggtctgcccgccagtgggcgcaggcattgaacgcagagcaggtataa

SEQ ID NO: 5060 - protein, 147 aa, Escherichia coli
MFNNILVVCVGNICRSPTAERLLQRYHPELKVESAGLGALVGKGADPTAISVAAEHQLSLEGHCARQISRSLCRNYDLILTMEKRHIERLCEMAPEMRGKVMLFGHWDNECEIPDPYRKSRETFAAVYTLLERSARQWAQALNAEQV

SEQ ID NO: 5061 - DNA, 1140 bp, Escherichia coli
atgatgaaatccaaaatgaaattgatgccattattggtgtcagtaaccttgataagcggttgcacagtacttccgggcagcaatatgtcgacgatgggtaaagacgtcatcaaacagcaggacgctgatttcgatctcgacaaaatggtgaatgtttatccgttgaccccgcgcctgattgatcaattacgcccacgcccgaatgtagcgcgccccaatatgacgctggaaagtgagatcgcgaattatcagtatcgcgtcgggccgggggacgttcttaatgtcaccgtctgggatcacccggaactcaccacgccagccggtcagtaccgcagctccagcgacaccggcaactgggtacagcctgacggcactatgttctatccgtatatcggcaaggttcacgtcgtggggaaaacgctcgctgaaatccgcagtgatattaccgggcgcttagcgacgtacatcgctgacccgcaggtggacgttaatatcgccgccttccgctcgcaaaaagcctatatctccggtcaggtgaataaatccggtcaacaggcgattaccaacgtgccactgaccattctcgatgccatcaacgccgcaggtggcctgaccgataccgctgactggcgcaacgtagtgctaacacacaatggtcgtgaagaacgcatttctttgcaggcgctgatgcaaaacggcgacctcaatcagaaccgactgctttaccccggcgatattctttacgtgccacgtaatgatgatctgaaagtatttgtgatgggtgaagtgaagaaacagagcaccctgaaaatggactttagcggcatgaccctgactgaagccctgggcaatgctgaaggcatcgacatgaccacctccaacgccagcggcatctttgtcattcgtccgctgaaaggcgagggcgggcgtaacggcaagattgccaatatctaccagctggatatgtccgatgccacgtcgctggtgatggcgacagaattccgcctgcaaccttatgacgtggtgtatgtcaccaccgcaccggtttcccgctggaaccgtctgatcaatcagttgctgccaactattagcggtgtccgttacatgacggatacagccagcgacattcataactggtaa

SEQ ID NO: 5062 - protein, 379 aa, Escherichia coli
MMKSKMKLMPLLVSVTLISGCTVLPGSNMSTMGKDVIKQQDADFDLDKMVNVYPLTPRLIDQLRPRPNVARPNMTLESEIANYQYRVGPGDVLNVTVWDHPELTTPAGQYRSSSDTGNWVQPDGTMFYPYIGKVHVVGKTLAEIRSDITGRLATYIADPQVDVNIAAFRSQKAYISGQVNKSGQQAITNVPLTILDAINAAGGLTDTADWRNVVLTHNGREERISLQALMQNGDLNQNRLLYPGDILYVPRNDDLKVFVMGEVKKQSTLKMDFSGMTLTEALGNAEGIDMTTSNASGIFVIRPLKGEGGRNGKIANIYQLDMSDATSLVMATEFRLQPYDVVYVTTAPVSRWNRLINQLLPTISGVRYMTDTASDIHNW

SEQ ID NO: 5063 - DNA, 1650 bp, Escherichia coli
ttgccccgatttatccatgatcgaattgtgacatttgtcatacaacgaataggttttgtacttactatggaatggattgccgatccgtctatctgggccgggttaatcacgctgattgtgatcgaactggtcctcggcattgataacctggtctttattgccatcctcgccgaaaaactaccgccgaagcagcgcgaccgcgcacgggttaccgggctgctgctggcgatgttaatgcgcctgctactgctggcgtcaatctcctggctggtcaccctgactcaaccgctgttcagcttccgctcgtttacctttagcgcccgcgacttaatcatgctgtttggtggtttcttcctgctgttcaaagccacgatggagctgaacgaacggctggaagggaaagacagcaataaccccacgcaacgcaaaggtgcgaagttctggggggtggtgacacaaattgtggtactggacgccatcttctcactcgactcggtgattactgccgtcgggatggtcgaccatttactggtcatgatggccgccgtcgttatcgctatcagcctgatgttgatggccagcaagccgttaacgcaatttgttaacagtcacccgacgatcgttattctctgcttaagcttcctgttgatgattggctttagcctggtggcagaaggtttcggcttcgtcattccgaaaggctacctgtacgctgctattggtttctcggtgatgatcgaggcgctcaatcagttggctatctttaaccggcgacgttttctctccgctaaccagacgctgcgccagcgaactaccgaagcggtaatgcgcctgttaagcgggcaaaaagaagatgcggaactggatgccgaaaccgcgtctatgctggtggatcatgataatcagcaaatctttaatccgcaggaacggcggatgattgagcgggtacttaatcttaaccagcgtaccgtcagcagcattatgacgtcgcgccacgatattgagcatatcgatctcaacgcaccggaagaagaaatccgccagttgctggagcgaaatcagcacacgcgactggtggttactgatggcgatgacgcggaagatttgctcggtgttgttcacgttatcgacctgctacaacagtctctgcgcggcgaaccgctcaacctgcgggtgttgattcgccagccgctggtgttcccggaaaccttgccgttgttacctgccctggagcagttccgtaatgcccgcacgcactttgcttttgtagtggatgagtttggctcggtggaaggaattgtgacattaagtgacgtcactgaaaccattgccggtaacttaccgaacgaagtggaagagatcgacgcccgccatgatattcagaaaaatgcggacggttcctggacggcgaatggtcatatgccgctggaggatctggtgcaatatgtgccgctgccgctggatgaaaaacgtgaatatcacaccattgccgggctattgatggaatatttgcagcgtattccaaaacctggcgaagaagttcaggtgggggattatttgcttaaaacgttgcaggtggaaagccatcgcgtgcagaaggtgcaaattattccgctacgtaaggatggcgagatggagtacgaagtgtga

SEQ ID NO: 5064 - protein, 549 aa, Escherichia coli
MPRFIHDRIVTFVIQRIGFVLTMEWIADPSIWAGLITLIVIELVLGIDNLVFIAILAEKLPPKQRDRARVTGLLLAMLMRLLLLASISWLVTLTQPLFSFRSFTFSARDLIMLFGGFFLLFKATMELNERLEGKDSNNPTQRKGAKFWGVVTQIVVLDAIFSLDSVITAVGMVDHLLVMMAAVVIAISLMLMASKPLTQFVNSHPTIVILCLSFLLMIGFSLVAEGFGFVIPKGYLYAAIGFSVMIEALNQLAIFNRRRFLSANQTLRQRTTEAVMRLLSGQKEDAELDAETASMLVDHDNQQIFNPQERRMIERVLNLNQRTVSSIMTSRHDIEHIDLNAPEEEIRQLLERNQHTRLVVTDGDDAEDLLGVVHVIDLLQQSLRGEPLNLRVLIRQPLVFPETLPLLPALEQFRNARTHFAFVVDEFGSVEGIVTLSDVTETIAGNLPNEVEEIDARHDIQKNADGSWTANGHMPLEDLVQYVPLPLDEKREYHTIAGLLMEYLQRIPKPGEEVQVGDYLLKTLQVESHRVQKVQIIPLRKDGEMEYEV

SEQ ID NO: 5065 - DNA, 339 bp, Escherichia coli
atgagaaaaaagctggcttttcttgataccagtcttgacgatttacgcgcatttccagaatcgtctcgacaggaaattggctatcaactcgacaggatccaacaagggttaaacccatacgactggaaacctttttcaactatcggccctggtgtgcgagagattcgtactcgcgatgctgatgggatctatcgcgtcatgtatatcgcaaaatttgaagaagcggtttacgtattgcattgttttcaaaagaaaacacagactaccagtcaatcggatattgatttagacaaacgacgctataaagaacttgttcaggagcggaaaaatgaaaattga

SEQ ID NO: 5066 - protein, 112 aa, Escherichia coli
MRKKLAFLDTSLDDLRAFPESSRQEIGYQLDRIQQGLNPYDWKPFSTIGPGVREIRTRDADGIYRVMYIAKFEEAVYVLHCFQKKTQTTSQSDIDLDKRRYKELVQERKNEN

SEQ ID NO: 5067 - DNA, 291 bp, Escherichia coli
atgaaaattgaaacctttgatagtgtgtgggatgcggtgagtgacacccctgaacaagcggaaaatatgcggatccgtgccgaacttgtaacgatcattaataactggattgaacaacaagggtttagccaggctcaggcagcgtctgctttaggggtcactcaacctcgcatatctgaacttgccagaggtaagatccagatctttagtatcgataaattgatcaccatgatggctcatgcaggattgcatattcaacgtattgaaattcaatatccacatgctgcttag

SEQ ID NO: 5068 - protein, 96 aa, Escherichia coli
MKIETFDSVWDAVSDTPEQAENMRIRAELVTIINNWIEQQGFSQAQAASALGVTQPRISELARGKIQIFSIDKLITMMAHAGLHIQRIEIQYPHAA

SEQ ID NO: 5069 - DNA, 1854 bp, Escherichia coli
atgagacgatttctgacgacgctgatgatactcctggtcgtgctggtggccgggttatctgcgttagtgttgctggtgaatccgaatgatttccgcgactatatggtcaagcaagttgctgcacgtagcggttatcaattgcagctcgacgggccactgcgttggcacgtctggccgcagcttagtatcctctccgggcgaatgtctctcaccgcccagggcgcgagccagccactggttcgcgccgacaacatgcgtctggacgtggcgcttttaccactactgagtcatcaactgagcgttaagcaggtgatgctaaaaggggctgtgatccaactgacgccgcagacggaagcggtgcgcagtgaagacgctccggttgcaccgcgcgacaataccttgccggatctgtcagacgatcgcggatggtcgtttgatatatccagtcttaagatggcggacagcgtgctggtgttccagcatgaagatgacgagcaggtgacaatccgcaatatccgcctgcaaatggaacaagatccccaacatcgtggctcatttgagttctccgggcgggttaatcgcgatcagcgcgacctcacgatatcccttaacggtacggtagatgcttctgattatccgcatgatttaacggcggctattgaacaaattaactggcagttgcagggtgccgatttaccaaaacaaggtattcaggggcaggggagtttccaggcccagtggcaggagtcacataaacgcctttcatttaaccaaattagtttgaccgccaatgacagtacgctgagcgggcaagcacaggtcacgttgacagagaaaccggaatggcagctgagactgcaattcccgcaactgaatcttgacaacctcatcccgcttaaagaaacagcgaacggtgaaaacggtgccgcgcagcaagggcagagccaatccacgttgccgcgcccggtcatttcttcgcgtattgatgaaccggcctatcagggattgcatggctttacggctgatattttgttgcaggccagtaacgtgcgctggcgcggaatgaattttacagacgttgccacgcaaatgaccaacaagtcgggtttgctggaaattactcaactgcagggcaagcttaacggtggacaggtttcgctgccgggcacgctggacgcgacatcaataaatccgcggataaacttccagccacggctggaaaacgttgagattggtaccattctgaaggcgtttaactatccgatttcgttgaccggaaagatgtcactggctggtgatttctccggtgctgacatagatgccgacgcattccgccacaactggcaaggacaggcacatgtcgaaatgaccgacacacgcatggaagggatgaacttccagcagatgattcagcaagcggtagaacgtaatggtggtgatgtgaaggccgctgaaaactttgataacgtgacgcgtcttgaccgctttaccaccgatttgacgttgaaggatggcgtcgtgacgttaaacgacatgcaaggtcaatcgccagtgctggcgctgacaggggaaggcatgttgaatctggcagatcaaacctgcgacacccagtttgacattcgtgtgattggtggctggaacggagaaagcaaactgattgatttcctcaaagaaacgccagtaccgctgcgggtttatggcaactggcagcaactcaattacagcctgcaagtggatcagttactgcgcaaacatctacaggacgaagcgaaacgtcgcctgaatgactgggccgagcggaataaagattcccgcaatggcaaagatgtgaagaagttgctggagaagatgtaa

SEQ ID NO: 5070 - protein, 617 aa, Escherichia coli
MRRFLTTLMILLVVLVAGLSALVLLVNPNDFRDYMVKQVAARSGYQLQLDGPLRWHVWPQLSILSGRMSLTAQGASQPLVRADNMRLDVALLPLLSHQLSVKQVMLKGAVIQLTPQTEAVRSEDAPVAPRDNTLPDLSDDRGWSFDISSLKMADSVLVFQHEDDEQVTIRNIRLQMEQDPQHRGSFEFSGRVNRDQRDLTISLNGTVDASDYPHDLTAAIEQINWQLQGADLPKQGIQGQGSFQAQWQESHKRLSFNQISLTANDSTLSGQAQVTLTEKPEWQLRLQFPQLNLDNLIPLKETANGENGAAQQGQSQSTLPRPVISSRIDEPAYQGLHGFTADILLQASNVRWRGMNFTDVATQMTNKSGLLEITQLQGKLNGGQVSLPGTLDATSINPRINFQPRLENVEIGTILKAFNYPISLTGKMSLAGDFSGADIDADAFRHNWQGQAHVEMTDTRMEGMNFQQMIQQAVERNGGDVKAAENFDNVTRLDRFTTDLTLKDGVVTLNDMQGQSPVLALTGEGMLNLADQTCDTQFDIRVIGGWNGESKLIDFLKETPVPLRVYGNWQQLNYSLQVDQLLRKHLQDEAKRRLNDWAERNKDSRNGKDVKKLLEKM

SEQ ID NO: 5071 - DNA, 582 bp, Escherichia coli
atgcgtctgtgtgaccgagatattgaagcctggcttgatgaaggccgtttgtcgatcaacccacgtccgccagtggagcgtattaacggcgcgacggtggatgtgcgcctgggcaataaatttcgtaccttccgtggtcacacggcagcgtttatcgatctgagcggtcccaaagatgaagtgagcgccgcgcttgaccgcgtgatgagcgatgagatcgttctcgatgaaagcgaggcgttctatcttcacccaggagagctggcgctggcggtgacgctggagtcggtgacgctgccagccgatctggtgggctggctggacgggcgttcttcactggcgcgtctggggctgatggtgcacgtcaccgcgcaccgcatcgatccgggctggtctggctgcattgtgctggagttctacaactccggtaagctgccgctggcgctgcgtccgggcatgttaattggtgcgctgagctttgagccgctttccggcccggcggcgcgaccttacaaccgccgtgaagatgcgaaatatcgcaaccagcagggcgcggtagccagccgaatcgataaagactaa

SEQ ID NO: 5072 - protein, 193 aa, Escherichia coli
MRLCDRDIEAWLDEGRLSINPRPPVERINGATVDVRLGNKFRTFRGHTAAFIDLSGPKDEVSAALDRVMSDEIVLDESEAFYLHPGELALAVTLESVTLPADLVGWLDGRSSLARLGLMVHVTAHRIDPGWSGCIVLEFYNSGKLPLALRPGMLIGALSFEPLSGPAARPYNRREDAKYRNQQGAVASRIDKD

SEQ ID NO: 5073 - DNA, 705 bp, Escherichia coli
ttgccgcgtttggcgcttcgtcgcccccttcctaacatccaggttaatcaggtcgctaaatatatgactgatcagtctcatcagtgcgtcattatcggtatcgctggcgcatcggcttccggcaagagtcttattgccagtaccctttatcgtgaattacgtgagcaagtcggtgatgaacacatcggcgtaattcccgaagactgctattacaaagatcaaagccatctgtcgatggaagaacgcgttaagaccaactacgaccatcccagcgcgatggatcacagcctgctgcttgagcatttacaagcattgaaacgcggctcggcaattgacctgccggtttacagctatgttgaacatacgcgtatgaaagaaacggtgacggttgagccgaagaaagtcatcattctcgaaggcattttgctgctaacggatgcgcgtttgcgtgacgaacttaacttctcaattttcgttgataccccgctggatatctgcctgatgcgccgcatcaagcgtgacgttaacgagcgtgggcgttcaatggattcagtgatggcgcaatatcaaaaaaccgtgcgcccgatgtttctgcaattcattgagccttctaaacaatatgcggacattatcgtgccgcgcggcgggaaaaaccgcatcgccatcgatatattgaaagcgaaaataagtcagttctttgaataa

SEQ ID NO: 5074 - protein, 234 aa, Escherichia coli
MPRLALRRPLPNIQVNQVAKYMTDQSHQCVIIGIAGASASGKSLIASTLYRELREQVGDEHIGVIPEDCYYKDQSHLSMEERVKTNYDHPSAMDHSLLLEHLQALKRGSAIDLPVYSYVEHTRMKETVTVEPKKVIILEGILLLTDARLRDELNFSIFVDTPLDICLMRRIKRDVNERGRSMDSVMAQYQKTVRPMFLQFIEPSKQYADIIVPRGGKNRIAIDILKAKISQFFE

SEQ ID NO: 5075 - DNA, 3318 bp, Escherichia coli
atgagcaaacaatcacagcatgtattaattgccctgccccacccgctgcttcacctggtcagtttaggtttagtctcgtttatcttcacccttttctcacttgagctttcgcagtttggcacccaactcgccccactgtggttcccgacgtccatcatgatggtggcgttttatcgccatgccgggcgcatgtggccggggattgcgctgagctgctcgctgggaaatatcgccgcatccatcctgcttttttccaccagctcgctgaacatgacctggacgaccatcaatattgttgaagccgtggtcggggcagtgctactgcgtaaattgctgccgtggtataacccattgcaaaatctggctgactggctgcgtctggcactcggcagcgccattgttccacctctgttagggggtgttctggttatcctgctgacgcccggagacgatcctctcagggcatttttgatatgggtactgtcagaatccatcggcgcactggcactggtgccgctgggattgttatttaaaccacactatctgctgcgccatcgcaacccacggttgctttttgagtcgctgctcacgttagccatcacactgacgttaagctggctttcgatgctgtatctgccgtggccttttactttcattattgtgctgttgatgtggagcgccgtgcgcctgccacgaatggaagcctttttgatcttccttaccacggtgatgatggtgtcactgatgatggccgctgatccctccctgcttgctacgccgcgtacatacctgatgagccatatgccgtggctaccgtttttgctgatcctgctgcccgccaacatcatgaccatggtgatgtatgcctttcgtgcggaacgcaaacacatttccgaaagcgaaacccgttttcgtaacgccatggaatattccgccatcggcatggcattagtgggcaccgaggggcaatggctgcaatccaacaaagcactctgccagtttctcggttacagtcaggaagagctgcgcggactcacctttcagcaactgacctggccggaggatctcaataaagatctccaacaggttgaaaagctgatcagcggtgaaataaacacctattcaatggaaaaacgctactacaaccgcaatggcgatgttgtctgggcgttgcttgccgtctcactggtgcgccacacggatggcacgccgctctattttatcgctcagattgaagacattaacgagctaaaacgcaccgaacaggtgaatcagcaactgatggagcgcatcacgctggctaacgaagcgggcgggattggcatctgggagtgggagctgaagccgaatatttttagctgggataagcggatgttcgagctgtatgaaattcctccgcatatcaaaccgaactggcaggtgtggtacgagtgcgtgctgccggaagatcgccagcacgccgaaaaagtgattcgtgattcgttgcaatcacgctcgccctttaaactggaatttcgcattaccgtgaaagacggcattcgccatatccgcgccctcgctaaccgggtactgaataaagaaggcgaagtcgaacgcctgctcggcattaatatggatatgaccgaagtgaaacagcttaacgaggcattgtttcaggaaaaagagcgcctgcacataacgctggattccatcggcgaagccgtggtctgtattgatatggcaatgaaaattacctttatgaatccggtggcggagaagatgagcggctggacgcaggaagaagcgttaggtgttccgctcctgacggtgttgcatattacttttggcgacaacggaccattaatggagaacatttacagtgccgacacctcacgttccgcgattgaacaagatgtggtgttgcactgccgaagcggcggcagctacgacgtgcattacagtattacgccgttaagtactctggacggcagcaatataggctcggttctggtgattcaggacgtcaccgaatcacgcaaaatgctgcgccagctgagctacagcgcctcccatgatgcactgacgcatctcgccaatcgcgccagttttgagaagcaactacgcatcctgctgcaaacggtaaacagtacgcatcagcgacatgccctggtgtttatcgatcttgatcgctttaaagcggtgaatgacagcgccgggcatgcggcgggcgacgctttactgcgcgaactggcgtcgttgatgctgagtatgctgcgctccagcgacgtgctggcgcgactcggtggcgatgaatttggtctgctgctgccagattgtaatgtcgaaagtgcgcgttttatcgctacacgcattatcagcgccgtgaatgactatcactttatctgggaaggacgtgtgcatcgggtaggtgccagtgccgggattaccttgattgatgacaacaatcatcaggcggctgaagtgatgtcgcaggctgatatcgcctgttatgcctccaaaaatggtggacggggccgggtgacggtttacgaaccgcagcaagctgccgcacatagcgaacgggcggcgatatcgcttgatgaacagaggcggatgattaaagagaatcagttgatgatgatcgcccacggtgtcgcttcgccgcggatcccgcaagcgcgtaatttgtggctgatttcacttaagctctggagttgcgaaggcgagattattgatgaacaaacatttcgtcgtagcttcagcgatccggcacttagccatgctcttgaccgacgggtattccacgattttttccagcaggccgcaaaagcgattgccagtaaaggcttaagcatcgccctccccctttccgttgccggtttgagtagcgccacgctggtgaatgaactaattgagcagctggaaaatagccctctaccaccacggttattacatctgattattccggcagacgcgattttagatcacgcagcaagcgtgcaaaaactgcggctggcgggatgtcggatcgtattcagtcaggtgggccgcgatctgcaaatcttcaactcgctgaaagcaaatatggcagattacctgctacttgatggtgagttatgcgccagcgtgcagggtaatttgatggatgagatgctgattacgattattcaggggcatgctcagcgactcgggatgaaaaccatcgccgggccagtcgttttacccttagtgatggatacgctttcgggcatcggcgtcgatctgatttatggcgatgtgattgtcgatgcccaaccgctggatttgctggtgaatagcagttatttcgcgattaactga

SEQ ID NO: 5076 - protein, 1105 aa, Escherichia coli
MSKQSQHVLIALPHPLLHLVSLGLVSFIFTLFSLELSQFGTQLAPLWFPTSIMMVAFYRHAGRMWPGIALSCSLGNIAASILLFSTSSLNMTWTTINIVEAVVGAVLLRKLLPWYNPLQNLADWLRLALGSAIVPPLLGGVLVILLTPGDDPLRAFLIWVLSESIGALALVPLGLLFKPHYLLRHRNPRLLFESLLTLAITLTLSWLSMLYLPWPFTFIIVLLMWSAVRLPRMEAFLIFLTTVMMVSLMMAADPSLLATPRTYLMSHMPWLPFLLILLPANIMTMVMYAFRAERKHISESETRFRNAMEYSAIGMALVGTEGQWLQSNKALCQFLGYSQEELRGLTFQQLTWPEDLNKDLQQVEKLISGEINTYSMEKRYYNRNGDVVWALLAVSLVRHTDGTPLYFIAQIEDINELKRTEQVNQQLMERITLANEAGGIGIWEWELKPNIFSWDKRMFELYEIPPHIKPNWQVWYECVLPEDRQHAEKVIRDSLQSRSPFKLEFRITVKDGIRHIRALANRVLNKEGEVERLLGINMDMTEVKQLNEALFQEKERLHITLDSIGEAVVCIDMAMKITFMNPVAEKMSGWTQEEALGVPLLTVLHITFGDNGPLMENIYSADTSRSAIEQDVVLHCRSGGSYDVHYSITPLSTLDGSNIGSVLVIQDVTESRKMLRQLSYSASHDALTHLANRASFEKQLRILLQTVNSTHQRHALVFIDLDRFKAVNDSAGHAAGDALLRELASLMLSMLRSSDVLARLGGDEFGLLLPDCNVESARFIATRIISAVNDYHFIWEGRVHRVGASAGITLIDDNNHQAAEVMSQADIACYASKNGGRGRVTVYEPQQAAAHSERAAISLDEQRRMIKENQLMMIAHGVASPRIPQARNLWLISLKLWSCEGEIIDEQTFRRSFSDPALSHALDRRVFHDFFQQAAKAIASKGLSIALPLSVAGLSSATLVNELIEQLENSPLPPRLLHLIIPADAILDHAASVQKLRLAGCRIVFSQVGRDLQIFNSLKANMADYLLLDGELCASVQGNLMDEMLITIIQGHAQRLGMKTIAGPVVLPLVMDTLSGIGVDLIYGDVIVDAQPLDLLVNSSYFAIN

SEQ ID NO: 5077 - DNA, 849 bp, Escherichia coli
atgtataccctgaactggcagccgccgtatgactggtcgtggatgttgggatttctcgccgcccgtgcggtgagcagcgtggaaacgggcgcggacagttattatgcccgtagtctggcggtaggcgaatatcgcggcgtggtgactgctattccggatatagcccgccatactctgcacataaatttaagtgcaggtttagaacctgttgccgctgagtgtctggcgaaaatgagctgcctgtttgatctgcaatgtaacccgcagattgttaacggtgcgttgggcaagttaggcgcggcgcggcccggattgcgtttacccggcagtgttgatgcttttgagcagggcgtgcgggcgattttaggccaactggtgagcgtggcgatggcggcaaaattgaccgccagagtggcacagctttatggcgaacggctggatgattttccggattatgtctgcttccccacgcctcagcggctggctgcagccgacccgcaggcattaaaagcgttaggtatgccgttgaaacgggcagaggcactgattcatctggcaaatgcggcgctggagggcaccttaccaatgacaataccgggcgacgtagaacaagcgatgaaaaaactgcaaacttttccggggatcgggcgctggacggcgaattatttcgccttgcgcggctggcaggcgaaagatgtttttctgccggatgattatctgattaaacagcgatttccgggaatgacaccggcacaaatccgccgttatgccgagcgctggaaaccctggcgttcttatgcgctgttgcatatctggtatacggaaggctggcaaccagacgaagcatga

SEQ ID NO: 5078 - protein, 282 aa, Escherichia coli
MYTLNWQPPYDWSWMLGFLAARAVSSVETGADSYYARSLAVGEYRGVVTAIPDIARHTLHINLSAGLEPVAAECLAKMSCLFDLQCNPQIVNGALGKLGAARPGLRLPGSVDAFEQGVRAILGQLVSVAMAAKLTARVAQLYGERLDDFPDYVCFPTPQRLAAADPQALKALGMPLKRAEALIHLANAALEGTLPMTIPGDVEQAMKKLQTFPGIGRWTANYFALRGWQAKDVFLPDDYLIKQRFPGMTPAQIRRYAERWKPWRSYALLHIWYTEGWQPDEA

SEQ ID NO: 5079 - DNA, 153 bp, Escherichia coli
atgccggtgaagaaggggcgtgactttagcgaaatgttgccgtcgcgacaaccggaatatgaaagcaaagcgcagcgtctgaataacgtttatgctgaaagcggattaacaaggagatgcgatgtataccctgaactggcagccgccgtatga

SEQ ID NO: 5080 - protein, 50 aa, Escherichia coli
MPVKKGRDFSEMLPSRQPEYESKAQRLNNVYAESGLTRRCDVYPELAAAV

SEQ ID NO: 5081 - DNA, 1353 bp, Escherichia coli
gtgtttattggttttgattacggtacagcaaactgttcagtggcggtcatgcgcgacggtaaaccgcatttgctaaaaatggaaaacgacagcacgctgctgccttcaatgctttgcgcgccaacgcgtgaagcggtaagcgaatggctgtaccgccatcatgacgttccggcagacgacgatgaaacgcaggcgctgctgcgtcgggcgattcgttataaccgcgaagaagatatcgatgttacggcgaaaagcgtgcagttcggtctttcctcactggcacagtacattgatgatccagaagaggtgtggtttgtgaaatcaccaaaatcgttcctcggtgccagcggcttaaaaccgcagcaggtagcgctgtttgaggatctggtctgcgcaatgatgttgcacattcgccagcaggcgcaggctcaactgccggaggcaattactcaggcagtgattggtcgcccgatcaacttccaggggctgggcagcgatgaagcaaacacccaggcgcaagggattctggaacgcgcggcgaagcgtgccgggtttaaggatgtggtattccagtacgagccggtcgcggctgggctggattacgaagccaccttgcaggaagaaaaacgggtgctggtggtggatatcggcggtggtacgactgactgttctttactgctaatggggccacagtggcgttcgcgcctcgatcgtgaagccagcctgctgggtcacagtggttgccgtattggcggtaacgatctggatatcgcactggcgtttaaaaacctgatgccgttactgggcatgggtggcgaaaccgaaaaaggcatcgcgctgccgattctgccgtggtggaatgcggttgccatcaacgacgtccctgcgcaaagtgatttctacagtagtgccaatggtcgtctgcttaacgatctggtacgcgatgcccgcgaaccggaaaaagtggccctgttacagaaagtctggcgtcagcgtttaagctatcgcctggtacgtagcgcagaagagagcaaaattgcgctttcaagcgtagcggaaacccgcgcctcactgccgtttatcagcgatgaactggctacgctgattagccagcaagggctggaaagcgccctcaaccagccactggcgcgaattctggaacaggtgcaactggcgctggataacgcccaggaaaaaccggatgtcatctatctgactggtggtagcgcccgatcgccgctgattaaaaaagcgctggcagaacagttgccgggcattccgattgcaggcggcgatgactttggctccgtcaccgccgggctggcacgctgggcggaagtggtgtttcgttaa

SEQ ID NO: 5082 - protein, 450 aa, Escherichia coli
MFIGFDYGTANCSVAVMRDGKPHLLKMENDSTLLPSMLCAPTREAVSEWLYRHHDVPADDDETQALLRRAIRYNREEDIDVTAKSVQFGLSSLAQYIDDPEEVWFVKSPKSFLGASGLKPQQVALFEDLVCAMMLHIRQQAQAQLPEAITQAVIGRPINFQGLGSDEANTQAQGILERAAKRAGFKDVVFQYEPVAAGLDYEATLQEEKRVLVVDIGGGTTDCSLLLMGPQWRSRLDREASLLGHSGCRIGGNDLDIALAFKNLMPLLGMGGETEKGIALPILPWWNAVAINDVPAQSDFYSSANGRLLNDLVRDAREPEKVALLQKVWRQRLSYRLVRSAEESKIALSSVAETRASLPFISDELATLISQQGLESALNQPLARILEQVQLALDNAQEKPDVIYLTGGSARSPLIKKALAEQLPGIPIAGGDDFGSVTAGLARWAEVVFR

SEQ ID NO: 5083 - DNA, 1950 bp, Escherichia coli
gtggttaccatgaaacccactttatatactgctactggtgagtgcgttacgcctagccgtgaactgggcaaaggcggcgaaggtgcggtttatgatatcgaggagtttgtcgatagcgtcgccaagatttatcacacgccgccgcccgccttaaaacaggacaaacttgcctttatggctgcgacagctgacgcgcagttgttgaattatgtcgcctggccgcaggcaacgcttcacggtggacgaggcggaaaagttatcggttttatgatgccaaaagtttctggtaaagaaccgattcatatgatctatagcccggcacatcgtcgccagagttaccctcattgtgcgtgggattttctactctatgttgcgcgcaatattgcttcatcttttgctactgttcatgagcacgggcacgtcgtgggtgacgtaaaccagaacagctttatggtaggtcgcgacagcaaagtggtgttgattgatagcgactcctttcagattaatgccaatggtacactgcatttatgcgaagtcggcgtgtcgcattttacgccgccagagctgcaaaccatgccatcatttgtcggctttgaacgcacagaaaatcacgataattttggccttgcgttgctgatatttcacatcttgtttggtgggcggcatccttattccggtgtaccgcttatctctgatgcaggtaatgcgctggagacggatattgcccatttccgttatgcctacgcctcagataatcagcgacgtggtttaaaaccgccgccacgatcgattccgctgtcgatgttaccgggcgatgttgaagccatgtttcagcaggcattcacggaaagtggcgtggcaaccgggcgtccgacggcaaaagcgtgggtagcggcacttgatttactacgccaacagttaaagaaatgtaccgtttcggcaatgcatgtttaccccgctcatttgactgactgcccgtggtgtgcgctggataatcaaggcgttatctattttattgatctcggtgaagaggtcattaccaccggcggtgattttgtgctggcgagagtctgggcgatggtgatggcatcagtagcaccgccagcattgcaattgccattacccgatcatttccaaccgactggcaggccgcttcctttaggcctgttacggcgcgaatacatcattctgattgagatcgcactgtcagcgttatcgctgttgttttgcggccttcaggcagaaccgagttatattattttgattcctgtgctggcggctatctggattattggcagcctgacaagcaaagcgtacaaagcagaaatccagcaacgccgtgaggcgtttaatcgcgcgaaaatggactatgaccatttagtcagccagatccagcagttgggcgggctggaaggttttatcgccaaacgggcgaggctcgaaaaaatgaaggacgaaattcttgggttaccggaagaagaaaagcgcgatctggcagcacttcaggacaccgcaagggaacggcagaagcagaagtttctggagggattttttattgatgttgcctctattcccggcgttggccctgcgcgtaaagcggcgttacggtcctttggtattgaaacggcggcagacgttacccgacggagcgttaagcaagtaaaaggttttggtgatcatctgacccaggcggttatcgactggaaagcgagttgcgaacgccgttttgtgttcaggccgaatgaagcggtaacgccagcagacagacaagcggtaatggcgaaaatgaccgccaaacgacatcggctggaatcggcgttgactgtcggtgcgacagagttgcagcgattccgccttcatgctccagcacggaccatgccgttgatggagccgctacgtcaggcggcagaaaaactggctcaggcgaaggctgatttaagccgctgctga

SEQ ID NO: 5084 - protein, 649 aa, Escherichia coli
MVTMKPTLYTATGECVTPSRELGKGGEGAVYDIEEFVDSVAKIYHTPPPALKQDKLAFMAATADAQLLNYVAWPQATLHGGRGGKVIGFMMPKVSGKEPIHMIYSPAHRRQSYPHCAWDFLLYVARNIASSFATVHEHGHVVGDVNQNSFMVGRDSKVVLIDSDSFQINANGTLHLCEVGVSHFTPPELQTMPSFVGFERTENHDNFGLALLIFHILFGGRHPYSGVPLISDAGNALETDIAHFRYAYASDNQRRGLKPPPRSIPLSMLPGDVEAMFQQAFTESGVATGRPTAKAWVAALDLLRQQLKKCTVSAMHVYPAHLTDCPWCALDNQGVIYFIDLGEEVITTGGDFVLARVWAMVMASVAPPALQLPLPDHFQPTGRPLPLGLLRREYIILIEIALSALSLLFCGLQAEPSYIILIPVLAAIWIIGSLTSKAYKAEIQQRREAFNRAKMDYDHLVSQIQQLGGLEGFIAKRARLEKMKDEILGLPEEEKRDLAALQDTARERQKQKFLEGFFIDVASIPGVGPARKAALRSFGIETAADVTRRSVKQVKGFGDHLTQAVIDWKASCERRFVFRPNEAVTPADRQAVMAKMTAKRHRLESALTVGATELQRFRLHAPARTMPLMEPLRQAAEKLAQAKADLSRC

SEQ ID NO: 5085 - DNA, 762 bp, Escherichia coli
gtgagctggcgactggtctatgcatcagccgttggaacgtcgcatattagcgctgatttgccttgccaggatgcctgccagatgcaggttgcctggctaaatgaccagcagccattattgtcggtatttgtcgctgatggcgcaggcagcgtctcgcagggtggcgaaggtgcgatgctcgccgtcaatgaagcgatggcttatatgtcgcaaaaaatgcagggcggggaattggggcttaatgatgtcctcgcaacggacattgtgctgaccattcgtcagcgactttttgccgaggcggaagccaaagaattagcggttcgcgattttgcctgcacgtttttgggattgatttcatcagctaatggcaccttgattatgcagattggcgatggcggcgtggtggtagatttggggcacggtttgcaactgccgctcacgccgatggtgggtgaatataccaatatgacgcacttcattaccgatgaagatgccgtttccagactggaaactttcaccagcactgagcgtgcgcacaaagttgcagcatttacggatggtattcagcgactggcgttaaatatgctggataattctccgcatgtgcctttctttaccccgtttttcaatggactggcgtcagcaacgcaggaacaactcgatttattacctgaattgttaaagcagtttttgtccagcccggcggtaaacgagcgtacggatgatgataaaacgttggcactggcgctgtggttaccatga

SEQ ID NO: 5086 - protein, 253 aa, Escherichia coli
MSWRLVYASAVGTSHISADLPCQDACQMQVAWLNDQQPLLSVFVADGAGSVSQGGEGAMLAVNEAMAYMSQKMQGGELGLNDVLATDIVLTIRQRLFAEAEAKELAVRDFACTFLGLISSANGTLIMQIGDGGVVVDLGHGLQLPLTPMVGEYTNMTHFITDEDAVSRLETFTSTERAHKVAAFTDGIQRLALNMLDNSPHVPFFTPFFNGLASATQEQLDLLPELLKQFLSSPAVNERTDDDKTLALALWLP

SEQ ID NO: 5087 - DNA, 660 bp, Escherichia coli
atgagcgaacaaatcacgtttgccaccagcgattttgccagtaacccggaaccacgttgcccctgcattttgctgctggatgtttctggctcgatgagcggcagacccattaatgaacttaacaccggattggttacctttcgcgatgagctgcttgccgattcgctggccttaaaaagagtggaactcggcattgtgacgttcggcccggtgcatgtggaacaaccctttaccagcgccgctaattttttcccgcccatcctgtttgcccagggcgatacaccaatgggcgctgccattaccaaagccctggatatggttgaggagcggaaacgtgaatatcgtgccaatggtatttcctattatcgtccgtggattttcctgatcaccgatggcgcaccaaccgatgagtggcaggctgccgccaacaaagtgtttcagggggaagaagataagaagtttgccttctttaccatcggtgttcagggggcggatatgaagacgctggcccaaatcagcgtccgtcagcctttgtctctgcagggattacaattccgtgaactgtttagctggttatccagttcgctgcgttcggtttcccgctccacgccgggaacggaagttgtgctggaagcgccaaaaggctggacgtcagtgtga

SEQ ID NO: 5088 - protein, 219 aa, Escherichia coli
MSEQITFATSDFASNPEPRCPCILLLDVSGSMSGRPINELNTGLVTFRDELLADSLALKRVELGIVTFGPVHVEQPFTSAANFFPPILFAQGDTPMGAAITKALDMVEERKREYRANGISYYRPWIFLITDGAPTDEWQAAANKVFQGEEDKKFAFFTIGVQGADMKTLAQISVRQPLSLQGLQFRELFSWLSSSLRSVSRSTPGTEVVLEAPKGWTSV

SEQ ID NO: 5089 - DNA, 1395 bp, Escherichia coli
gtgttattactggatgcgtgctcgcaaatgtgcccgtcattcagacgattcccgacagtgtttcataattcctccatttttctcccttattggctggctacactagtatcattccgcgaaacgtttcaggaagagaaactcttaacgatgaaaggcagttataaatcccgttgggtaatcgtaatcgtggtggttatcgccgccatcgccgcattctggttctggcaaggccgcaatgactcccagagtgcagcccctggggcgacgaaacaagcgcagcaatcgccagcgggtggtcgccgtggtatgcgtgccggcccattagctccggttcaggcggcgaccgcagtagaacaggctgttccgcgttacctcaccgggcttggcaccattaccgccgctaatactgttacggtgcgcagccgcgtggacggtcaactgatggcgttacatttccaggaaggccagcaggtcaaagcaggcgatttactggcagaaattgacccaagccagttcaaagttgcattagcacaagcccagggccaactggcaaaagataaagccacgctcgccaacgcccgccgtgacctgtcgcgttatcaacaactggcaaaaaccaatctcgtatctcgtcaggaactggatgcccaacaagcgctggtcagtgaaaccgaaggtaccattaaggctgatgaagcaagcgtcgccagcgcgcaattgcaactcgactggagccgtatcaccgcaccagttgatggtcgcgttggtctcaagcaggttgatgttggtaaccaaatctccagtggcgacaccaccgggattgtggtgatcacccaaacacatcctatcgatctggtctttactctgccggaaagcgatatcgccaccgttgtacaggcgcaaaaagccggaaaaccgctggtggtagaagcctgggatcgcaccaactcgaagaagttaagtgaaggcacgctgttaagtctcgataaccaaatcgatgccactaccggtacgattaaagtgaaagctcgctttaataatcaggatgatgcgcttttccctaatcagtttgttaacgctcgcatgttagtcgataccgaacaaaacgccgtggtgatccccaccgccgcactgcaaatgggcaacgaaggccattttgtctgggtactgaatagcgaaaacaaagtcagcaaacatctggtgacaccgggcattcaggacagtcagaaagtggtgatccgcgcaggtatttctgcgggcgatcgcgtagtgacggacggcattgatcgcctgaccgaaggggcgaaagtggaagtggtggaagcccagagcaccactactccggaagagaaagccaccagccgcgaatacgcgaaaaaaggagcgcgctcctga

SEQ ID NO: 5090 - protein, 464 aa, Escherichia coli
MLLLDACSQMCPSFRRFPTVFHNSSIFLPYWLATLVSFRETFQEEKLLTMKGSYKSRWVIVIVVVIAAIAAFWFWQGRNDSQSAAPGATKQAQQSPAGGRRGMRAGPLAPVQAATAVEQAVPRYLTGLGTITAANTVTVRSRVDGQLMALHFQEGQQVKAGDLLAEIDPSQFKVALAQAQGQLAKDKATLANARRDLSRYQQLAKTNLVSRQELDAQQALVSETEGTIKADEASVASAQLQLDWSRITAPVDGRVGLKQVDVGNQISSGDTTGIVVITQTHPIDLVFTLPESDIATVVQAQKAGKPLVVEAWDRTNSKKLSEGTLLSLDNQIDATTGTIKVKARFNNQDDALFPNQFVNARMLVDTEQNAVVIPTAALQMGNEGHFVWVLNSENKVSKHLVTPGIQDSQKVVIRAGISAGDRVVTDGIDRLTEGAKVEVVEAQSTTTPEEKATSREYAKKGARS

SEQ ID NO: 5091 - DNA, 3123 bp, Escherichia coli
atgcaggtgttacctccgagcagcacaggcggcccgtcgcgcctgtttattatgcgtcctgtcgccaccacgctgctgatggtggcgatcttactcgccgggattatcggttatcgcgccctgcccgtttcggcactgccggaagtggattatccgaccattcaggtggtcacgctctacccaggtgcaagcccggatgtcatgacctctgccgttaccgcgccgctcgaacgccagtttgggcagatgtccggcctgaaacaaatgtcgtcgcaaagttccggcggtgcgtcagttatcactttacagttccagctaaccttaccgctggatgtcgccgagcaggaagtgcaggccgcgattaacgctgccactaacctgttgccgagcgatctgcctaacccgccggtttacagcaaagtgaacccggcagatccgccgatcatgacgctcgccgtcacctcaaccgccatgccgatgacccaggtggaagatatggtggaaacccgcgtcgcgcagaaaatctcgcagatttccggcgtagggctggtcacgctttccggcggccagcgtccggctgttcgcgtcaaacttaacgctcaggcgattgccgccctcggtctgaccagcgaaaccgtgcgcaccgctattaccggcgctaacgttaactcggcaaaagggagcctcgacggcccttcccgcgcggtcacgctttccgcgaacgaccagatgcaatccgccgaagagtatcgccagctaatcatcgcctaccagaacggcgcaccgattcgtctgggcgatgtcgcaaccgtagagcaaggagcagaaaacagctggctcggcgcgtgggcgaacaaagaacaggccattgtgatgaatgtccagcgccagcccggtgctaacattatctccaccgccgacagcatccggcagatgctaccacagctcaccgagagtctgccgaaatcggtgaaggtgacggtactttctgaccgtaccaccaatatccgcgcatcggtcgacgatacccagtttgagctgatgatggctatcgcgctggtagtcatgattatctacctgtttttgcgcaatattccggcgaccatcattcccggcgtcgcagtgccgctgtcgttaatcggcaccttcgcggtcatggtgtttctcgatttttcaatcaataacctgacgctgatggcgttaactatcgccaccggatttgtggtcgatgacgccatcgtggtgatcgaaaacatttcccgctatatcgaaaaaggcgaaaaaccgctggcggcggcgctcaagggcgcgggtgaaatcggctttaccattatctcgctgaccttctcgctgattgcggtgttgatccccctgctgtttatgggcgatatcgtcgggcgactgttccgcgaatttgctattaccctggcagtcgcgattttgatctcagcggtggtgtcgctaaccctgacaccgatgatgtgcgcacggatgctcagccaggagtcgctgcgtaaacagaaccgcttctcccgtgcctcggagaaaatgttcgacaggataatcgccgcctatggtcgtggactggcgaaagtgctgaatcatccgtggctgaccttaagcgtggcgctcagcacgctgctgcttagcgtgctgctgtgggtgttcattccgaaaggtttcttcccggtgcaggacaacggcattattcagggcactttgcaggcaccgcaatccagctcctttgccaatatggcccagcggcaacgccaggtcgcggacgtgattttgcaggatccggcagtgcaaagtttgacctcatttgttggcgttgatggcactaacccgtcgctgaacagtgcgcgtttacagatcaatctcaaaccactggatgaacgagatgaccgggtgcaaaaagtcatcgcccgtctgcaaacggcggtggataaagtgccgggcgtcgatctcttcctgcaaccaacgcaggacctgactattgatactcaggtcagccgcacccagtaccagtttaccttgcaggccacgtcactggatgcgctcagtacctgggtgccacagttgatggaaaaactccagcagctgccacagctttctgatgtctccagcgactggcaggacaaagggctggtggcgtatgtcaatgtcgacagggacagcgccagccgtctggggatcagcatggcggatgtcgataacgccctgtacaacgcgtttggtcagcgactgatttccactatttatactcaggctaaccagtatcgcgtggtactggaacacaacaccgaaaataccccaggcctcgcggcgctggataccattcgcctgaccagcagcgacggtggcgtggtgccgttaagctcaattgccaaaattgagcagcgttttgcgccgctttccatcaaccatctggatcagttcccggtaacgactatctcctttaacgtgccggataactattcgctgggcgatgcggtgcaagcgattatggacacagagaagacgctgaatctgccggtggatatcaccacgcagttccagggcagcaccctcgccttccagtcagcgctgggcagcactgtctggctgattgtcgcggcggtggtggcgatgtatatcgtgctcggcattctgtacgagagctttattcacccgatcaccattctctcgacgctacccaccgcaggggtcggcgcgctgctggcgttaatgattgccggtagcgaactggatgtgattgccattatcggcattattttgctgatcggtatcgtgaagaagaacgccatcatgatgatcgacttcgcgctggctgctgagcgcgagcaaggcatgtcgccgcgcgaagctatttaccaggcttgtctgttgcgttttcgtccgatcctgatgaccactctggcggctctgcttggtgcgctgccgctgatgttgagtaccggggtcggcgcggaactgcgtcgtccgttaggtatcggcatggtcggcggtctgattgtcagccaggtgctgacgctgtttaccacgccggtgatttatctgctgttcgaccgtctggcattgtggaccaaaagccgctttgcccgtcatgaagaggaggcgtaa

SEQ ID NO: 5092 - protein, 1040 aa, Escherichia coli
MQVLPPSSTGGPSRLFIMRPVATTLLMVAILLAGIIGYRALPVSALPEVDYPTIQVVTLYPGASPDVMTSAVTAPLERQFGQMSGLKQMSSQSSGGASVITLQFQLTLPLDVAEQEVQAAINAATNLLPSDLPNPPVYSKVNPADPPIMTLAVTSTAMPMTQVEDMVETRVAQKISQISGVGLVTLSGGQRPAVRVKLNAQAIAALGLTSETVRTAITGANVNSAKGSLDGPSRAVTLSANDQMQSAEEYRQLIIAYQNGAPIRLGDVATVEQGAENSWLGAWANKEQAIVMNVQRQPGANIISTADSIRQMLPQLTESLPKSVKVTVLSDRTTNIRASVDDTQFELMMAIALVVMIIYLFLRNIPATIIPGVAVPLSLIGTFAVMVFLDFSINNLTLMALTIATGFVVDDAIVVIENISRYIEKGEKPLAAALKGAGEIGFTIISLTFSLIAVLIPLLFMGDIVGRLFREFAITLAVAILISAVVSLTLTPMMCARMLSQESLRKQNRFSRASEKMFDRIIAAYGRGLAKVLNHPWLTLSVALSTLLLSVLLWVFIPKGFFPVQDNGIIQGTLQAPQSSSFANMAQRQRQVADVILQDPAVQSLTSFVGVDGTNPSLNSARLQINLKPLDERDDRVQKVIARLQTAVDKVPGVDLFLQPTQDLTIDTQVSRTQYQFTLQATSLDALSTWVPQLMEKLQQLPQLSDVSSDWQDKGLVAYVNVDRDSASRLGISMADVDNALYNAFGQRLISTIYTQANQYRVVLEHNTENTPGLAALDTIRLTSSDGGVVPLSSIAKIEQRFAPLSINHLDQFPVTTISFNVPDNYSLGDAVQAIMDTEKTLNLPVDITTQFQGSTLAFQSALGSTVWLIVAAVVAMYIVLGILYESFIHPITILSTLPTAGVGALLALMIAGSELDVIAIIGIILLIGIVKKNAIMMIDFALAAEREQGMSPREAIYQACLLRFRPILMTTLAALLGALPLMLSTGVGAELRRPLGIGMVGGLIVSQVLTLFTTPVIYLLFDRLALWTKSRFARHEEEA

SEQ ID NO: 5093 - DNA, 3078 bp, Escherichia coli
gtgaagttttttgccctcttcatttaccgcccggtggcgacgattttactgtcggtcgccattaccctgtgcggcatactgggtttccgtatgctgccagtcgccccgctgccgcaggtcgattttccggtgatcatggtcagcgcctcgctgcccggtgcgtcaccagaaacaatggcgtcttccgttgccacgccgctggagcgctcacttgggcgcattgccggagtcagcgaaatgacctccagcagttcgctcggcagcacgcgcattattttgcagtttgattttgaccgggatatcaacggcgcagcgcgcgatgtgcaggcggcgatcaacgccgcgcaaagtctgctacccagcgggatgcccagccgtccgacctatcgcaaagcgaacccgtcggatgcgccaattatgatcctcacgctgacatccgatacttattcgcagggtgaactgtacgatttcgcctcgacacagctggctccgacgatttcgcaaatcgacggtgtcggtgatgtcgatgttggcggcagctcgctgcccgccgtacgcgtcgggctgaatccgcaggcgctgtttaatcagggcgtctcgctggacgacgtacgcaccgccatcagcaatgccaacgtgcgtaaaccgcagggggcgctggaagatggtactcaccgctggcagatccagactaacgatgaactgaaaaccgccgctgaatatcagccactgattattcattacaacaacggcggcgcggttcgtctgggcgatgtggcgacggtgaccgactcagtacaggatgtgcgcaacgccgggatgaccaacgccaaaccggctattttgctgatgatccgcaagctgccggaagccaacattatccagacggtagacagcatccgcgcccgtctgccggaattacaatccaccatcccggcagcaattgatctgcaaattgcccaggatcgctcccctactatccgcgcgtcgctggaagaggttgagcagacgctgattatctcggtggcgctggtgattctggtggtgtttttgttcctgcgttcgggtcgcgccaccattattcccgccgttgcggtgccggtttcgctgattggtacgtttgcggcgatgtacctgtgtggtttcagtctcaataatctttcgttaatggcgctcaccatcgccactggctttgtggtggatgacgccatcgtggtgctggaaaacattgcccgtcatctggaggcggggatgaaaccgctacaggccgcgctgcaaggtactcgcgaagtcggctttacggtgctgtcgatgagtctgtcactggtggcggtgttcctgccgctgctgttgatgggcggattgccgggtcgcctgttacgcgagtttgccgtgacgctttctgtcgccattggtatttcgctgctggtttccctgacgttaacgccgatgatgtgcggctggatgctaaaagccagcaagccgcgcgagcaaaagcgactgcgtggctttggtcgcatgttggtagccctgcaacaaggctatggcaagtcgctgaaatgggtgctcaatcatacccgtctggtgggcgtggtgctgcttggcaccattgcgctgaatatctggctgtatatctcgatcccgaaaaccttcttcccggagcaggacaccggcgtactgatgggcgggatacaggctgaccagagtatttcgtttcaggcgatgcgcggtaagttgcaggacttcatgaaaattatccgtgacgatccggcggtggataatgtcaccggctttaccggcggttcacgggtgaacagtggaatgatgtttatcacccttaaaccacgcggcgagcggagcgaaacggcccaacagattatcgatcgcttgcgtaaaaaactggcgaaagaaccgggagcgaatctgttcctgatggcggtacaggatattcgcgttggcggacgtcaggctaacgccagttaccagtacacgttgttatccgacgacctggcggcactgcgcgaatgggagccgaaaatccgcaaaaaactggcgacattgccagagctggctgatgttaactccgatcaggaagataatggcgcggagatgaaccttatttacgatcgcgacaccatggcgcgattgggaattgacgtgcaagccgccaacagcctgttaaataacgccttcggtcagcggcaaatctcgaccatttaccagccgatgaaccagtacaaagtggtgatggaagttgatccgcgctatacccaggacatcagtgcactggaaaaaatgttcgttatcaataacgaaggaaaagcgatcccgctgtcgtatttcgctaaatggcaaccggcgaacgctccactgtcggtgaatcatcagggattatcggcggcctcgaccatttcgttcaacctgccgaccgggaaatcgctctcggacgccagtgcggcgatcgatcgcgcaatgacccagcttggtgtgccttcgacggtgcgcggcagttttgccggaacagcgcaagtgttccaggagacgatgaactcacaggtgatcctgattatcgccgccatcgccacggtatatatcgtactgggtatcctttacgagagttatgtgcatccactgacgattctctccaccctaccctcggcgggcgtcggagcgctgttggcgctgcagctgttcaatgccccgttcagcctaattgcgctgatagggatcatgttattaatcggcatcgtgaagaaaaacgccattatgatggtcgattttgcgcttgaagcccaacggcacggtaacctgacgccgcaggaagctattttccaggcctgtctgctgcgttttcgcccgattatgatgactaccctggcggcgctgtttggtgcgctgccgctggtattgtcgggcggtgacggctcggagttgcggcaaccattggggatcaccattgtcggcggtctggtcatgagccagcttctgacgctgtataccacgccggtggtgtatctctttttcgaccgtctgcggctgcgtttttcgcgtaaacctaaacaagcggtaaccgagtaa

SEQ ID NO: 5094 - protein, 1025 aa, Escherichia coli
MKFFALFIYRPVATILLSVAITLCGILGFRMLPVAPLPQVDFPVIMVSASLPGASPETMASSVATPLERSLGRIAGVSEMTSSSSLGSTRIILQFDFDRDINGAARDVQAAINAAQSLLPSGMPSRPTYRKANPSDAPIMILTLTSDTYSQGELYDFASTQLAPTISQIDGVGDVDVGGSSLPAVRVGLNPQALFNQGVSLDDVRTAISNANVRKPQGALEDGTHRWQIQTNDELKTAAEYQPLIIHYNNGGAVRLGDVATVTDSVQDVRNAGMTNAKPAILLMIRKLPEANIIQTVDSIRARLPELQSTIPAAIDLQIAQDRSPTIRASLEEVEQTLIISVALVILVVFLFLRSGRATIIPAVAVPVSLIGTFAAMYLCGFSLNNLSLMALTIATGFVVDDAIVVLENIARHLEAGMKPLQAALQGTREVGFTVLSMSLSLVAVFLPLLLMGGLPGRLLREFAVTLSVAIGISLLVSLTLTPMMCGWMLKASKPREQKRLRGFGRMLVALQQGYGKSLKWVLNHTRLVGVVLLGTIALNIWLYISIPKTFFPEQDTGVLMGGIQADQSISFQAMRGKLQDFMKIIRDDPAVDNVTGFTGGSRVNSGMMFITLKPRGERSETAQQIIDRLRKKLAKEPGANLFLMAVQDIRVGGRQANASYQYTLLSDDLAALREWEPKIRKKLATLPELADVNSDQEDNGAEMNLIYDRDTMARLGIDVQAANSLLNNAFGQRQISTIYQPMNQYKVVMEVDPRYTQDISALEKMFVINNEGKAIPLSYFAKWQPANAPLSVNHQGLSAASTISFNLPTGKSLSDASAAIDRAMTQLGVPSTVRGSFAGTAQVFQETMNSQVILIIAAIATVYIVLGILYESYVHPLTILSTLPSAGVGALLALQLFNAPFSLIALIGIMLLIGIVKKNAIMMVDFALEAQRHGNLTPQEAIFQACLLRFRPIMMTTLAALFGALPLVLSGGDGSELRQPLGITIVGGLVMSQLLTLYTTPVVYLFFDRLRLRFSRKPKQAVTE

SEQ ID NO: 5095 - DNA, 1416 bp, Escherichia coli
atgacagatcttcccgacagcacccgctggcaattgtggattgtggctttcggcttctttatgcagtcgctggacaccaccatcgttaacaccgcgcttccctcaatggcgcaaagcctcggggaaagtccgttgcatatgcacatggtcattgtctcttatgtactgaccgtggcggtgatgctgcccgccagcggctggctggcggacaaagtcggcgtgcgcaatattttctttaccgccatcgtgctgtttactctcggttcactgttttgcgcgctttccggcacgctgaacgaactgttgctggcacgcgcgctacagggcgttggcggcgcgatgatggtgccggtcggcaggttgacggtgatgaaaatcgtaccacgcgagcaatatatggcggcgatgacctttgtcacgctgcccggtcaggtcgggccgctgcttggcccggcgctcggaggtctgctggtggagtacgcatcgtggcactggatctttttgatcaacattccggtggggattattggcgcgatcgccacactgatgttaatgccgaactacaccatgcagacgcggcgctttgatctctccggctttctgttgctggcggttggcatggcagtcttaaccctggcgctggacggcagtaaaggtacaggtttctcgccgctggcgattgctggcctggtcgcagttggcgtggtagcactggtgctttatctgctgcacgcccaaaataacaaccgcgccctgttcagtctgaaactgttccgcactcgtaccttttcgctgggcctggcggggagctttgccggacgtattggcagtggcatgttgccctttatgacaccggttttcctgcaaattggtctcggtttctcgccgtttcatgccggactgatgatgatcccgatggtactcggcagcatgggaatgaagcgaattgtggtacaggtagtgaatcgctttggttatcgtcgggtactggtggcgaccacgctgggcctgtcgctggtcaccctgttgtttatgactaccgctctgctgggctggtactacgttttgccgttcgtcctgtttttacaaggaatggtcaactcgacgcgtttctcctccatgaacaccctgacgctgaaagatctcccggacaacctggcgagcagcggcaacagtctgctgtcgatgattatgcaattgtcgatgagtattggcgtcaccatcgccgggctgttgctgggactttttggttcgcagcatgtcagcgtcgacagcggcaccacacaaaccgtctttatgtacacctggcttagcatggcgtttatcatcgcccttccggcgtttgtctttgccagagtgccgagcgatacgcatcaaaatgtggctatttcacggcgaaaaaggagcgcgcaatga

SEQ ID NO: 5096 - protein, 471 aa, Escherichia coli
MTDLPDSTRWQLWIVAFGFFMQSLDTTIVNTALPSMAQSLGESPLHMHMVIVSYVLTVAVMLPASGWLADKVGVRNIFFTAIVLFTLGSLFCALSGTLNELLLARALQGVGGAMMVPVGRLTVMKIVPREQYMAAMTFVTLPGQVGPLLGPALGGLLVEYASWHWIFLINIPVGIIGAIATLMLMPNYTMQTRRFDLSGFLLLAVGMAVLTLALDGSKGTGFSPLAIAGLVAVGVVALVLYLLHAQNNNRALFSLKLFRTRTFSLGLAGSFAGRIGSGMLPFMTPVFLQIGLGFSPFHAGLMMIPMVLGSMGMKRIVVQVVNRFGYRRVLVATTLGLSLVTLLFMTTALLGWYYVLPFVLFLQGMVNSTRFSSMNTLTLKDLPDNLASSGNSLLSMIMQLSMSIGVTIAGLLLGLFGSQHVSVDSGTTQTVFMYTWLSMAFIIALPAFVFARVPSDTHQNVAISRRKRSAQ

SEQ ID NO: 5097 - DNA, 1404 bp, Escherichia coli
atgaagttctggcgacccggtattaccggcaaactgtttctggcgattttcgccacctgcattgtcttattgatcacgatgcactgggcggtacgtatcagttttgagcgcggctttatcgattacatcaagcatggtaatgaacaacggctgcaaatgctcggcgatgcgcttggtgagcagtacgcccagcacgggaactggcgcttcctgcgtaataacgatcgctttgtatttcagatcctacgttcactggagcatgataacaacgaagataagcccggccccggtatgccaccacacggctggcgcacgcaattttgggtggttgatcaaaataataaagtgctggttggcccgcgagcaccggttccacccgacggcacacggcggcccattatggtcaatggtgcggaagttggcgcggtgatcgcctcccctgttgaacgactgacccgtaatactgatatcaattttgacagacaacagcggcaaaccagttggctgattgtggctttatctaccttattagcggcgctggcgacattcccactggcgcgcggtttgctggctccggtaaaacgactggtggatggcacgcacaaactggcagcgggtgatttcactactcgcgtagcccccaccagcgaagatgagttgggcagactggcagaggatttcaatcaactcgccagcacactggagaaaaaccagcagatgcgccgcgattttatggccgatatttctcatgaactgcgcacgcctttagcagtactgcgcggcgaactggaagccattcaggatggtgtgcgtaaattcacgccggagacgctggcttctttacaggcagaagtcggaacactgacaaaactggttgacgatctccatcaattgtctatgtctgatgaaggcgctctcgcctatcaaaaagcaccggtagatttgatcccactgctggaagtggcgggaggcgcatttcgcgaacgattcgccagccgtggcctgaaattgcaattttccctgccagacagtattaccgtatttggcgatcgcgatcgtttaatgcagttgttcaataacttactggaaaacagcctgcgctacactgacagcggcggcagcctgaaaatctctgccgaacagcacgacaaaacggtgcgcctgacctttgccgacagtgcgccgggtgtcagtgacgatcagctacaaaaattgtttgaacgtttttatcgcaccgaaggttcccgcaaccgcgccagcggtggttccgggctggggctggcgatttgcctgaacattgttgaagcacataacggccgcattattgccgcccattcgccttttggcgggcttagcattacagtagagttaccgctggaacgggatttacagagagaagtatga

SEQ ID NO: 5098 - protein, 467 aa, Escherichia coli
MKFWRPGITGKLFLAIFATCIVLLITMHWAVRISFERGFIDYIKHGNEQRLQMLGDALGEQYAQHGNWRFLRNNDRFVFQILRSLEHDNNEDKPGPGMPPHGWRTQFWVVDQNNKVLVGPRAPVPPDGTRRPIMVNGAEVGAVIASPVERLTRNTDINFDRQQRQTSWLIVALSTLLAALATFPLARGLLAPVKRLVDGTHKLAAGDFTTRVAPTSEDELGRLAEDFNQLASTLEKNQQMRRDFMADISHELRTPLAVLRGELEAIQDGVRKFTPETLASLQAEVGTLTKLVDDLHQLSMSDEGALAYQKAPVDLIPLLEVAGGAFRERFASRGLKLQFSLPDSITVFGDRDRLMQLFNNLLENSLRYTDSGGSLKISAEQHDKTVRLTFADSAPGVSDDQLQKLFERFYRTEGSRNRASGGSGLGLAICLNIVEAHNGRIIAAHSPFGGLSITVELPLERDLQREV

SEQ ID NO: 5099 - DNA, 723 bp, Escherichia coli
atgaccgagttaccaatcgacgaaaacacaccgcgtattttgatcgtggaagatgaaccgaagctggggcagttgctcattgattatctgcgtgctgcgagctatgcgccaacgttgattagccacggcgatcaggtactgccatatgtgcgccagacaccaccggatctgatcctgttggatctgatgctccctggcaccgatggcctgacgctgtgccgggaaattcgtcgtttttctgacattccgatcgtgatggtgacggcaaaaatcgaagagatcgaccgcctgctggggttggagattggcgcagatgactatatctgcaagccgtacagcccacgggaagtggtagcgcgcgtcaaaaccattttgcgccgttgcaaaccgcagcgtgagttgcagcaacaggatgctgaaagcccgttgattatcgacgaaggtcgttttcaggcttcctggcgcggtaaaatgcttgacctgacgcctgcagaatttcgtctgctgaaaacgctctctcatgaaccaggaaaagtgttctcccgcgagcagttgctgaaccatctttatgacgactaccgcgtggtaaccgaccgtaccatcgacagccacattaaaaacctgcgccgcaagctggaatctctcgacgccgaacagtcatttatccgcgccgtttacggcgtcggttaccgctgggaagccgacgcctgccgcatcgtttaa

SEQ ID NO: 5100 - protein, 240 aa, Escherichia coli
MTELPIDENTPRILIVEDEPKLGQLLIDYLRAASYAPTLISHGDQVLPYVRQTPPDLILLDLMLPGTDGLTLCREIRRFSDIPIVMVTAKIEEIDRLLGLEIGADDYICKPYSPREVVARVKTILRRCKPQRELQQQDAESPLIIDEGRFQASWRGKMLDLTPAEFRLLKTLSHEPGKVFSREQLLNHLYDDYRVVTDRTIDSHIKNLRRKLESLDAEQSFIRAVYGVGYRWEADACRIV

SEQ ID NO: 5101 - DNA, 333 bp, Escherichia coli
atggctggttggtttgaactcagtaagagcagtgataatcagttccggtttgtgctaaaagcgggcaatggtgagactatcctcaccagcgagctgtatacctcaaaagcctctgcggaaaagggcatcgcgtcggtgcgtagcaacagcccgcaagaagaacgctatgagaaaaaaacggcaagcaatggcaaattctatttcaatctgaaagccgccaatcatcaaattatcggctccagccagatgtatgccaccgcgcaatctcgtgaaaccggaattgcctccgttaaagtaaatggcacaagccagacggtgaaagacaatacgtaa

SEQ ID NO: 5102 - protein, 110 aa, Escherichia coli
MAGWFELSKSSDNQFRFVLKAGNGETILTSELYTSKASAEKGIASVRSNSPQEERYEKKTASNGKFYFNLKAANHQIIGSSQMYATAQSRETGIASVKVNGTSQTVKDNT

SEQ ID NO: 5103 - DNA, 606 bp, Escherichia coli
atgctgatgttaaaaaaaggaatgatgctggtggggctgatattcttttctttacccgccaatgccgggtgtacgctggaggaaacagccagaaaggtgattatgggctttcagcaagaagatgcccaattaatcaactcgttaattgataaaaaaacgggtttgtatgttcttttccaccgtggtgcttcgatggatgttgaaaatcttaagcaaattaatttcaggcaacctgttcccgagtatttcccatggccctcggcaggggaacatgttccgcgagatgacgaatttaataagaaagctatcccgaaatttaactgcgaacgtggctggaataagcaggggtattttattagcaatagcgatgttcaccataaagtcagccgtagtttggtcttcacgcagatgtttggttcaccgcaaaatactatttctgatgcgcagattgccgcagcgcgtcgaatggaatacggggccgtgcgtgtggtcgctgcgccagaagagagtaacgatggactggtattttatttaagtcaactttacagttatgacagtgactggtatctgacggtggtggatcagattggtgattgtggggcgtga

SEQ ID NO: 5104 - protein, 201 aa, Escherichia coli
MLMLKKGMMLVGLIFFSLPANAGCTLEETARKVIMGFQQEDAQLINSLIDKKTGLYVLFHRGASMDVENLKQINFRQPVPEYFPWPSAGEHVPRDDEFNKKAIPKFNCERGWNKQGYFISNSDVHHKVSRSLVFTQMFGSPQNTISDAQIAAARRMEYGAVRVVAAPEESNDGLVFYLSQLYSYDSDWYLTVVDQIGDCGA

SEQ ID NO: 5105 - DNA, 2148 bp, Escherichia coli
atgaatttaaaatttttgaacctaattaaaaggatatctatggaacaggatgctcgtttactcagtgcaatgcaaaagatgtgtgaccaaaaaatgccacttaatactcttgagagaaaatggcaaatcgcaaatattccttatatgttacaagaaaaacgttatcaggaactagatgaaatttataaccaggtattacaggagagtttcacttctcgtcaggctgaaaagcgctattttttatcctggacccaaatgtgcaactatttttatgatatgaacacgctagttgatgccggaacagaaggtttaagactcattaaaacctggcagcaagcaagacctcattctacacatgcctggcttgccgaagcacaatactggaatcaccgtgcatggttatatcgcagttatggctgggcaaatgataccacacatgcaatgtggctttgtgctggtgcatgtaatgaacaaatggtcatcgctacacttaaagcaattgattgtgacccacgacaatggatggctgcattacttaccagcaccaactcaaaagtatttggtcagccagcctggctggcggcacaccttaacggtgatagtgtcgcaggaataccattaatgatcgcactgaaaaattatcaccgccgctccccgcaagaagtggaagcgttgatggcgtattccggactttcgtttgagcatgcaatatgccccgttttgcctcgccccaatatacttcctgagtatgatgatgatggtgggcaaaaatattggctttctgtttgcctgactatttttcctcacactttttatccttttgttgaatatataccatttcgaatgccacgctggggagggtcgcataaagaaatttccgaattgctggattcagtaacctgtaagcacttatctaccgaagaacatgactatatggatctcttactttggtgggatgattaccgagatgtcagcattgaggacattgcgcccgaggagcaacaatatgcaatcgacttagcagagaatattgctcagtacgcacaatttcaggaatgtcgccataatgccctagagtggttacttgcctgctataacaagcagaacgatcacgataagttgtggtgctgtatacagcgagcggtgatggaagacatgaagctcaataattattacactgcgtacgcgataaaatttgcattaagttattatccagattcattctggatatataattttatctgccaaaattcacagaatacaacttatgctacacctgttatttatagggggtttttccagcgagagggtattttgggttttgaaaaagatgaagggcagggcgatgcttggctggaaaaagctagtgacattaaatacaatcataattggcggtcggcaataaaagatttgagttggtttgacctttctgattatttcattccgcttgcgacaattggtaagcaaagaaatattcctgccgcattaaatttagttgctcttgaatatttggataaggaagacaatacaaaattaccttatgaaccatctacagctttggagtattttcgacgggcacttaaaatacttcaagatgacctaaatttccatagctcggtatcttatccactggtaaaaaattatggttatagcgaacatcaacaagatctacaaaatatttattttagcattgctatctgctaccaggcactaaataaacaagaaatttctaaagaaacacgggctatttatgaaaaaaatctccttgacaatttatttctggctcatgaagctggacatgaaaaagcatgggggctttttttacttaatatctttgaggtgaaagaactctcacttgctcatttgcacctccaacaggtacaagaagaagcgaataaaggtacgctcgaagcaatgattactttgtcgcgcctgtatggtaacaaagaagatgaaaaactgtttaacatgaaactcagtgcgcgctggacacattttgccgagtctttatatccagataacgaaattattgcagattgcctttatcatctccatttctccagcctgtggaaacgctgtcgttatgcctggtatacctttcgtattccagctagcgaattacccggccaggttaacagtatggtgtaa

SEQ ID NO: 5106 - protein, 715 aa, Escherichia coli
MNLKFLNLIKRISMEQDARLLSAMQKMCDQKMPLNTLERKWQIANIPYMLQEKRYQELDEIYNQVLQESFTSRQAEKRYFLSWTQMCNYFYDMNTLVDAGTEGLRLIKTWQQARPHSTHAWLAEAQYWNHRAWLYRSYGWANDTTHAMWLCAGACNEQMVIATLKAIDCDPRQWMAALLTSTNSKVFGQPAWLAAHLNGDSVAGIPLMIALKNYHRRSPQEVEALMAYSGLSFEHAICPVLPRPNILPEYDDDGGQKYWLSVCLTIFPHTFYPFVEYIPFRMPRWGGSHKEISELLDSVTCKHLSTEEHDYMDLLLWWDDYRDVSIEDIAPEEQQYAIDLAENIAQYAQFQECRHNALEWLLACYNKQNDHDKLWCCIQRAVMEDMKLNNYYTAYAIKFALSYYPDSFWIYNFICQNSQNTTYATPVIYRGFFQREGILGFEKDEGQGDAWLEKASDIKYNHNWRSAIKDLSWFDLSDYFIPLATIGKQRNIPAALNLVALEYLDKEDNTKLPYEPSTALEYFRRALKILQDDLNFHSSVSYPLVKNYGYSEHQQDLQNIYFSIAICYQALNKQEISKETRAIYEKNLLDNLFLAHEAGHEKAWGLFLLNIFEVKELSLAHLHLQQVQEEANKGTLEAMITLSRLYGNKEDEKLFNMKLSARWTHFAESLYPDNEIIADCLYHLHFSSLWKRCRYAWYTFRIPASELPGQVNSMV

SEQ ID NO: 5107 - DNA, 717 bp, Escherichia coli
atgagtcttatcattgttctcctggtcgcaatatttatttttatctatagatacaaaaaaaacaaaccacaaatcgatgcttttattgctaaagaaaaagaaaaggatctaatcaaggacaaaagacgagcaacaaagagacgtaagtgggcattagcaattggtgatatagttgctcgtcgtaatggactgtcagtaaatggcttcacgttagatttaaagttgactgatgataagcgtcaacaacttgcactacaggttaaacaagagctaggaacagaaacttaccaaagcaacgaagatttccgtcaacaaattggcgttatattacagcgctgggctacagggcttggtaattctccacatgatttttacgaacaactggcagcacaaggccaggttctggatgggctggcgtttgactgtatgcgcactgcttttttaactcgttgcatcgccggtttaggctggtgcgatgaaaaccaggcctggatagtgttattactgaatgctcaaagagcacaagattgtttcgcttcatgggaagattatgccagtgcttatgttcgcgcccgacaaaaatggttaatgatatacgatacccccgtcgccactgcgaaccgtgatttaaaggaagtcactgcatggttgaaagatccatccagtaactggaaaaaattgccgtggaatgaatttaaaatttttgaacctaattaa

SEQ ID NO: 5108 - protein, 238 aa, Escherichia coli
MSLIIVLLVAIFIFIYRYKKNKPQIDAFIAKEKEKDLIKDKRRATKRRKWALAIGDIVARRNGLSVNGFTLDLKLTDDKRQQLALQVKQELGTETYQSNEDFRQQIGVILQRWATGLGNSPHDFYEQLAAQGQVLDGLAFDCMRTAFLTRCIAGLGWCDENQAWIVLLLNAQRAQDCFASWEDYASAYVRARQKWLMIYDTPVATANRDLKEVTAWLKDPSSNWKKLPWNEFKIFEPN

SEQ ID NO: 5109 - DNA, 1215 bp, Escherichia coli
atgactggaaatattcaccagaattataatgcaagggatgtaattaatgccccggaagtaaaaacagcaattttgcaaagaagtctgtttcgccaggataatgagaccatccaaaaatggttactcaaccatttttatcgatggctaattagtgactttccaatggtgcaacaaattaactcgcttgcagaatattcactgtttaataaaaatgatgatgtaatcccggaatggctggtatcgaagtttaatactgcctcagtatcaactgcgacactttattatatcgaaaccgatcatcaacaaatattaaccaaagaacgggagttggtggaatttctttccaggaaatgtggtacccgtctggaatcaaaactacagcgcataacctgctacgttgcgttcagaatgcgtgaagaagagcatgaaaagatgcttcaacgacgcgagaaagggtggcagccgagtgaacaaaatactgtaaagtcaatacttgatgtgccagacggaaaaattgttgagtttgatgccagtcattcgaaccttcgtcgtgaaatggcttatgaatcatggcatatgcaacattgcgtaggccagtttgatgatcgaaaaaatcttaccggtggttatggtgagtattatgcaaatcaaattgagcaacataaattacggttattcagtttgcgtgataataataatattcctcatgttactattgctctcaatgttgttggtgattcacttgaaattgatcaaataaaaggtaagcaaaatcgtcatccagttaaaaaatatgcggacgatgttttgtctcttttgcaactattatcaccacaagcagttcgacatagtgattgtgaaggtatgggtattgtttatgaaaatacacctgaatatcaggggtggaaatatgtaacggaagtatacgaaaccagttttttactaagcgtactacataataactttcatttattagaacattttacaaatccttcagtggagttgcagtggttactgttacacagcgcacctgataagttacattatcttaatgctattgaccctatagttgctacttctgcggaaatgttattccctggcgctgagtggcatccgcaatttgcaggtcaaaatatcagcaacatttcctttgagatagagagtttgacattacagacatctcattacttacccctgtcagaggttgaaaaataa

SEQ ID NO: 5110 - protein, 404 aa, Escherichia coli
MTGNIHQNYNARDVINAPEVKTAILQRSLFRQDNETIQKWLLNHFYRWLISDFPMVQQINSLAEYSLFNKNDDVIPEWLVSKFNTASVSTATLYYIETDHQQILTKERELVEFLSRKCGTRLESKLQRITCYVAFRMREEEHEKMLQRREKGWQPSEQNTVKSILDVPDGKIVEFDASHSNLRREMAYESWHMQHCVGQFDDRKNLTGGYGEYYANQIEQHKLRLFSLRDNNNIPHVTIALNVVGDSLEIDQIKGKQNRHPVKKYADDVLSLLQLLSPQAVRHSDCEGMGIVYENTPEYQGWKYVTEVYETSFLLSVLHNNFHLLEHFTNPSVELQWLLLHSAPDKLHYLNAIDPIVATSAEMLFPGAEWHPQFAGQNISNISFEIESLTLQTSHYLPLSEVEK

SEQ ID NO: 5111 - DNA, 1362 bp, Escherichia coli
atgtttaaaccggaactcctttccccggcgggaacgctgaaaaatatgcgttacgctttcgcttatggcgcagatgctgtttatgcgggccagccgcgttactccctgcgtgtacgcaacaacgaattcaaccacgaaaatcttcagctcggcatcaatgaagcccacgcgctggagaaaaagttttatgtcgtggtcaacattgcaccgcacaacgccaagctgaaaacctttatccgtgacctgaaaccggtggtggaaatggggccggatgcgctgattatgtccgatccagggctgattatgctggtgcgtgaacacttcccggaaatgccaatccacctctcggtacaggctaacgccgtaaactgggcgacggtgaaattctggcagcaaatgggtctgacccgcgtgatcctctctcgcgaactgtcactggaagagattgaagagatccgcaatcaggtgccggatatggagatcgaaatcttcgttcacggcgcgctgtgcatggcctactccggtcgctgcctgctctctggctatatcaacaagcgcgacccgaaccagggcacctgcaccaacgcctgccgctgggagtacaacgtccaggaagggaaagaagatgacgtcggcaacatcgtacacaagtacgagccgattccggtgcaaaatgttgagccgacgctgggtatcggcgcgccaaccgacaaagtgtttatgatcgaagaagcccagcgtccgggcgagtatatgaccgcgtttgaagatgagcacggcacttacatcatgaactcgaaagatctgcgcgccatcgcccatgttgaacgcctgaccaaaatgggcgtgcattcgctgaaaatcgaaggccgtaccaaatctttctactattgcgcacgcaccgcgcaggtttaccgtaaagctatcgatgacgccgctgcgggcaaaccgttcgataccagcctgctggaaacgctggaaggtctggcgcatcgtggctataccgaaggtttcctgcgtcgtcatacccacgacgattatcagaactacgaatacggttattcggtttctgaccgccagcagtttgttggtgagtttaccggtgagcgcaagggggagctcgcggcggtagcggtgaaaaataaattctccgttggcgacagccttgagctgatgacgccgcaaggcaacattaactttacccttgagcatatggaaaacgccaaaggtgaagcgatgccggtcgcaccaggcgatggttatactgtgtggctcccggtgccgcaggatcttgagctaaattacgcgctgctgatgcgtaatttctccggggaaaccacgcgtaacccccacggtaagtga

SEQ ID NO: 5112 - protein, 453 aa, Escherichia coli
MFKPELLSPAGTLKNMRYAFAYGADAVYAGQPRYSLRVRNNEFNHENLQLGINEAHALEKKFYVVVNIAPHNAKLKTFIRDLKPVVEMGPDALIMSDPGLIMLVREHFPEMPIHLSVQANAVNWATVKFWQQMGLTRVILSRELSLEEIEEIRNQVPDMEIEIFVHGALCMAYSGRCLLSGYINKRDPNQGTCTNACRWEYNVQEGKEDDVGNIVHKYEPIPVQNVEPTLGIGAPTDKVFMIEEAQRPGEYMTAFEDEHGTYIMNSKDLRAIAHVERLTKMGVHSLKIEGRTKSFYYCARTAQVYRKAIDDAAAGKPFDTSLLETLEGLAHRGYTEGFLRRHTHDDYQNYEYGYSVSDRQQFVGEFTGERKGELAAVAVKNKFSVGDSLELMTPQGNINFTLEHMENAKGEAMPVAPGDGYTVWLPVPQDLELNYALLMRNFSGETTRNPHGK

SEQ ID NO: 5113 - DNA, 735 bp, Escherichia coli
ttgggcgtcgcaacggtgattgccggtggtggcgatggcaccattaatgaagtttctacggcgttgattcagtgtgagggggatgacatacccgcgctgggaattttaccattaggaaccgccaatgattttgccaccagtgtagggattcctgaggcactggataaggcgctgaaactggcaattgccggtaacgccattgcgatagatatggcgcaggtcaataaacaaacctgttttattaatatggcgacaggcggatttgggacgcgtattaccacagaaacgccggaaaaattaaaagccgcgctgggtggcgtctcttacatcattcatggcttaatgcgcatggatactctgcaaccggaccgttgtgagatccgcggtgaaaactttcactggcaaggtgacgccctggtcattggtattggtaacgggcgtcaggccggtggcggtcaacaattgtgcccgaacgcattaattaacgatggcttgctgcaactgcgcatttttaccggcgatgaaattattccgactctcgtatcaaccttaaaatctgacgaagataacccgaatattatcgaaggtgcttcgtcgtggtttgatatacaagccccacacgaaatcacttttaatcttgatggcgaaccgttgagtgggcaaaacttccatattgaaatacttccggcggcgttgcgttgtcgattaccaccagattgtccattgttgcgttaa

SEQ ID NO: 5114 - protein, 244 aa, Escherichia coli
MGVATVIAGGGDGTINEVSTALIQCEGDDIPALGILPLGTANDFATSVGIPEALDKALKLAIAGNAIAIDMAQVNKQTCFINMATGGFGTRITTETPEKLKAALGGVSYIIHGLMRMDTLQPDRCEIRGENFHWQGDALVIGIGNGRQAGGGQQLCPNALINDGLLQLRIFTGDEIIPTLVSTLKSDEDNPNIIEGASSWFDIQAPHEITFNLDGEPLSGQNFHIEILPAALRCRLPPDCPLLR

SEQ ID NO: 5115 - DNA, 780 bp, Escherichia coli
atgacgatgaattcattcgagcgaaggaataagatcatccaattagtgaatgaacagggaaccgtgcttgttcaggatctggcgggagtatttgctgcctcggaagcgacaatccgtgccgatttgcgctttctcgaacaaaaaggcgtggttacgcgctttcatggcggtgcggcgaaaataatgtccggtaatagtgaaaccgagacccaggaagttgggtttaaagagcgatttcagctcgccagtgcgccaaaaaacagaatagcgcaggcggcagtcaaaatgatccacgaagggatgaccgttattctcgacagcggaagtaccacaatgcttatcgccgaaggtttaatgaccgccaaaaatatcacggtgattaccaacagtctcccggcggcgtttgccctttccgaaaataaagacattactctggtcgtctgcggtggcacggtccgccataaaacgcgatctatgcatggatctattgctgaacgttccctgcaggatattaatgccgatttaatgtttgtcggtgctgatggtattgatgcggttaatggtattacgacctttaatgaaggttattccgttagcggtgcgatggtgacagcggcgaataaagtgattgccgttctcgattcatcgaaatttaaccgtcgcggttttaatcaggtactgccaatcgaaaaaattgacattattattaccgatgatgctgtgtctgaggtggataaactggcattgcagaagacacgggtaaaattaattacggtgtag

SEQ ID NO: 5116 - protein, 259 aa, Escherichia coli
MTMNSFERRNKIIQLVNEQGTVLVQDLAGVFAASEATIRADLRFLEQKGVVTRFHGGAAKIMSGNSETETQEVGFKERFQLASAPKNRIAQAAVKMIHEGMTVILDSGSTTMLIAEGLMTAKNITVITNSLPAAFALSENKDITLVVCGGTVRHKTRSMHGSIAERSLQDINADLMFVGADGIDAVNGITTFNEGYSVSGAMVTAANKVIAVLDSSKFNRRGFNQVLPIEKIDIIITDDAVSEVDKLALQKTRVKLITV

SEQ ID NO: 5117 - DNA, 1041 bp, Escherichia coli
atgaaatcagtggtgaatgatactgatggtatcgtgcgcgttgcagaaagcgtcattcctgaaattaaatatcaggatgaggtgcgggtaaaaattgccagctcgggcttatgtggttccgatttacccaggatatttaaaaatggtgcacattattatccaataacgttaggtcatgaatttagcggctatattgatgcggtgggatccggtgttgatgatttacaccctggcgatgtggttgcctgtgtgccgttattaccctgttttacttgtccagagtgtttgaaagggttttattcccagtgcgcaaaatatgattttattggctcgcggcgtgatggtggacttgctgaatatattgtcgttaagcgaaaaaatgtctttgctctacccacggatatgcctattgaggatggggcttttattgagccgattaccgttggcctgcatgcttttcatttagcgcaaggttgtgagaataaaaacgttattattattggtgccggaaccattggcctgctggctattcagtgcgctgtcgcgctgggagcaaagagtgtgacggctatcgacattagctcagaaaaactggcactggcaaaatctttcggtgcgatgcaaacatttaacagccttgaaatgagcgcgccgcaaatgcagggcgttttacgcgagctgcgctttaatcagcttatcctcgagacggctggcgtcccgcaaactgtcgaactggcggtagagattgccgggcctcatgcccagctggcgctggtgggcacgttgcatcaggatctgcatttaacatcgacaacgtttggcaaaatattacgtaaagagctgacggttatcggcagttggatgaactactccagcccttggccggggcaggagtgggaaacggcgagccggttgctgacagaacgtaagttaagcctggagccattaatcgctcaccgtggaagctttgaaagcttcgcccaggcggtgcgtgacatcgctcgtaatgctatgccgggcaaagtgttgctcattccctga

SEQ ID NO: 5118 - protein, 346 aa, Escherichia coli
MKSVVNDTDGIVRVAESVIPEIKYQDEVRVKIASSGLCGSDLPRIFKNGAHYYPITLGHEFSGYIDAVGSGVDDLHPGDVVACVPLLPCFTCPECLKGFYSQCAKYDFIGSRRDGGLAEYIVVKRKNVFALPTDMPIEDGAFIEPITVGLHAFHLAQGCENKNVIIIGAGTIGLLAIQCAVALGAKSVTAIDISSEKLALAKSFGAMQTFNSLEMSAPQMQGVLRELRFNQLILETAGVPQTVELAVEIAGPHAQLALVGTLHQDLHLTSTTFGKILRKELTVIGSWMNYSSPWPGQEWETASRLLTERKLSLEPLIAHRGSFESFAQAVRDIARNAMPGKVLLIP

SEQ ID NO: 5119 - DNA, 1356 bp, Escherichia coli
atgttttcagaagtcatgcgttatattctcgacctcggccctacggtgatgctgccgattgtcatcattattttttctaaaatattaggcatgaaggcaggcgattgctttaaagcaggtctgcatatcgggattggctttgttggtattggccttgtgattggcttaatgctggattccattggcccggcggcgaaagcgatggcggaaaattttgacctgaatctgcatgtggtcgatgtcggttggccgggctcttcaccaatgacctgggcgtcgcaaattgcgctggtggcgattccgattgcgattctggttaacgtggcgatgctactgacccgtatgacgcgggtggtaaatgttgatatctggaatatctggcatatgaccttcaccggcgcattgctgcatctggcaaccggttcatggatgatagggatggcgggtgtggtaattcacgcggcgtttgtttataagctcggcgactggtttgcccgcgatactcgaaatttctttgagctggaaggcattgctattccgcacggtacgtcggcgtatctggggccaattgcggtgctggtggatgctatcatcgagaaaatcccaggcgttaaccgtattaaatttagcgccgacgatattcagcgcaaatttggcccatttggcgaacctgtcaccgtgggctttgtgatggggctgattaccggcatcctcgcgggttacgatgtcaaaggtgtattgcagctggcggtaaaaacggcggcagttatgctgctgatgccacgggtgattaaacccatcatggatggtttaacgcccatcgctaagcaggcccgtagtcgtttacaggcgaagttcggcggtcaggagttcctgattggccttgatccggcgttgctgctggggcatacggcggtggtatcggcaagcctgatttttatccctctcaccattttaattgctgtttgtgttccgggtaatcaggtgctgccgtttggcgatcttgcaactatcggcttctttgtggcgatggcagttgccgtgcatcgtggaaatctgttccgcaccttaatctcgggtgtcatcattatgagcatcaccctgtggatcgcgacgcaaactattggtttgcacacccaactggcggctaatgctggggcgttaaaagccgggggcatggtggcttcaatggatcagggcggttctcccattacctggttactgattcaggttttctccccgcaaaatattcccggtttcattattatcggtgccatttatcttaccggtattttcatgacctggcgtagagcgcgtggctttattaaacaagagaaagccgttctcgcagaataa

SEQ ID NO: 5120 - protein, 451 aa, Escherichia coli
MFSEVMRYILDLGPTVMLPIVIIIFSKILGMKAGDCFKAGLHIGIGFVGIGLVIGLMLDSIGPAAKAMAENFDLNLHVVDVGWPGSSPMTWASQIALVAIPIAILVNVAMLLTRMTRVVNVDIWNIWHMTFTGALLHLATGSWMIGMAGVVIHAAFVYKLGDWFARDTRNFFELEGIAIPHGTSAYLGPIAVLVDAIIEKIPGVNRIKFSADDIQRKFGPFGEPVTVGFVMGLITGILAGYDVKGVLQLAVKTAAVMLLMPRVIKPIMDGLTPIAKQARSRLQAKFGGQEFLIGLDPALLLGHTAVVSASLIFIPLTILIAVCVPGNQVLPFGDLATIGFFVAMAVAVHRGNLFRTLISGVIIMSITLWIATQTIGLHTQLAANAGALKAGGMVASMDQGGSPITWLLIQVFSPQNIPGFIIIGAIYLTGIFMTWRRARGFIKQEKAVLAE

SEQ ID NO: 5121 - DNA, 285 bp, Escherichia coli
atgaaacgcaaaattattgtcgcttgcggaggcgcggttgcgacctctacgatggcggcggaagaaattaaagagttgtgtcagagtcataatattcctgttgaattaatccagtgtcgggttaatgaaatagaaacctatatggatggcgtgcatttgatatgcaccactgccagggtggatcgtagttttggcaatattccgttagttcacggcatgccttttgtttctggtgtcggtatcgaagcattacaaaataaaattctgactatcttacaggggtga

SEQ ID NO: 5122 - protein, 94 aa, Escherichia coli
MKRKIIVACGGAVATSTMAAEEIKELCQSHNIPVELIQCRVNEIETYMDGVHLICTTARVDRSFGNIPLVHGMPFVSGVGIEALQNKILTILQG

SEQ ID NO: 5123 - DNA, 453 bp, Escherichia coli
atgactaacctgtttgttcgtagcggaatttcttttgtcgatcgtagcgaagttttaacccatatcggtaatgagatgctcgcgaaaggtgtggttcatgatacctggccacaggcattaattaccagagaagcagaattccctaccgggataatgcttcagcagcacgccattgcaataccgcattgtgaggcgattcatgctaagtcgtcagccatttatctgttaaggccaacaaataaagttcattttcagcaagcggatgatgataacgacgtggcggtatcgttggttattgcgttgattgtggaaaatccgcagcagcaattgaaacttttacgctgtttatttggcaagttacaacagcccgatatcgtcgagacactaatcactcttcctgaaacccagttaaaggaatacttcacaaagtatgttttagattcagacgaataa

SEQ ID NO: 5124 - protein, 150 aa, Escherichia coli
MTNLFVRSGISFVDRSEVLTHIGNEMLAKGVVHDTWPQALITREAEFPTGIMLQQHAIAIPHCEAIHAKSSAIYLLRPTNKVHFQQADDDNDVAVSLVIALIVENPQQQLKLLRCLFGKLQQPDIVETLITLPETQLKEYFTKYVLDSDE

SEQ ID NO: 5125 - DNA, 1263 bp, Escherichia coli
atgaaaacgttaattgcccggcataaagctggtgaacatattggcatatgttcagtctgttctgcacatccgttggttatcgaagcggcgctggcatttgatcgcaacagcacgcgtaaagtgctgattgaagcaacgtcaaaccaggtcaatcaatttggcggttataccggaatgacaccggcagactttcgcgaatttgtttttgcgattgccgataaagtcggatttgctcgtgagcgtattattctcggcggcgaccatctgggaccaaactgctggcagcaagaaaatgcggatgcggcgatggaaaaatccgtcgagctggtaaaggcatatgttcgtgccggcttcagtaaaattcatcttgatgcgtcaatgtcctgcgctgacgattccataccgttagcgccagaaacggttgctgaacgtgccgctgtgctttgtctggcggcggaaagtgtggcgactgattgccagcgtgagcaactgaactatgtcattggcactgaagttccggttccgggcggtgaggccagcgccattcagtcagtacacatcacccaggttgaagatgccgccaatactttacgcacgcatcaaaaggcctttattgcccgtggtctggcagaggcgttaacacgcgtgattgccatcgtggtgcagccgggtgtggaatttgaccatagcaatattattcattatcaggcgcaagaagctcaggcgttggcgcaatggatagaaaaaaccaaaatggtttatgaagcgcattccaccgattaccagactcagacggcctatcgggaattagttcgcgatcattttgcaattttgaaagtcggtccggcattaacctttgctttacgtgaggcgatatttgcgctggcacaaattgagcaggaacttatcgcacccgaaaatcgtagccgttgtctggcggtaattgaagaagtgatgctcgacgaaccgcaatactggaaaaaatattatcgcacgggttttaacgattcattactgggtattcgttacagcctgtcggatcgtattcgttattactggccgcatagccggattaaaaatagcgtcgaaacgatgatggtgaatctggaaggcgtggacatcccactgggcatgattagtcagtatcttccgaaacaatttgaacgcattcagtccggggaattatcagcaataccgcatcagcttattatggataaaatttatgatgttttgcgcgcctatcgctacggctgtgcggaataa

SEQ ID NO: 5126 - protein, 420 aa, Escherichia coli
MKTLIARHKAGEHIGICSVCSAHPLVIEAALAFDRNSTRKVLIEATSNQVNQFGGYTGMTPADFREFVFAIADKVGFARERIILGGDHLGPNCWQQENADAAMEKSVELVKAYVRAGFSKIHLDASMSCADDSIPLAPETVAERAAVLCLAAESVATDCQREQLNYVIGTEVPVPGGEASAIQSVHITQVEDAANTLRTHQKAFIARGLAEALTRVIAIVVQPGVEFDHSNIIHYQAQEAQALAQWIEKTKMVYEAHSTDYQTQTAYRELVRDHFAILKVGPALTFALREAIFALAQIEQELIAPENRSRCLAVIEEVMLDEPQYWKKYYRTGFNDSLLGIRYSLSDRIRYYWPHSRIKNSVETMMVNLEGVDIPLGMISQYLPKQFERIQSGELSAIPHQLIMDKIYDVLRAYRYGCAE

SEQ ID NO: 5127 - DNA, 855 bp, Escherichia coli
atgtacgtggtatcgacaaagcagatgctgaacaacgcgcggcgcggcggttatgcggttccggcattcaatattcacaatctcgaaacgatgcaagtggtggtggaaaccgctgccagcatgcatgcgccggtcatcatcgccggaacgcccggcacatttactcatgccggtacagaaaatctgatggcgctggtcagcgcgatggcgaagcaatatcaccatccactggcgattcatctcgaccatcacacgaaatttgacgatatcgctcagaaggttcgttctggcgtgcgctcagtcatgattgacgcctcgcatttgccttttgcgcaaaatatttcacgggtcaaagaggtggtggatttttgccatcgctttgatgtcagcgtcgaagcggagctggggcaacttggcggccaggaagatgatgtgcaagtcaatgaagccgatgctttttataccaaccccgttcaggcgcgtgaatttgccgaggcaaccgggattgattccctggcggtcgccatcggcacggctcatgggatgtatgccagcgcaccggcgcttgatttttctcgactggagaacattcgccagtgggtgaacttaccgctggtgctgcatggcgcgtcaggattatcgacaaaggatattcagcaaaccatcaaactggggatatgcaaaatcaacgttgcaacggagctgaaaaatgccttctcgcaggcgttaaaaaattacctgacagagtaccccgaagcgaccgatccccgggattatttgcagtcggctaaatctgcaatgcgcgatgtggtgagcaaagtgattgccgattgtggctgcgagggcagggcataa

SEQ ID NO: 5128 - protein, 284 aa, Escherichia coli
MYVVSTKQMLNNARRGGYAVPAFNIHNLETMQVVVETAASMHAPVIIAGTPGTFTHAGTENLMALVSAMAKQYHHPLAIHLDHHTKFDDIAQKVRSGVRSVMIDASHLPFAQNISRVKEVVDFCHRFDVSVEAELGQLGGQEDDVQVNEADAFYTNPVQAREFAEATGIDSLAVAIGTAHGMYASAPALDFSRLENIRQWVNLPLVLHGASGLSTKDIQQTIKLGICKINVATELKNAFSQALKNYLTEYPEATDPRDYLQSAKSAMRDVVSKVIADCGCEGRA

SEQ ID NO: 5129 - DNA, 1053 bp, Escherichia coli
atgacagatattgcgcagttgcttggcaaagacgccgacaaccttttacagcaccgttgtatgactattccttctgaccagctttatctccccggacatgactacgtagaccgcgtgatgattgacaataatcgcccgccagcggtgttacgtaatatgcagacgttgtacaacaccgggcgtctggctggcacaggatatctttctattctgccggttgaccagggcgttgagcactctgccggagcttcatttgccgctaacccgctctactttgacccgaaaaacattgttgaactggcgatcgaagcgggctgtaactgtgtggcgtcaacttacggcgtgctggcatcggtatcgcggcgctacgcgcatcgcatcccatttctcgtcaaacttaatcacaacgagacgctaagttacccgaatacctacgatcaaacgctgtatgccagcgtggagcaggcgttcaatatgggcgcggtggccgttggtgcgactatctattttggctcggaagagtcacgtcgccagattgaagaaatttctgcggcttttgaacgtgcgcacgagctgggcatggtgacagtgctgtgggcctatttgcgtaactccgcctttaagaaagatggcgttgattaccatgtttccgccgacctgaccggtcaggcgaaccatctggcggcaaccataggtgcagatatcgtcaaacaaaaaatggcggaaaataacggcggctataaagcgattaattacggttataccgacgatcgcgtgtacagcaagttgaccagcgaaaacccgattgacctggtgcgttatcagttagctaactgctatatgggccgggccgggttgataaactccggcggtgctgcaggcggtgaaactgacctcagcgatgcagtgcgtactgcggttatcaacaaacgcgcaggcggaatggggctgattcttggacgtaaggcgttcaagaaatcgatggctgacggcgtgaaactgattaacgccgtgcaggacgtttatctcgatagcaaaattactatcgcctga

SEQ ID NO: 5130 - protein, 350 aa, Escherichia coli [sequence omitted]

SEQ ID NO: 5131 - DNA, 1278 bp, Escherichia coli
atgaaaacaacagcaaagctgtcgttcatgatgtttgttgaatggtttatctggggcgcgtggtttgtgccattgtggttgtggttaagtaaaagcggttttagtgccggagaaattggctggtcgtatgcctgtaccgccattgcggcgatcctgtcgccgattctggttggctccatcactgaccgctttttctcggcgcagaaagtgctggcggtattgatgttcgctggtgcggtgctgatgtatttcgccgcgcaacagaccacttttgccgggttcttcccgttactgctggcctactcgctaacctatatgccgaccattgcgctgactaacagtatcgcttttgccaacgtgccggatgtggagcgtgatttcccgcgcattcgtgtgatgggcactatcggctggattgcctctggtctggcatgtggtttcttgccgcaaatgctggggtatgccgatatctcaccgacgaacatcccgctgctgattactgccggaagttctgctctgcttggtgtgtttgcatttttcctgcccgacacaccgccaaaaagcaccggcaaaatggatattaaagtcatgctcggcctggatgcgctgatcctgctgcgcgataagaacttcctcgtctttttcttctgttcattcctgtttgcgatgccactggcgttctattacatctttgccaacggttatctgaccgaagttggcatgaaaaacgccactggctggatgacgctcggccagttctctgaaatcttctttatgctggcattgccgtttttcaccaaacgctttggtatcaaaaaggtattattgcttggtctggtcaccgccgcgatccgttatggcttctttatttacggcagtgcggatgaatatttcacttacgctctcttgttcctcggcattttgctgcacggcgtaagttacgatttttactacgttaccgcttacatctatgtcgataaaaaagcccccgtgcatatgcgtactgccgcgcaggggctgatcacgctctgctgccagggcttcggcagtttgctcggctatcgtcttggcggtgtgatgatggaaaagatgttcgcttatcaggaaccggtaaacggactgactttcaactgggccgggatgtggactttcggcgcggtgatgattgccattatcgccgtgctgttcatgatttttttccgcgaatccgacaacgaaattacggctatcaaggtcgatgatcgcgatattgcgttgacacaaggggaagttaaatga

SEQ ID NO: 5132 - protein, 425 aa, Escherichia coli
MKTTAKLSFMMFVEWFIWGAWFVPLWLWLSKSGFSAGEIGWSYACTAIAAILSPILVGSITDRFFSAQKVLAVLMFAGAVLMYFAAQQTTFAGFFPLLLAYSLTYMPTIALTNSIAFANVPDVERDFPRIRVMGTIGWIASGLACGFLPQMLGYADISPTNIPLLITAGSSALLGVFAFFLPDTPPKSTGKMDIKVMLGLDALILLRDKNFLVFFFCSFLFAMPLAFYYIFANGYLTEVGMKNATGWMTLGQFSEIFFMLALPFFTKRFGIKKVLLLGLVTAAIRYGFFIYGSADEYFTYALLFLGILLHGVSYDFYYVTAYIYVDKKAPVHMRTAAQGLITLCCQGFGSLLGYRLGGVMMEKMFAYQEPVNGLTFNWAGMWTFGAVMIAIIAVLFMIFFRESDNEITAIKVDDRDIALTQGEVK

SEQ ID NO: 5133 - DNA, 1005 bp, Escherichia coli
atgaaaacagaacgtattctcggtgctctttatgggcaggcgttaggggatgcgatggggatgccctccgagctttggccgcgcagtcgcgtcaaagcacactttggctggattgaccgttttctgcctgggccaaaggagaataacgcagcctgttattttaaccgcgccgaattcaccgacgatacctcgatggcgctgtgtctggcggatgcgttactggaacgtgaaggcaagatcgatccggatctgattgggcgtaatattctcgactgggcgctgcgtttcgacgcctttaacaaaaacgtactaggtccgacctcgaagattgcgcttaacgccattcgcgacggtaaacccgttgctgaactggaaaataacggcgtgaccaacggcgcagcgatgcgcatctcgccattaggttgtttgcttccggcgcgtgatgttgattcctttattgatgatgtggcgctggcctccagcccgacacataaatccgatctggcggttgcgggggcggtagtcatcgcatgggcgatttctcgtgccattgacggagaaagctggtcagcaattgttaattcactgccttcaattgcgcgacatgctcaacaaaaacgcatcactaccttcagcgcctcactggctgctcgtctggagattgcgctgaaaattgtgcgcaatgctgacggcaccgaatccgccagcgaacagctttaccaggtcgttggcgcaggtaccagcactattgagtccgttccgtgcgccattgcgctggttgaactggcacaaaccgacccgaaccgttgcgccgtcctgtgcgctaaccttggcggcgacacagacaccatcggtgctatggcgacggcaatttgcggcgcgttgcatggcgttaacgctatcgatcctgcgttaaaggcggaactggatgcagtaaatcagcttgatttcaaccgctatgccacggcgctggcgaagtatcgccaacaacgggaggcgatatga

SEQ ID NO: 5134 - protein, 334 aa, Escherichia coli
MKTERILGALYGQALGDAMGMPSELWPRSRVKAHFGWIDRFLPGPKENNAACYFNRAEFTDDTSMALCLADALLEREGKIDPDLIGRNILDWALRFDAFNKNVLGPTSKIALNAIRDGKPVAELENNGVTNGAAMRISPLGCLLPARDVDSFIDDVALASSPTHKSDLAVAGAVVIAWAISRAIDGESWSAIVNSLPSIARHAQQKRITTFSASLAARLEIALKIVRNADGTESASEQLYQVVGAGTSTIESVPCAIALVELAQTDPNRCAVLCANLGGDTDTIGAMATAICGALHGVNAIDPALKAELDAVNQLDFNRYATALAKYRQQREAI

SEQ ID NO: 5135 - DNA, 747 bp, Escherichia coli
atggaacaagcgcatacccagctgattgcccaactgaacgagcgtattttagcggcggataacacgccgctttatattaagtttgccgaaacggtaaaaaatgccgtgcgcagcggggtgctggagcatggcaatattttgcccggtgagcgtgatttaagtcagttaaccggcgtttcgcgcattacggtgcgcaaggcgatgcagtcgctggaagaagagggcgtggtgacgcgttcgcgtggttacggcacgcagatcaacaacatcttcgaatactcgctgaaagaagcgcgggggttttctcagcaggtggtattgcgcgggaaaaagcccgatacgttatgggttaacaagcgtgtcgtgaaatgtcccgaagaagtcgcgcagcagctggcggtcgaagcgggaagtgatgtctttttgcttaagcgtattcgctatgtcgatgaagaggcggtatcgattgaggaatcgtgggttccggcacatttaattcatgatgttgatgccatcgggatttctctttatgactacttccgcagccagcacatttacccacaacgtacgcgttcccgcgttagcgcccggatgccggatgccgagtttcagtcacatattcagttagatagcaaaataccggtgctggtgatcaagcaagtggcgcttgaccaacagcaacggcctattgagtacagcatcagccactgtcgcagcgatctatacgtttttgtgtgcgaggagtag

SEQ ID NO: 5136 - protein, 248 aa, Escherichia coli
MEQAHTQLIAQLNERILAADNTPLYIKFAETVKNAVRSGVLEHGNILPGERDLSQLTGVSRITVRKAMQSLEEEGVVTRSRGYGTQINNIFEYSLKEARGFSQQVVLRGKKPDTLWVNKRVVKCPEEVAQQLAVEAGSDVFLLKRIRYVDEEAVSIEESWVPAHLIHDVDAIGISLYDYFRSQHIYPQRTRSRVSARMPDAEFQSHIQLDSKIPVLVIKQVALDQQQRPIEYSISHCRSDLYVFVCEE

SEQ ID NO: 5137 - DNA, 966 bp, Escherichia coli
atgagcggcgctcgattacacacgctgctgcctgaattagccacgcgtcagccggtgatggtcgtcggcgcggcggtcattgatgtgatcgccgacgcttatgccctcccctggcgtgggtgcgatatcgaactgaaacagcagagcgttaacgttggcggctgcgccctgaatattgccgtggcattaaagcgcctcggcatcgaagcgggtaatgccttgccgctcggtcagggggtgtgggcggagattattcgcaaccgcatggcaaaagaggacttaatcagcctgatcgataacgccgaaggtgataacggctggtgtctggcgctggttgagccggatggcgaacgcacttttatgtcattcagcggtgtggaaaatcaatggaatcgccagtggctggcgcgattaaccgttgcgcctggcagcctgctctatttttccggttatcaactggcctcgccctgcggcgaattgttagtggaatggctggaaaagctacaagacgtgacgccgtttatcgattttggcccacgtattggcgatatcccggatgcattactggcgcggatcatggcctgtcgacctttagtgtcactcaatcgtcaagaggctgagattgccgccgaacgttttgctttatccgcagagataacaacacttggcaagcaatggcaggagaaatttgccgcgccgttgatcgttcgcctcgataaagaaggcgcatggtatttcagcaacgacgcttctggctgcattccggcatttccaacgcaagttgtagacaccattggggcgggcgacagtcatgccggtggcgtacttgccgggctggcctctggtctgccactggcggatgccgtattactgggcaatgcagtggcgtcgtgggttgtcgggcatcggggcggtgattgtgcgccaacgcgcgaggaactactcctcgcacacaaaaacgtatag

SEQ ID NO: 5138 - protein, 321 aa, Escherichia coli
MSGARLHTLLPELATRQPVMVVGAAVIDVIADAYALPWRGCDIELKQQSVNVGGCALNIAVALKRLGIEAGNALPLGQGVWAEIIRNRMAKEDLISLIDNAEGDNGWCLALVEPDGERTFMSFSGVENQWNRQWLARLTVAPGSLLYFSGYQLASPCGELLVEWLEKLQDVTPFIDFGPRIGDIPDALLARIMACRPLVSLNRQEAEIAAERFALSAEITTLGKQWQEKFAAPLIVRLDKEGAWYFSNDASGCIPAFPTQVVDTIGAGDSHAGGVLAGLASGLPLADAVLLGNAVASWVVGHRGGDCAPTREELLLAHKNV

SEQ ID NO: 5139 - DNA, 819 bp, Escherichia coli
atgcagttgagaatcaccagtcgaaaaaaattcaccgttttattatgcgctcttgggctaatttccatcgttgcaatttatccgcgtcagacggtgaattttttctattcgacagcaattcagattaaagactacatccacttctacggttatcgcccggttaaatctttcgctattcgcattcctgccagttacaccattcacggaatagatgtttcacgctggcaggagcggatcgactggcagcgtgtggcaaaaatgcgcgacaacggtatccgcttacagtttgcttttattaaggcgacggaaggcgaaaagctggtggacccctatttttcgcgtaactggcaactaagccgcgaaaatggcctgctgcgcggggcgtatcattatttttccccgtcggtatctgcttcagttcaggcgagattatttctgcaaacggtggatttctcacaaggcgatttccctgccgtgctggacgtagaagaacggggaaaattatcggcaaaagaattacgcaagcgggtaagtcagtggctaaaaatggtcgaaaaacgtacgggtaaaaagccaattatttactcaggagccgttttttatcacaccaatctggcgggctatttcaatgaatatccgtggtgggtggctcactattatcaacgtcgcccggacaatgacggcatggcctggcgcttctggcagcattccgaccgtggacaggtcgatggcattaatggtccggtggattttaatgtgtttaatggcacggtggaggagttgcaggcattcgttgatgggattaaagaaacgccttaa

SEQ ID NO: 5140 - protein, 272 aa, Escherichia coli
MQLRITSRKKFTVLLCALGLISIVAIYPRQTVNFFYSTAIQIKDYIHFYGYRPVKSFAIRIPASYTIHGIDVSRWQERIDWQRVAKMRDNGIRLQFAFIKATEGEKLVDPYFSRNWQLSRENGLLRGAYHYFSPSVSASVQARLFLQTVDFSQGDFPAVLDVEERGKLSAKELRKRVSQWLKMVEKRTGKKPIIYSGAVFYHTNLAGYFNEYPWWVAHYYQRRPDNDGMAWRFWQHSDRGQVDGINGPVDFNVFNGTVEELQAFVDGIKETP

SEQ ID NO: 5141 - DNA, 801 bp, Escherichia coli
atgaaacgaattaacgctctgacgattgccggtactgatccgagtggtggtgcggggattcaggccgatcttaaaaccttctcggcacttggcgcttatggttgctcagttattactgcactggtggcgcaaaatacccgtggtgtacagtcggtgtatcgcattgagcctgattttgtcgccgcccagctcgattcggtgttcagtgatgtgcgaatcgacaccactaaaatcggtatgttggcggaaaccgatattgttgaagcggtggcagaacggttgcaacgttatcagatccaaaacgtggtactcgacaccgttatgctggcaaaaagcggcgacccgctgctttcaccatcggcggttgctacgctgcgcagtcgattattgccacatgtttcattaataacgccaaacttgcccgaagcagccgccttgctcgacgcgccacacgcgcgcaccgaacaggaaatgctggaacaagggcgatcgctgttggcgatgggctgtggcgcagtgctaatgaaaggtggtcatctggatgatgagcaaagcccggactggctgtttactcgtgagggggaacaacgatttactgcaccgcgcattatgaccaaaaacacccacggcactggttgtacgctctctgcggcgttggctgcactacgcccgcgccatacaaactgggctgacaccgtacaggaggcaaaaagctggctttcatcggcattagcccaggccgacacgctggaagttggtcacggtattggtccggttcaccacttccacgcctggtggtga

SEQ ID NO: 5142 - protein, 266 aa, Escherichia coli
MKRINALTIAGTDPSGGAGIQADLKTFSALGAYGCSVITALVAQNTRGVQSVYRIEPDFVAAQLDSVFSDVRIDTTKIGMLAETDIVEAVAERLQRYQIQNVVLDTVMLAKSGDPLLSPSAVATLRSRLLPHVSLITPNLPEAAALLDAPHARTEQEMLEQGRSLLAMGCGAVLMKGGHLDDEQSPDWLFTREGEQRFTAPRIMTKNTHGTGCTLSAALAALRPRHTNWADTVQEAKSWLSSALAQADTLEVGHGIGPVHHFHAWW

SEQ ID NO: 5143 - DNA, 789 bp, Escherichia coli
atgcaagtcgacctgctgagttcagcgcaatctgcgcacgcgttacacctttttcaccaacattcccctcttgtgcactgcatgaccaacgatgtggtgcaaacttttactgccaataccttgctggcgctcggcgcatcgccagcgatggttatcgaaaccgaagaggccagtcagtttgcggctatcgccagtgccttgttgattaacgttggcacgctgacgcagccacgagcgcaagcgatgagtgctgccgttgagcaagcaacacgatcacaaacgccctggacgcttgatccggttgcggttggtgcgctcgattatcgccgccgtttttgtgtggaacttctgtcccataagccaaccgccatacgtggtaatgcttcggaaatcatggcattagctggcgttgctaatggtggacggggagtggataccactgatgccgcagctaacgcgatacccgctgcacaaacactggcacgggaaactggcgcaatcgtcgtggtcactggcgaggtggattatgttaccgatggacatcgtatcattggcattcacggtggcgatccgttaatgaccaaagtggtaggaactggctgtgcactatcggcggttgtcgctgcctgttgtgcgctaccaggcgatacgctggaaaatatcgcatctgcctgtcactggatgaaacaagccggagaacgcgcagttgccagaagcgaggggccaggcagttttgttccacatttccttgatgcgctctggcaattgacgcaggaggtgcaggcatga

SEQ ID NO: 5144 - protein, 262 aa, Escherichia coli
MQVDLLSSAQSAHALHLFHQHSPLVHCMTNDVVQTFTANTLLALGASPAMVIETEEASQFAAIASALLINVGTLTQPRAQAMSAAVEQATRSQTPWTLDPVAVGALDYRRRFCVELLSHKPTAIRGNASEIMALAGVANGGRGVDTTDAAANAIPAAQTLARETGAIVVVTGEVDYVTDGHRIIGIHGGDPLMTKVVGTGCALSAVVAACCALPGDTLENIASACHWMKQAGERAVARSEGPGSFVPHFLDALWQLTQEVQA

SEQ ID NO: 5145 - DNA, 273 bp, Escherichia coli
atgtctcatacaatccgtgataaacagaaactgaaagcgcgtgccagtaagattcagggccaggtcgtggcgctcaagaaaatgctcgacgaaccgcatgaatgcgctgcagttttacaacagattgctgctatccgtggcgcggtaaacggtctgatgcgggaagtgattaaaggtcatctgacggaacacatcgttcaccagggggatgagctaaaacgagaagaagatctggatgtcgttctgaaggtgctggattcttatatcaaataa

SEQ ID NO: 5146 - protein, 90 aa, Escherichia coli
MSHTIRDKQKLKARASKIQGQVVALKKMLDEPHECAAVLQQIAAIRGAVNGLMREVIKGHLTEHIVHQGDELKREEDLDVVLKVLDSYIK

SEQ ID NO: 5147 - DNA, 825 bp, Escherichia coli
atgaccgaatttacaacacttcttcagcaaggaaacgcctggttcttcatccccagcgccatcttacttggtgcgcttcatggcctggaaccggggcactcaaaaacgatgatggcggcgtttatcatcgccatcaaaggcaccattaaacaggcggtgatgctcggactggcagcaactatttcgcataccgcagtggtctggttaattgcctttggcgggatggtgatcagcaaacgctttactgctcaatcagcagaaccgtggctccagttgatttccgcagtgatcattattagcaccgcgttctggatgttctggcgtacctggcgcggcgaacgcaactggctggagaatatgcacgagcatgatcatgagcatcatcaccacgatcacgaagatcaccacgaccatggacatcatcaccatcacgaacatggcgagtatcaggatgcccatgcacgagcccatgccaatgacattaaacgacgctttgatggtagagaggtcaccaactggcaaattttgctatttggcttaaccggtggccttatcccctgcccggcagcaattaccgtgctgttgatttgcattcagttgaaagccctgacactgggcgcaacactggtcgtcagtttcagcctcggcctggcgttaacgcttgtcaccgtaggcgttggcgcagcaatcagcgttcagcaggtcgcaaaacgctggagcggatttaacactctcgctaaacgcgctccctatttttccagtctgttgattggcttagttggtgtgtatatgggcgtacatggcttcatgggcataatgcgataa

SEQ ID NO: 5148 - protein, 274 aa, Escherichia coli
MTEFTTLLQQGNAWFFIPSAILLGALHGLEPGHSKTMMAAFIIAIKGTIKQAVMLGLAATISHTAVVWLIAFGGMVISKRFTAQSAEPWLQLISAVIIISTAFWMFWRTWRGERNWLENMHEHDHEHHHHDHEDHHDHGHHHHHEHGEYQDAHARAHANDIKRRFDGREVTNWQILLFGLTGGLIPCPAAITVLLICIQLKALTLGATLVVSFSLGLALTLVTVGVGAAISVQQVAKRWSGFNTLAKRAPYFSSLLIGLVGVYMGVHGFMGIMR

SEQ ID NO: 5149 - DNA, 519 bp, Escherichia coli
atgattcttaaatcagctatttccgctgactctctgctcgctaaggatgcttttagggcatcctttcatttacactttttacgaaatcatgggatcactaacaaaatatcgcttgtcagttatattgtatggcaggaaagatatgcgactgatattacagatccccaaagtggagagtttatgaccattaaaaataagatgttgctgggtgcgcttttgctggttaccagtgccgcctgggccgcaccagccaccgcgggttcgaccaatacctcgggaatttctaagtatgagttaagcagtttcattgctgactttaagcatttcaaaccaggtgacaccgtcccagagatgtaccgcaccgatgagtacaacattaagcagtggcagttacgtaacctgcccgcgcctgatgccgggacgcactggacctatatgggtggcgcgtacgtgttgatcagcgacaccgacggtaaaatcattaaagcctacgacggtgagattttttatcatcgctaa

SEQ ID NO: 5150 - protein, 172 aa, Escherichia coli
MILKSAISADSLLAKDAFRASFHLHFLRNHGITNKISLVSYIVWQERYATDITDPQSGEFMTIKNKMLLGALLLVTSAAWAAPATAGSTNTSGISKYELSSFIADFKHFKPGDTVPEMYRTDEYNIKQWQLRNLPAPDAGTHWTYMGGAYVLISDTDGKIIKAYDGEIFYHR

SEQ ID NO: 5151 - DNA, 1035 bp, Escherichia coli
atggaaattcgcataatgctatttatagtaataatgatggttatgcctgtgagctatgcggcatgttatagtgagttatctgttcagcacaatttggttgttcagggggattttgcacttactcaaacacaaatggcgacatatgagcataattttaatgattcgtcatgcgtgagtacaaatactatcacacctatgagcccgtcggatattattgttggactttataacgataccattaaattaaatttacattttgaatggaccaataaaaacaacattacgttgtcaaataatcagaccagtttcaccagtggttattcggtgacggtgacacctgcggccagtaatgcaaaagtgaatgtttctgcggggggcggtggttcagtgatgattaatggagttgcgacattatccagtgcttcatcatcgacacgcgggagtgccgcagtacaatttctactgtgtttattaggtggtaagtcatgggatgcatgtgtaaatagctacagaaatgcattggcacaaaatgcaggtgtctattcctttaatctgacattgtcatacaacccgataaccacaacctgcaaaccggacgatttattaattacgttagagagtattcccgtttcacaattaccagccacaggtaacaaaacaacaataaatagtaaaaaaggggatattattctgcgttgtaaaaatttattaggtcaacaaaatcaaacatcacggaaaatgcaggtgtatttatcaagttctgacttgttaaccaacagcaacacgatcctgaaaggtgcggaagataatggcgtaggatttattcttgaaagtaatggtacgccagtcacacttttaaatatcactaacagcagtaaaggatatacaaatttaaaagaaattgcggcaaagtcaaaacttacagatacaacggtttcaattccgataacggccagttactacgtctacgatacaaacaaagttaaatctggcgcactggaggcaaccgcattaatcaacgtgaaatacgactaa

SEQ ID NO: 5152 - protein, 344 aa, Escherichia coli
MEIRIMLFIVIMMVMPVSYAACYSELSVQHNLVVQGDFALTQTQMATYEHNFNDSSCVSTNTITPMSPSDIIVGLYNDTIKLNLHFEWTNKNNITLSNNQTSFTSGYSVTVTPAASNAKVNVSAGGGGSVMINGVATLSSASSSTRGSAAVQFLLCLLGGKSWDACVNSYRNALAQNAGVYSFNLTLSYNPITTTCKPDDLLITLESIPVSQLPATGNKTTINSKKGDIILRCKNLLGQQNQTSRKMQVYLSSSDLLTNSNTILKGAEDNGVGFILESNGTPVTLLNITNSSKGYTNLKEIAAKSKLTDTTVSIPITASYYVYDTNKVKSGALEATALINVKYD

SEQ ID NO: 5153 - DNA, 2481 bp, Escherichia coli
atgttgagaatgcccccacttgcatcagcaatcgtagcgttattgatcggcattgaagcttatgcagctgaagaaacctttgatacccatttcatgataggtggaatgaaagaccagcaggtttcaaatattcgtcttgaagataatcagcccttgccggggcagtatgacatcgatatttatgtcaataagcaatggcgtgggaaatatgagatcattgttaaagacaacccgcaagaaacatgtttatcaagggaaatgatcaagcggttaggcattaataccgatagctttgccagcggtaagcaatgtttaacatttaagcaacttattcagggcgggagctatacctgggatatcggagtttttcgtctcgatttcagtgtcccgcaggcctgggtggaagaactggaaagtggctatgtaccacctgaaaactgggagcggggtattaatgcgttttatacctcttattatatgagtcagtattacagcgattataaagcgtccggtaatagcaagagtacatatgtacgttttaacagcgggttaaatttattggggtggcaactgcattctgatgccagtttcagtaaaacaaataacaatccaggggtgtggaaaagcaataccctgtatctggaacgtggatttgcccaacttctcggcacgcttcgtgtgggtgatatgtacacatcaagcgatatttttgattctgttcgcttcagcggtgtgcggttgtttcgtgatatgcagatgttgcctaactcgaaacaaaattttacgccacgggtgcaggggattgctcagagtaacgcgctggtaactattgaacagaatggttttgtggtttatcagaaagaggttcctcctggcccgtttgcgattacagatttgcagttggccggtggtggagcggatcttgatgtcagcgtgaaagaggcggacggttcggtaaccacctatctggtgccttatgcagcggtaccaaatatgctgcaacccggcgtgtcgaaatatgattttgcggcgggtcgtagccatattgaaggggcgagcaaacaaagtgattttgtccaggtgggtcatcagtatggttttaataacttattaacgctgtatggtggctcgatggtcgcgaataattattacgcgttcactttggggactggctggaatacacgcattggtgccatttccgtcgatgccacgaagtcgcatagtaaacaagacaacggcgatgtgtttgacgggcaaagttatcaaattgcctacaacaaatttgtgagccaaacgtcgacacgttttggtctggcggcctggcgttattcgtcgcgtgattatcggacatttaatgatcacgtatgggcaaacaataaagataattatcgccgtgatgaaaacgatatctatgacattgccgattattaccagaacgattttggccgtaaaaatagcttctctgccaatatgagtcagtcattgccagaaggctggggttctgtgtccttaagtacgttatggcgagattactgggggcgtagcggcagcagtaaggattatcagttgagttattccaacaacctgcgaaggataagctataccctcgcggcaagccatgcttatgacgagaatcatcatgaagagaaacgttttaatatttttatatcgattccctttgattggggtgatgacgttacgacgcctcgtcggcaaatatatatgtctaactcaacgacgtttgatgatcagggggttgcctcaaataatacgggattatcaggaaccgttggaagccgggatcagtttaactatggggtcaacctgagttatcagtatcagggaaatgaaacgacagctggggcgaatttaacctggaacgcgccggttgcgacagtgaatggcagttatagtcagtcgagtgcttatcgacaggctggagccagtgtttcagggggcattgtcgcttggtcgggtggcgttaatctggcaaaccgtctttctgaaacgtttgctgtgatgaatgcgccaggaattaaagatgcttatgtcaatgggcaaaaatatcgcacaacaaaccgtaatggagtggtggtatacgacggaatgacaccttatcgggaaaattacctgatgttggatgtgtcacaaagcgatagcgaagcagaattacgtggcaaccggaaaattgccgccccttatcgcggcgcggttgtactggttaattttgataccgatcagcgcaagccatggtttataaaagcgttaagagcggatgggcaaccattaacgtttggttatgaagtcaatgatatccatggtcataatattggtgttgtcggccagggaagccagttatttattcgcaccaatgaagtaccgccatcggttaatgtggcaattgataagcaacaagggctttcatgcacaatcaccttcggtaaagagattgatgaaagtagaaattatatttgccagtaa

SEQ ID NO: 5154 - protein, 826 aa, Escherichia coli
MLRMPPLASAIVALLIGIEAYAAEETFDTHFMIGGMKDQQVSNIRLEDNQPLPGQYDIDIYVNKQWRGKYEIIVKDNPQETCLSREMIKRLGINTDSFASGKQCLTFKQLIQGGSYTWDIGVFRLDFSVPQAWVEELESGYVPPENWERGINAFYTSYYMSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQVGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 5155 - DNA, 675 bp, Escherichia coli
atgaaaggattattagctttactcatttcttctatggtccttcctgcacatgccggtattgttatctacgggacgcgtattatttacccggcagagcacaaagaagtgatggtgcagttgatgaaccagggaaaccgttcttcgctgatgcaggcgtggattgatgatggcgatacgtcattaccaccagaaaaaattcaggttcctttcatgttaacgccaccagtggcaaaaataggggcaaattccgggcagcaagtaaaaattaaaattatgccgaataaactccccactaataaagagagtattttttatctgaatgttctggatattccaccaaatagtccagaacaagaaggtaagaatgcactgaagtttgcgatgcaaaacagaattaagttgttttaccggccagcgggtattgctccggtaaataaagtgacctttaaaaagttactggtaaatcgcagtggcaatggattggtgataaaaaatgactcagctaattgggtgacgatttcggatgtcaaagctaataatgtcaaagtcaattatgaaactattatgattgcccccttagaaagtcagagtgttaatgtcaaaagtaataatgcaaataactggcatctgaccattatcgatgaccatggcaattatattagtgacaaaatttaa

SEQ ID NO: 5156 - protein, 224 aa, Escherichia coli
MKGLLALLISSMVLPAHAGIVIYGTRIIYPAEHKEVMVQLMNQGNRSSLMQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKVTFKKLLVNRSGNGLVIKNDSANWVTISDVKANNVKVNYETIMIAPLESQSVNVKSNNANNWHLTIIDDHGNYISDKI

SEQ ID NO: 5157 - DNA, 543 bp, Escherichia coli
atgaaacgttcaattattgctgccgctgttttttcttctttttttatgagcgctggggtatttgccgcagacgttgataccggaacattaaccattaaagggaatattgcagaatctccgtgtaaattcgaagcaggtggcgattcattaagtattaatatgccaactgtaccaactacggtctttgaaggtaaagctaaatactcgacctatgatggtgcagtcggtgtaaccagcagcatgttaaaaattagctgtccgaaagaagttgctggtgtaaaactctcgttgattaccaacgataaaataaccggaaacgataaggcgatagccagtagcaacgataccgtgggttattatctctatttaggtgataacagcgatgtcctggatgtttctgcacctttcaacatcgagagttataaaacagcggacggtcaatatgccattccgtttaaagcaaaatacctgaaactgacagataactcagtgaattcaggtgatgtgttatcttccctgattatgcgtgtggcgcaggattaa

SEQ ID NO: 5158 - protein, 180 aa, Escherichia coli
MKRSIIAAAVFSSFFMSAGVFAADVDTGTLTIKGNIAESPCKFEAGGDSLSINMPTVPTTVFEGKAKYSTYDGAVGVTSSMLKISCPKEVAGVKLSLITNDKITGNDKAIASSNDTVGYYLYLGDNSDVLDVSAPFNIESYKTADGQYAIPFKAKYLKLTDNSVNSGDVLSSLIMRVAQD

SEQ ID NO: 5159 - DNA, 1110 bp, Escherichia coli
atgaacgaacaatcccaggccaaatcaccagaagccttgcgcgcaatggtcgccgggacactggccaattttcagcacccaaccctgaagcataacctcacaacgctgaaagcgttgcaccatgtcgcctggatggacgacacgctgcatgtggaactggttatgccattcgtctggcatagcgcgttcgaagagttaaaagagcaatgtagcgccgaactgctgcgcatcaccggagcgaaagctatcgactggaaactgtcgcataacatagccactctgaaacgcgtgaagaatcagccgggaattaacggcgtgaagaacattatcgcggtcagttccggtaaaggtggcgtgggtaaatcctccacggcggtaaacctggcgttggcactggcggcggaaggggcgaaagtcggcattctggacgccgatatctacggcccatcaatccctaccatgctgggcgcagaaaatcagcgtccaacttcgccggacggtacccatatggcaccgattatgtctcatggcctggcaactaattcaattggttatctggtgacagacgacaatgcgatggtgtggcgtggcccaatggcgagcaaggcgttaatgcaaatgttgcaggaaaccttgtggccggatctcgactatctggtgcttgatatgccgccaggtaccggtgacattcaattgacattggcacaaaacattccagtaaccggtgcagtcgtggtcaccaccccgcaggacatcgcgttgatcgatgcgaaaaaaggcattgtgatgttcgagaaagtcgaggttccggtgctcggtattgtcgagaacatgagtgtgcatatttgcagtaactgtggtcaccatgaaccgattttcggtaccggtggtgcagagaaactggccgagaaataccacacgcagctgctggggcagatgccgttacacatctccttacgtgaggatctcgataaaggcacgccaacggttatcagccgtcctgagagcgaatttaccgctatctaccgccagctggctgaccgcgttgcagctcagctctactggcagggtgaagtcattccaggcgagatttccttccgcgcggtctaa

SEQ ID NO: 5160 - protein, 369 aa, Escherichia coli
MNEQSQAKSPEALRAMVAGTLANFQHPTLKHNLTTLKALHHVAWMDDTLHVELVMPFVWHSAFEELKEQCSAELLRITGAKAIDWKLSHNIATLKRVKNQPGINGVKNIIAVSSGKGGVGKSSTAVNLALALAAEGAKVGILDADIYGPSIPTMLGAENQRPTSPDGTHMAPIMSHGLATNSIGYLVTDDNAMVWRGPMASKALMQMLQETLWPDLDYLVLDMPPGTGDIQLTLAQNIPVTGAVVVTTPQDIALIDAKKGIVMFEKVEVPVLGIVENMSVHICSNCGHHEPIFGTGGAEKLAEKYHTQLLGQMPLHISLREDLDKGTPTVISRPESEFTAIYRQLADRVAAQLYWQGEVIPGEISFRAV

SEQ ID NO: 5161 - DNA, 2022 bp, Escherichia coli
atgcctactatgactcaagtcgcgaagaaaattctggtgacgtgcgcactgccgtacgctaacggctcaatccacctcggccatatgctggagcacatccaggctgatgtctgggtccgttaccagcgaatgcgcggccacgaggtcaacttcatctgcgccgacgatgcccacggcacgccgatcatgcttaaagctcagcagcttggtatcaccccggagcagatgattggcgaaatgagtcaggaacatcagactgatttcgcaggctttaacatcagctatgacaactatcactcgacgcacagcgaagagaatcgccagttgtcagaacttatctactctcgtctgaaagaaaacggttttattaaaaaccgcaccatctctcagctgtacgatccggaaaaaggcatgttcctgccggaccgttttgtaaaaggcacctgcccgaaatgtaaatccccggatcaatacggcgataactgcgaagtctgcggcgcgacctacagcccgactgaactgatcgagccgaaatcggtggtttctggtgctaccccggtaatgcgtgattctgaacacttcttctttgatctgccctctttcagcgaaatgctgcaggcatggacccgcagcggtgcgttgcaggagcaggtggcaaataaaatgcaggagtggtttgaatctggcctgcaacagtgggatatctcccgcgacgcgccttatttcggttttgaaattccgaacgcgccgggcaaatatttctatgtctggctggacgcaccgattggctatatgggctctttcaagaatctgtgtgacaagcgcggcgacagcgtaagcttcgataaatactggaagaaagattccactgccgagctgtatcacttcatcggtaaagatatcgtttacttccacagcctgttctggcctgccatgctggaaggcagcaacttccgcaagccgaccaacctgtttgttcacggctatgtgacggtgaacggcgcgaaaatgtccaagtctcgcggcacctttattaaagccagcacctggctgaatcattttgacgccgacagcctgcgctactactacaccgccaaactgtcttcgcgcattgatgatatcgatctcaacctggaagatttcgttcagcgcgtgaatgccgatatcgtgaacaaagtggttaacctggcgtcccgtaacgctggctttatcaataagcgttttgacggtgtgctggcaagcgagctggctgacccgcagttgtacaaaaccttcactgatgccgctgaagtgattggtgaagcgtgggaaagccgcgaatttggtaaagctatccgtgaaatcatggcgctggctgacctggctaaccgctatgtcgatgaacaggctccgtgggtggtggcgaagcaggaaggtcgcgatgccgatctgcaggcgatttgctcaatgggcatcaacctgttccgcgtgctgatgacttacctgaaaccggtactgccgaaactgaccgagcgcgcagaagcattcctcaatacagaactgacctgggatggtatccagcaaccgctgttgggccataaagtgaatccattcaaggcgctgtataaccgcatcgatatgaaacaggttgaagcactggtggaagcatccaaagaggaagtaaaagccacagccgcaccggtaactggcccactggctgacgacccgattcaggaaaccatcacctttgacgacttcgccaaagttgacctgcgcgtggcgctgattgaaaacgcagagtttgttgaaggttctgacaaactgctgcgcctgacgctggatctcggcggtgaaaaacgcaatgtcttctccggcattcgttctgcttacccggatccgcaagcactaattggtcgtcacaccattatggtggctaacctggcaccacgtaaaatgcgcttcggtatctccgaaggcatggtaatggctgctggtcctggtgggaaagatatcttccctgctaagcccggatgccggtgctaa

SEQ ID NO: 5162 - protein, 673 aa, Escherichia coli
MPTMTQVAKKILVTCALPYANGSIHLGHMLEHIQADVWVRYQRMRGHEVNFICADDAHGTPIMLKAQQLGITPEQMIGEMSQEHQTDFAGFNISYDNYHSTHSEENRQLSELIYSRLKENGFIKNRTISQLYDPEKGMFLPDRFVKGTCPKCKSPDQYGDNCEVCGATYSPTELIEPKSVVSGATPVMRDSEHFFFDLPSFSEMLQAWTRSGALQEQVANKMQEWFESGLQQWDISRDAPYFGFEIPNAPGKYFYVWLDAPIGYMGSFKNLCDKRGDSVSFDKYWKKDSTAELYHFIGKDIVYFHSLFWPAMLEGSNFRKPTNLFVHGYVTVNGAKMSKSRGTFIKASTWLNHFDADSLRYYYTAKLSSRIDDIDLNLEDFVQRVNADIVNKVVNLASRNAGFINKRFDGVLASELADPQLYKTFTDAAEVIGEAWESREFGKAIREIMALADLANRYVDEQAPWVVAKQEGRDADLQAICSMGINLFRVLMTYLKPVLPKLTERAEAFLNTELTWDGIQQPLLGHKVNPFKALYNRIDMKQVEALVEASKEEVKATAAPVTGPLADDPIQETITFDDFAKVDLRVALIENAEFVEGSDKLLRLTLDLGGEKRNVFSGIRSAYPDPQALIGRHTIMVANLAPRKMRFGISEGMVMAAGPGGKDIFPAKPGCRC

SEQ ID NO: 5163 - DNA, 3789 bp, Escherichia coli
atgagacactttatctatcaggacgaaaaatcacataaattctgggcggtggagcaacagggaaacgagttgcatatcagttggggaaaagttggtacccaagagcaaagccaggtaaaaagttttgctgatgctgtggcagcggaaaaagcggagctgaagctgattgcggagaaggtgaagaagggatatgtggagcaagcgaaggataattctttgcaaccttcccaaacggtaacggactctctcaaggtagcggacttatccaccattattcaggaacaaccctctttcgtagcagaaacccgtgcggctgacaaaaatacagatgctgttttaccgtggctggcgaaagatattgctgtcgtttttccgcccgaagttgtacacaccacgttaagtcatcgccgctttcccggagttcctgttcagcaagcagacaaattgacccaattacgtcgcttagcctgtagtgtgtcgcaacgggataatacaacagccacatttgacttcagcgcctgttctttagaatggcaaaacaccgtcgcccaggcgatcagtcagatcgacgacctgaaaacaacacagctaccatcacccgtaatggctgtactcacggcacttgaaatgaaatgcacaagatataaagagcgtgaggatgttatggatcagattattcaggaaggcggtctggaatatgctactgatgtaataatacatcttcaacaaatatctattgaatgggattatgtcaacaataatattgttttcctgtcgtctggcatttcacctgattatttgcagcaatattccagctttgaattacgcctacgtaaacatttatcactggcggaagagtctctctggcaaaaatgtgcacaaaaacttattgccgcagttccacatattccagaatggcggcaaccattaattgctttgttattgcccgaaaaaccagaaattgcacatgaaattgcccagcgtctactggggcaaaagaaattaccctcgctggagtggctaaaaatagtggcgactgatgagcacattcttgcctcattagaaaaatatcacgagccatatgccatttttgatgattactattgtggtgcgatatggtcagccaccgtattacaggagcaaggtgttgcggccctgccccgatttgctccctatgtcgcaagtgactactgcgccgatgtgttgcgtcatatcaatcatccgttcgcattaacactgcttatacgtgtagcagggcatactaaacgctgtcacgatcgaatgacgaaagcctgcgctgcgttcccacacgcagcactggcagcactggcggaacttctagtgcaaaaagaagagaatagttggcgcattatgctaatgacgatgcttatctcgcaaccgacactagcagaacaggtcattccctggctttcgacacccgcagttgcagtgctgaaatcatgccagcaacaactgacacagccctcaaaccatgccagcgccgatctactgccggccatagtagtctccccaccatggctttcgaaaaagaaaaaatcgccgattccggtgctggatttagcaccgctcaacctcgaatccatatgcacaataaccgacacagaagctaaagagtttcaaactcattgggactgggaaccgcataagccaggtgaaggtgctaaaaatttcctttactcgctggggtatcgccgctgggattttgacacatataaatatatcggcgcttctgactcggcaattgacgcatgggaacgtgaggacttcgctacactcatccaaatgtttaaagcccaccatgcaccgtatcagggggagtggcatctcaactcacttccctttttacctatgcaaaaagcgattaagctatgggaatttctcagcaaagagccgcataccgcgataaaaccagtcatgctttatttgcgactggcaggtatgagtggttttctacactcgttttcacgctaccctcaagaaggttttgcggttgctaattattttgccgcaacggaactggctcctgccgtcgcccgcgccttcaacaaactcaaaacattacgacaagacgccagtagctggctgctgaaatacccggaacacgccattaccggcctgctgcctgcagcgctcggcaaagccagtgaagcacaggacaacgcccgtgctgccttgcgtatgcttaccgaaaacggtcatcagccattgctgcaagaaatcgcccggcgttataaccagccggaagtaaccgatgcggtgaacgctctacttgcgctcgatcccttagataatcacccgacaaaaatccccactcttccgaccttttatcagccatcgctctggacgcgcccgttattaaaagcaaacgcccaatcactgcctgatagcgcactcctccacctcggtgaaatgctccgcttccctcaggaagaggcactgtatccgggattattgcaggtgaaagatgcctgtaccaccgactcactggctgaatttgcctgggatctgtttaccgcctggcagaccgctggcgcgccgtcgaaagagagttgggcgttcactgcgttaggcgttctcggtaacgatgacaccgcccgcaaactgacgcctttgattcgcgcctggcctggtgaatcccagcataaacgcgccaccgtcgggttggatattctcgctgctatcggtagtgatatcgccctgatgcagcttaacggcatcgcccagaaactgaaattcaaagcattacaggagcgggcaaaagaaaaaattgccgacattgccgagagccgcgaactcacggtggcggagcttgaagatcggttagcaccggatctcggtctggatgataatggttcgttgttgctggatttcggcccacgccagttcaccgtcagctttgatgaaaccttaaaaccgtttgtgcgtgacgcttccggcagtcgtctgaaagacctgcccaaaccaaacaaaagcgatgatgaatcacaggcgaacgatgctgttaaccgctacaaattgctgaaaaaagatgcgcgtaccgtcgccgcccagcaggtagcaaggctggaatccgccatgtgcctgcgtcgccgctggtcaccggaaaactttcagctcttcctggttgagcatccgctggtccgccacttaacccaccgtctgatttggggcgtttatagcgccgaaaaccagctactggcttgctttcgcgtagcggaagataacagctacagcaccgctgacgatgatcttttcaccctgccggaaggcgatatctctattggtattcctcacgttctggaaatatcaccgacggatgctgccgccttcgggcagctttttgccgactacgaactgttaccaccgttccgccagcttgatcgtaacagttacgcgctgacagaagccgagcgcaacgccagcgaactgacacgctggacaggcagaaaatgcccgagtggtcgggtaatggggctggcgaataaaggctggataaagggcaccccgcaggatgctggctggatcggctggatgatcaaccccctgggccgctggtcgttaatcatggaaatcgatgaaggttttgcggtaggcatgtcgccagccgaactgagtgccgagcaactcttaagcaagctgtggctatgggaaggcaaagcggaaagctatggctgggggagtaattcaacacaggaagcgcagttctccgtactcgatgccatcaccgccagcgagctaattaacgatattgaagccctgtttgaataa

SEQ ID NO: 5164 - protein, 1262 aa, Escherichia coli
MRHFIYQDEKSHKFWAVEQQGNELHISWGKVGTQEQSQVKSFADAVAAEKAELKLIAEKVKKGYVEQAKDNSLQPSQTVTDSLKVADLSTIIQEQPSFVAETRAADKNTDAVLPWLAKDIAVVFPPEVVHTTLSHRRFPGVPVQQADKLTQLRRLACSVSQRDNTTATFDFSACSLEWQNTVAQAISQIDDLKTTQLPSPVMAVLTALEMKCTRYKEREDVMDQIIQEGGLEYATDVIIHLQQISIEWDYVNNNIVFLSSGISPDYLQQYSSFELRLRKHLSLAEESLWQKCAQKLIAAVPHIPEWRQPLIALLLPEKPEIAHEIAQRLLGQKKLPSLEWLKIVATDEHILASLEKYHEPYAIFDDYYCGAIWSATVLQEQGVAALPRFAPYVASDYCADVLRHINHPFALTLLIRVAGHTKRCHDRMTKACAAFPHAALAALAELLVQKEENSWRIMLMTMLISQPTLAEQVIPWLSTPAVAVLKSCQQQLTQPSNHASADLLPAIVVSPPWLSKKKKSPIPVLDLAPLNLESICTITDTEAKEFQTHWDWEPHKPGEGAKNFLYSLGYRRWDFDTYKYIGASDSAIDAWEREDFATLIQMFKAHHAPYQGEWHLNSLPFLPMQKAIKLWEFLSKEPHTAIKPVMLYLRLAGMSGFLHSFSRYPQEGFAVANYFAATELAPAVARAFNKLKTLRQDASSWLLKYPEHAITGLLPAALGKASEAQDNARAALRMLTENGHQPLLQEIARRYNQPEVTDAVNALLALDPLDNHPTKIPTLPTFYQPSLWTRPLLKANAQSLPDSALLHLGEMLRFPQEEALYPGLLQVKDACTTDSLAEFAWDLFTAWQTAGAPSKESWAFTALGVLGNDDTARKLTPLIRAWPGESQHKRATVGLDILAAIGSDIALMQLNGIAQKLKFKALQERAKEKIADIAESRELTVAELEDRLAPDLGLDDNGSLLLDFGPRQFTVSFDETLKPFVRDASGSRLKDLPKPNKSDDESQANDAVNRYKLLKKDARTVAAQQVARLESAMCLRRRWSPENFQLFLVEHPLVRHLTHRLIWGVYSAENQLLACFRVAEDNSYSTADDDLFTLPEGDISIGIPHVLEISPTDAAAFGQLFADYELLPPFRQLDRNSYALTEAERNASELTRWTGRKCPSGRVMGLANKGWIKGTPQDAGWIGWMINPLGRWSLIMEIDEGFAVGMSPAELSAEQLLSKLWLWEGKAESYGWGSNSTQEAQFSVLDAITASELINDIEALFE

SEQ ID NO: 5165 - DNA, 243 bp, Escherichia coli
atggacaaggaattaccgtggctggcggataacgcccaactggaacttaaatataaaaaaggcaaaacaccactcagccatcgcaattggccaggcgaaccggtgcctgttatcactgaaagcatcattcagacactgagtgatgaattgctacaaaaagcagagaagaaaaaaacattgtctggcgttatgaaaacttttcactggagtggcagtccgccatcacgcaggccatcaacttga

SEQ ID NO: 5166 - protein, 80 aa, Escherichia coli
MDKELPWLADNAQLELKYKKGKTPLSHRNWPGEPVPVITESIIQTLSDELLQKAEKKKTLSGVMKTFHWSGSPPSRRPST

SEQ ID NO: 5167 - DNA, 3393 bp, Escherichia coli
ttgatcggcgaacacaaaccctcaatcacggcccggacaatggcggcgctagcctgtatcgcgcaaaatgatagccaacagttgctcgacgaaatcgtccaacaagaggggctggaatatgcaactgaggtggtgattgcacgccagtttattgtacggtgttatgagagtgatcctctggtagtaacattgcagtatcagaacgaggactatggctatggttatcgctcagaaacctataacgaattcgatctccgattacgtaagcatctctctctggcagaggaaacctgctggcagcgttgcgccgacaaactcattgccgcactgccaggaataaccaaagttcgccgcccttttattgctctgaacctcccggaaaaacccgaaatcgccaacgagctggtaagccttgaatgttcgcaaactcattttcgctcaaaagagtggttaaaagttgttgctgatgaccctaaggcggtgaaagaactcgcacgttactggagccaggatatatttagcgatcgagaagccagctacatgtcgcatgaaaaccacttcggctacgcggcctgcgctgcccttttgcgcgaacaaggactggcagccgttccgcgcctcgcgatgtatgcacataaagaagattgcggcagtctgctggtacaaattaaccatccgcaagtcatccgcaccttgctactggtggctgataaaaacaaacccagcctgcaacgtgtggctaaatacagtaaaaacttcccccatgcgacgctcgccgcactggcagaactgctggcgttaaaagccccccctgcgcgccctggttatcccatcatcgaagacaaaaagctgcctgcacagcaaaaagcacgtgatgaatactggcatacgctgttacaaacgctgatggcatcgcagccacaactggcagaagaggtgatgccgtgcttaagtacacaagcccaggcagtggtgaatggttatttatcggcatcgccaaaacttgctttcgagagtactcatagcaacgacctgccagaaatacttgtttctccaccgtggcgaggtaagaaaaaaacggcattgctgcgccttgatttagtgcctcttgaattagcgcccaaagcccgctggcaaccaggcgaacgagagagacttgccgccacagagtctgcccgttatttcagcacgggatcttttacggaacgcatggaacgaaaaagtggtcgagttgtactacaggagctaggttttggggatgatgtatggctgttccggaattatatactgcccggcaaactggatgcggcgcgcaaatcattagtgggtcagtggcattactccccgcgcagagtagaggaaatcaacaatggctggcactccacggaagcaaaatcagccgaacaggcgcttcgttccggcgacgttgaagcgttaattaacacctgggaaaatgatagctactcacgttatcgtccggaaaagagtgtctggaacctgtatttattggcacagttgccgcgtgagatggctttgactttctggctgcgtatcaatgagaaaaagcatctgttcgcgggtgaggactattttctcagtatcctcgggttggatacattacctggcctgttattggctttttcacatcatccaaaagaaacatttccgttaattttaaatttcggcgcaacagaactggccctgcccgttgcccgcgtctggcgacgtttcgcggcgcagcgtgatctggctcgccagtggattttacaatggccggaacatacggctactgcacttatccctcttgtctttacaaaaccctgcgataatagcgaagctgcattacttgccctgcgtttactgtatgaacaagggcatggcgaattactgcaaaccgtggcaaaccgctggcagcgtacagatgtatggcctgccctggagcaattacttaaactgggtccaatagaaatttacccggcacgtattccaaaagctcctgatttctggcatccggcaatgtggtccaggccgcgccttatcaagaataatcagcctgttaccgatgacgctctggaaattatcggcgaaatgctgcgctttacccagggcggacgtttttatggcggactggaacagctgaaaacgttttgccagccgcaaacgctggcagcttttgcctgggatcttttcaccgcgtggcaacaagctggtgctcccgcaaaagacaactgggcatttctggcgttaagtctctttggcgacgaaagcacggcacgggatctgacgacacagatcctcgcctggccacaagagggcaaatctgcccgtgctgtcagtggtctgaatatacttactaagatgaataatgatatggcactgatacagctgcatcatatatcgcaacgggcgaaatcccgccccttacgtgataacgcggcggaatttcttcaggtggtcgcagaaaatcgcgggctaagccaggaagagttagcggacagattagtcccaacactgggtcttgatgatccgcaggcgttgatttttgattttggtccacggcaatttaccgttcgcttcgatgaaaacctcaacccggttatctttgatcagcaaaacgttcgccagaaaagcgttccccggttgcgcgccgatgacgatcaactgaaaacccccgaggcactggcccgactcaaagggctaaaaaaagatgcgactcaggtgagcaaaaacctgctcccgcgtcttgaaactgccctgcgcaccacccgacgctggtcgctggcagattttcattctctgtttgttaatcatccctttacccgtctggttactcagcgattaatatggggggtttatccggcaaatgaaccgcgtcgtttacttaacgcctttcgtgtggccgctgagggggagttctgcaatgagcaagatgagccaattgacctgcctgccgatgctctgattggcattgcccacccgttagaaatgacagcagaaatgcgcagtgaatttgcacagctttttgccgattacgaaattatgccgccttttcgccagttgacgcggcgcacagtgctgctcacgcctgacgagtcagccagtaatagtttgaatcgctgggaaggtaaatctgctaccgttgggcagcttatgggaatgcgatacaaaggctgggagtcaggctatgaggacgcatttgtctatgacttaggtgcgtaccggctggtccttaagttttcacccggttttaaccattacagtactgatagcaaagcgctaatgagcttccgttctcttcgggtttaccgtgacaataaatccgtcacttttgccgaacttgatgtgtttgatttgagtgaggcattaagcgcacctgacgtcattttccattaa

SEQ ID NO: 5168 - protein, 1130 aa, Escherichia coli
MIGEHKPSITARTMAALACIAQNDSQQLLDEIVQQEGLEYATEVVIARQFIVRCYESDPLVVTLQYQNEDYGYGYRSETYNEFDLRLRKHLSLAEETCWQRCADKLIAALPGITKVRRPFIALNLPEKPEIANELVSLECSQTHFRSKEWLKVVADDPKAVKELARYWSQDIFSDREASYMSHENHFGYAACAALLREQGLAAVPRLAMYAHKEDCGSLLVQINHPQVIRTLLLVADKNKPSLQRVAKYSKNFPHATLAALAELLALKAPPARPGYPIIEDKKLPAQQKARDEYWHTLLQTLMASQPQLAEEVMPCLSTQAQAVVNGYLSASPKLAFESTHSNDLPEILVSPPWRGKKKTALLRLDLVPLELAPKARWQPGERERLAATESARYFSTGSFTERMERKSGRVVLQELGFGDDVWLFRNYILPGKLDAARKSLVGQWHYSPRRVEEINNGWHSTEAKSAEQALRSGDVEALINTWENDSYSRYRPEKSVWNLYLLAQLPREMALTFWLRINEKKHLFAGEDYFLSILGLDTLPGLLLAFSHHPKETFPLILNFGATELALPVARVWRRFAAQRDLARQWILQWPEHTATALIPLVFTKPCDNSEAALLALRLLYEQGHGELLQTVANRWQRTDVWPALEQLLKLGPIEIYPARIPKAPDFWHPAMWSRPRLIKNNQPVTDDALEIIGEMLRFTQGGRFYGGLEQLKTFCQPQTLAAFAWDLFTAWQQAGAPAKDNWAFLALSLFGDESTARDLTTQILAWPQEGKSARAVSGLNILTKMNNDMALIQLHHISQRAKSRPLRDNAAEFLQVVAENRGLSQEELADRLVPTLGLDDPQALIFDFGPRQFTVRFDENLNPVIFDQQNVRQKSVPRLRADDDQLKTPEALARLKGLKKDATQVSKNLLPRLETALRTTRRWSLADFHSLFVNHPFTRLVTQRLIWGVYPANEPRRLLNAFRVAAEGEFCNEQDEPIDLPADALIGIAHPLEMTAEMRSEFAQLFADYEIMPPFRQLTRRTVLLTPDESASNSLNRWEGKSATVGQLMGMRYKGWESGYEDAFVYDLGAYRLVLKFSPGFNHYSTDSKALMSFRSLRVYRDNKSVTFAELDVFDLSEALSAPDVIFH

SEQ ID NO: 5169 - DNA, 1155 bp, Escherichia coli
atgcgccaaacatttattgcgcgtaaaatatcgtttatttcattaatacatttcagggatgaatatatgtcaccgcagaataatcacctgcagcgtccgcctgctgctgtgttatacgccgttgaactggcaaaattaaaacaaaatgataacgcaccttgcccgccaggttggcagttaagtttgcctgcggcccgtgcttttatccttggcgacgaagcgcaaaatattagccgtaaagtggtgattagtccctccgctgtcgaacgtatgttagtcactcttgccaccgggcgcggtttgatgttggtgggggaacctggcaccgcaaaatctctcctgtctgaattactggcaaccgctattagcggcgatgccgggttaaccatccagggcggcgcatctactactgaagatcaaatcaagtacggctggaactacgccctgcttatcaaccatggtccgtcaacggaagcactggtccctgccccgctttaccagggaatgcgcgacggcaaaatcgtccgttttgaagagataacgcgtacaccgctggaagtacaagactgtctgttaggtatgctttctgacagggtgatgacggtgccggaactcaccggtgaagccagtcagctctatgcgcgggaaggctttaatattattgccactgccaatacccgcgatcgcggcgtcaatgaaatgagtgccgcgctaaagcgtcgcttcgattttgaaactgtctttccgattatggatttcgcccaggagctggagcttgtcgccagtgcttcggcgcgtttgctggcccatagcggcattccgcataaagtgcctgacgcggtactggagttactggtccgcacctttcgcgatctgcgtgccaacggcgaaaagaaaacgtcaatggatacactgacagcgattatgtccaccgctgaagccgtgaacgtggcccacgcggtgggcgtccgcgcctggtttttagcgaatcgcgcaggtgagccggccgatctggtggactgtattgccggaaccatcgtcaaagataacgaagaagatcgcgcgcgcctgcgccgttacttcgaacaacgtgttgctacacataaagaagctcactggcaggcttattatcaagctcgccaccgcctgccgtga

SEQ ID NO: 5170 - protein, 384 aa, Escherichia coli
MRQTFIARKISFISLIHFRDEYMSPQNNHLQRPPAAVLYAVELAKLKQNDNAPCPPGWQLSLPAARAFILGDEAQNISRKVVISPSAVERMLVTLATGRGLMLVGEPGTAKSLLSELLATAISGDAGLTIQGGASTTEDQIKYGWNYALLINHGPSTEALVPAPLYQGMRDGKIVRFEEITRTPLEVQDCLLGMLSDRVMTVPELTGEASQLYAREGFNIIATANTRDRGVNEMSAALKRRFDFETVFPIMDFAQELELVASASARLLAHSGIPHKVPDAVLELLVRTFRDLRANGEKKTSMDTLTAIMSTAEAVNVAHAVGVRAWFLANRAGEPADLVDCIAGTIVKDNEEDRARLRRYFEQRVATHKEAHWQAYYQARHRLP

SEQ ID NO: 5171 - DNA, 2277 bp, Escherichia coli
atgtatgagcgagccgttaattgtcggcatcatagtccggcctgcgcccggctggcgaaatcgttaatcgaaagccagcggccacgatacgtattgattgaaggcccggctgattttaatgaccggatagacgaactgtttttagcccaccagcttccggtagctatttacagttattgccagtatcaggacggtgcggcccccgggcgtggtgcctggacgccatttgctgaattttcgccggagtggcaggcgctacaagccgcacgtcgtattcaggcacaaacttacttcatcgatttgccttgctgggcgcagagtgaagaagaggacgattcgcctgatacacaagatgaaagccagaccttactgctgcgtgacacccgcatggataacagcgataccctgtgggatcacttattcgaagatgaaagccagcaaactgcattaccctctgcactggcgcgctattttgcccaactgcggggcgattcccccggagatgctctcaatcgtcagcgcgaagcctttatggctcgctggattacatgggcgatgcagcaaaacaatggcgacgtgttagtcgtctgcggcggctggcacgctcctgcactggcaaacatgtggcgcgaatgcccgcaggaaattaacaagccagaattgtcctcgctggcagatgccgttacaggttgttatctcacaccctacagtgaaaagcgccttgatgtgctggcaggatacctttccggaatgcctgccccggtctggcaaaactggtgctggcagtgtggcttacagcaggcaggtgaacaactgctgaaaacggttcttacccgtttgcgccagcacaaattgcccgcttctaccgctgatatggctgctgctcatctgcatgctatggcactggcacagttgcgcggccatacactacctctacgcactgactggctggatgccatagctggctcgctgattaaagaagccttgaacgcgccgttgccgtggagctaccgcggagttattcatcccgataccgatccgattctggtaacgttgatagacacattagcgggtgacggattcggtaaacttgccccttctacgccacaaccgcctctgccaaaagatgtcacctgcgaactggaacgtaccggaatctctcttccggcggagcttaccttaaatcgctttacccccgatggactggcgcaaagtcaggtgttacatcggttggcaatactggagatcccaggggttgtgcgccagcagggaagtacactgtcacttgcaggcaacggtgaagaatgctggaaattaacccgcccgcttagccagcatgcggcattgattgaggccgcctgctttggcgccacactccaggaagccgcacgccataaattagaagccgatatgctggacgcgggtggaatcggctgtatcaccacatgtcttagccaggcagcgttagcgggtctggcgtctttcagtcaacaattactggaacaactcacattattaatcgcccaggaaaatcaattcgccgaaatgggccaggcgctggaagtgctatatgccttatggcggctggatgaaattagcggtatgcaaggcgcgcagatattacaaatgacattatgcgcggccatcgatcgcacgctgtggctatgtgaatccaacggcagaccggatgaaaaggagtttcacactcacctgcatagctggcaggcgctttgccatatcctgcgcgatctacatagcggcgttaatttacccggcgtttctctttctgcggcggtagccttactggagcgccgcagtcaggcgattcatgccccggcgctggatcgcggcgcgactcttggcgcactgatgcgtctggaacatcccaacgccagtgccgaagcggcgctgacgatgctggcgcagttatccccggcacaatccggcgaggcgctgcacggtttgctggcattagcccgtcatcaactggcctgtcagccggtatttatcgccggtttcagcagtcatttaaatcaactgagtgatgccgattttatcaatgccctgcccgatttacgcgcggcgatggcctggctaccacctcgagaacgcgggacgctggcgcatcaggtgcttgagcattatcaactggtgcaacttcccgtttcggcactgcaaatgccgttgcattgtccaccacaagacattgcacatcatcatcaactcgaacagcaggcactggcatcgctgcaacactggggagttttccatgtctga

SEQ ID NO: 5172 - protein, 758 aa, Escherichia coli
MYERAVNCRHHSPACARLAKSLIESQRPRYVLIEGPADFNDRIDELFLAHQLPVAIYSYCQYQDGAAPGRGAWTPFAEFSPEWQALQAARRIQAQTYFIDLPCWAQSEEEDDSPDTQDESQTLLLRDTRMDNSDTLWDHLFEDESQQTALPSALARYFAQLRGDSPGDALNRQREAFMARWITWAMQQNNGDVLVVCGGWHAPALANMWRECPQEINKPELSSLADAVTGCYLTPYSEKRLDVLAGYLSGMPAPVWQNWCWQCGLQQAGEQLLKTVLTRLRQHKLPASTADMAAAHLHAMALAQLRGHTLPLRTDWLDAIAGSLIKEALNAPLPWSYRGVIHPDTDPILVTLIDTLAGDGFGKLAPSTPQPPLPKDVTCELERTGISLPAELTLNRFTPDGLAQSQVLHRLAILEIPGVVRQQGSTLSLAGNGEECWKLTRPLSQHAALIEAACFGATLQEAARHKLEADMLDAGGIGCITTCLSQAALAGLASFSQQLLEQLTLLIAQENQFAEMGQALEVLYALWRLDEISGMQGAQILQMTLCAAIDRTLWLCESNGRPDEKEFHTHLHSWQALCHILRDLHSGVNLPGVSLSAAVALLERRSQAIHAPALDRGATLGALMRLEHPNASAEAALTMLAQLSPAQSGEALHGLLALARHQLACQPVFIAGFSSHLNQLSDADFINALPDLRAAMAWLPPRERGTLAHQVLEHYQLVQLPVSALQMPLHCPPQDIAHHHQLEQQALASLQHWGVFHV

SEQ ID NO: 5173 - DNA, 1137 bp, Escherichia coli
atgtctgaactgaacgatcttctgaccacccgtgagctacaacgctggcgattaattcttggcgaagcggcagaaacgacgctttgtgggctggatgacaacgcccggcagatagaccacgcgctggagtggctgtatgggcgcgatcctgaacggctccagcgtggtgaacgttacggtggattaggtcgttcaaatctcaccacccctgagtggatcaacagcattcacacgctgtttccgcaacaggtgattgagcggctggaaagcgatgccgtgctgcgctacggcattgaagatgtggtgacgaatctcgacgtgctggaacgtatgcagccttctgaaagcctgctacgcgccgttttgcacaccaaacatctgatgaatcccgaagtactggctgccgcccgccggatagtgcaccaggttgttgaagagattatggcgcgactggcaaaggaagttcgtcaggctttttctggagtacgcgatcgccgtcgccgctcatttatttcactggcgcgaaactttgatttcaaaagtactctgcgcgccaacctgcaacactggcacccgcaacacggcaagttgtatatcgaatccccccgctttaacagccgcattaaacgccatagcgaacaatggcaactggtcctactggttgatcaaagcggatcgatggttgattcggtgatccactccgcagtgatggcggcttgtttatggcagttacccggcattcgtacccatctggtcgcttttgacaccagcgtggttgatctcacggcagacgttgccgatccggtagagttattaatgaaagtacaactgggcggcgggaccaatatcgccagtgccgtggagtatggtcggcaacttattgaacaacctgcaaaaagtgtcattattctcgtgagcgatttttatgaaggtgggtcatcatcattgctgacgcatcaggtgaaaaagtgtgtccagagcggcatcaaagtgctggggctggcagcgctcgacagcaacgcaacgccttgctatgaccacgatacggcccaggcgctggttaatgtcggcgcacaaatagccgcaatgacaccgggcgagctggcttcctggcttgcggagaatcttcagtcatga

SEQ ID NO: 5174 - protein, 378 aa, Escherichia coli
MSELNDLLTTRELQRWRLILGEAAETTLCGLDDNARQIDHALEWLYGRDPERLQRGERYGGLGRSNLTTPEWINSIHTLFPQQVIERLESDAVLRYGIEDVVTNLDVLERMQPSESLLRAVLHTKHLMNPEVLAAARRIVHQVVEEIMARLAKEVRQAFSGVRDRRRRSFISLARNFDFKSTLRANLQHWHPQHGKLYIESPRFNSRIKRHSEQWQLVLLVDQSGSMVDSVIHSAVMAACLWQLPGIRTHLVAFDTSVVDLTADVADPVELLMKVQLGGGTNIASAVEYGRQLIEQPAKSVIILVSDFYEGGSSSLLTHQVKKCVQSGIKVLGLAALDSNATPCYDHDTAQALVNVGAQIAAMTPGELASWLAENLQS

SEQ ID NO: 5175 - DNA, 2004 bp, Escherichia coli
atgaattcactacgtccggaattattagaactgacaccacaggcactgacggcgttaagcaatgccggttttgttaagcgcagccttaaggaactggaaaatggcaacgtcccggaaatcagtcatgagaacggcgctttaatcgccaccttcagtgacggtgtccgtacccagctggcgaacggccaggcactgaaagaggctcagtgcacctgcggggccagcggcatgtgccgtcatcgcgtgatgctggtgttaagttatcaacgactttgtgccaccgcccagcctacggaaaaaaaagaagaagagtgggatccggcaatctggctgaaagaactggctaccttgcccgatgccacccgcaaacgcgcgcaggcgctggtcgctaaaggcatcaccattgagttgttctgtgcgcctggcgaaattccctctgcccgattaccgatgagcgatgtgcgtttttattcccgcagcagcattcgcttcgcacgctgtgattgcattgaaggcacactttgcgaacatgtcgtactggctgtgcaggccttcgtcgaggccaaaactcagcaagcggaatttactcatttaatctggcagatgcgcagtgaacacgtcacatcatctgatgatccgtttgccagcgaagaaggcaaaacgtgtcgtcaatatgttcagcaattaagccaggcattatggctgggcgggataagtcaaccgccaatccattacgaggccgctttcagtcgcgcgcagcaagcggcggaacgctgcaactggcgatgggtgagtgaatcgctacggcaattgcgcgccagtgttgatgccttccacgcccgtgccagccactaccatgccggagaatgcttacgtcagcttgcggcattaaacagtcgattaaattgcgtacaagagatggcgcggcgcgacagtatcggtgaagttcctcccatgccgtggcgcacggtcgttggcgctggtattgccggagaagcaaaacttgatcatctgcggctggtgtctttaggtatgcgttgctggcaggatattgagcagtatggtttacgcatctggtttaccgatcccgacacaggaagtattttgcatctttcgcgtagttggcagagaagcgaacaggaaaactcaccggcagcgacgcgtcggctgtttagttttcaggctggcgcactggcaggtgggcaaattgtttcacaagctgcaaaacgcagtgccgatggcgagctgctgttcgcgacccgtaaccgcttgagtggcgttgttccactgtcgccagacgcctggctaatgttgagcgcgccgttgcgccagccgggcattgtggctttgcgggaatatttacgccagcgtccccccgcctgcatacgaccaatcaaccaggtcgataacttatttattctgccgatagcggagtgtatttcgctcggttgggatagcagccgccagacactggatgcgcaggtaatcagcggcgaaggggaagataatgtgctgacgttatcccttccggcatctgcctgttctccttttgccgttgaacgcatggcggcgcttttgcaacaaacagacgaccccgtgagcctggtttctggctttgtcagttttgtagaggggcaattgacactggaaccacgggtgatgatgacaaaaacccgcgcctgggcgctggacgcagaaactgcgcctgtggcaccgctaccttctgccagcgttctgcctgtgccgtctaccgctcatcagttgctgatgcgctgccaggcgttacttattcaactgctccataacggctggcgctatcaggaacagagtgctattggtcaggcagagttgctggcgaatgacctcaccgcggtgggtttttatcggctggcacatgtgttgggacaatttcgtaatacagaaagcgaggcacgggtagaagcaatgaataacggtgttttgctttgcgaacaattattccccatgcttcagcaacaaggatga

SEQ ID NO: 5176 - protein, 667 aa, Escherichia coli
MNSLRPELLELTPQALTALSNAGFVKRSLKELENGNVPEISHENGALIATFSDGVRTQLANGQALKEAQCTCGASGMCRHRVMLVLSYQRLCATAQPTEKKEEEWDPAIWLKELATLPDATRKRAQALVAKGITIELFCAPGEIPSARLPMSDVRFYSRSSIRFARCDCIEGTLCEHVVLAVQAFVEAKTQQAEFTHLIWQMRSEHVTSSDDPFASEEGKTCRQYVQQLSQALWLGGISQPPIHYEAAFSRAQQAAERCNWRWVSESLRQLRASVDAFHARASHYHAGECLRQLAALNSRLNCVQEMARRDSIGEVPPMPWRTVVGAGIAGEAKLDHLRLVSLGMRCWQDIEQYGLRIWFTDPDTGSILHLSRSWQRSEQENSPAATRRLFSFQAGALAGGQIVSQAAKRSADGELLFATRNRLSGVVPLSPDAWLMLSAPLRQPGIVALREYLRQRPPACIRPINQVDNLFILPIAECISLGWDSSRQTLDAQVISGEGEDNVLTLSLPASACSPFAVERMAALLQQTDDPVSLVSGFVSFVEGQLTLEPRVMMTKTRAWALDAETAPVAPLPSASVLPVPSTAHQLLMRCQALLIQLLHNGWRYQEQSAIGQAELLANDLTAVGFYRLAHVLGQFRNTESEARVEAMNNGVLLCEQLFPMLQQQG

SEQ ID NO: 5177 - DNA, 462 bp, Escherichia coli
atgaaggctttcaataagctgttttcccttgttgttgcatctgttctggttttctctcttgctggctgcggtgacaaagaagaatcaaagaaattcagcgccaatctgaacggcactgaaattgccattacctatgtctacaaaggtgacaaggtgcttaagcaatcttctgaaaccaaaattcaatttgcctccattggtgcaaccaccaaagaagatgccgccaggacacttgagccgttaagcgctaaatacaaaaacatcgcgggtgttgaagaaaaattaacctataccgatacctacgcgcaggaaaacgtgactattgatatggaaaaagtggattttaaagccctgcagggtatttcaggaatcaacgtttctgctgaagatgccaaaaaaggtatcactatggcgcaaatggaactggtgatgaaagccgctggttttaaagaagtgaaataa

SEQ ID NO: 5178 - protein, 153 aa, Escherichia coli
MKAFNKLFSLVVASVLVFSLAGCGDKEESKKFSANLNGTEIAITYVYKGDKVLKQSSETKIQFASIGATTKEDAARTLEPLSAKYKNIAGVEEKLTYTDTYAQENVTIDMEKVDFKALQGISGINVSAEDAKKGITMAQMELVMKAAGFKEVK

SEQ ID NO: 5179 - DNA, 528 bp, Escherichia coli
ttggcctgtaaaagactgctaaaatggctttttgcctcatcaacacctgaaggcctcatgctaagtaacgatattctgcgcagcgtgcgctacattttgaaagccaataataatgacctggtgcgtattctggcgctgggtaatgtcgaagccaccgcggaacagatcgccgtctggctacgtaaagaagacgaagagggttttcagcgttgtccggacattgttttgtcgtcattcctcaatggcctgatttatgaaaaacgcggcaaggatgagtctgctccggcactggagccggagcgtcgcattaataacaacatcgtgctgaaaaaattacgcatcgcgttttcgcttaaaaccgatgacattctggcaatcctcaccgaacagcagttccgcgtttcgatgccggaaattacggcgatgatgcgtgcaccggatcataaaaacttccgcgaatgcggcgatcaatttttacgttattttctgcgtggactggcagcgcgccagcatgtgaagaaaagctaa

SEQ ID NO: 5180 - protein, 175 aa, Escherichia coli
MACKRLLKWLFASSTPEGLMLSNDILRSVRYILKANNNDLVRILALGNVEATAEQIAVWLRKEDEEGFQRCPDIVLSSFLNGLIYEKRGKDESAPALEPERRINNNIVLKKLRIAFSLKTDDILAILTEQQFRVSMPEITAMMRAPDHKNFRECGDQFLRYFLRGLAARQHVKKS

SEQ ID NO: 5181 - DNA, 720 bp, Escherichia coli
atgattaaagtcttaattgtcgatgatgaaccgcttgcacgggagaacctgcgcgtatttttgcaggagcagagcgatattgaaatcgttggagagtgttcaaacgccgtagaagggatcggcgcggtgcataaactgcgcccggatgtgctgtttctcgatatccagatgccgcgcatcagtggtctggaaatggtggggatgctcgacccggaacatcgcccgtatattgtttttctcaccgcgtttgacgaatacgccattaaagcctttgaagaacatgcctttgattatctgctgaagccaattgatgaagcgcgactggagaaaacgctggcgcgattgcgtcaggagcgcagcaagcaggatgtttcgttgttaccggaaaatcaacaggcgctgaaatttatcccttgtacggggcatagtcggatttatttgctgcaaatgaaagatgtggcatttgtcagcagtcggatgagcggtgtctacgttaccagtcacgaagggaaagagggctttaccgaactgacattacgtaccctggaaagtcgtacaccactactgcgctgccatcgtcagtatctggttaacctcgcgcatttacaggagatccgtctggaagataacggccaggccgagttgattttgcgtaatggcttaaccgtgccggtcagccgccgttatctgaaaagcttaaaagaggcgattggcctgtaa

SEQ ID NO: 5182 - protein, 239 aa, Escherichia coli
MIKVLIVDDEPLARENLRVFLQEQSDIEIVGECSNAVEGIGAVHKLRPDVLFLDIQMPRISGLEMVGMLDPEHRPYIVFLTAFDEYAIKAFEEHAFDYLLKPIDEARLEKTLARLRQERSKQDVSLLPENQQALKFIPCTGHSRIYLLQMKDVAFVSSRMSGVYVTSHEGKEGFTELTLRTLESRTPLLRCHRQYLVNLAHLQEIRLEDNGQAELILRNGLTVPVSRRYLKSLKEAIGL

SEQ ID NO: 5183 - DNA, 1701 bp, Escherichia coli
gtgtggtttgcgggtatgtacgattttaatctggtgttgctgctgcttcagcagatgtgcgtttttttagtcattgcgtggttaatgagtaaaacgccattattcataccgttaatgcaggtcacggttcgtctgccgcataaatttctctgctacatcgtcttttccatcttctgcatcatgggcacctggtttgggttgcacattgacgattctattgccaatacccgtgcgataggtgcggtaatgggcggcttactcggcggtccggtcgtcggtgggctggttggtctgaccggcgggttacatcgatattcgatggggggcatgaccgcgctaagttgcatgatctcgaccatcgttgaaggattgctcggcggcctggtacacagcatcctgatccgtcgcgggcgcactgataaagtctttaaccccattaccgccggtgccgtcacgttcgtcgctgaaatggtgcaaatgttgatcatcctggcgatcgcccgaccttatgaagatgcggtgcgtctggtgagtaatattgctgcgccaatgatggtcaccaataccgtcggcgcggcactgtttatgcgtatattgctcgataaacgcgcgatgtttgaaaaatacacttcggctttttctgccactgcgctgaaagtggcggcctcgacggaaggcattttgcgccaggggtttaacgaagtgaacagcatgaaagtggcacaggtgctgtatcaggagctggatattggtgcagtcgcgattaccgatcgagagaaattgctggcctttaccggaattggtgacgaccaccatttacccggcaaaccaatttcttcgacttataccttaaaagcgattgaaaccggtgaagtggtctacgctgatggcaacgaagtgccttaccgttgctctttgcatccgcaatgcaaactggggtcgacgctggtcattccgttgcgtggtgaaaatcagcgagtgatgggtaccatcaaattgtatgaagccaaaaaccgtttattcagttcaatcaaccgcacgctgggcgaggggattgcgcaactgctttcggcgcagatcctcgccgggcaatatgagcggcaaaaagcgatgctcacccagtcagagatcaaactgcttcacgcccaggtgaatccccattttttgtttaatgcgcttaacaccattaaagcggtgatccgccgcgacagcgaacaggccagccagctggtgcagtatctttctacttttttccgcaaaaacttaaagcggccttcggagtttgttactctcgccgacgaaattgaacatgtgaacgcttatctgcaaattgaaaaggcgcgcttccagtcgcggttgcaggtcaacattgctattccgcaagaattatcccagcagcaattgcccgcgtttaccctgcaaccgatagtggaaaacgccattaaacatgggacatcacaactgttggatacagggcgagtggcaatcagcgcccgacgtgaggggcaacatttgatgctggagatcgaagacaatgccggtttgtatcaaccggtaaccaatgccagtgggctggggatgaatctggtggataagcgtttacgtgaacggtttggcgatgactatgggataagcgtcgcctgtgagcctgatagttacacccgaataacgttacgactaccatggagggacgaggcatga

SEQ ID NO: 5184 - protein, 566 aa, Escherichia coli
MWFAGMYDFNLVLLLLQQMCVFLVIAWLMSKTPLFIPLMQVTVRLPHKFLCYIVFSIFCIMGTWFGLHIDDSIANTRAIGAVMGGLLGGPVVGGLVGLTGGLHRYSMGGMTALSCMISTIVEGLLGGLVHSILIRRGRTDKVFNPITAGAVTFVAEMVQMLIILAIARPYEDAVRLVSNIAAPMMVTNTVGAALFMRILLDKRAMFEKYTSAFSATALKVAASTEGILRQGFNEVNSMKVAQVLYQELDIGAVAITDREKLLAFTGIGDDHHLPGKPISSTYTLKAIETGEVVYADGNEVPYRCSLHPQCKLGSTLVIPLRGENQRVMGTIKLYEAKNRLFSSINRTLGEGIAQLLSAQILAGQYERQKAMLTQSEIKLLHAQVNPHFLFNALNTIKAVIRRDSEQASQLVQYLSTFFRKNLKRPSEFVTLADEIEHVNAYLQIEKARFQSRLQVNIAIPQELSQQQLPAFTLQPIVENAIKHGTSQLLDTGRVAISARREGQHLMLEIEDNAGLYQPVTNASGLGMNLVDKRLRERFGDDYGISVACEPDSYTRITLRLPWRDEA

SEQ ID NO: 5185 - DNA, 732 bp, Escherichia coli
atggcgctttacacaattggtgaagtggcgttgctttgtgatattaaccctgtcacgttacgcgcgtggcagaggcgttacggattgctgaaaccacaacggacagacggcggtcatcggctgttcaacgatgccgatattgaccggatccgcgagatcaaacgctggatcgacaacggcgtgcaggtcagcaaagtaaaaatgctgctcagtaatgaaaatgttgatgtgcagaacggctggcgcgatcagcaagaaacattactgacttacctgcaaagcggcaatctgcatagcctgcgaacgtggatcaaagagcgcggtcaggattaccccgcccagacactcaccacacatctgtttattcctctgcgccgacggcttcagtgccaacaagcgactctccaggcgctgctggcgatcctcgacggcgtactgatcaactacatctctatttgcctggcttcggcgcgcaaaaaacagggtaaagatgcactggtggttggctggaatattcaggataccactcgtctgtggctggagggctggattgccagtcaacaaggatggcgcattgatgtcctcgcccactcgctcaatcaactacgccctgaactgttcgaaggccgtacattgctggtatggtgcggtgataatcgaacctccgcccaacaacagcaactcaccagttggcaggaacaaggccatgatattttcccactcggcatttaa

SEQ ID NO: 5186 - protein, 243 aa, Escherichia coli
MALYTIGEVALLCDINPVTLRAWQRRYGLLKPQRTDGGHRLFNDADIDRIREIKRWIDNGVQVSKVKMLLSNENVDVQNGWRDQQETLLTYLQSGNLHSLRTWIKERGQDYPAQTLTTHLFIPLRRRLQCQQATLQALLAILDGVLINYISICLASARKKQGKDALVVGWNIQDTTRLWLEGWIASQQGWRIDVLAHSLNQLRPELFEGRTLLVWCGDNRTSAQQQQLTSWQEQGHDIFPLGI

SEQ ID NO: 5187 - DNA, 732 bp, Escherichia coli
atgaagatgttgcgcgatccgctgttctggctgattgctctgtttgtggcgctgattttctggctgccttacagccagccgctgtttgctgccttgttcccacaactgccacgacccgtttatcagcaggaaagctttgcagctctggcactggctcatttctggctggtgggaatttcgagtttgtttgcggtgatcattggtactggtgccggaattgctgtcactcgcccttggggcgcgggatttcgtccactggtggaaactattgccgccgttggacagacttttccgcccgttgcagtgctggcgattgccgttccggtgatcggctttggtctgaaaccagcgattatcgccttgatcctttacggcgtgctgcccgtcctgcaggcgacacttgccgggctgggagcgattgatgccagcgtgacagaagttgcgaaaggtatgggaatgagtcgtggtcagcgactgcgtaaggtcgagctaccgctggcggctccggtgattctggcgggcgtgcgaacttcggtgattatcaacattggtacggcgacgatcgcctcaacggtaggggccagcacgctgggtacgccgatcatcatcgggcttagcggatttaataccgcgtatgtgatccagggggcgttactggtggcactggcggcgatcatcgcagaccgcctgtttgaaaggctggtgcaggcgttcagccagcacgcaaaataa

SEQ ID NO: 5188 - protein, 243 aa, Escherichia coli
MKMLRDPLFWLIALFVALIFWLPYSQPLFAALFPQLPRPVYQQESFAALALAHFWLVGISSLFAVIIGTGAGIAVTRPWGAGFRPLVETIAAVGQTFPPVAVLAIAVPVIGFGLKPAIIALILYGVLPVLQATLAGLGAIDASVTEVAKGMGMSRGQRLRKVELPLAAPVILAGVRTSVIINIGTATIASTVGASTLGTPIIIGLSGFNTAYVIQGALLVALAAIIADRLFERLVQAFSQHAK

SEQ ID NO: 5189 - DNA, 108 bp, Escherichia coli
atgcgcatagctaaaattggggtcatcgccctgttcctgtttatggcgttaggcggaattggtggcgtcatgctcgcaggttatacctttattttgcgtgctggctga

SEQ ID NO: 5190 - protein, 35 aa, Escherichia coli
MRIAKIGVIALFLFMALGGIGGVMLAGYTFILRAG

SEQ ID NO: 5191 - DNA, 927 bp, Escherichia coli
atgattgaatttagccatgtcagcaaactgttcggcgcacaaaaagccgttaacgatctcaatctcaattttcaggaagggagtttttcggtactgattggcacgtcgggttccggtaaatccaccactctgaaaatgattaaccgcctggtggagcatgacagtggcgtgatccgctttgccggagaagaaattcgctcgctgccagtgctggagttgcgccgccggatgggctatgccattcaatctattggcctgtttccccactggagcgtggcgcaaaatattgccaccgtgccgcaattacaaaaatggtcacgggcgcggatcgacgatcgtatcgacgaattaatggcgctactggggctggagccaaatttgcgtgagcgttatccgcatcagctttccggtggtcagcagcaacgtgtgggagtggcccgcgcgctggctgccgatccgcaagtcttactgatggatgaaccttttggcgcgctggacccggtaacgcgcggcgcgttgcaacaagagatgacgcgcatacaccgtttgctggggcgtaccattgtgctggtcactcatgatattgatgaggcgctacgactggcagaacatctggtgttgatggatcacggtgaagtggtgcagcagggcaatccgctgacgatgctgactcgtccgacgaatgattttgtccgccagttttttgggcatagtgaactgggtgtccgcctgctttcgttacgtagcgtggcggattacgtgcgtcgcgaagaacgggcagaaggtgaggcgctggcagaagagatgacgctacgcgatgcgctttctctgtttgtcgcgcggggatgcgaggtgctgccggtggtgaacacgcagggcgagccttgcggcacgctgcattttcaggatctgctggaggaggcgtaa

SEQ ID NO: 5192 - protein, 308 aa, Escherichia coli
MIEFSHVSKLFGAQKAVNDLNLNFQEGSFSVLIGTSGSGKSTTLKMINRLVEHDSGVIRFAGEEIRSLPVLELRRRMGYAIQSIGLFPHWSVAQNIATVPQLQKWSRARIDDRIDELMALLGLEPNLRERYPHQLSGGQQQRVGVARALAADPQVLLMDEPFGALDPVTRGALQQEMTRIHRLLGRTIVLVTHDIDEALRLAEHLVLMDHGEVVQQGNPLTMLTRPTNDFVRQFFGHSELGVRLLSLRSVADYVRREERAEGEALAEEMTLRDALSLFVARGCEVLPVVNTQGEPCGTLHFQDLLEEA

SEQ ID NO: 5193 - DNA, 1158 bp, Escherichia coli
gtgacttatttccgtattaatcctgttctggcgctgctgctgttgctgacggcaatcgcagcggcgctgccgtttatcagttacgcacctaatcgtttagtttcgggtgaggggcgtcatctctggcagctgtggccgcaaactctctggatgctggtgggcgttggttgcgcctggctgacagcctgttttattcccgctaaaaaaggcagcatttttgcactcattctggcgcaattcgtcttcgtattgctggtgtggggagctggaaaggcggcgacacaactggcgcaaaatggcagtgcgctggcgcgtaccagcctcggcagtggtttctggctggctgcggcgctggcactgctggcctgtagcgatgccatccgccgaatctccacgcatccgctgtggcgctggttgttgcatatgcagattgccattattccgctgtggttgctgtactccggcacgcttaacgatctctcgttaatgaaagaatacgccaaccgtcaggatgtgtttgacgacgcgctggcacaacatctgacgttgctgtttggtgcggtgctgcctgcgttagtgattggtgtgccgttgggcatctggtgctacttttccaccgcgcggcagggagcgattttttctctgctgaatgtcattcagaccgtgccttcgatagcgctctttggcctgctgattgcgccgcttgccgcgctggttacggcctttccgtggctgggaatgctcggcatagcaggaaccggaatgacacccgcactgattgcgctggtgctctatgccttgctgccgctggtgcgcggcgtagtagtcggcttgaaccagatcccgcgcgatgtgctggagagcgccagagcgatggggatgagcggggtgcagcgtttcctgcatgttcagttaccgctggcgttaccggtatttctgcgcagcctgcgggtggtgatggtacaaaccgttggcatggcggtgattgcggcgttaatcggcgcaggcggttttggtgcgctggttttccaggggctgctaagcagtgccattgatttagtgttgctgggggtgatcccggtaattgttctggcggtgcttaccgacgcgctgttcgatttgcttatcgcactgctgaaggtgaaacgtaatgattga

SEQ ID NO: 5194 - protein, 385 aa, Escherichia coli
MTYFRINPVLALLLLLTAIAAALPFISYAPNRLVSGEGRHLWQLWPQTLWMLVGVGCAWLTACFIPAKKGSIFALILAQFVFVLLVWGAGKAATQLAQNGSALARTSLGSGFWLAAALALLACSDAIRRISTHPLWRWLLHMQIAIIPLWLLYSGTLNDLSLMKEYANRQDVFDDALAQHLTLLFGAVLPALVIGVPLGIWCYFSTARQGAIFSLLNVIQTVPSIALFGLLIAPLAALVTAFPWLGMLGIAGTGMTPALIALVLYALLPLVRGVVVGLNQIPRDVLESARAMGMSGVQRFLHVQLPLALPVFLRSLRVVMVQTVGMAVIAALIGAGGFGALVFQGLLSSAIDLVLLGVIPVIVLAVLTDALFDLLIALLKVKRND

SEQ ID NO: 5195 - DNA, 918 bp, Escherichia coli
atgccactctcaaaggtctgggcaggttcactggttttgttggcagccgtgagcctgccgctacaggcggcttcccccgttaaggttggttcaaaaatcgatacggaaggcgcgctgctcggcaatatcattttgcaggtgctggaaagtcacggcgttcctacggtaaataaagtgcagctgggaacgactcccgtagtgcgcggggcgatcacttctggcgagctggatatctatccggaatatactggcaatggcgcgtttttctttaaagatgaaaacgatacggcatggaaaaacgcgcagcaaggctatgagaaagtcaaaaaactcgatgcagagcaaaacaagttaatctggctgacgcccgcgcctgcaaataacacctggaccatcgccgtgcgtcaggatgtggcagagaaaaacaaactcacttcgcttgccgagctgagtcgttatctgaaagagggtggcaacttcaaactggcagcctcggcagagtttattgaacgcgccgatgccttacccgcgtttgaaaaagcctatggctttaagctcggtcaggatcagttgctgtcactggccggtggtgacacggcggtgacgatcaaagccgctgcccagcaaacttctggtgttaatgccgcaatggcttacggcaccgacggcccggttgcggcgctggggctgcaaaccttaagcgatccgcaaggcgtgcaacctatctacgcgcctgcgccagtggtgcgtgagtcggtgctgaaagagtatccgcaaatagcacagtggctacagccagtcttcgccagcctcgatgaaaaaacattgcagcagctgaatgccagcattgcagtggaaggactggatgccaaaaaagtggcagccgactacctgaaacaaaaagggtggacgaagtaa

SEQ ID NO: 5196 - protein, 305 aa, Escherichia coli
MPLSKVWAGSLVLLAAVSLPLQAASPVKVGSKIDTEGALLGNIILQVLESHGVPTVNKVQLGTTPVVRGAITSGELDIYPEYTGNGAFFFKDENDTAWKNAQQGYEKVKKLDAEQNKLIWLTPAPANNTWTIAVRQDVAEKNKLTSLAELSRYLKEGGNFKLAASAEFIERADALPAFEKAYGFKLGQDQLLSLAGGDTAVTIKAAAQQTSGVNAAMAYGTDGPVAALGLQTLSDPQGVQPIYAPAPVVRESVLKEYPQIAQWLQPVFASLDEKTLQQLNASIAVEGLDAKKVAADYLKQKGWTK

SEQ ID NO: 5197 - DNA, 2370 bp, Escherichia coli
atgcttatggcaaactacggtttttgcaccattttcgctgccacgtcgggcaacaaaggaagaaaaatccatatgaaatggctatgttcagtaggaatcgcggtgagtctggccctgcagccagcactggcggatgatttattcggcaaccatccattaacgcccgaagcgcgggatgcgttcgtcaccgaactgcttaagaaaatgacagttgacgagaaaattggtcagctgcgcttaatcagcgtcggcccggataacccgaaagaggcgatccgcgagatgatcaaagacggtcaggttggggcgattttcaacactgtaacccgtcaggatatccgcgccatgcaggatcaggtgatggaattaagccgcctgaaaattcctcttttctttgcttacgacgtgctgcacggtcagcgcacggtgttcccgattagtctcggtctggcttcgtcttttaacctcgatgcggtgaaaacagtcgggcgtgtctctgcttatgaagcggcagatgatggcctgaatatgacctgggcaccgatggtcgatgtctcgcgcgatccgcgctggggacgtgcttccgaaggttttggcgaagatacgtatctcacctcaataatgggcaaaaccatggtggaagcgatgcagggtaaaagcccggcagatcgctactcggtgatgaccagcgtcaaacactttgccgcatacggcgcggtagaaggcggtaaagagtacaacaccgtcgatatgagtccgcagcgcctgtttaacgactatatgccgccgtacaaagcggggctggatgcaggcagcggtgcggtgatggtggcgctgaactcgctgaacggcacgccagccacctccgactcctggctgctgaaagatgttctgcgcgaccagtggggctttaaaggcatcaccgtttccgatcacggcgcaatcaaagagctgattaaacatggcacggcggcagacccagaggatgcggtacgcgtggcgctgaagtccggaatcaacatgagcatgagcgacgagtattactcgaagtatctgcctgggttgatcaaatccggcaaagtgacgatggaagagctggacgatgctgcccgccatgtactgaacgttaaatatgatatgggattgtttaacgacccatacagccatttggggccgaaagagtctgacccggtggataccaatgccgaaagccgcctgcaccgtaaagaagcgcgtgaagtggcgcgcgaaagcctggtgttgctgaaaaaccgtctcgaaacgctgccgctgaaaaaatctgcaaccattgcggtggttggcccgctggcagacagcaagcgtgacgtgatgggaagctggtcggcggcaggtgtcgccgatcaatctgttactgtgctaacagggattaaaaacgccgtcggtgaaaacggtaaagtgctgtatgccaaaggggcgaacgttaccagtgacaaaggcattatcgatttcctgaatcagtatgaagaggcggtcaaagttgatccgcgttcgccgcaagagatgcttgatgaagcagtgcaaaccgcgaaacaatctgatgtggtggtggctgtggtcggtgaagctcaggggatggcgcacgaagcttccagtcgtaccgatatcactattccgcaaagccaacgtgacttgattgcggcgctgaaagccaccggtaaaccgctggtgctggtgctgatgaacgggcgtccgctggcgctggtgaaagaagatcagcaggctgatgcgattctggaaacctggtttgcggggactgaaggcggtaatgcaattgccgatgtattgtttggcgattataacccgtccggcaagctgccgatgtccttcccgcgttctgtcgggcagatcccggtgtactacagccatctgaataccgggcgtccgtataatgccgacaagccgaacaaatacacttcgcgttattttgatgaagctaacggggcgctttatccgttcggctatggtctgagctataccactttcaccgtctctgatgtgaaactttctgcgccgaccatgaagcgtgacggcaaagtgacggccagcgtgcaggtgacgaacaccggtaaacgcgaaggggccacggtagtacagatgtacttgcaggatgtgacggcttccatgagtcgcccggtgaagcagctgaaaggctttgagaaaatcaccctgaaaccgggcgaaactcagaccgtcagcttcccaatcgatattgaggcgctgaagttctggaatcaacagatgaaatatgacgccgagcctggcaagttcaatgtcttcatcggcactgattccgcacgcgttaagaaaggcgagtttgagttgctgtaa

SEQ ID NO: 5198 - protein, 789 aa, Escherichia coli
MLMANYGFCTIFAATSGNKGRKIHMKWLCSVGIAVSLALQPALADDLFGNHPLTPEARDAFVTELLKKMTVDEKIGQLRLISVGPDNPKEAIREMIKDGQVGAIFNTVTRQDIRAMQDQVMELSRLKIPLFFAYDVLHGQRTVFPISLGLASSFNLDAVKTVGRVSAYEAADDGLNMTWAPMVDVSRDPRWGRASEGFGEDTYLTSIMGKTMVEAMQGKSPADRYSVMTSVKHFAAYGAVEGGKEYNTVDMSPQRLFNDYMPPYKAGLDAGSGAVMVALNSLNGTPATSDSWLLKDVLRDQWGFKGITVSDHGAIKELIKHGTAADPEDAVRVALKSGINMSMSDEYYSKYLPGLIKSGKVTMEELDDAARHVLNVKYDMGLFNDPYSHLGPKESDPVDTNAESRLHRKEAREVARESLVLLKNRLETLPLKKSATIAVVGPLADSKRDVMGSWSAAGVADQSVTVLTGIKNAVGENGKVLYAKGANVTSDKGIIDFLNQYEEAVKVDPRSPQEMLDEAVQTAKQSDVVVAVVGEAQGMAHEASSRTDITIPQSQRDLIAALKATGKPLVLVLMNGRPLALVKEDQQADAILETWFAGTEGGNAIADVLFGDYNPSGKLPMSFPRSVGQIPVYYSHLNTGRPYNADKPNKYTSRYFDEANGALYPFGYGLSYTTFTVSDVKLSAPTMKRDGKVTASVQVTNTGKREGATVVQMYLQDVTASMSRPVKQLKGFEKITLKPGETQTVSFPIDIEALKFWNQQMKYDAEPGKFNVFIGTDSARVKKGEFELL

SEQ ID NO: 5199 - DNA, 1716 bp, Escherichia coli
atgtcttccatgacaacaactgataataaagcctttttgaatgaacttgcccgtctggtcggtcattcacacctgctcaccgatcccgccaaaacggcccgctatcgcaagggcttccgttctggtcagggcgacgcgctggctgtcgttttccctggctcactactggaattgtggcgggtgctgaaagcctgcgtcaccgctgacaaaattattctgatgcaggctgccaatacaggcctgaccgaaggatcgacgccaaacggtaacgattatgatcgcgatatcgtgatcatcagcaccctgcgtctcgacaagctgcacgttctcggcaagggcgaacaagtgctggcctatccgggcaccacgctctattcactggaaaaagccctcaaaccgctgggacgcgaaccgcactcagtgattggatcatcgtgtataggcgcatcggtcatcggcggtatttgtaacaactcgggcggctcgctggtgcaacgtggcccggcgtataccgaaatgtcattattcgcgcgtataaatgaagatggcaaactgacgctggtgaaccatctggggattgatctgggcgaaacgccggagcagatccttagcaagctggatgacgatcgcatcaaagatgacgatgtgcgccacgatggtcgtcacgcccacgattatgactatgtccaccgcgttcgtgatattgaagccgacacgcccgcacgttataacgctgatccggatcggttatttgaatcttctggttgcgcagggaagctggccgtctttgcagtacgtcttgataccttcgaagcggaaaaaaatcagcaggtgttttatatcggcaccaaccagccggaagtgctgaccgaaatccgccgtcatattctggctaatttcgaaaatctgccggttgccggggaatatatgcaccgggatatctacgatattgcggaaaaatacggcaaagacaccttcctgatgattgataagttaggcaccgacaagatgccgttcttctttaatctcaagggacgcaccgatgcgatgctggagaaagtgaaattcttccgtccgcattttaccgaccgtgcaatgcaaaaattcggtcacctgttccccagccatttaccgccgcgcatgaaaaactggcgcgataaatacgagcatcatctgctgttaaaaatggcgggcgatggcgtcggtgaagcaaaatcgtggctagtggattatttcaaacaggccgagggcgatttctttgtctgtacgccggaggaaggcagcaaagcgtttttacaccgtttcgccgctgcgggcgcagcaattcgttatcaggctgtgcattccgatgaagtcgaagacattctggcgctggatatcgctctgcggcgtaacgacaccgaatggtatgagcatttaccgccggagatcgacagccagctggtgcacaagctctattatggccattttatgtgctatgtcttccatcaggattacatcgtgaaaaaaggcgtggatgtgcatgtgttgaaagaacagatgctggaactgctacagcagcgcggcgcgcaataccctgccgagcataacgtcggtcatttgtataaagcaccggaaacgttgcagaagttttatcgcgagaacgatccgaccaacagtatgaatccggggattggtaaaaccagtaagcggaaaaactggcaggaagtgaaataa

SEQ ID NO: 5200 - protein, 571 aa, Escherichia coli
MSSMTTTDNKAFLNELARLVGHSHLLTDPAKTARYRKGFRSGQGDALAVVFPGSLLELWRVLKACVTADKIILMQAANTGLTEGSTPNGNDYDRDIVIISTLRLDKLHVLGKGEQVLAYPGTTLYSLEKALKPLGREPHSVIGSSCIGASVIGGICNNSGGSLVQRGPAYTEMSLFARINEDGKLTLVNHLGIDLGETPEQILSKLDDDRIKDDDVRHDGRHAHDYDYVHRVRDIEADTPARYNADPDRLFESSGCAGKLAVFAVRLDTFEAEKNQQVFYIGTNQPEVLTEIRRHILANFENLPVAGEYMHRDIYDIAEKYGKDTFLMIDKLGTDKMPFFFNLKGRTDAMLEKVKFFRPHFTDRAMQKFGHLFPSHLPPRMKNWRDKYEHHLLLKMAGDGVGEAKSWLVDYFKQAEGDFFVCTPEEGSKAFLHRFAAAGAAIRYQAVHSDEVEDILALDIALRRNDTEWYEHLPPEIDSQLVHKLYYGHFMCYVFHQDYIVKKGVDVHVLKEQMLELLQQRGAQYPAEHNVGHLYKAPETLQKFYRENDPTNSMNPGIGKTSKRKNWQEVK

SEQ ID NO: 5201 - DNA, 942 bp, Escherichia coli
atgctcatcatgccgaaatttcgagtttctttatttagcctggccctgatgctggctgtgccttttgcaccgcaggccgttgcgaaaacggtagccgctaccaccgcgtcacaaccggaaattgcctccggtagcgcgatgattgttgatctgaataccaacaaagtgatctattcgaaccacccggatctggtgcgtccgattgcgtctatcagcaaattaatgaccgcgatggttgtgctggatgcacgactgccgctggatgaaaaactaaaagtggatatcagccagacgccggagatgaaaggggtctattcgcgcgtaagactgaacagcgaaatcagccgtaaagatatgctgttgctggcgctgatgtcttcagaaaaccgcgcggcggcaagtcttgcgcaccattatcccggtggttacaaagcctttattaaggcgatgaacgcgaaagcgaaatcgctcggaatgaacaacacgcgctttgttgaaccaaccggattgtcggtgcataacgtttcaaccgcccgtgacttaaccaaactactcattgccagcaaacaatatccgttgatcgggcagttaagtactacccgggaagatatggcaaccttctctaacccgacgtatacgctgccgttccgcaatactaaccatctggtgtatcgtgataactggaatattcagttaaccaaaaccggttttaccaatgcggcgggccattgtctggtgatgcgcacggttatcaataataaaccggtggcgctggtagtgatggacgcgtttggcaaatatacccattttgccgatgccagccgcctgcgtacctggattgaaaccggtaaagtgatgcctgttccggcagcagcgttgagctataaaaaacaaaaagccgcccaaatggcggcggcggggcagacggcacagaacgattaa

SEQ ID NO: 5202 - protein, 313 aa, Escherichia coli
MLIMPKFRVSLFSLALMLAVPFAPQAVAKTVAATTASQPEIASGSAMIVDLNTNKVIYSNHPDLVRPIASISKLMTAMVVLDARLPLDEKLKVDISQTPEMKGVYSRVRLNSEISRKDMLLLALMSSENRAAASLAHHYPGGYKAFIKAMNAKAKSLGMNNTRFVEPTGLSVHNVSTARDLTKLLIASKQYPLIGQLSTTREDMATFSNPTYTLPFRNTNHLVYRDNWNIQLTKTGFTNAAGHCLVMRTVINNKPVALVVMDAFGKYTHFADASRLRTWIETGKVMPVPAAALSYKKQKAAQMAAAGQTAQND

SEQ ID NO: 5203 - DNA, 588 bp, Escherichia coli
atgagccatgtctggggactgttttcccatcccgatcgtgaaatgcaggtgattaatcgcgaaaacgaaacgatttctcatcactacacccaccacgttttgctgatggcggcgattccggtgatttgcgccttcattggcactacacagattggctggaattttggcgatggcactatcctgaagttatcctggtttaccggactggcgctggctgtcttgttttacggcgttatgctggctggggttgcggtgatggggcgggtcatctggtggatggcgcgtaattatccgcagcgtccgtcacttgcgcactgcatggtcttcgcgggctacgttgcaactccgctgtttttaagcggtctggtggcgctttacccgctggtctggttgtgtgcgctggtcggcacggtggcgctgttttacaccggctacctgctgtatctcggtattccgagcttcctgaatatcaacaaagaggaaggacttagcttctccagttcgacactggcgataggcgtgctggtgctggaagtgctgctcgcccttaccgttatactatggggctacggttatcgtttgttctag

SEQ ID NO: 5204 - protein, 195 aa, Escherichia coli
MSHVWGLFSHPDREMQVINRENETISHHYTHHVLLMAAIPVICAFIGTTQIGWNFGDGTILKLSWFTGLALAVLFYGVMLAGVAVMGRVIWWMARNYPQRPSLAHCMVFAGYVATPLFLSGLVALYPLVWLCALVGTVALFYTGYLLYLGIPSFLNINKEEGLSFSSSTLAIGVLVLEVLLALTVILWGYGYRLF

SEQ ID NO: 5205 - DNA, 579 bp, Escherichia coli
atggatctcaatacactcatctcacaatatggttatgccgcgctggtgatcggtagcctggcggaaggtgaaaccgtgactttgctgggaggcgttgcggcacatcaggggctattaaagttcccgctggtggtactttctgtggcgcttggcggcatgattggcgaccaggtgctttatctgtgcgggcggcggtttggcggcaagctgttacgccgtttctcgaaacatcaggataaaattgagcgggcgcagaaacttatccaacgccatccgtatctgtttgtcattggtacgcgttttatgtatggctttcgggtcattggcccgacgctgattggtgccagccagctgccgccgaaaatctttctgccgctgaatattctcggcgcatttgcctggtcgctgatttttaccactatcggttacgctggtgggcaggtgattgcgccgtggttgcacaatctcgaccagcatttgaagcactgggtctggttgattctggtcgtggttctggtggtaggcgtgcgctggtggctgaaacggcgcgggaagaaaaagccggatcatcaggcgtaa

SEQ ID NO: 5206 - protein, 192 aa, Escherichia coli
MDLNTLISQYGYAALVIGSLAEGETVTLLGGVAAHQGLLKFPLVVLSVALGGMIGDQVLYLCGRRFGGKLLRRFSKHQDKIERAQKLIQRHPYLFVIGTRFMYGFRVIGPTLIGASQLPPKIFLPLNILGAFAWSLIFTTIGYAGGQVIAPWLHNLDQHLKHWVWLILVVVLVVGVRWWLKRRGKKKPDHQA

SEQ ID NO: 5207 - DNA, 762 bp, Escherichia coli
atggcacaggtcgcgataattaccgcctccgattcggggatcggcaaagagtgcgcgttattactggcgcagcaggggtttgatattggcattacctggcactcagatgaagaaggggcaaaagataccgcgcgtaaggtggttagccatggcgtacgtgcggagatcgtgcaactggatctcggcaatctaccagaaggtgcgcaggcgctggagaaacttattcaacggctgtggcgtattgatgtgctggtgaataatgcgggcgcaatgaccaaagcgccgtttcttgatatggctttcgatgagtggcgcaagatttttaccgttgatgtcgatggtgcatttttatgctcgcaaattgctgcccgccagatggtgaagcaagggcagggcggtcgcatcatcaacattacatcggtacatgaacatacgccgctgccggatgccagcgcctacacagccgctaaacatgcgctcggcgggttaaccaaagcaatggcgctggagttggtcaggcataaaattttggtgaacgcagtcgcacctggggcgatcgccacgccaatgaacggcatggatggcggcgacgtgaagcccgacgcggagccttcgattcccttgcgacgttttggcacaacgcatgagattgccagcctggtggcctggctatgttccgaaggcgccaattacaccaccgggcagtcgctgattgtcgatggcggttttatgctggcaaatccgcagtttaagccggagtag

SEQ ID NO: 5208 - protein, 253 aa, Escherichia coli
MAQVAIITASDSGIGKECALLLAQQGFDIGITWHSDEEGAKDTARKVVSHGVRAEIVQLDLGNLPEGAQALEKLIQRLWRIDVLVNNAGAMTKAPFLDMAFDEWRKIFTVDVDGAFLCSQIAARQMVKQGQGGRIINITSVHEHTPLPDASAYTAAKHALGGLTKAMALELVRHKILVNAVAPGAIATPMNGMDGGDVKPDAEPSIPLRRFGTTHEIASLVAWLCSEGANYTTGQSLIVDGGFMLANPQFKPE

SEQ ID NO: 5209 - DNA, 1527 bp, Escherichia coli
ttgctactgatgtattgccacgcgaaactaaaaaatatatcgcaacacacggtaatctccgcgcaccttttcttacctgattattcccccatgaatcgtgattccttttatcccgccatcgcctgttttccgctgttactgatgctggccgggtgtgcacctatgcatgaaacccgccaggtgttaagccagcaaacgcccgctgcacaagttgacaccgtattacccacggcgctgaaaaatggttggccagacagccaatggtggctggagtatcacgataatcaactcacttccttaattaataatgcactacagagcgcaccggatatgcaggtggctgaacagcgcattcagctggctgaagcccaggcgaaggcaattgccactcaggatggtccgcagctcgacttttctgcggatatggagcggcaaaaaatgtcggcagaagggttaatggggccgtttgctctgaacgatccggccgcaggtacgaccggtccgtggtacaccaacggtacttttggcttaacggcgggctggcatctcgatatctggggaaagaatcgggcggaggttactgctcgcctgggtacggttaaagcacgggcggcggaacgcgagcaaacccgccaattgctggctggcagcgtagcccgcctgtactgggagtggcaaacccaggcggcgttaaacacggtcttgcagcaaatcgaaaaagagcagaacaccattatcgcgaccgatcgccagctatatcagaacgggattacttcttcagttgaaggtgtggaaaccgatattaatgccagcaaaacccggcagcagctcaacgatgtcgcgggtaaaatgaaaattattgaggcacggttaaatgcactcacaaatcaccagacaaagtcactgaagcttaaaccggtcgcgttgccgaaagtggcaagccagcttcctgatgaactggggtactccttactggcgcggcgggcagatttgcaggcggcgcactggtacgttgagtcatcgttaagcactattgatgcggcaaaagcggcattttatcctgacatcaacctgatggccttcctgcaacaggatgcgttgcacttaagcgatctgttccgtcattccgcgcagcaaatgggcgttacggcaggcctgacgctacccattttcgatagtggtcgtcttaacgccaacctcgatatcgcaaaagccgaaagcaacttgtctatcgccagctacaacaaagcggtggttgaagcggtgaatgacgtggcgcgggcagccagtcaggttcagacactggcggagaaaaaccagcatcaggcgcaaattgagcgcgatgccttgcgtgtagtaggtcttgcgcaggcccgctttaacgcgggcctcattgctggttcccgggtcagcgaagccagaatcccggcgctgcgtgagcgggccaatggcctgttattgcaagggcagtggctggatgcctccattcaactcactggtgcgctgggcggggggtacaaacgctga

SEQ ID NO: 5210 - protein, 508 aa, Escherichia coli
MLLMYCHAKLKNISQHTVISAHLFLPDYSPMNRDSFYPAIACFPLLLMLAGCAPMHETRQVLSQQTPAAQVDTVLPTALKNGWPDSQWWLEYHDNQLTSLINNALQSAPDMQVAEQRIQLAEAQAKAIATQDGPQLDFSADMERQKMSAEGLMGPFALNDPAAGTTGPWYTNGTFGLTAGWHLDIWGKNRAEVTARLGTVKARAAEREQTRQLLAGSVARLYWEWQTQAALNTVLQQIEKEQNTIIATDRQLYQNGITSSVEGVETDINASKTRQQLNDVAGKMKIIEARLNALTNHQTKSLKLKPVALPKVASQLPDELGYSLLARRADLQAAHWYVESSLSTIDAAKAAFYPDINLMAFLQQDALHLSDLFRHSAQQMGVTAGLTLPIFDSGRLNANLDIAKAESNLSIASYNKAVVEAVNDVARAASQVQTLAEKNQHQAQIERDALRVVGLAQARFNAGLIAGSRVSEARIPALRERANGLLLQGQWLDASIQLTGALGGGYKR

SEQ ID NO: 5211 - DNA, 1017 bp, Escherichia coli
ttgcagacctttaatccgttgaccggaggcgctaacatagcgcctcatttttttgcgggtgatgatatgcgtgtgttactggctccgatggagggtgtacttgactctttggtgcgggaattactgaccgaagttaacgactacgatctgtgcatcaccgagtttgtccgcgtggtggatcaactgctgccagtaaaagtctttcatcgcatttgccctgagctacaaaatgccagccggacaccatccggtacgctggtgcgcgtgcagttgttagggcagttcccacagtggctggcagagaacgccgcccgtgcggtggagttaggctcctggggcgtggatcttaactgcggctgcccgtcgaaaacggttaacggtagcggtggtggggcaacgttactgaaagatcctgaactcatctaccagggtgcaaaagcgatgcgcgaagctgtaccggcgcatttgcctgtcagcgtaaaagtgcgtctgggctgggacagcggtgagaagaaatttgaaatcgccgatgcggttcaacaggctggtgctacggagctggtagtacatgggcggacaaaagagcagggttaccgcgcggaacatattgactggcaggcgattggcgagattcgccagcggcttaatattccggtgattgccaacggtgaaatctgggactggcagagtgcgcaacaatgcatggcgatcagcggctgcgacgcagtgatgattggtcgcggggcgctcaatattcccaacctgagccgtgtggtgaaatataacgaaccgcgaatgccgtggccggaggtggttgctttgctgcaaaaatatacccgtctggaaaagcagggcgataccgggttatatcacgttgcgcggattaaacagtggttgagttatttgcgtaaagaatacgatgaagcaacggaattatttcagcatgttcgggtgttgaataattcccctgatattgcaagggctattcaggccattgatatcgataagctgcgataa

SEQ ID NO: 5212 - protein, 338 aa, Escherichia coli
MQTFNPLTGGANIAPHFFAGDDMRVLLAPMEGVLDSLVRELLTEVNDYDLCITEFVRVVDQLLPVKVFHRICPELQNASRTPSGTLVRVQLLGQFPQWLAENAARAVELGSWGVDLNCGCPSKTVNGSGGGATLLKDPELIYQGAKAMREAVPAHLPVSVKVRLGWDSGEKKFEIADAVQQAGATELVVHGRTKEQGYRAEHIDWQAIGEIRQRLNIPVIANGEIWDWQSAQQCMAISGCDAVMIGRGALNIPNLSRVVKYNEPRMPWPEVVALLQKYTRLEKQGDTGLYHVARIKQWLSYLRKEYDEATELFQHVRVLNNSPDIARAIQAIDIDKLR

SEQ ID NO: 5213 - DNA, 435 bp, Escherichia coli
ttgtatgatgaatccatctcatctggggtgttgattatgagtaagacactgaacattatctggcaatatttacgcgctttcgtcctgatttatgcctgcctgtatgcaggcattttcattgcttccctgctaccggtaaccattccgggcagcatcatcgggatgctgatcctgtttgtcctgctggccttgcaaattcttccggcgaaatgggtcaatccggggtgctacgtactgattcgctatatggcgctattgtttgtgccgattggcgtaggcgtcatgcaatattttgatttgctccgcgcacagtttggtccggtagtggtttcctgtgcagtcagtacgctggtggtttttctggtggtgagctggagttcacaactggtgcacggtgaacgtaaagtcgtaggtcagaaaggatcagaagaatga

SEQ ID NO: 5214 - protein, 144 aa, Escherichia coli
MYDESISSGVLIMSKTLNIIWQYLRAFVLIYACLYAGIFIASLLPVTIPGSIIGMLILFVLLALQILPAKWVNPGCYVLIRYMALLFVPIGVGVMQYFDLLRAQFGPVVVSCAVSTLVVFLVVSWSSQLVHGERKVVGQKGSEE

SEQ ID NO: 5215 - DNA, 696 bp, Escherichia coli
atgatggcgaatatctggtggtcattaccgctgacgttgattgtcttttttgccgcccgcaaactggcggcacggtataagtttcccctgcttaacccgttgctggtagcaatggtggtgatcattccttttttaatgctgactggcatctcttacgacagctactttaaaggtagcgaagtgctaaacgatctgctgcaaccggcggtcgtcgcactggcttatcctttatatgagcagctacaccagatccgcgcgcgctggaaatcgatcatcaccatctgttttatcggcagcgtggttgcgatggtgacggggacttccgtggcattgttgatgggcgcttcaccggaaatcgccgcgtcaatcctgccgaaatcagttaccacgcctattgcaatggcggttggcggcagtattggcggtattccggcaatcagcgcagtttgcgtgattttcgtcggcatcctcggcgctgtgtttggccatacattgcttaatgcgatgcgtattcgtaccaaagctgcgcgcggtctggcaatgggcacagcctcgcacgccctcggtacggcgcgctgcgccgagctggattatcaggaaggtgcatttagttcgctggcgctggtgttatgcgggattattacttcgctgatcgcaccgttccttttcccgattattctggcagtaatgggctaa

SEQ ID NO: 5216 - protein, 231 aa, Escherichia coli
MMANIWWSLPLTLIVFFAARKLAARYKFPLLNPLLVAMVVIIPFLMLTGISYDSYFKGSEVLNDLLQPAVVALAYPLYEQLHQIRARWKSIITICFIGSVVAMVTGTSVALLMGASPEIAASILPKSVTTPIAMAVGGSIGGIPAISAVCVIFVGILGAVFGHTLLNAMRIRTKAARGLAMGTASHALGTARCAELDYQEGAFSSLALVLCGIITSLIAPFLFPIILAVMG

SEQ ID NO: 5217 - DNA, 885 bp, Escherichia coli
atgcatccacgttttcaaaccgcttttgcccaacttgcggataacttgcaatctgcactggaacctattctggcagacaagtacttccccgctttgttgaccggggagcaagtctcatcgctgaagagcgcaacggggctggacgaagacgcgctggcattcgcactacttccgctggcggcagcctgtgcgcgtacgccattgtcgaattttaatgttggcgcaattgcgcgcggtgtgagcggaacctggtatttcggtgccaatatggaatttattggtgcgacaatgcagcaaaccgttcatgccgaacaaagcgcgatcagccacgcctggctgagtggtgaaaaagcgcttgcagccatcaccgttaactacacgccttgtggtcactgccgtcagtttatgaatgaactgaacagcggtctggatctgcgtattcatcttccgggacgcgaggcacacgcgctgcgtgactatctaccggatgcctttgggccgaaagatctggagattaaaacgctgctgatggacgagcaggatcacggctatgcgctgactggtgatgcgctttctcaggcggcgattgcggcggcaaaccgttcgcacatgccttacagtaagtcgccaagcggtgtcgcgctggaatgtaaagacggtcgtattttcagcggcagctacgctgaaaacgccgcattcaacccgactctgccgccgttgcagggggcgttaattctgttgaatctcaagggttatgattacccggatatccagcgcgcggttctggcagaaaaagccgatgcgccgttgattcagtgggatgccacctccgcaacgctgaaagctctcggctgtcacaatatcgaccgcgtgcttctcgcttaa

SEQ ID NO: 5218 - protein, 294 aa, Escherichia coli
MHPRFQTAFAQLADNLQSALEPILADKYFPALLTGEQVSSLKSATGLDEDALAFALLPLAAACARTPLSNFNVGAIARGVSGTWYFGANMEFIGATMQQTVHAEQSAISHAWLSGEKALAAITVNYTPCGHCRQFMNELNSGLDLRIHLPGREAHALRDYLPDAFGPKDLEIKTLLMDEQDHGYALTGDALSQAAIAAANRSHMPYSKSPSGVALECKDGRIFSGSYAENAAFNPTLPPLQGALILLNLKGYDYPDIQRAVLAEKADAPLIQWDATSATLKALGCHNIDRVLLA

SEQ ID NO: 5219 - DNA, 720 bp, Escherichia coli
atgttaaagcgcgtgttcctcagcctgttagtcctgatcggcttgctgctgttgactgtgctcggcctcgatcgctggatgagctggaaaaccgcgccttatatctacgacgaattgcaggatctcccctaccgccaggtcggtgtggtgctcggcacagcaaaatattatcggactggcgtaattaatcagtattatcgctaccgcattcaaggagcgattaatgcctataacagcggtaaggtaaattatctattactgagcggcgataacgcattgcaaagttataatgagccgatgaccatgcgcaaagatttaatcgcagctggtgtcgacccatcagatattgttctcgattacgcaggctttcgtacgctggattccatcgtgcgtacacgcaaagttttcgatactaatgatttcattattatcacccaacgtttccactgtgagcgggcattatttattgcgctgcatatggggattcaggctcagtgttatgccgtaccgtcaccgaaagatatgctgtcagtacgtattcgcgaatttgccgcccgtttcggtgcgctggctgacctttatatttttaaacgtgaaccgcgttttttagggccgctggtccctattccggctatgcaccaggtgccggaagatgcgcaggggtatcccgccgtcacacccgaacagttacttgaattacaaaagaaacaaggaaagtag

SEQ ID NO: 5220 - protein, 239 aa, Escherichia coli
MLKRVFLSLLVLIGLLLLTVLGLDRWMSWKTAPYIYDELQDLPYRQVGVVLGTAKYYRTGVINQYYRYRIQGAINAYNSGKVNYLLLSGDNALQSYNEPMTMRKDLIAAGVDPSDIVLDYAGFRTLDSIVRTRKVFDTNDFIIITQRFHCERALFIALHMGIQAQCYAVPSPKDMLSVRIREFAARFGALADLYIFKREPRFLGPLVPIPAMHQVPEDAQGYPAVTPEQLLELQKKQGK

SEQ ID NO: 5221 - DNA, 240 bp, Escherichia coli
atggatgtacagcagttttttgtcgttgccgtttttttccttatcccgatattttgtttccgcgaagcatggaaaggctggcgcgcaggcgcgattgataaacgggttaaaaatgcaccggaaccggtgtatgtctggcgagcgaaaaatcccggactcttcttcgcttatatggtggcatatatcggcttcggaattttatctatcggcatgattgtttatcttattttctatcgttaa

SEQ ID NO: 5222 - protein, 79 aa, Escherichia coli
MDVQQFFVVAVFFLIPIFCFREAWKGWRAGAIDKRVKNAPEPVYVWRAKNPGLFFAYMVAYIGFGILSIGMIVYLIFYR

SEQ ID NO: 5223 - DNA, 1239 bp, Escherichia coli
atgccgcaacaaaattatctggatgaactcactccggcttttacgcctttactggcgattaaagaagcctctcgctgtttattatgtcatgacgctccctgtagtcaggcttgcccggcacagaccgatccggggaaatttattcgctcaatctactttcgtaattttaaaggcgctgccgagacaattcgcgaaaataatgccctcggtgccgtttgtgccagagtgtgcccgacggagaaattatgccaaagcggttgtacacgtgccggtgttgatgctcccattgatatcggtcgcttacagcgttttgttactgattttgaacaacaaactgggatggaaatttatcagcccggtactaaaacgctcggcaaagtcgccattattggcgcaggtcctgccggattgcaggccagtgtgacgctgacaaaccagggttatgacgtcacgatctatgagaaagaagcacaacccggtggctggttgcgtaacggcattccgcaattccggttaccgcaatcggtgctggatgcagaaatcgcccgtatagaaaaaatgggcgtgaccattaagtgcaataacgaaatcggtaaaacacttaccctggagcagctgaaagcggaaaaccgcgcggtactggtcaccgtagggttatcgagcggttccgggttatcgctgtttgagcatagcgacgttgagattgccgtcgacttcctgcaacgtgcacgacaggcgcaaggcgatatcagcattccacaaagcgcattaattatcggcggcggtgatgtcgcgatggacgtagccagcacgctgaaagttctcggctgtcaggcggtaacctgcgtagcgcgtgaagagttagatgagtttccggcaagcgaaaaagagtttaccagcgccagagagctgggcgtttcgatcatcgatggatttacaccagtagccgtggaaggcaataaagtcacctttaagcatgttcgtttaccgggtgaactaacgatagcggcggacaaaattattctcgctgtaggtcaacatgccgaacttgctgctttttccgcactggaaccgcaacgtaacaccatcgaaacgcaacattaccagacccgcgacccgcaagtctttgctgctggcgatattgttgagggtgacaaaaccgtggtctatgcagtgaaaaccgggaaagaagccgccggggcgattcatcactatttagagggagcttgctcatgttaa

SEQ ID NO: 5224 - protein, 412 aa, Escherichia coli
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAQPGGWLRNGIPQFRLPQSVLDAEIARIEKMGVTIKCNNEIGKTLTLEQLKAENRAVLVTVGLSSGSGLSLFEHSDVEIAVDFLQRARQAQGDISIPQSALIIGGGDVAMDVASTLKVLGCQAVTCVAREELDEFPASEKEFTSARELGVSIIDGFTPVAVEGNKVTFKHVRLPGELTIAADKIILAVGQHAELAAFSALEPQRNTIETQHYQTRDPQVFAAGDIVEGDKTVVYAVKTGKEAAGAIHHYLEGACSC

SEQ ID NO: 5225 - DNA, 1236 bp, Escherichia coli
atgttaacgaaagatctttcgattactttttgcggcgtgaagtttcccaacccgttctgcctttcttcttcgccggtaggcaactgctatgagatgtgcgccaaagcctacgacacaggttggggcggcgtggtgtttaaaacgatcggtttttttatcgccaacgaagtctcgccgcgttttgatcatctggtgaaagaagataccggttttatcggcttcaaaaatatggagcagattgctgaacatccgttggaagagaatctggccgccctgcgtcggctgaaagaagattacccggacaaagtattgatcgcttcaatcatgggcgaaaatgagcagcaatgggaagagctggcgcgtctggtgcaagaagctggcgcggatatgatcgagtgtaacttctcctgtccgcaaatgacttctcatgcgatgggtagcgatgtcgggcaaagcccggagctggtagaaaaatattgtcgggcagtaaaacgtggttccacgctgccaatgctggcgaagatgacgccgaatattggtgatatgtgcgaagtggcgctggcggcgaagcgcggcggcgcagatggcattgcggcgattaacaccgttaaatccatcaccaatatcgatcttaatcagaaaattggtatgccgatcgttaacggtaaatcgagtatttccggatattccggtaaagcggtaaaaccgatcgccctacgctttattcagcaaatgcgcacccatccagaactgcgcgatttcccgatcagcggtatcggcggcattgaaacctgggaagatgcggcggagtttttattgctcggcgcagcgacgttgcaggtgaccaccggcattatgcagtacgggtatcggatagtggaagatatggcaagcgggttgtcgcattatctcgccgatcaagggtttgattcgttgcaggagatggtgggtctggcgaatcacaatattgtcccggcggaagatttagaccgcagttatattgtctatccccatatcaatcttgataaatgtgttggctgtggacgctgttatatttcctgttacgacggcggtcaccaggcgatggaatggagcgagaaaacccgcacaccgcattgtaataccgagaaatgcgtgggttgtctgctttgtggtcatgtctgcccggtaggttgtattgatcttggggaagtgaagtttaagaaaggcgagaaagaacacccggtaacgttgtaa

SEQ ID NO: 5226 - protein, 411 aa, Escherichia coli
MLTKDLSITFCGVKFPNPFCLSSSPVGNCYEMCAKAYDTGWGGVVFKTIGFFIANEVSPRFDHLVKEDTGFIGFKNMEQIAEHPLEENLAALRRLKEDYPDKVLIASIMGENEQQWEELARLVQEAGADMIECNFSCPQMTSHAMGSDVGQSPELVEKYCRAVKRGSTLPMLAKMTPNIGDMCEVALAAKRGGADGIAAINTVKSITNIDLNQKIGMPIVNGKSSISGYSGKAVKPIALRFIQQMRTHPELRDFPISGIGGIETWEDAAEFLLLGAATLQVTTGIMQYGYRIVEDMASGLSHYLADQGFDSLQEMVGLANHNIVPAEDLDRSYIVYPHINLDKCVGCGRCYISCYDGGHQAMEWSEKTRTPHCNTEKCVGCLLCGHVCPVGCIDLGEVKFKKGEKEHPVTL

SEQ ID NO: 5227 - DNA, 120 bp, Escherichia coli
gtgaacgccttacccggcatacaaaacaatataaatcagtatgttgtgctcattgtaggccggataaaacgcgccagcgttgcatccggcatttggttcctgtcgccggatgcggcgtaa

SEQ ID NO: 5228 - protein, 39 aa, Escherichia coli
MNALPGIQNNINQYVVLIVGRIKRASVASGIWFLSPDAA

SEQ ID NO: 5229 - DNA, 1011 bp, Escherichia coli
atgagtgcgttaaataagaaaagttttcttacttacctgaaagagggcggtatttacgtcgttcttttagttttgctggcgattattattttccaggacccaacatttttaagtctgttgaacttaagtaatattctcacccagtcatcggtgcgtattattatcgcgcttggtgtggcagggttaattgtcacccaggggactgacctttccgcaggtcgccaggtggggctggcggcagtagtagcagcgacgttattgcagtccatggataacgccaacaaagtgttcccggaaatggcgacgatgccgattgcgctggttattctgattgtctgtgccattggtgcggttatcggtttgatcaacgggctgattatcgcctatctcaacgtgacgccgttcattaccacgctcggcacgatgattatcgtctacggcattaactcgctctattacgactttgtcggggcgtcgccaatttccggttttgacagcggcttctctacctttgctcagggctttgtcgcgctggggagtttccgtctctcttacatcaccttctacgcgttgattgcggtggtgtttgtctgggtgttatggaacaaaacccgcttcggcaagaacatttttgccattggcggtaacccggaagcggcgaaagtatctggtgtcaacgtcggcctgaacctgctgatgatttacgcgttgtctggtgtgttctatgccttcggcgggatgttagaagccggacgtatcggctcagccaccaacaacctcggctttatgtatgagctggatgctatcgcggcgtgcgtggtaggcggcgtatcgttcagcggcggtgtggggacggtaattggtgtggtgaccggggtgattatttttaccgtcatcaactatggtctgacgtacatcggcgtaaacccgtactggcagtacatcatcaaaggggcgattattatcttcgccgtggcgctggattcactgaaatacgcgcgtaagaagtga

SEQ ID NO: 5230 - protein, 336 aa, Escherichia coli
MSALNKKSFLTYLKEGGIYVVLLVLLAIIIFQDPTFLSLLNLSNILTQSSVRIIIALGVAGLIVTQGTDLSAGRQVGLAAVVAATLLQSMDNANKVFPEMATMPIALVILIVCAIGAVIGLINGLIIAYLNVTPFITTLGTMIIVYGINSLYYDFVGASPISGFDSGFSTFAQGFVALGSFRLSYITFYALIAVVFVWVLWNKTRFGKNIFAIGGNPEAAKVSGVNVGLNLLMIYALSGVFYAFGGMLEAGRIGSATNNLGFMYELDAIAACVVGGVSFSGGVGTVIGVVTGVIIFTVINYGLTYIGVNPYWQYIIKGAIIIFAVALDSLKYARKK

SEQ ID NO: 5231 - DNA, 1485 bp, Escherichia coli
ttgttggaaatgagcggtatcaacaagtcttttcctggtgttaaggcacttgataacgttaatttaaaagtccgaccacattctatccatgcattaatgggggaaaacggtgcaggaaaatcgacattattaaaatgcctgtttggtatttatcaaaaagactccggcaccattttattccagggtaaagagatcgatttccattccgccaaagaagcactggaaaatggtatttcgatggtacaccaggagttaaacctggtattacaacgttcggtgatggacaacatgtggctggggcgatatcccaccaaaggcatgtttgtcgatcaggacaaaatgtaccgcgaaaccaaagcgatttttgatgaactggatattgatatcgatccgcgtgcgcgcgtcggtacattatctgtttcgcaaatgcagatgatcgaaattgccaaagcgttttcctataacgcgaaaattgtgattatggatgaaccgacttcttcgttaaccgaaaaagaggtcaatcatctgttcactattattcgtaaattaaaagagcgcggctgcggtattgtttatatctcgcataaaatggaagaaatcttccagttatgtgatgaagttaccgtattgcgcgacggtcagtggatcgctaccgaaccgctggcagggctgacgatggacaagatcatcgccatgatggttgggcgttctcttaaccagcgtttccctgacaaagaaaacaagccgggcgaagtgattctggaagtgcgtaacctgacgtcgctgcgccagccgtcgattcgcgatgtctcgtttgatctgcataaaggggagattctcggtatagccggtctggtgggagcgaaacgtaccgatattgttgagacgttatttggtattcgcgagaaatcggctggcaccattacgttgcacggcaaaaagatcaataaccataatgccaacgaagccataaaccacggatttgcactggtaactgaagagcgccgctcaacgggaatttatgcctatctggatattggctttaactcgttaatttccaatatccgcaactataaaaataaagttggtttactggataactcgcggatgaaaagcgatacccagtgggtgattgattcaatgcgggtaaaaacaccggggcatcggacgcaaattggttcgctctccggtggtaatcagcaaaaagtgattattggtcgctggctgttaacgcaaccagaaatattaatgctcgatgaaccgacacgcggtattgatgttggggctaagtttgagatttatcagttaattgccgaactggcgaagaaaggcaaggggattattattatctcctccgaaatgccagagttgttagggataacagaccgtattctggtcatgagcaatggtctcgtttccggaattgtcgatacaaaaacaacaacgcaaagcgaaattctgcgtcttgcgtctttgcacctttaa

SEQ ID NO: 5232 - protein, 494 aa, Escherichia coli
MLEMSGINKSFPGVKALDNVNLKVRPHSIHALMGENGAGKSTLLKCLFGIYQKDSGTILFQGKEIDFHSAKEALENGISMVHQELNLVLQRSVMDNMWLGRYPTKGMFVDQDKMYRETKAIFDELDIDIDPRARVGTLSVSQMQMIEIAKAFSYNAKIVIMDEPTSSLTEKEVNHLFTIIRKLKERGCGIVYISHKMEEIFQLCDEVTVLRDGQWIATEPLAGLTMDKIIAMMVGRSLNQRFPDKENKPGEVILEVRNLTSLRQPSIRDVSFDLHKGEILGIAGLVGAKRTDIVETLFGIREKSAGTITLHGKKINNHNANEAINHGFALVTEERRSTGIYAYLDIGFNSLISNIRNYKNKVGLLDNSRMKSDTQWVIDSMRVKTPGHRTQIGSLSGGNQQKVIIGRWLLTQPEILMLDEPTRGIDVGAKFEIYQLIAELAKKGKGIIIISSEMPELLGITDRILVMSNGLVSGIVDTKTTTQSEILRLASLHL

SEQ ID NO: 5233 - DNA, 999 bp, Escherichia coli
atgaataagaaggtgttaaccctgtctgctgtgatggccagcatgttattcggtgccgctgcacacgctgctgatactcgcattggtgtaacaatctataagtacgacgataactttatgtctgtagtgcgcaaggctattgagcaagatgcgaaagccgcgccagatgttcagctgctgatgaatgattctcagaatgaccagtccaagcagaacgatcagatcgacgtattgctggcgaaaggggtgaaggcactggcaatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactccaaagagtccggcattattcagggcgatttgattgctaaacactgggcggcgaatcagggttgggatctgaacaaagacggtcagattcaattcgtactgctgaaaggtgagccggggcatccggatgcagaagcacgtaccacttacgtgattaaagaattgaacgacaaaggcattaaaactgaacagttacagttagataccgctatgtgggataccgctcaggcgaaagataagatggacgcctggctgtctggcccgaacgccaacaaaatcgaggtggttatcgccaacaacgacgcgatggcaatgggcgcggtagaagcactgaaagcacacaataagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggcaaaggtgcggctgatggcaccaactggaaaatcgacaacaaagtggtccgcgtaccttatgttggcgtagataaagacaacctggctgaattcagcaagaaataa

SEQ ID NO: 5234 - protein, 332 aa, Escherichia coli
MNKKVLTLSAVMASMLFGAAAHAADTRIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSKK

SEQ ID NO: 5235 - DNA, 1041 bp, Escherichia coli
atgatcaccattcgtgatgtagcgcgtcaggctggcgtctctgtggcaacggtttcccgggtgctcaataacagcacgctggtcagtgccgatacgcgtgaggcagtaatgaaagctgtgagtgagctggattatcggccaaacgccaatgcccaggcgctggcaactcaggttagcgataccattggcgtggtggtgatggacgtttctgatgcgtttttcggcgcgctggtaaaagcggtggatctggtcgcccagcagcatcagaaatacgtgctaatcggcaatagctatcatgaagcggaaaaagagcgtcacgccattgaggtgttaattcgccagcgttgtaatgcgttgattgttcactcaaaagcattgagtgacgatgaactggcacaatttatggataacattcccggtatggtgttaatcaaccgcgttgtgccggggtacgcccatcgttgcgtttgcctggataatctcagcggtgcccgaatggcgacgcgcatgttgctgaataacggtcatcaacgtattggttatctttcttccagccacggcattgaagatgacgccatgcgtaaagcaggctggatgagtgcgttgaaagagcaggatattattccgccggaaagctggattggcactggcacgccggacatgccgggcggtgaggcggcgatggttgaactgctggggcgcaatctacaactaaccgctgtatttgcttacaacgacaatatggccgctggcgcactgacagcattaaaagataatggcattgcgattccgttacatctctcaatcattggtttcgatgatattcccatcgcccgttacaccgacccgcaattaacgactgtgcgttatcccattgcttcaatggctaaattagctaccgaactggccttgcagggggcagcagacaatattgatcctcgtgccagccactgttttatgccgacgttagtgcgtcgccattctgtcgcaacacgccagaatgcggcggcgatcactaactcaacaaatcaggcgatgtaa

SEQ ID NO: 5236 - protein, 346 aa, Escherichia coli
MITIRDVARQAGVSVATVSRVLNNSTLVSADTREAVMKAVSELDYRPNANAQALATQVSDTIGVVVMDVSDAFFGALVKAVDLVAQQHQKYVLIGNSYHEAEKERHAIEVLIRQRCNALIVHSKALSDDELAQFMDNIPGMVLINRVVPGYAHRCVCLDNLSGARMATRMLLNNGHQRIGYLSSSHGIEDDAMRKAGWMSALKEQDIIPPESWIGTGTPDMPGGEAAMVELLGRNLQLTAVFAYNDNMAAGALTALKDNGIAIPLHLSIIGFDDIPIARYTDPQLTTVRYPIASMAKLATELALQGAADNIDPRASHCFMPTLVRRHSVATRQNAAAITNSTNQAM

SEQ ID NO: 5237 - DNA, 1242 bp, Escherichia coli
gtggattgttcaaatccagtcagaatacgcgccacgagtttctgcgcgctgtgcgtcatcacaactgataaaaaggcaggaaccgtggagcgcaacgtcacgctcgattttgttcgcggcgtcgccattctggggatcctgctattaaacatcagcgcctttgggctaccaaaggcggcttatctcaatcccgcctggtacggcgctattacgccacaggatgcatggacctgggcatttctcgatctcatcggccaggtgaaattcctcacgctttttgcgctgttgtttggtgcgggcctgcaaatgttgctgccccgtggcagacgatggatccagtcgcggttaacgctgttagtcttgctgggctttattcacggtttattgttctgggacggcgatattctgctggcttacgggctggtgggcttaatctgctggcggctggtgcgcgatgcgccatcggtaaaaagcctgtttaataccggcgtcatgctttatctggtggggcttggcgttttgctgttattggggttgatttccgatagccagaccagccgcgcctggacacctgatgcatcggctattttgtatgaaaagcactggaaacttcacggtggtgttgaagcgatcagtaatcgtgccgatggtgttggcaacagtttactggcactgggcgcacagtatggctggcaactggcagggatgatgctcattggtgccgcattgatgcgcagtggctggctgaaagggcagttcagcttacgtcactatcgtcgtactggttttgtgctggtggcgattggagtgatcattaaccttcctgccatcgccctgcaatggcgactggactgggcgtatcgttggtgcgccttcttacttcagatgccgcgggaactgagtgcgccgtttcaggcgattggctatgcgtcgctgttttatggcttctggccgcaattaagccgctttaagctggtgctggcaatcgcctgtgtcggacggatggcactgaccaactatctattgcaaacgctgatttgtactacgcttttttaccacctcggtttgtttatgcagtttgaccgtctggagctgctggcgtttgttattccggtatggttggcgaatatcttcttctctgttatctggctgcgttacttccgccaggggccggtggaatggctctggcgtcagttaactttgcgtgctgccggaccgacaatatctaaaacatcaagataa

SEQ ID NO: 5238 - protein, 413 aa, Escherichia coli
MDCSNPVRIRATSFCALCVITTDKKAGTVERNVTLDFVRGVAILGILLLNISAFGLPKAAYLNPAWYGAITPQDAWTWAFLDLIGQVKFLTLFALLFGAGLQMLLPRGRRWIQSRLTLLVLLGFIHGLLFWDGDILLAYGLVGLICWRLVRDAPSVKSLFNTGVMLYLVGLGVLLLLGLISDSQTSRAWTPDASAILYEKHWKLHGGVEAISNRADGVGNSLLALGAQYGWQLAGMMLIGAALMRSGWLKGQFSLRHYRRTGFVLVAIGVIINLPAIALQWRLDWAYRWCAFLLQMPRELSAPFQAIGYASLFYGFWPQLSRFKLVLAIACVGRMALTNYLLQTLICTTLFYHLGLFMQFDRLELLAFVIPVWLANIFFSVIWLRYFRQGPVEWLWRQLTLRAAGPTISKTSR

SEQ ID NO: 5239 - DNA, 204 bp, Escherichia coli
atggtgatcatattcactacctgttatgagattgcagtaaatgactgcttgctggcggctattttgtcagcactgaatacaggacttcgtgaatcgagtcacagcaatggaaacggttacagccgttttgttaacgaatgtgatccagatcgttatcttgatgttttagatattgtcggtccggcagcacgcaaagttaactga

SEQ ID NO: 5240 - protein, 67 aa, Escherichia coli
MVIIFTTCYEIAVNDCLLAAILSALNTGLRESSHSNGNGYSRFVNECDPDRYLDVLDIVGPAARKVN

SEQ ID NO: 5241 - DNA, 669 bp, Escherichia coli
atgccatcactcagtaaagaagcggccctggttcatgaagcgttagttgcgcgaggactggaaacaccgctgcgcccgcccgtgcatgaaatggataacgaaacgcgcaaaagccttattgctggtcatatgaccgaaatcatgcagctgctgaatctcgacctggctgatgacagtttgatggaaacgccgcatcgcatcgctaaaatgtatgtcgatgaaattttctccggtctggattacgccaatttcccgaaaatcaccctcattgaaaacaaaatgaaggtcgatgaaatggtcaccgtgcgcgatatcactctgaccagcacctgtgaacaccattttgttaccatcgatggcaaagcgacggtggcctatatcccgaaagattcggtcattggtctgtcaaaaattaaccgtattgtgcagttctttgcccagcgtccgcaggtgcaggaacgtctgacgcagcaaattctcattgcgctacaaacgctgctgggcaccaataatgtggctgtctctatcgacgcggtgcattactgcgtgaaggcgcgtggcatccgcgatgcaaccagtgccacgacaacgacctctcttggtggattgttcaaatccagtcagaatacgcgccacgagtttctgcgcgctgtgcgtcatcacaactga

SEQ ID NO: 5242 - protein, 222 aa, Escherichia coli
MPSLSKEAALVHEALVARGLETPLRPPVHEMDNETRKSLIAGHMTEIMQLLNLDLADDSLMETPHRIAKMYVDEIFSGLDYANFPKITLIENKMKVDEMVTVRDITLTSTCEHHFVTIDGKATVAYIPKDSVIGLSKINRIVQFFAQRPQVQERLTQQILIALQTLLGTNNVAVSIDAVHYCVKARGIRDATSATTTTSLGGLFKSSQNTRHEFLRAVRHHN

SEQ ID NO: 5243 - DNA, 837 bp, Escherichia coli
atggaaatgctcgaagagcaccgctgttttgaaggctggcagcaacgctggcgacacgactccagtaccttaaactgcccgatgacgttcagtatctttctcccaccacctcgtgatcacaccccgccaccagtgctgtactggctttccggattaacctgcaatgacgagaacttcaccaccaaggcgggtgcccagcgcgtggcggcggaactggggattgtactggtgatgccagacaccagcccgcgcggcgaacaggttgccaacgacgatggctacgatttaggccagggcgcggggttttatcttaacgccacgcaaccaccgtgggcgacacattaccggatgtatgattatctgcgcgatgaattaccggcgctgattcagtcgcaatttaatgtcagcgaccgctgcgccattagcggtcattccatgggtggtcacggtgcactgattatggcgctgaaaaatccgggtaaatacaccagcgtttccgcctttgcgccaattgtgaatccgtgcagcgtcccgtggggaatcaaagcgtttagcacttatttaggtgaggacaaaaatgcatggctggaatgggacagttgcgcgttgatgtatgccagtaacgcgcaggatgcaatcccgacgcttattgatcagggtgataatgatcagtttcttgctgaccaactgcaacctgcagtactggcagaagccgcgcgccagaaagcgtggccgatgacgctgcgtattcagccgggatatgatcacagttactacttcatcgcctcttttatagaggatcacctgcgcttccatgcgcagtatttactgaagtga

SEQ ID NO: 5244 - protein, 278 aa, Escherichia coli
MEMLEEHRCFEGWQQRWRHDSSTLNCPMTFSIFLPPPRDHTPPPVLYWLSGLTCNDENFTTKAGAQRVAAELGIVLVMPDTSPRGEQVANDDGYDLGQGAGFYLNATQPPWATHYRMYDYLRDELPALIQSQFNVSDRCAISGHSMGGHGALIMALKNPGKYTSVSAFAPIVNPCSVPWGIKAFSTYLGEDKNAWLEWDSCALMYASNAQDAIPTLIDQGDNDQFLADQLQPAVLAEAARQKAWPMTLRIQPGYDHSYYFIASFIEDHLRFHAQYLLK

SEQ ID NO: 5245 - DNA, 2187 bp, Escherichia coli
ttgataattgttatcgtttgcattatcgttacgccgcaatcaaaaaaggctgacaaatcagaggctgttccggctttctgggatgatcacctgcatacaaataagtccaccgcgatgctgccgtacgcaaggggacgtaaagaagatgtgagcgatacccattttattttcgtagttacctcatggagatatggaatgtttaggttgaaccctttcgtacgggtcgggctgtgtttgtccgctatttcttgtgcatggcctgtgttagcggtcgatgatgatggcgaaacgatggttgtcactgcatcttccgttgaacaaaaccttaaagatgctcccgccagtatcagcgtcattacccaggaagacctgcagcgaaaaccggtacagaatctgaaggatgtcctcaaagaagtgcctggcgtacaactgacgaacgaaggggataaccgtaagggcgtaagtattcgtggtctggacagcagctacaccctgattcttgtcgacggtaaacgcgttaactcccgcaatgccgtcttccgccacaatgatttcgatctgaactggatcccggtcgattccatcgaacgtattgaagtggtccgtggcccgatgtcgtcgctgtacggttccgatgcgctcggcggtgtagtgaatatcatcaccaaaaaaatcggtcagaaatggtcgggcaccgttaccgtcgataccaccgttcaggaacatcgcgatcgcggtgatacctataacggtcaattctttaccagcggaccattaattgacggcgtgctgggaatgaaagcttacggcagcctggcaaaacgtgaaaaggatgacccgcaaaactcaacgaccaccgataccggagaaacgccgcgtattgaaggattctccagccgcgacggcaatgtcgaatttgcctggacaccgaatcaaaatcacgattttactgccggatacggtttcgaccgtcaggatcgtgattccgactcgctggacaaaaaccgcctggaacgccagaactactccgtcagccataatgggcgttgggattacggcaccagcgaactgaaatactacggtgagaaagtcgagaacaaaaaccctggcaacagcagcccgataacttccgaaagcaatacggtcgacggcaaatacacgttgccgctgacggcgattaatcagtttctcacggttggcggtgaatggcgtcacgacaaacttagcgatgcggtgaacctgaccgggggaaccagctccaaaacgtctgccagccagtacgcgctgtttgtggaagatgaatggcggatcttcgagccgctggcgctgacgaccggcgtgcgtatggacgatcacgaaacctacggtgaacactggagtccgcgtgcctacctggtttataacgccaccgacaccgtaacggtgaaagggggctgggcgacggcatttaaagccccttctctgttgcaacttagccctgactggacgagcaattcctgccgtggcgcatgtaagattgtgggtagcccggatctgaaaccagaaaccagcgaaagttgggagctggggctttactacatgggtgaagaaggctggctggaaggggttgaatccagcgttaccgttttccgtaacgatgtgaaagatcgtatcagcattagccgtacgtctgacgtcaatgctgcaccgggctaccaaaactttgtcggttttgagacgggcgctaacggacggcgcataccggtatttagctactacaacgttaacaaagctcgtattcagggcgtggaaaccgaactgaaaattccgttcaacgatgaatggaaactgtcgatcaactacacctacaacgatggtcgtgatgtcagcaacggcgaaaacaaaccgctatccgatctgccgttccatactgctaacggtacgctggactggaaaccgctggcgctggaagactggtcattctatgtttctggtcactataccgggcagaaacgcgccgacagcgcgacggctaaaacaccgggcggttataccatctggaataccggcgcggcctggcaggtgactaaagacgtcaaactgcgcgcaggcgtgctgaaccttggcgacaaggatctcagtcgtgacgactacagctataacgaagacggacgtcgttactttatggcagtggattatcgcttctga

SEQ ID NO: 5246 - protein, 728 aa, Escherichia coli
MIIVIVCIIVTPQSKKADKSEAVPAFWDDHLHTNKSTAMLPYARGRKEDVSDTHFIFVVTSWRYGMFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 5247 - DNA, 1470 bp, Escherichia coli
atgggttccgaaactaaaactacagaagcgccgggcttacgccgtgaattgaaggcgcgtcacctgacgatgattgccattggcggttccatcggtacaggtctttttgttgcctctggcgcaacgatttctcaggcaggtccgggcggggcattgctctcgtatatgctgattggcctgatggtttacttcctgatgaccagtctcggtgaactggctgcatatatgccggtttccggttcgtttgccacttacggtcagaactatgttgaagaaggctttggcttcgcgctgggctggaactactggtacaactgggcggtgactattgccgttgacctggttgcagcacagctggtcatgagctggtggttcccggatacaccgggctggatctggagtgcgttgttcctcggcgttatcttcctgttgaactacatctctgttcgcggctttggtgaagcggaatactggttctcactgatcaaagtcacgacagttattgtctttatcatcgttggcgtgctgatgattatcggtatcttcaaaggcgcgcagcctgcgggctggagcaactggacaatcggcgaagcgccgtttgctggtggttttgcggcgatgatcggcgtagctatgattgtcggcttctctttccagggaaccgagctgatcggtattgctgcaggcgagtccgaagatccggcgaaaaacattccacgcgcggtacgtcaggtattctggcgaatcctgttgttctatgtgttcgcgatcctgattatcagcctgattattccgtataccgatccgagcctgctgcgtaacgatgttaaagacatcagcgtcagtccgttcaccctggtgttccagcacgcgggtctgctctctgcggcggcggtgatgaacgcagttattctgacggcggtgctgtcagcaggtaactccggtatgtatgcgtctactcgtatgctgtataccctggcgtgtgacggtaaagcgccgcgcattttcgctaaactgtcgcgtggtggcgtgccgcgtaatgcgctgtatgcgacgacggtgattgccggtttgtgcttcctgacctccatgtttggcaaccagacggtatacctgtggctgctgaacacctccgggatgacgggctttatcgcctggctggggattgccattagccactatcgtttccgtcgcgggtacgtattgcagggacacgacattaacgatctgccgtaccgttcaggtttcttcccaatggggccgatcttcgcattcattctgtgtctgattatcactttgggccagaactacgaagcgttcctgaaagataccattgactggggcggcgtagcggcaacgtatattggtatcccgctgttcctgattatttggttcggctataagctgattaaaggaactcacttcgtacgctacagcgaaatgaagttcccgcagaacgataagaaataa

SEQ ID NO: 5248 - protein, 489 aa, Escherichia coli
MGSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPMGPIFAFILCLIITLGQNYEAFLKDTIDWGGVAATYIGIPLFLIIWFGYKLIKGTHFVRYSEMKFPQNDKK

SEQ ID NO: 5249 - DNA, 807 bp, Escherichia coli
atgctggcgttgtcgcaatcagcagtgagcgcagccttgaccgacctggaagggcagcttggcgttcaactgtttgatcgcgtggggaaaagactggttgttaatgaacacgggcggctgctctatccgcgagcgttggcactgcttgaacaggcggttgaaatcgaacaactgtttcgcgaagacaacggcgcgattcgtatctatgccagtagtaccatcggtaactacattctgcctgcagttatcgcccgttatcgccatgattatccgcagttgccgattgaacttagcgttgggaatagccaggacgtgatgcaagcggtgctggatttccgcgttgatattggctttattgaaggaccgtgccacagcactgaaatcatttctgaaccgtggctggaagacgagctggtggttttcgccgcgccgacttcgccgttggctcgtggtccggtcaccttagaacagctggccgctgcgccgtggatcctgcgtgaacgcggttccggcacgcgggagattgtcgattatctgttgctgtcacatttaccgaagtttgagatggcgatggaattaggtaactccgaggcaatcaaacatgcggtgcgtcatgggttgggaattagttgcctgtcgcgacgggtgattgaagatcaattgcaggcaggcacattaagtgaagttgcggtccctctgccgcgcctgatgcgtacgttgtggcgtatacatcatcggcaaaaacacctttccaacgcgctacggcgctttctggactattgcgatcccgcgaatgtaccgcgttaa

SEQ ID NO: 5250 - protein, 268 aa, Escherichia coli
MLALSQSAVSAALTDLEGQLGVQLFDRVGKRLVVNEHGRLLYPRALALLEQAVEIEQLFREDNGAIRIYASSTIGNYILPAVIARYRHDYPQLPIELSVGNSQDVMQAVLDFRVDIGFIEGPCHSTEIISEPWLEDELVVFAAPTSPLARGPVTLEQLAAAPWILRERGSGTREIVDYLLLSHLPKFEMAMELGNSEAIKHAVRHGLGISCLSRRVIEDQLQAGTLSEVAVPLPRLMRTLWRIHHRQKHLSNALRRFLDYCDPANVPR

SEQ ID NO: 5251 - DNA, 1050 bp, Escherichia coli
atgacgaatatcaccttacagaaacaacatcgtacactgtggcattttattccggggttagccctgagtgcagttatcaccggggtcgccctgtggggtggttccattcccgctgttgcgggtgccgggtttagtgccctcaccctcgcaatcttgttggggatggttttaggcaacaccatttacccgcacatctggaaaagctgtgacggtggtgtgctgtttgccaagcaatatttattacgtctgggtatcattctttatggcttccgtctgacgttctcgcaaattgccgatgtcggtatcagtgggatcatcattgacgtgttgacgctgtccagtaccttcctgctggcttgcttcctggggcagaaagtgtttggtctggataagcacaccagctggttgatcggtgccggtagcagtatctgtggtgctgccgcggtactggcgactgagccggtagtgaaagcagaagccagtaaagtaaccgtggctgttgcaaccgttgttatcttcgggaccgtcgcgattttcctctacccggcgatatatccgctgatgtctcaatggtttagtccggaaactttcggtatctacattggttctactgtgcacgaagtggcgcaggtggtggcggcaggtcatgccatcagcccggatgcagaaaacgcagcagttatttccaaaatgctgcgcgtgatgatgctggctccgttcctcatcctgctggcggcgcgtgttaaacagctgtctggggcgaacagcggcgagaaaagcaaaatcactattccgtggtttgccatcttgttcatcgtcgttgccatctttaactcgttccacctgttaccgcagagcgtggtgaacatgctggtaacgctggataccttcctgctggcaatggcgatggcggcgctgggtctgaccactcacgtcagcgcgctgaaaaaagccggggcgaaacctctgctgatggcactggtactgtttgcctggctgattgttggtggtggtgcgattaactatgtgattcaaagcgtcatcgcataa

SEQ ID NO: 5252 - protein, 349 aa, Escherichia coli
MTNITLQKQHRTLWHFIPGLALSAVITGVALWGGSIPAVAGAGFSALTLAILLGMVLGNTIYPHIWKSCDGGVLFAKQYLLRLGIILYGFRLTFSQIADVGISGIIIDVLTLSSTFLLACFLGQKVFGLDKHTSWLIGAGSSICGAAAVLATEPVVKAEASKVTVAVATVVIFGTVAIFLYPAIYPLMSQWFSPETFGIYIGSTVHEVAQVVAAGHAISPDAENAAVISKMLRVMMLAPFLILLAARVKQLSGANSGEKSKITIPWFAILFIVVAIFNSFHLLPQSVVNMLVTLDTFLLAMAMAALGLTTHVSALKKAGAKPLLMALVLFAWLIVGGGAINYVIQSVIA

SEQ ID NO: 5253 - DNA, 858 bp, Escherichia coli
atgaaatacattggagcgcacgttagtgctgctggcggtctggcaaatgccgcaattcgcgccgccgaaatcgacgcaaccgcgtttgccttgttcaccaaaaaccaacgtcagtggcgtgccgcaccgctcacgacgcaaaccatcgatgaattcaaagccgcctgtgaaaaatatcactacacatcggcgcaaattcttccccacgacagttatctgattaacctcggacatccggttgctgaagctctggaaaaatcgcgcgatgcctttatagatgaaatgcagcgttgcgaacagctggggctttctttgctcaacttccaccctggcagccatctgatgcagatttcagaagaggattgccttgcgcgtattgccgaatccatcaacattgcgctggataaaactcaaggtgtcaccgcggtgattgaaaacaccgccggtcagggcagtaacttagggtttaaattcgaacatctcgcggcgattatcgacggcgtggaagataaatcccgcgtcggcgtctgcattgatacctgccatgctttcgctgccgggtatgatttgcgtactcctgccgaatgcgagaaaacgttcgctgattttgcccgtattgtaggctttaagtatctgcacgggatgcacctcaacgatgcgaaaagcacctttggcagccgcgttgaccgccatcatagcctcggcgaaggcaatatcggtcatgatgcgttccgctggatcatgcaagacgaccgtttcgacggcattccgctgatccttgaaaccatcaacccggatatctgggcagaagagatcgcctggctgaaagcgcaacaaactgaaaaagcggtggcctga

SEQ ID NO: 5254 - protein, 285 aa, Escherichia coli
MKYIGAHVSAAGGLANAAIRAAEIDATAFALFTKNQRQWRAAPLTTQTIDEFKAACEKYHYTSAQILPHDSYLINLGHPVAEALEKSRDAFIDEMQRCEQLGLSLLNFHPGSHLMQISEEDCLARIAESINIALDKTQGVTAVIENTAGQGSNLGFKFEHLAAIIDGVEDKSRVGVCIDTCHAFAAGYDLRTPAECEKTFADFARIVGFKYLHGMHLNDAKSTFGSRVDRHHSLGEGNIGHDAFRWIMQDDRFDGIPLILETINPDIWAEEIAWLKAQQTEKAVA

SEQ ID NO: 5255 - DNA, 1089 bp, Escherichia coli
atgaacgacagggaaaagcagattcttaaaattttacggcgtaacccgctgattcaacagaatgaaatcgccgatattctgcaaatcagccgctcacgtgttgccgctcatattatggatttgatgcgcaagggtttgattaaaggcaaaggatatatccttaccgagcaggattactgtgtggttgtgggtgcaatcaatatggatattcgcggaatggcggatatccgttacccgcaagcagcctctcatccaggttctgttcactgttccgcaggcggcgtcggacgtaatatcgcgcataacctggctctgcttggtcgggatgtgcatttaatatcagctattggcaacgatttttacggcgagacattactggaagaaacgcgccgcgcgggcgtgaacgtttcaaactgcattcgtctgcatggacacagcactgcaacttatctcgctatcgctaataagcaggaagaaactatcctggcaatcaatgacacacatattctgcaacagctaacgcctcaactgctcaatacttcacgggacttgattcgccatgctggtgtggtgctggctgattgtaatctcacacctgaagccctggagtgggtctttaccattgctgatgaaattccgatgtttgtcgataccgtttccgaatttaaagcgaacaaagtaaaaaactggtacagccggatccacactctgaaaccaacacaaaatgaactggaaattttgtgggggcaaccgattaaagacgacaacaatcgcatcagagctgtaaattcgctgcatcaacaaggtgttaaacgcatttttgtttatctgaaagatgaatctgtattttgcagcgataaggatggagaacaatttttgctgaccgcgccagcgcatacgacagtagacagttttggtgctgacgatggttttatggcgggcctggtatatagctttcttgaaggatacagtttccgcgacagcgcccgttttgcgatggcctgcgcggcaatttcgcgcgccagcggcagcttaaacaaccctaccctgtctgccgataacgcgctttcattagtgccaatggtgtaa

SEQ ID NO: 5256 - protein, 362 aa, Escherichia coli
MNDREKQILKILRRNPLIQQNEIADILQISRSRVAAHIMDLMRKGLIKGKGYILTEQDYCVVVGAINMDIRGMADIRYPQAASHPGSVHCSAGGVGRNIAHNLALLGRDVHLISAIGNDFYGETLLEETRRAGVNVSNCIRLHGHSTATYLAIANKQEETILAINDTHILQQLTPQLLNTSRDLIRHAGVVLADCNLTPEALEWVFTIADEIPMFVDTVSEFKANKVKNWYSRIHTLKPTQNELEILWGQPIKDDNNRIRAVNSLHQQGVKRIFVYLKDESVFCSDKDGEQFLLTAPAHTTVDSFGADDGFMAGLVYSFLEGYSFRDSARFAMACAAISRASGSLNNPTLSADNALSLVPMV

SEQ ID NO: 5257 - DNA, 942 bp, Escherichia coli
atggaaaagagaaaaattattctggattgtgatccgggtcatgatgatgctattgctataatgatggcggcgaaacatccggcgattgatttattaggtatcaccattgtagcgggtaatcaaaccctcgataaaacattaattaatggcctgaatgtttgccagaaactggagattaatgttccggtttatgcggggatgccgcagcccattatgcgtcaacaaattgttgccgataatattcacggtgaaaccggactggatggcccggtattcgagccgctgacccgccaggcagaaaacactcatgcggtgaaatatatcatcgatacccttatggcaagcgatggcgatatcactctggtgccggttggtccgttgtcaaacatcgcggtggcaatgcgtatgcaacccgcgatcctgccgaaaatccgtgaaattgttctgatgggcggtgcttatggtactggcaacttcaccccatctgctgagttcaacatctttgctgacccggaggccgcacgcgtggtgttcacctccggcgttccattagtgatgatgggcctcgatcttaccaaccagaccgtttgcaccccggatgtgattgctcggatggaaagggctggcggccctgccggagagctgttcagcgacatcatgaacttcactctcaaaacgcagttcgaaaactacggcctggctggcggcccggtacatgacgccacctgtatcggttatctgattaaccccgatggcattaaaacccaggagatgtacgtcgaagtggacgtcaacagtggcccttgttacgggcgtaccgtctgcgacgagctgggcgttcttggcaagcccgccaatacaaaagtcggcatcactattgataccgactggttctggggattagtcgaagagtgcgtacgcggctacataaaaacccattaa

SEQ ID NO: 5258 - protein, 313 aa, Escherichia coli
MEKRKIILDCDPGHDDAIAIMMAAKHPAIDLLGITIVAGNQTLDKTLINGLNVCQKLEINVPVYAGMPQPIMRQQIVADNIHGETGLDGPVFEPLTRQAENTHAVKYIIDTLMASDGDITLVPVGPLSNIAVAMRMQPAILPKIREIVLMGGAYGTGNFTPSAEFNIFADPEAARVVFTSGVPLVMMGLDLTNQTVCTPDVIARMERAGGPAGELFSDIMNFTLKTQFENYGLAGGPVHDATCIGYLINPDGIKTQEMYVEVDVNSGPCYGRTVCDELGVLGKPANTKVGITIDTDWFWGLVEECVRGYIKTH

SEQ ID NO: 5259 - DNA, 660 bp, Escherichia coli
atgagtgaatctgcgtttaaggattgcttttcaacggatgtttcagccgatacgcggctgtttcattttttagcgcgtgactacattgtgcaggaagggcaacagccgtcctggctgttttacctgacgcgaggccgcgccaggctttacgtcacgcttgctaatggtcgcgtgtcgctaatcgatttctttgccgcgccctgttttattggcgagattgagttaatcgacaaagaccatgaaccgcgtgcagtgcaggctattgaagagtgttggtgccttgcgctccctatgaagcattaccgcccgttgttattaaacgacacgctatttttacgaaaactctgcgtcaccttaagtcataaaaattatcgtaatattgtttctttaactcagaatcaatcatttccgttagtgaatcgcctggcagcttttatattactctcgcaggaaggtgatctttatcacgaaaagcatacgcaagcggcagagtatttaggcgtttcttatcgacatcttttatatgttcttgcgcaattcattaatgacggtttattaattaaaagcaagaaagggtatctcattaaaaacagaaagcagttgtcaggactggcgctgaagatgtacccggagaataaattctccgggatgatgcagtaa

SEQ ID NO: 5260 - protein, 219 aa, Escherichia coli
MSESAFKDCFSTDVSADTRLFHFLARDYIVQEGQQPSWLFYLTRGRARLYVTLANGRVSLIDFFAAPCFIGEIELIDKDHEPRAVQAIEECWCLALPMKHYRPLLLNDTLFLRKLCVTLSHKNYRNIVSLTQNQSFPLVNRLAAFILLSQEGDLYHEKHTQAAEYLGVSYRHLLYVLAQFINDGLLIKSKKGYLIKNRKQLSGLALKMYPENKFSGMMQ

SEQ ID NO: 5261 - DNA, 1251 bp, Escherichia coli
atggatataatgagaagtgttgtggggatggtggtgttactggcaatagcatttctgttgtcggtaaataaaaagagcatcagcttgcgcacggttggggctgcgctgctgctgcaaattgccattggtggcatcatgctctattttcccccgggaaaatgggcagtagagcaggcggcattaggcgtccataaagtgatgtcctacagtgacgcaggaagtgcctttatttttggttcgctggtcggtcccaaaatggatgttctgtttgacggtgcgggctttatcttcgcctttcgcgtactcccggcgattattttcgttaccgcgcttatcagcttgctgtactacattggcgtaatggggctgctgattcgtattcttggcagtatttttcagaaagccctcaacatcagcaaaatcgaatcttttgtcgcagtcaccactattttcctcgggcaaaatgagatcccggcgatcgtgaaaccttttattgatcgcatgaatcgcaacgagctatttacggctatttgtagcggcatggcgtctattgcgggttcgatgatgattggctatgccggaatgggcgtgccgattgactatttgttagccgcttcgctgatggctattcctggcggtatcctgtttgcacgtattcttagtccggcgacggaaccttcgcaagttacgtttgaaaatctgtcgtttagcgaaacaccgccaaaaagcattattgaagctgcggcgaacggtgcaatgactgggctgaaaatcgccgccggtgtggcgacggtggtaatggcatttgtggcgatcattgcgctgatcaacggcattattggtggagttggcggctggtttggttttgccaatgtctctctggaaagcattttcggctatgtgctggccccgttggcatggattatgggggtggactggagtgatgcaaatcttgccggaagtttgattgggcagaaactggcgattaatgagtttgttgcttatctcaatttctcgccctatctgcaaacgagcggcacgctggatgtcaagaccattgccattatctcgttcgccctctgtgggtttgcaaactttggttctatcggtgttgtcgttggagcgttttcggctatttcgccaaaacgcgcgccggaaatcgcccagcttggtttacgggcgctggcggcggcgacgctttccaacctgatgagcgcgaccattgccgggttctttattggtttagcttga

SEQ ID NO: 5262 - protein, 416 aa, Escherichia coli
MDIMRSVVGMVVLLAIAFLLSVNKKSISLRTVGAALLLQIAIGGIMLYFPPGKWAVEQAALGVHKVMSYSDAGSAFIFGSLVGPKMDVLFDGAGFIFAFRVLPAIIFVTALISLLYYIGVMGLLIRILGSIFQKALNISKIESFVAVTTIFLGQNEIPAIVKPFIDRMNRNELFTAICSGMASIAGSMMIGYAGMGVPIDYLLAASLMAIPGGILFARILSPATEPSQVTFENLSFSETPPKSIIEAAANGAMTGLKIAAGVATVVMAFVAIIALINGIIGGVGGWFGFANVSLESIFGYVLAPLAWIMGVDWSDANLAGSLIGQKLAINEFVAYLNFSPYLQTSGTLDVKTIAIISFALCGFANFGSIGVVVGAFSAISPKRAPEIAQLGLRALAAATLSNLMSATIAGFFIGLA

SEQ ID NO: 5263 - DNA, 939 bp, Escherichia coli
atgtctgaattaactctgtcccctgaattattacaaatatccgctgaagtacaggatgctttaaaaaataaaaaatcggttgttgcgctggaatcgaccataatttctcacggaatgccattcccacaaaatgcccaaaccgcaattgaagtagaagaaacaattcgtaaacagggcgcagtaccagccactatcgccattattggcggtgtgatgaaagtgggcttaagtaaagaagaaatcgaattgctgggccgtgaaggacataacgtgacgaaagttagtcgtcgtgatttaccttttgtcgttgctgcagggaaaaatggcgcgactaccgttgcatcaaccatgattattgcagcactggctgggattaaagtttttgcaaccggaggtattggtggtgtgcatcgcggagcggaacataccttcgatatttctgccgatttacaggaactggcaaataccaatgtcactgttgtttgtgcgggggcaaaatctattctcgatttaggattaacaacagaatatttagaaaccttcggtgtaccgttaattggttatcagacaaaagcgctgcctgcgtttttctgccgaaccagcccatttgatgtcagcattcgtctcgacagtgcccgcgaaattgctcgcgcgatggcagtgaagtggcaaaccggtttgaacggcggcctggtggtagcgaacccgatcccggaacagtttgcgatgccagaagaaaccatcaatgcagcaattgatcaagccgttgctgaagccgaagaacagggtgttattgggaaagagagtacaccgttcctgctggcgcgtgttgcggagctaaccggcggtgatagcctgaaatccaatattcaactggtctttaataacgccattctggcgagcgaaattgccaaagaatatcagcgtctcgtgggttaa

SEQ ID NO: 5264 - protein, 312 aa, Escherichia coli
MSELTLSPELLQISAEVQDALKNKKSVVALESTIISHGMPFPQNAQTAIEVEETIRKQGAVPATIAIIGGVMKVGLSKEEIELLGREGHNVTKVSRRDLPFVVAAGKNGATTVASTMIIAALAGIKVFATGGIGGVHRGAEHTFDISADLQELANTNVTVVCAGAKSILDLGLTTEYLETFGVPLIGYQTKALPAFFCRTSPFDVSIRLDSAREIARAMAVKWQTGLNGGLVVANPIPEQFAMPEETINAAIDQAVAEAEEQGVIGKESTPFLLARVAELTGGDSLKSNIQLVFNNAILASEIAKEYQRLVG

SEQ ID NO: 5265 - DNA, 942 bp, Escherichia coli
atgcgcgaaaaggactacatagtaattattggctcggcgaatattgatgtggctgggtattcacatcatccattgaattatgcggattcgaatcccggaaaaattaaatttaccccaggtggcgtgggaaggaatatcgctcataatctggcgttactggggaaaaatgcctggcttttaagtgcagtaggtggtgatttttatgggcaatcattactggcgcaaactaatcaatccggtgtttatgtcgataaatgcttaattgttccgggtgagaatacatccagctatttatcactgctcgataatacaggagaaatgcttgtcgcgataaatgatatgagtattagtgactgtatttctgcagaatttcttgcccagcatcaggagtttattcgcggtgcaaaggttattgtcgcggattgcaaccttagtgaagaggcgctggtctgggttctggaaaatagcggggaaacgcctgtatttattgatccggtatcggcatggaaatgcgtcaaaatccgcgatcatctgagcaaaatccatacgttaaaacctaaccgtcttgaagccgaaacgttgagcggaattgcactttccggacgtgaagatgtcgcaaaggtcgccgcctggtttcatcaacacggcctgaaccgcctggtgcttagcatgggaggggatggcgtttactacagtgatatcaacggtgaaagtgggtggtcggcccctattaaaacgaatgtcatcaatgttactggggcaggcgacgccatgatggcggggctggcctcctgttgggtagacggtatgccgtttatcgattctgttcgatttgcgcagggatgttcgtcaatggcacttgcctgtgaatataccaacaaccctgaattatcaattgccaatgttacatcgttagtggagaacacagaatgtctgaattaa

SEQ ID NO: 5266 - protein, 313 aa, Escherichia coli
MREKDYIVIIGSANIDVAGYSHHPLNYADSNPGKIKFTPGGVGRNIAHNLALLGKNAWLLSAVGGDFYGQSLLAQTNQSGVYVDKCLIVPGENTSSYLSLLDNTGEMLVAINDMSISDCISAEFLAQHQEFIRGAKVIVADCNLSEEALVWVLENSGETPVFIDPVSAWKCVKIRDHLSKIHTLKPNRLEAETLSGIALSGREDVAKVAAWFHQHGLNRLVLSMGGDGVYYSDINGESGWSAPIKTNVINVTGAGDAMMAGLASCWVDGMPFIDSVRFAQGCSSMALACEYTNNPELSIANVTSLVENTECLN

SEQ ID NO: 5267 - DNA, 1692 bp, Escherichia coli
atgaaaacgctgctgattattgacgctaatctcggtcaggcacgcgcctatatggcgaagaccctgctgggcgcggcggcgcgaaaagcaaaactggaaatcatcgacaatccgaacgacgcagaaatggcgattgttctcggtgattccatcccgaatgacagcgcgctgaacggtaaaaatgtctggctgggtgatatttcccgggcagttgcgcaccctgagctgttcctgagtgaagccaaaggccatgcgaaaccttacactgcgccggtcgctgcgacagcaccggttgctgccagcggtccgaaacgcgtagttgcggtgactgcttgcccgactggcgtagcacacacctttatggcggctgaagccattgaaaccgaagcgaaaaaacgtggctggtgggtgaaagttgaaacccgtggttctgttggcgcgggcaatgcaatcacccctgaagaagtcgcagcagcggatctggtgattgtggcggcagatatcgaagtggatctggcgaaatttgctggtaaaccgatgtatcgcacctctaccggtctggcgctgaagaaaactgcgcaggaactggataaagcggttgctgaagcaacgccgtatgaaccggcgggcaaaactcaaacagcgaccactgaaggtaagaaagagagtgcaggtgcttaccgtcacttgctgacgggcgtctcttacatgctgccgatggttgttgcaggtggtctgtgtatcgcgctttcttttgcttttggtatcgaagcgtttaaagagccgggtacgttggcagcggcgctgatgcagattggtggtggttcagcctttgcgctgatggtgccggtactggcaggttatattgccttctccattgccgatcgtccgggtctcacgccgggtctgattggcggtatgctggcggttagcaccggttctggcttcattggtggtattattgcgggcttcctggcgggttacattgcgaagttaatcagtacgcaactgaaactgccacagagtatggaggcactgaaaccgatcctgatcattccgctaatttccagtctggtggtcggtctggcgatgatctacctaatcggtaaaccggttgctggcattctcgatgggttgactcactggctgcagaccatggggactgcgaatgcggttctgctgggggcgatcctcggtggcatgatgtgtactgacatgggcggtccggtaaacaaagcagcgtacgcattcggtgtgggtctgctgagtactcaaacctatggcccgatggcggcgattatggcggcaggtatggtgccaccgctggcaatgggtctggcaacaatggtggcgcgtcgcaaattcgacaaagcgcagcaggaaggtggcaaagccgctctggtacttggtctgtgctttatttcggaaggtgcaattccgtttgctgctcgtgatccgatgcgtgtgctaccgtgctgtatcgttggtggggcgctgactggcgcaatctcaatggcgattggtgcgaaactgatggcaccacacggtggtctgtttgttctgctgatccctggcgctattacgccggtattgggttacctggtagcaattattgccggtacgctggtggcgggtttggcctatgccttcctcaaacgcccggaaacacaaatagtagaaaaaaacgcataa

SEQ ID NO: 5268 - protein, 563 aa, Escherichia coli
MKTLLIIDANLGQARAYMAKTLLGAAARKAKLEIIDNPNDAEMAIVLGDSIPNDSALNGKNVWLGDISRAVAHPELFLSEAKGHAKPYTAPVAATAPVAASGPKRVVAVTACPTGVAHTFMAAEAIETEAKKRGWWVKVETRGSVGAGNAITPEEVAAADLVIVAADIEVDLAKFAGKPMYRTSTGLALKKTAQELDKAVAEATPYEPAGKTQTATTEGKKESAGAYRHLLTGVSYMLPMVVAGGLCIALSFAFGIEAFKEPGTLAAALMQIGGGSAFALMVPVLAGYIAFSIADRPGLTPGLIGGMLAVSTGSGFIGGIIAGFLAGYIAKLISTQLKLPQSMEALKPILIIPLISSLVVGLAMIYLIGKPVAGILDGLTHWLQTMGTANAVLLGAILGGMMCTDMGGPVNKAAYAFGVGLLSTQTYGPMAAIMAAGMVPPLAMGLATMVARRKFDKAQQEGGKAALVLGLCFISEGAIPFAARDPMRVLPCCIVGGALTGAISMAIGAKLMAPHGGLFVLLIPGAITPVLGYLVAIIAGTLVAGLAYAFLKRPETQIVEKNA

SEQ ID NO: 5269 - DNA, 939 bp, Escherichia coli
atgagtagacgtgttgctacgatcacccttaatccggcttatgaccttgttggtttctgcccggaaattgaacgcggcgaagtgaacctggtgaaaaccaccggtctgcatgcggcgggtaaaggcatcaacgtggccaaagtattaaaagacctgggaattgatgtcaccgttggcggcttcctgggtaaagacaatcaggatggttttcagcaactgttcagcgagctgggcattgccaaccgtttccaggttgtacaggggcgcacccgaattaacgttaagctgacggaaaaagacggcgaagtgaccgacttcaacttctcgggttttgaagtcacccccgccgactgggaacgctttgtgactgattctctgagctggctcggtcagttcgatatggtctgtgtcagcggaagcttaccgtcaggcgtcagcccggaagcgttcaccgactggatgactcgcctgcgtagtcagtgtccttgcattatctttgatagtagccgtgaagcgttagtagcaggtttgaaagcggcaccgtggctggtgaaacctaaccgccgcgagctggaaatctgggcaggccgtaaactgcctgaaatgaaagatgtgattgaagctgcgcatgcgctgcgtgaacaaggcatcgcgcatgttgttatttcactgggtgccgaaggcgcgctttgggttaatgcctccggcgaatggatcgccaaaccaccgtcagtcgatgtcgtaagcaccgttggcgcaggggattctatggttggtggcctgatttatggcttgctgatgcgtgaatccagtgaacacacactgcgtctggcgacagctgttgcagccctggcggtaagtcaaagcaatgtgggtattaccgatcgtccgcagttggccgcaatgatggcgcgcgtcgacttacaaccttttaactga

SEQ ID NO: 5270 - protein, 312 aa, Escherichia coli
MSRRVATITLNPAYDLVGFCPEIERGEVNLVKTTGLHAAGKGINVAKVLKDLGIDVTVGGFLGKDNQDGFQQLFSELGIANRFQVVQGRTRINVKLTEKDGEVTDFNFSGFEVTPADWERFVTDSLSWLGQFDMVCVSGSLPSGVSPEAFTDWMTRLRSQCPCIIFDSSREALVAGLKAAPWLVKPNRRELEIWAGRKLPEMKDVIEAAHALREQGIAHVVISLGAEGALWVNASGEWIAKPPSVDVVSTVGAGDSMVGGLIYGLLMRESSEHTLRLATAVAALAVSQSNVGITDRPQLAAMMARVDLQPFN

SEQ ID NO: 5271 - DNA, 1131 bp, Escherichia coli
atgttccagttatccgtacaggacatccatccgggcgaaaaggccggagacaaagaagaggcgattcgccaggtcgctgcggcgctggtgcaggccggtaatgtagctgaaggctacgtcaatggcatgctggcgcgcgaacagcaaacctcaacgttcctcggcaatggtattgctattccacacggcactaccgacacccgcgatcaggtgctgaaaaccggcgttcaggtatttcagttcccggaaggcgtcacctggggtgacggccaggtagcgtacgtggcgatcggtattgctgccagctcggatgaacatctgggcctgctacgccagctgacccacgtactgagcgatgattccgttgctgaacaactgaagtcagcaacaacagcagaagaacttcgcgcattgctgatgggcgaaaagcagagtgagcagctgaagctcgacaacgaaatgctgacgttggatatcgtcgccagcgatctgctgactcttcaggcgctgaacgctgcgcgtctgaaagaggcgggggcagttgacgccactttcgtcaccaaagccatcaatgaacaaccgctgaacctcgggcagggtatctggctgagcgatagcgccgaaggcaatctgcgtagcgcgattgcggtaagccgtgcggcaaatgcttttgatgtggacggcgaaacggcagccatgctggtgagtgtggcgatgaatgacgatcagcccatcgcggttcttaagcgtctcgctgatttgttgctcgataataaagctgaccgcttgctgaaagcggatgcggcaacgttgctgacgctgctgaccagcgatgatgcgccgaccgacgacgtgttaagcgcggagtttgtggtgcgcaatgaacacggcctgcatgctcgtccaggtaccatgctggtcaataccattaaacaatttaacagtgatattaccgtgacaaaccttgatggcaccggcaaaccggcaaacggacgtagtctgatgaaagttgtggcacttggcgttaagaaaggtcatcgcctacgctttaccgcccagggtgcagatgctgaacaggcgctgaaagccattggcgacgctatcgctgctggtcttggggagggcgcataa

SEQ ID NO: 5272 - protein, 376 aa, Escherichia coli
MFQLSVQDIHPGEKAGDKEEAIRQVAAALVQAGNVAEGYVNGMLAREQQTSTFLGNGIAIPHGTTDTRDQVLKTGVQVFQFPEGVTWGDGQVAYVAIGIAASSDEHLGLLRQLTHVLSDDSVAEQLKSATTAEELRALLMGEKQSEQLKLDNEMLTLDIVASDLLTLQALNAARLKEAGAVDATFVTKAINEQPLNLGQGIWLSDSAEGNLRSAIAVSRAANAFDVDGETAAMLVSVAMNDDQPIAVLKRLADLLLDNKADRLLKADAATLLTLLTSDDAPTDDVLSAEFVVRNEHGLHARPGTMLVNTIKQFNSDITVTNLDGTGKPANGRSLMKVVALGVKKGHRLRFTAQGADAEQALKAIGDAIAAGLGEGA

SEQ ID NO: 5273 - DNA, 132 bp, Escherichia coli
gtgctgcacaattttttgtcatttttcctaattgctgatgggaaaatccgttatcagcaatttcatttcagcagcgtcagcagccaatcagcaacagtgaaatggcattttgattattcgtggcgcttttga

SEQ ID NO: 5274 - protein, 43 aa, Escherichia coli
MLHNFLSFFLIADGKIRYQQFHFSSVSSQSATVKWHFDYSWRF

SEQ ID NO: 5275 - DNA, 1182 bp, Escherichia coli
atgcataactcccccgcagtcaccagcgcgaaatcgtttgacctgacctcgacggcgtttttaatcgttgcctttctcaccggtattgcgggcgctctgcaaaccccgacactcagtatttttcttactgatgaagtacatgcccgtccggcgatggtgggattcttctttaccggcagcgctgtcattgggattctggtgagtcagtttctcgccgggcgctctgataagcgcggcgatcgcaaatcgctgattgtcttttgctgcctgttaggcgtgctggcctgcaccctttttgcctggaatcgcaactactttgttttgctattcgttggcgtctttcttagcagctttggctcaaccgctaacccgcaaatgtttgcccttgcccgtgaacatgctgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcgtttattgtttgcggcgtgatggtgtggctgtttttgccgtcgatgcaaaaagagcttccgctggcgaccggcacggttgaagcgccgcgccgtaaccgtcgcgatacgttgctgctgtttgtcatttgtacattgatgtggggctcgaacagcctgtacatcatcaacatgccgctatttattatcaacgaactgcatcttcccgagaaactggccggtgtgatgatggggaccgccgcagggctggaaatcccgaccatgttgatcgccggatattttgccaaacgtctgggtaagcgcttcttaatgcgcgttgctgccgtgggtggcgtctgtttttacgcaggaatgctgatggcgcattcacctgtcattctgttgggcttgcagctgctaaatgctatttttattggcattctgggcggcatcgggatgctctattttcaggatttgatgcccggtcaggcaggttcagccaccacgctctataccaacacgtcgcgcgtgggctggatcatcgcaggatcagtggcgggcatcgtcgccgagatctggaattatcacgctgtgttctggtttgcgatggtgatgattatcgctactctgttttgcttactgcgaattaaagatgtttaa

SEQ ID NO: 5276 - protein, 393 aa, Escherichia coli
MHNSPAVTSAKSFDLTSTAFLIVAFLTGIAGALQTPTLSIFLTDEVHARPAMVGFFFTGSAVIGILVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMQKELPLATGTVEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPVILLGLQLLNAIFIGILGGIGMLYFQDLMPGQAGSATTLYTNTSRVGWIIAGSVAGIVAEIWNYHAVFWFAMVMIIATLFCLLRIKDV

SEQ ID NO: 5277 - DNA, 828 bp, Escherichia coli
atgcagggcgtattggcgggcttgccatctggcataccgggaatagggctggaaattgaaggggcagtgcaacacgccccgcaacccggacggcattccatacgttgttctcttaaggttaaccaccggattgatgagcgcgcacagtaccaccttttttgcaccagcaaaagtgcgaataccacttgcccgaaaggcccgtcgcgagtactttgtcgcgatatttttgacattttcgactacaggaatttttcgatgccaagagcgaacgaaattaaaaaaggtatggtactgaattacaacggcaaactgctgctggttaaggacattgatattcagtcgcccactgcccgcggtgccgctacgctgtacaaaatgcgtttttctgatgtccgtaccgggctgaaagtagaagagcgtttcaaaggtgatgatatcgttgacaccgtgacgctgacccgccgttacgttgacttctcctatgtcgatggcaacgaatatgtctttatggataaagaagactataccccgtataccttcaccaaagatcagattgaagaagagttgctgtttatgcctgagggcggcatgccggacatgcaggtgctgacctgggacggtcaattgctggcgcttgagctgccgcagaccgttgatctggaaatcgttgaaactgcaccaggcatcaaaggggcatctgccagcgcccgtaacaaaccggcgacattgagcactggtctggtgattcaggtaccagaatacttaagcccgggcgaaaaaattcgtatccatatcgaagaacgccgttatatgggtcgtgctgactaa

SEQ ID NO: 5278 - protein, 275 aa, Escherichia coli
MQGVLAGLPSGIPGIGLEIEGAVQHAPQPGRHSIRCSLKVNHRIDERAQYHLFCTSKSANTTCPKGPSRVLCRDIFDIFDYRNFSMPRANEIKKGMVLNYNGKLLLVKDIDIQSPTARGAATLYKMRFSDVRTGLKVEERFKGDDIVDTVTLTRRYVDFSYVDGNEYVFMDKEDYTPYTFTKDQIEEELLFMPEGGMPDMQVLTWDGQLLALELPQTVDLEIVETAPGIKGASASARNKPATLSTGLVIQVPEYLSPGEKIRIHIEERRYMGRAD

SEQ ID NO: 5279 - DNA, 1263 bp, Escherichia coli
atgagccaactccgcgcacagaaccatttatataccgtgctggagaaaggtgcggacggcaatcaggcgataattgtcggtgccgttcacgaatgtctgaatgcaaaactggattccttagcggcaattattgagaaattttgcgagccacaggtggcaattgtttccctgacaattaccgaaaaaggctattgtattgacccggccatcggtgcactcgacaccagcaatccgcgtattattcacgatctacaaaaccctgaagaacctcactccgcgccaggtattctcgtcgaagcactgaaacgccgccgtgagcgcggccttacaccgtttaccgtgctctcctgcgacaatattcccgacaatggccatgtggtgaaaaacgcggtgctgggaatggcagaaaaacgttcgccagaactcgccgggtggataaaagaacacgtcagttttccgggaactatggtcgaccgcattgttccggctgcaaccaacgaatcactggcggaaataagccagcatctgggggtgaatgatccctgcgcgattagctgcgaaccgtttatccagtgggtggttgaagataacttcgtcgctgggcgtcctgcctgggaagtcgcaggtgtacaaatggtgaatgatgtcctgccatgggaagagatgaaactgcgtatgcttaatggcagccactcttttctcgcttatctgggttacctctcaggattcgcccatatcagtgattgcatgcaggatcgcgcatttcgccatgccgccagaacattaatgctggatgagcaagcgccgacactgcggattaaagatgtcgatttaacacaatatgcggataagttaattgcacgttttgctaatccggcactgaaacataagacctggcaaatcgcgatggatggcagccaaaaattaccgcaacgcatgctggcaggtattcgcatacatctggggcgcgaaacggactggtcgttgctggcattaggcgttgcaggctggatgcgttacgtcagcggcgttgatgatgccggaaatgccattgatgttcgcgatccgcttagcgataaaattcgtgaacttgttgcggtcagcagcagtgaacaacgcgtaaccgccctgctttccctgcgtgaaattttcggtgatgatctgccagataacccgcattttgtgcaggccatcgaacaagcctggcaacaaatcgcacaattcggcgcgcatcaggcgctattaaacaccctcaaaatttaa

SEQ ID NO: 5280 - protein, 420 aa, Escherichia coli
MSQLRAQNHLYTVLEKGADGNQAIIVGAVHECLNAKLDSLAAIIEKFCEPQVAIVSLTITEKGYCIDPAIGALDTSNPRIIHDLQNPEEPHSAPGILVEALKRRRERGLTPFTVLSCDNIPDNGHVVKNAVLGMAEKRSPELAGWIKEHVSFPGTMVDRIVPAATNESLAEISQHLGVNDPCAISCEPFIQWVVEDNFVAGRPAWEVAGVQMVNDVLPWEEMKLRMLNGSHSFLAYLGYLSGFAHISDCMQDRAFRHAARTLMLDEQAPTLRIKDVDLTQYADKLIARFANPALKHKTWQIAMDGSQKLPQRMLAGIRIHLGRETDWSLLALGVAGWMRYVSGVDDAGNAIDVRDPLSDKIRELVAVSSSEQRVTALLSLREIFGDDLPDNPHFVQAIEQAWQQIAQFGAHQALLNTLKI

SEQ ID NO: 5281 - DNA, 987 bp, Escherichia coli
gtgaccagaaccaacctcatcaccggttttctcggcagcgggaaaactacgtcgattcttcatctgttagcccataaagatcccaacgaaaaatgggcggtactggttaatgaatttggggaagtcggaattgatggtgctttgctcgccgatagcggcgcactgttgaaagagatccccggcggctgcatgtgctgcgttaatggtttacccatgcaggtagggttgaataccttactgcgtcagggaaaaccagaccgcttgttgatagagccgaccgggctgggccatccgaaacagatcctcgatctcttaaccgcacccgtctatgaaccgtggatagatctgcgcgccacgttgtgcattctcgatccacgcctgttgctggacgaaaaaagcgccagcaatgaaaacttccgtgaccaactggctgccgcagacattattgtcgccaataaatccgaccgtgcgacgcccgaaagtgagcaagcgctagagcgctggtggcagcaaaatggtggcgatcggcaattaattcacagcgagcatggaaaaattgacggtcatcttctggatttgccgcgtcgcaatttagccgagttgcccgccagcgccgcgcattctcatcagcatagcgtgaaaaaagggttagcagcgttaagcctgccagagcatcaacgctggcgtcgcagtctgaacagcggacaagggcatcaggcctgtggctggatattcgacgctgatacggtattcgacaccattggtattctggaatgggcgcgacttgcaccggtggaacgcgtcaaaggcgtgctgcgtattcccgaagggctggtgcgaatcaaccgtcagggcgatgacctgcacattgaaacgcaaaacgttgcgccaccggacagtcgtattgagctgatttccagcagcgaagctgactggaatgccttgcagagcgcgctgttgaagcttcgtttagcgactcccgcgtaa

SEQ ID NO: 5282 - protein, 328 aa, Escherichia coli
MTRTNLITGFLGSGKTTSILHLLAHKDPNEKWAVLVNEFGEVGIDGALLADSGALLKEIPGGCMCCVNGLPMQVGLNTLLRQGKPDRLLIEPTGLGHPKQILDLLTAPVYEPWIDLRATLCILDPRLLLDEKSASNENFRDQLAAADIIVANKSDRATPESEQALERWWQQNGGDRQLIHSEHGKIDGHLLDLPRRNLAELPASAAHSHQHSVKKGLAALSLPEHQRWRRSLNSGQGHQACGWIFDADTVFDTIGILEWARLAPVERVKGVLRIPEGLVRINRQGDDLHIETQNVAPPDSRIELISSSEADWNALQSALLKLRLATPA

SEQ ID NO: 5283 - DNA, 750 bp, Escherichia coli
ttgcctgcgtttttcagtaagataattagagaaaatatgattaaaaatttgccgcaaatagtgttgttgaatattgtcggcctcgcgctgtttctttcctggtatattcccgttaatcatggattctggttgccgattgatgcggatattttttatttctttaatcagaaactggtcgaaagtaaggcctttttgtggctggttgcattgaccaacaatcgcgccttcgacggttgttcactgctggcgatgggtatgttgatgctgagtttctggctgaaagaaaacgcccctggcagacgacgtatcgtgattattggtctggtcatgctattaactgcagtggtattaaaccagctgggtcaggcattaattcctgtaaaacgggccagcccaacattgacttttaccgatattaaccgcgtcagcgaactgctctctgttcccacgaaagatgcctcacgagatagctttcccggcgatcacggtatgatgctgcttattttttcggcattcatgtggcgttatttcggcaaagttgcaggccttatcgcccttattatttttgtggtttttgcatttcccagagtaatgattggcgcacactggtttactgacatcattgttggttcgatgaccgtgatattgatcggtttgccctgggtgttgctgacgccattaagtgatcgattaatcaccttttttgacaaatcactaccgggaaaaaacaaacatttccaaaacaaataa

SEQ ID NO: 5284 - protein, 249 aa, Escherichia coli
MPAFFSKIIRENMIKNLPQIVLLNIVGLALFLSWYIPVNHGFWLPIDADIFYFFNQKLVESKAFLWLVALTNNRAFDGCSLLAMGMLMLSFWLKENAPGRRRIVIIGLVMLLTAVVLNQLGQALIPVKRASPTLTFTDINRVSELLSVPTKDASRDSFPGDHGMMLLIFSAFMWRYFGKVAGLIALIIFVVFAFPRVMIGAHWFTDIIVGSMTVILIGLPWVLLTPLSDRLITFFDKSLPGKNKHFQNK

SEQ ID NO: 5285 - DNA, 567 bp, Escherichia coli
atggtcaaatctcaaccgattttgagatatatcttgcgcgggatccccgcgattgcagtagcggttctgctttctgcatgtagtgcaaataacaccgcaaagaatatgcatcctgagacacgtgcagtgggtagtgaaacatcatcactgcaagcttctcaggatgaatttgaaaacctggttcgtaatgtcgacgtaaaatcgcgaattatggatcagtatgctgattggaaaggcgtacgctatcgtctgggcggcagcactaaaaaaggtatcgattgttctggtttcgtacagcgtacattccgtgagcaatttggcttagaacttccgcgttcgacttatgaacagcaggaaatgggtaaatctgtttcccgcagtaatttgcgcacgggtgatttagttctgttccgtgccggttcaacgggacgccatgtcggtatttatatcggcaacaaccagtttgtccatgcttccaccagcagtggtgttattatttccagcatgaatgaaccatactggaagaagcgttacaacgaagcacgccgggttctcagccgcagctaa

SEQ ID NO: 5286 - protein, 188 aa, Escherichia coli
MVKSQPILRYILRGIPAIAVAVLLSACSANNTAKNMHPETRAVGSETSSLQASQDEFENLVRNVDVKSRIMDQYADWKGVRYRLGGSTKKGIDCSGFVQRTFREQFGLELPRSTYEQQEMGKSVSRSNLRTGDLVLFRAGSTGRHVGIYIGNNQFVHASTSSGVIISSMNEPYWKKRYNEARRVLSRS

SEQ ID NO: 5287 - DNA, 1557 bp, Escherichia coli
atgtttatacgcgctcccaattctggacgtaagctcctgcttacctgcattgttgcaggcgtgatgattgcgatactggtgagctgccttcagtttttagtggcctggcataagcacgaagtcacatacgacacactgattaccgacgtacaaaagtatctcgatacctattttgccgaccttaaatccactactgaccggctccagccgctgaccttagatacctgccagcaggctaaccccgaactgaccgcccgcgcggcgtttagcatgaatgttcgtacgtttgtgctggtaaaagataaaaaaacattctgttcatctgcaactggtgagatggacattccactcaatgaattgattccggcgctcgacattaataaaaacgtcgatatggcgatcttacccggcacgccgatggtgccgaacaaacccgcaatcgtcatctggtatcgcaaccctttgctgaaaaatagcggcgtgtttgccgctctgaatctcaacctgacgccttcactcttttatagttcacggcaggaagattacgatggcctcgccctcattattggtaatactgcgctatctaccttttcttcacgtttgatgaacgttaatgaattaaccgacatgccggtccgtgaaactaaaattgcgggcattcctctgaccgttcggctttatgcagatgactggacatggaacgatgtgtggtacgcatttttactgggtggcatgagtggaactttcgttggacttctctgctattacctgatgagtgtgcgtatgcgcccaggcagagaaatcatgaccgccatcaagcgcgaacaattttacgtggtgtatcaaccggtggttgatacacaagctttgcgggtaacgggcctggaagtactgctacgctggcggcatccagtagcaggtgaaatccccccggatgccttcattaactttgccgaagcgcaaaagatgattgtgccactgactcagcacctgtttgagttgattgcccgcgatgccgcagaattagaaaaagtactgccggtaggcgtcaaatttggcattaacattgcgccggcccacttgcacagcgaaagctttaaagcggatatccagaaactgctcacttccctgcccgcacaccatttccagattgtgctggaaattaccgagcgcgatatgctgaaagagcgagaagccacacaactcttcgcctggctgcattcggtcggcgtagaaattgctattgatgacttcggcaccgggcacagcgcgcttatctatcttgagcgttttacgctcgattatctgaaaattgatcgtggatttatcaacgccatcggtacggaaacgatcacttcacccgtacttgacgcggtgctgacgctggcgaaacgtctcaatatgctgacagttgctgaaggggtcgaaacgccagaacaggcacgatggctaagcgaacgcggcgttaatttcatgcaaggctactggattagtcgcccgttaccgctggacgattttgttcgctggctgaagaaaccgtatacgccgcagtggtaa

SEQ ID NO: 5288 - protein, 518 aa, Escherichia coli
MFIRAPNSGRKLLLTCIVAGVMIAILVSCLQFLVAWHKHEVTYDTLITDVQKYLDTYFADLKSTTDRLQPLTLDTCQQANPELTARAAFSMNVRTFVLVKDKKTFCSSATGEMDIPLNELIPALDINKNVDMAILPGTPMVPNKPAIVIWYRNPLLKNSGVFAALNLNLTPSLFYSSRQEDYDGLALIIGNTALSTFSSRLMNVNELTDMPVRETKIAGIPLTVRLYADDWTWNDVWYAFLLGGMSGTFVGLLCYYLMSVRMRPGREIMTAIKREQFYVVYQPVVDTQALRVTGLEVLLRWRHPVAGEIPPDAFINFAEAQKMIVPLTQHLFELIARDAAELEKVLPVGVKFGINIAPAHLHSESFKADIQKLLTSLPAHHFQIVLEITERDMLKEREATQLFAWLHSVGVEIAIDDFGTGHSALIYLERFTLDYLKIDRGFINAIGTETITSPVLDAVLTLAKRLNMLTVAEGVETPEQARWLSERGVNFMQGYWISRPLPLDDFVRWLKKPYTPQW

SEQ ID NO: 5289 - DNA, 1815 bp, Escherichia coli
atgattgtgcgcatactgctgctgtttatcgctctgttcacctttggtgcgcaggcgcaggctatcaaggaaagctatgcctttgccgtactgggcgaaccccggtacgcatttaatttcaaccattttgattatgtgaaccccgccgcgccaaaaggtgggcaaataacgttgtctgccctcggcaccttcgataatttcaaccgctatgcactgcgcggcaacccgggcgcacgcaccgagcagctgtacgacacgctatttacgacttccgatgacgaaccaggcagttattacccgctgattgctgaaagcgcacgctatgctgacgattattcctgggtggaggtcgctattaatccacgcgcccgttttcatgatggttcgcccattactgcccgcgatgtagagtttacttttcaaaaatttatgaccgaaggcgtgccgcaatttcgtctggtctacaaaggcaccaccgtcaaagccattgcgccgttaaccgtgcgcattgagttagctaaacccggcaaagaagatatgctgagtctgttttcgctgccggtatttccagaaaagtactggaaagatcacaaacttagcgacccgctcgccacgcctccgcttgccagtggtccgtaccgcattacgtcctggaaaatggggcaaaatattgtctattcccgcgtgaaagattactgggcagcaaacttaccggtaaaccgtggacgctggaatttcgacaccattcgctacgattattacctcgatgataatgtcgcctttgaagcgtttaaagcaggagcctttgatttgcgtatggaaaacgacgccaaaaactgggccacgcgctataccggtaaaaatttcgataaaaaatacatcatcaaagatgagcaaaagaacgaatcagcccaggatacgcgctggctggcgtttaatatccaacgtccggtattcagcgatcgccgggtccgggaagcgatcactctcgcctttgactttgaatggatgaacaaagcgttgttttacaatgcctggagtcgcacgaacagttattttcagaataccgaatatgcggccagaaattaccccgacgccgcggagctggtgcttctggcaccaatgaaaaaagatctaccgccagaagtcttcacgcaaatctaccagccgccggtatccaaaggcgatggctacgatcgtgacaacctgttaaaagccgacaaacttctcaacgaagcaggctgggtgttgaagggtcagcaacgcgttaatgtcacaacgggtcagccactcagctttgaattattgcttcccgcaagcagcaatagtcagtgggtattgccgttccagcacagcctgcaacggctgggtatcaacatggacattcgcaaggtggataactcgcaaatcaccaaccgcatgcgcagtcgcgactatgacatgatgccgcgcgtatggcgggcgatgccgtggcccagttccgatttacagatttcctggtcatcggaatatatcaattccacttataatgcccccggcgtgcaaagcccggttatcgactcgctgatcaatcaaattattgccgcgcagggaaataaagaaaaattactgccgttggggcgagcactggatcgcgtattaacgtggaattattacatgctgccaatgtggtacatggcggaagaccgtctcgcctggtgggataaattctcccaacccgctgtacgccctgtttacagcctgggtatcgatacctggtggtatgacgttaataaagcggccaaactgccgtcagccagacaacagggagagtag

SEQ ID NO: 5290 - protein, 604 aa, Escherichia coli
MIVRILLLFIALFTFGAQAQAIKESYAFAVLGEPRYAFNFNHFDYVNPAAPKGGQITLSALGTFDNFNRYALRGNPGARTEQLYDTLFTTSDDEPGSYYPLIAESARYADDYSWVEVAINPRARFHDGSPITARDVEFTFQKFMTEGVPQFRLVYKGTTVKAIAPLTVRIELAKPGKEDMLSLFSLPVFPEKYWKDHKLSDPLATPPLASGPYRITSWKMGQNIVYSRVKDYWAANLPVNRGRWNFDTIRYDYYLDDNVAFEAFKAGAFDLRMENDAKNWATRYTGKNFDKKYIIKDEQKNESAQDTRWLAFNIQRPVFSDRRVREAITLAFDFEWMNKALFYNAWSRTNSYFQNTEYAARNYPDAAELVLLAPMKKDLPPEVFTQIYQPPVSKGDGYDRDNLLKADKLLNEAGWVLKGQQRVNVTTGQPLSFELLLPASSNSQWVLPFQHSLQRLGINMDIRKVDNSQITNRMRSRDYDMMPRVWRAMPWPSSDLQISWSSEYINSTYNAPGVQSPVIDSLINQIIAAQGNKEKLLPLGRALDRVLTWNYYMLPMWYMAEDRLAWWDKFSQPAVRPVYSLGIDTWWYDVNKAAKLPSARQQGE

SEQ ID NO: 5291 - DNA, 1095 bp, Escherichia coli
atgggcgcttatctgatccgccgtctgttgctggtgatcccaacgttatgggcgattatcactatcaactttttcatcgtgcaaattgcgcctggcggtccggtcgaccaggccatcgccgccattgagtttggtaatgccggagtattacccggcgcaggcggtgaaggtgttcgcgccagccatgcgcaaacgggcgtcggcaatatcagcgacagtaattaccgtggcggacgcggattagatccagaagtgatcgccgagatcactcatcgctacggtttcgataagccgatccacgaacgttacttcaaaatgctctgggactacatccgttttgattttggcgacagcctttttcgcagcgcctcggtgctgacgctgattaaagacagtctgccggtctccatcaccctcggattgtggagcacgctgattatctatctggtgtcgattccgttaggcattcgcaaagctgtttataatgggagccgttttgacgtctggagtagtgcatttatcatcatcggctacgccattccggcctttttgtttgccatcctgctgattgtcttcttcgcgggcggcagctatttcgatctgttccctctgcgcggcctggtttccgctaactttgattcgctgccgtggtatcagaaaatcaccgattatctgtggcatatcacgctgccggtgctggcgacagtgattggcggctttgcggctctgaccatgctgacaaaaaactcattccttgatgaagtgcgtaagcaatacgtggtgacggcacgtgcgaaaggggtaagtgaaaaaaatattctctggaaacatgtgttccgcaacgccatgctgctggtgattgccggttttccggcgacgtttatcagcatgttttttaccggctcgctgctgattgaggtgatgttttcactcaatggtcttggcttactgggctacgaagcgaccgtctcgcgcgattatcctgtaatgtttggtaccttgtatattttcaccctgattggcctgctgctgaatattgtcagtgatatcagctatacgctggtcgatccgcgtatagactttgagggacgttaa

SEQ ID NO: 5292 - protein, 364 aa, Escherichia coli
MGAYLIRRLLLVIPTLWAIITINFFIVQIAPGGPVDQAIAAIEFGNAGVLPGAGGEGVRASHAQTGVGNISDSNYRGGRGLDPEVIAEITHRYGFDKPIHERYFKMLWDYIRFDFGDSLFRSASVLTLIKDSLPVSITLGLWSTLIIYLVSIPLGIRKAVYNGSRFDVWSSAFIIIGYAIPAFLFAILLIVFFAGGSYFDLFPLRGLVSANFDSLPWYQKITDYLWHITLPVLATVIGGFAALTMLTKNSFLDEVRKQYVVTARAKGVSEKNILWKHVFRNAMLLVIAGFPATFISMFFTGSLLIEVMFSLNGLGLLGYEATVSRDYPVMFGTLYIFTLIGLLLNIVSDISYTLVDPRIDFEGR

SEQ ID NO: 5293 - DNA, 1026 bp, Escherichia coli
atgtcgcgactcagccccgtcaatcaggcccgttgggcgcgttttcgccataaccgtcgcggctactggtcgttatggattttcctcctcttgtttggtttgagtttgtgttctgaacttatcgccaacgataaaccgttgctggtgcgttatgacggcagttggtatttcccgttgttgaaaaactacagcgaaagcgattttggcggcccgctggcaagtcaggctgattatcaggacccgtggctgaaacaacgactggaaaataacggctgggtactgtgggcaccgattcgctttggtgctaccagtatcaactttgctaccgataagcccttcccttctccaccctcccggcaaaactggctgggaacggatgccaatggcggcgatgtgctggcgcgcattctctatggcacgcggatctcagttctgtttggcctgatgctgaccctctgctccagcgtgatgggcgtgctggcgggggcgctacaaggctattacggtggtaaagtcgatctctgggggcaacgttttattgaagtatggtcggggatgccgacgctgtttttgattattttactttccagcgtcgtacagcctaacttctggtggctgttggcaattaccgtcttgtttggctggatgagtctggtcggcgtggtgcgggcggagtttttacgtacccgtaatttcgactacatccgcgcggcgcaggcgcttggcgtcagcgatcgcagtatcatcctgcgtcatatgttgccaaatgccatggtcgctaccctcacttttttaccgtttattttatgtagttcgataaccaccctgacctcactcgatttcctcggcttcggtctgccgctcggttcaccgtcactcggtgaactgctgttacaagggaaaaataaccttcaggccccgtggcttgggatcaccgccttcttatcggtggcgatattgttgtctttgctgatctttattggtgaagccgtccgcgacgcatttgatcctaataaggcggtgtag

SEQ ID NO: 5294 - protein, 341 aa, Escherichia coli
MSRLSPVNQARWARFRHNRRGYWSLWIFLLLFGLSLCSELIANDKPLLVRYDGSWYFPLLKNYSESDFGGPLASQADYQDPWLKQRLENNGWVLWAPIRFGATSINFATDKPFPSPPSRQNWLGTDANGGDVLARILYGTRISVLFGLMLTLCSSVMGVLAGALQGYYGGKVDLWGQRFIEVWSGMPTLFLIILLSSVVQPNFWWLLAITVLFGWMSLVGVVRAEFLRTRNFDYIRAAQALGVSDRSIILRHMLPNAMVATLTFLPFILCSSITTLTSLDFLGFGLPLGSPSLGELLLQGKNNLQAPWLGITAFLSVAILLSLLIFIGEAVRDAFDPNKAV

SEQ ID NO: 5295 - DNA, 1590 bp, Escherichia coli
atgacgcaaactctgttagcgattgaaaatttgtcggtgggttttcgccatcagcaaaccgtacgtacagtagtaaatgatgtttcactacagattgcggctggcgaaacgctggcgctggtaggtgagtctggttcaggtaagagcgttaccgcgctgtcaattttacgcctgctcccttgcccgccggttgaatatctctccggcgatattcgttttcatggcgaatcgctgcttcatgccagcgatcaaacgttgcgcggtatacgcggtaataagatcgccatgatttttcaggagccgatggtgtcgttaaatccattacataccctggaaaaacagctttatgaagtgctttcactccaccgcgggatgcgtcgggaagcggctcgtggcgaaattcttaactgccttgatcgcgtcggtatccgccaggcggcaaaacggctgacagattatccgcatcagctctccggcggcgaacgccagcgggtgatgattgcgatggcgctgttaacgcgaccggaattattaattgccgatgaaccaaccaccgcgctggacgtctctgtccaggcgcagattttacagctgttgcgcgaactgcaaggcgagctgaatatgggcatgctgtttattactcataacctcagcattgtcagaaaactggcccaccgcgtggcggtaatgcaaaacggtcgctgtgtcgagcaaaataacgctgctacgctatttgcctcacccactcatccttacacacaaaagctactcaacagtgaaccatctggcgacccggtgccattgccagaacctgcctcaacgttgctagatgttgaacagcttcaggttgccttccccatccgcaaagggattttgaagcgcattgtggatcataatgtggtggtgaaaaacatcagttttacgctacgggcgggtgaaacactgggtttagtgggcgagtccggttccgggaaaagcacgacgggactggcgctgctgcgactgattaactctcagggcagcatcgtctttgacggtcagccactgcaaaatttaaatcgccgccagctgttacctattcgtcatcgcattcaggtggtatttcaggatccaaactcctcactcaacccacgactcaacgttttgcaaattattgaggaaggcttacgggttcaccagccgacgctttctgccgcacaacgcgaacaacaagtgatagccgtgatgcatgaagtgggattagatcctgaaacacgccaccgttatccggcggagttctctggtggtcagcggcaacgtattgcgattgccagggcgttaattcttaagccctcgctgatcattcttgatgaaccaacatcatcactcgacaaaacggtgcaggcgcaaatattgacgctattgaaatcattgcaacaaaagcatcaactggcctatttgtttatcagccacgatttgcacgttgtccgcgcgttatgtcatcaggttatcgtactgcgacaaggggaagtagtggaacaaggaccgtgcgcgcgcgtgtttgccgcaccgcagcaggagtatacgcgtcagctactggcgttgagctga

SEQ ID NO: 5296 - protein, 529 aa, Escherichia coli
MTQTLLAIENLSVGFRHQQTVRTVVNDVSLQIAAGETLALVGESGSGKSVTALSILRLLPCPPVEYLSGDIRFHGESLLHASDQTLRGIRGNKIAMIFQEPMVSLNPLHTLEKQLYEVLSLHRGMRREAARGEILNCLDRVGIRQAAKRLTDYPHQLSGGERQRVMIAMALLTRPELLIADEPTTALDVSVQAQILQLLRELQGELNMGMLFITHNLSIVRKLAHRVAVMQNGRCVEQNNAATLFASPTHPYTQKLLNSEPSGDPVPLPEPASTLLDVEQLQVAFPIRKGILKRIVDHNVVVKNISFTLRAGETLGLVGESGSGKSTTGLALLRLINSQGSIVFDGQPLQNLNRRQLLPIRHRIQVVFQDPNSSLNPRLNVLQIIEEGLRVHQPTLSAAQREQQVIAVMHEVGLDPETRHRYPAEFSGGQRQRIAIARALILKPSLIILDEPTSSLDKTVQAQILTLLKSLQQKHQLAYLFISHDLHVVRALCHQVIVLRQGEVVEQGPCARVFAAPQQEYTRQLLALS

SEQ ID NO: 5297 - DNA, 345 bp, Escherichia coli
gtgacttcattacaactctcaatcgtccatcgactgccgcagaactatcgctggtctgctggtttcgcaggttcgaaggttgaaccgattccgcaaaatggaccgtgcggtgacaacagcctggtggcgcttaaattgcttagcccggatggtgataatgcatggtcggtgatgtacaaactaagccaggcgttaagcgacatcgaagttccatgttcggtgctggagtgtgaaggtgagccgtgcctgtttgtaaatcgccaggacgaatttgctgcaacatgccgattgaaaaattttggtgtggcaattgccgaacccttttcaaactacaatcctttttaa

SEQ ID NO: 5298 - protein, 114 aa, Escherichia coli
MTSLQLSIVHRLPQNYRWSAGFAGSKVEPIPQNGPCGDNSLVALKLLSPDGDNAWSVMYKLSQALSDIEVPCSVLECEGEPCLFVNRQDEFAATCRLKNFGVAIAEPFSNYNPF

SEQ ID NO: 5299 - DNA, 1191 bp, Escherichia coli
gtgaccacccgacagcattcgtcgtttgctattgtttttatccttggcctgctggccatgttgatgccgctgtcgattgatatgtatctgcctgcgctaccggtaatttcagcgcagtttggtgtaccggcgggcagtacgcagatgaccctgagtacttatattctgggctttgcgttggggcagttaatctacgggccgatggcagacagcttcgggcgtaagccggtggttcttggcggtacgctggtgtttgccgccgccgcggtggcgtgtgcgttggcgcaaaccatcgatcagctgattgtgatgcgtttcttccacgggctggctgcggctgcggccagcgtggttatcaacgctttgatgcgtgatatctacccgaaagaagagttctcacggatgatgtcgtttgtcatgctggtgacgaccattgcaccgctgatggcaccgatagttggcggctgggtgctggtgtggctgagctggcattacatcttctggatcctcgccgtggcggcgattctggcttcggcaatgatcttctttctgatcaaagaaaccttaccgccggagcgtcgccagccttttcacattcgtaccactattggtaactttgcggcgctgttccgtcataagcgtgtcctgagttatatgctggccagcggtttcagctttgccgggatgttctcattcttaagcgccggaccgtttgtctacattgaaatcaaccacgtcgcgccggaaaactttggttattactttgcgctaaacattctttttctgttcgtgatgaccatctttaacagccgcttcgtccgccgtattggcgcgttaaatatgttccgctcggggttgtggatacagtttattatggcagcgtggatggtcatcagtgcactgctggggctgggattctggtcgctggtggttggcgttgcggcgtttgtgggctgcgtgtcgatggtgtcatccaatgcgatggcggtcattcttgatgagtttccccatatggcgggaacggcatcttcgctggcaggaaccttccgtttcggcataggggcaattgttggcgcattactttctcttgcgacctttaactctgcatggccgatgatttggtcaattgcattctgcgcaaccagctccattctcttctgtttgtacgccagtcggccgaaaaaacggtga

SEQ ID NO: 5300 - protein, 396 aa, Escherichia coli
MTTRQHSSFAIVFILGLLAMLMPLSIDMYLPALPVISAQFGVPAGSTQMTLSTYILGFALGQLIYGPMADSFGRKPVVLGGTLVFAAAAVACALAQTIDQLIVMRFFHGLAAAAASVVINALMRDIYPKEEFSRMMSFVMLVTTIAPLMAPIVGGWVLVWLSWHYIFWILAVAAILASAMIFFLIKETLPPERRQPFHIRTTIGNFAALFRHKRVLSYMLASGFSFAGMFSFLSAGPFVYIEINHVAPENFGYYFALNILFLFVMTIFNSRFVRRIGALNMFRSGLWIQFIMAAWMVISALLGLGFWSLVVGVAAFVGCVSMVSSNAMAVILDEFPHMAGTASSLAGTFRFGIGAIVGALLSLATFNSAWPMIWSIAFCATSSILFCLYASRPKKR

SEQ ID NO: 5301 - DNA, 792 bp, Escherichia coli
ttgagggaagttattagaccgctatactgggcagacaacagttcagattttcgggtcattacccgacctccgttttttacaggcaaaatcacacacatgcgacttgataaatttatcgcacagcaactcggtgttagccgtgctattgccgggcgtgaaatccgcggcaatcgtgtcaccgtcgatggcgaaatcgtccgtaatgcagcgttcaaactgctccctgaacatgatgtcgcttacgatggcaacccgctggcgcagcaacacggtccacgttacttcatgctcaataagcctcagggctatgtttgctccacggacgacccggatcacccaacggtgctctattttcttgatgaaccggtagcgtggaaactgcacgctgcagggcgtctggatatcgataccaccggtctggtactaatgacagatgatggtcagtggtcgcaccgcattacttccccgcgccatcattgcgagaagacctatctggtgacgctggaatcacccgtagctgacgatacggcagagcaatttgctaaaggcgtgcagctgcataacgaaaaagatctcactaagccggcggtgctggaagtgattaccccaacgcaggttcgtctgaccatcagcgaagggcgttatcatcaggtgaaacgcatgttcgccgccgtgggtaaccatgtggttgagctgcatcgtgaacgtattggcggcattacgctggatgctgatttagcccccggtgaatatcgtccgttaactgaagaagaaattgccagcgtcgtctaa

SEQ ID NO: 5302 - protein, 263 aa, Escherichia coli
MREVIRPLYWADNSSDFRVITRPPFFTGKITHMRLDKFIAQQLGVSRAIAGREIRGNRVTVDGEIVRNAAFKLLPEHDVAYDGNPLAQQHGPRYFMLNKPQGYVCSTDDPDHPTVLYFLDEPVAWKLHAAGRLDIDTTGLVLMTDDGQWSHRITSPRHHCEKTYLVTLESPVADDTAEQFAKGVQLHNEKDLTKPAVLEVITPTQVRLTISEGRYHQVKRMFAAVGNHVVELHRERIGGITLDADLAPGEYRPLTEEEIASVV

SEQ ID NO: 5303 - DNA, 1761 bp, Escherichia coli
atgatttttacactccgcccatatcagcaagaagccgtggatgccacgctcaaccattttcgtcgtcataaaacccctgccgtaatcgtgctgcccaccggtgcaggtaaaagcctggtgatagcggaactggcgcggctggcgcgtggtcgcgtgctggtgttggcacacgttaaagaactggtggcacaaaaccatgaaaaatatcaggcgctggggctggaagccgatatttttgccgccgggctaaagcgcaaagagagccacggtaaagttgtatttggcagcgtgcagtcggtcacccgtaatcttgatgcctttcagggtgaattttcgctgttgattgtcgatgaatgccaccgtattggtgacgatgaagagagccagtatcagcaaatcctcactcacctgaccaaagtgaatccccacttacgcctgctggggctgactgccacgccttttcgactgggcaaaggctggatttatcagttccattatcacggcatggtacgcggcgatgagaaagcccttttccgtgactgcatttatgagctgccgctgcgttatatgattaaacacggctatctgacgccgccagaacggctggatatgccagtcgtgcaatacgatttcagccgcttgcaggcacagagtaacggactgttcagcgaagccgatctcaaccgcgagctgaaaaaacagcaacgcattacgccacacatcatcagccaaatcatggagtttgctgcaacgcgcaaaggggtgatgattttcgccgcgacggtcgaacacgcaaaagagattgtgggattactgcctgccgaagatgcagcactgattactggcgacacacccggctctgagcgcgatgtgttaattgatgattttaaagcccagcgttttcgctatctggtcaacgtcgcggtactgaccaccggatttgacgccccgcacgtcgatcttatcgccattctgcgccctaccgaatcagtgagtctttaccaacaaattgtcgggcgcggtctgcgcctggcccccggcaagactgattgcttaattcttgattatgcgggtaaccctcacgatctctacgcgccggaagttggtacaccgaaaggcaaaagtgacaacgttccggtacaggttttctgccctgcctgcggttttgccaacaccttttgggggaaaacgaccgccgacgggacattgattgaacactttggtcgtcgctgtcagggatggtttgaagatgacgacggacatcgcgaacagtgtgacttccgtttccgttttaaaaattgcccgcaatgtaacgcagaaaatgatattgccgctcgccgctgccgcgaatgtgacacggtactggttgatccggatgatatgttaaaagcggcgctacgactgaaagacgcgctggtattacgctgtagcggcatgtctttgcagcatggacacgacgagaaaggcgaatggttgaaaatcacctattacgatgaagacggcgcggatgtgagtgagcgtttccgtctgcaaacgcccgcccagcgtaccgccttcgagcagctttttatccgcccgcatacgcgcacaccgggcatccctctgcgctggatcaccgccgccgatatcctcgcccagcaagcattactgcgacacccggattttgtcgtcgcccgcatgaaaggtcagtactggcaagtgcgtgaaaaagtgttcgattacgaaggtcgttttcgtcgggcgcacgaattacgcggttaa

SEQ ID NO: 5304 - protein, 586 aa, Escherichia coli
MIFTLRPYQQEAVDATLNHFRRHKTPAVIVLPTGAGKSLVIAELARLARGRVLVLAHVKELVAQNHEKYQALGLEADIFAAGLKRKESHGKVVFGSVQSVTRNLDAFQGEFSLLIVDECHRIGDDEESQYQQILTHLTKVNPHLRLLGLTATPFRLGKGWIYQFHYHGMVRGDEKALFRDCIYELPLRYMIKHGYLTPPERLDMPVVQYDFSRLQAQSNGLFSEADLNRELKKQQRITPHIISQIMEFAATRKGVMIFAATVEHAKEIVGLLPAEDAALITGDTPGSERDVLIDDFKAQRFRYLVNVAVLTTGFDAPHVDLIAILRPTESVSLYQQIVGRGLRLAPGKTDCLILDYAGNPHDLYAPEVGTPKGKSDNVPVQVFCPACGFANTFWGKTTADGTLIEHFGRRCQGWFEDDDGHREQCDFRFRFKNCPQCNAENDIAARRCRECDTVLVDPDDMLKAALRLKDALVLRCSGMSLQHGHDEKGEWLKITYYDEDGADVSERFRLQTPAQRTAFEQLFIRPHTRTPGIPLRWITAADILAQQALLRHPDFVVARMKGQYWQVREKVFDYEGRFRRAHELRG

SEQ ID NO: 5305 - DNA, 381 bp, Escherichia coli
ttgagtatagaatctcgcccgcttttgcatacgcaaagcagatcacttacctgttgctgggtcgcctgtagcaggattaatttaagagagaaagaaatgtttactatcaacgcagaagtacgtaaagagcagggtaagggtgcgagccgccgcctgcgtgccgctaacaagttcccggcaatcatctacggtggcaaagaagcgccgctggctgtcgaactggatcacgacaaagtcatgaacatgcaagttaaagctgaattctacagcgaagttctgaccatcgttgttgacggtaaagaaatcaaagttaaagctcaggacgtacagcgtcacccgtacaaaccgaagctgctgcacatcgacttcgttcgcgcttaa

SEQ ID NO: 5306 - protein, 126 aa, Escherichia coli
MSIESRPLLHTQSRSLTCCWVACSRINLREKEMFTINAEVRKEQGKGASRRLRAANKFPAIIYGGKEAPLAVELDHDKVMNMQVKAEFYSEVLTIVVDGKEIKVKAQDVQRHPYKPKLLHIDFVRA

SEQ ID NO: 5307 - DNA, 1008 bp, Escherichia coli
atgagtctggatatcaaccagattgctctgcaccagcttatcaagcgtgatgagcagaaccttgagctggtgttgcgcgattcattgctggaaccgacggaaaccgtcgttgagatggtggcagaactgcatcgggtctatagcgccaaaaataaagcttacggcttgtttagcgaagagagtgaactggcgcagacgctgcgcttacagcgtcagggcgaagaggactttctggcatttagccgcgcggcaaccggtcgcctgcgtgacgaattagcgaaatatccttttgctgacggtggattcgtgctgttttgccactatcgctatctggcggtggagtatctgctggtggcagttctgagcaacctgagcagtatgcgtgttaacgaaaatctcgacatcaacccaacccattatcttgatatcaatcatgcggatattgttgcgcgtatcgatttaaccgagtgggaaaccaatccagagtcgacccgctatctcactttcctgaaagggcgagtagggcgcaaagtggcggatttctttatggatttcctcggtgccagcgaagggttaaacgcgaaagcgcaaaaccgtgggctgttgcaagcggtcgatgatttcactgccgaagcacaactggataaagcagagcgacagaacgtgcgccagcaggtttatagctactgtaatgagcagctgcaggcaggtgaagagattgaactggaatcgctgtcgaaagagctggcaggcgtcagcgaagtgagcttcacggagtttgcggctgaaaaaggctacgaactggaagagagcttcccggcagaccgtagcacactgcgtcagttgacgaagtttgccggtagcggcggtggcttgactattaactttgatgcgatgctgttaggtgaacgcatcttctgggatccagcaaccgataccctgaccattaaaggcacgccgccgaacttgcgcgatcaattgcagcgccggacgtctggcggcaattaa

SEQ ID NO: 5308 - protein, 335 aa, Escherichia coli
MSLDINQIALHQLIKRDEQNLELVLRDSLLEPTETVVEMVAELHRVYSAKNKAYGLFSEESELAQTLRLQRQGEEDFLAFSRAATGRLRDELAKYPFADGGFVLFCHYRYLAVEYLLVAVLSNLSSMRVNENLDINPTHYLDINHADIVARIDLTEWETNPESTRYLTFLKGRVGRKVADFFMDFLGASEGLNAKAQNRGLLQAVDDFTAEAQLDKAERQNVRQQVYSYCNEQLQAGEEIELESLSKELAGVSEVSFTEFAAEKGYELEESFPADRSTLRQLTKFAGSGGGLTINFDAMLLGERIFWDPATDTLTIKGTPPNLRDQLQRRTSGGN

SEQ ID NO: 5309 - DNA, 120 bp, Escherichia coli
ttgatgaaagggcaacatattaccgtagcaacggttttttttctgcttttttatgcgttaaatcattctcgttacgccgccttctgtaaaatgaccgccatcttttattgcgtcgcttaa

SEQ ID NO: 5310 - protein, 39 aa, Escherichia coli
MMKGQHITVATVFFLLFYALNHSRYAAFCKMTAIFYCVA

SEQ ID NO: 5311 - DNA, 228 bp, Escherichia coli
atgccacaaatttcccgctacagtgatgaacaggttgaacaattgctcgcagagctgctcaacatactggaaaaacataaggctccgaccgacctttccctgatggtgttaggcaacatggtcactaaccttatcaacaccagcattgccccggcccaacgccaggcaattgccaactcttttgcccgcgccttacagtcctctatcaacgaagacaaagcgcactaa

SEQ ID NO: 5312 - protein, 75 aa, Escherichia coli
MPQISRYSDEQVEQLLAELLNILEKHKAPTDLSLMVLGNMVTNLINTSIAPAQRQAIANSFARALQSSINEDKAH

SEQ ID NO: 5313 - DNA, 1761 bp, Escherichia coli
atggtaactcatcgtcagcgctaccgtgaaaaagtctcccagatggtcagttgggggcactggtttgcactgttcaatattctgctttcgctcgtcattggcagccgttacctgtttatcgccgactggccgacaacgcttgctggtcgcatttattcctacgtaagcattatcggtcatttcagcttcctggtgttcgccacctacttgctgatcctcttcccgctaacctttatcgtcggctcccagaggctgatgaggtttttgtccgtcattctggcaacggcgggaatgacgctattactgatcgacagcgaagtctttactcgtttccatctccatcttaatcccatcgtctggcagctggttatcaacccagacgaaaatgagatggcgcgcgactggcagctaatgttcatcagtgtgccggttattttattgcttgaactggtgtttgcgacgtggagctggcaaaagctgcgcagcctgacgcgtcgtcggcgcttcgcgcgcccgctggccgcattcttatttatcgcctttatcgcctcgcatgtggtttatatctgggccgatgccaacttctatcgcccgatcaccatgcagcgcgctaacctgccgctttcgtacccgatgacggcacgacgttttcttgagaagcatggcctgcttgatgcgcaggagtatcaacgccgtcttattgagcaaggcaatccagacgccgtttccgttcagtatccgttaagcgaactgcgctatcgcgatatgggcaccgggcagaatgtgctgttgattactgtcgatggcctgaactactcacgcttcgagaagcagatgcctgcgctggcaggttttgctgagcaaaatatttcgttcacgcgccatatgagctccggcaacactacagacaacggcatctttggtctgttctatggcatctcgccgagctatatggacggcattctgtcgactcgtacgcctgcggcgttaattactgcgcttaatcagcaaggctatcagctggggttattctcatcagatggctttaccagcccgctgtatcgtcaggcattgttgtcagatttctcgatgccgagtgtacgcacccaatccgacgaacagaccgccacgcagtggatcaactggctgggccgctacgcacaagaagataaccgctggttctcgtgggtctctttcaatggcacaaacattgacgacagcaatcagcaggcatttgcacggaaatatagccgggcggcaggcaatgtcgatgaccagatcaaccgcgtgctcaatgcactgcgtgattctggcaaactggacaatacggtggtgattatcactgccgggcggggtattccgctgagcgaagaggaagaaacctttgactggtcccacggtcatctgcaggtgccattagtgattcactggccaggcacgccggcgcagcgtattaatgcgctgactgatcataccgatctgatgacgacgctgatgcaacgcctgctacatgtcagcacacctgccagcgaatattcgcaaggtcaggatttgttcaaccctcaacgccgccattactgggttaccgccgcggataacgatacgctggcaattaccaccccgaaaaagacactggtgctgaacaataacggtaaataccgcacttacaacttacgtggtgaaagagtgaaagatgaaaaaccacagttaagtttgttattgcaagtactgacagacgagaagcgttttatcgctaactga

SEQ ID NO: 5314 - protein, 586 aa, Escherichia coli [sequence omitted]

SEQ ID NO: 5315 - DNA, 486 bp, Escherichia coli
atgggtggcgcggtaaatcagactacgatcaataatggagtgctacaggtttatggcgcggcgaatgatcccacgattaaaggagggcgcggtgatgcggcatttacgttgggcaatgccggaagcgttgttgatatcagtacgtatgaatataccttgctggataatggcaaccatagctggagtctcgcagagaatcgcgtacaaatgcccccttcaaccacggatgtgctgaatatggcggcagcacaaccgctggtatttgatgtagaactggacaccgtgcgtgggcgtcttggtagcgtaaaaggcgttaattacgatacggcgatgtggagttcggcaattaacagccgcaacaacgtgaacactgatgcgggagctggctttgagcaaacattgacgggcctgacgctcggtatcgatagtcgtttctcccgtgaagaaagcagcacaactcaggcgggtgtagtctggacgttctga

SEQ ID NO: 5316 - protein, 161 aa, Escherichia coli
MGGAVNQTTINNGVLQVYGAANDPTIKGGRGDAAFTLGNAGSVVDISTYEYTLLDNGNHSWSLAENRVQMPPSTTDVLNMAAAQPLVFDVELDTVRGRLGSVKGVNYDTAMWSSAINSRNNVNTDAGAGFEQTLTGLTLGIDSRFSREESSTTQAGVVWTF

SEQ ID NO: 5317 - DNA, 648 bp, Escherichia coli
atgcctgaagcaacgccttttcaggtgatgattgtggatgatcatccacttatgcgacgcggtgttcgtcagttactggagcttgattctggctttgaagtggtcgccgaagcgggcgacggcgcaagcgcgatcgatctggcgaatagactggatatcgacgtgatcttgctggatctcaatatgaaaggcatgagtggcctggataccctcaatgccttgcgcagggatggcgttaccgcgcaaattattatcctgaccgtatcagatgcctccagcgatgtctttgcactgatagacgcaggcgcagacggttatctgttgaaagacagcgacccggaagtgttactggaagcaattcgtgccggagcgaaaggcagcaaagtctttagcgaacgcgtcaatcagtacttacgtgaacgtgaaatgtttggcgcggaagaagaccccttcagcgtgctgacagaacgcgagctggatgttctgcacgagctggcacaggggctgtcaaataaacagattgcctcggtgttgaatatttccgagcagacagtaaaagtccatattcgcaatctgctgcgtaaactcaacgtccgctcacgcgtggcggccaccattctgttcctgcaacaacgcggggcacaataa

SEQ ID NO: 5318 - protein, 215 aa, Escherichia coli
MPEATPFQVMIVDDHPLMRRGVRQLLELDSGFEVVAEAGDGASAIDLANRLDIDVILLDLNMKGMSGLDTLNALRRDGVTAQIIILTVSDASSDVFALIDAGADGYLLKDSDPEVLLEAIRAGAKGSKVFSERVNQYLREREMFGAEEDPFSVLTERELDVLHELAQGLSNKQIASVLNISEQTVKVHIRNLLRKLNVRSRVAATILFLQQRGAQ

SEQ ID NO: 5319 - DNA, 1053 bp, Escherichia coli
atgaggtttttattgggcgtgctgatgctgatgatctccggctcagcgctggcgaccatcgacgtgttgcagtttaaagatgaagcacaggaacaacagttccgtcagctcactgaagaactgcgctgcccgaaatgccagaacaacagcattgccgattccaactcgatgattgccaccgacctgcgccagaaagtgtatgaactgatgcaggaaggcaaaagtaagaaagagattgtcgattatatggtggcgcgttacggcaacttcgtcacttacgatccgccgttaacgccgctgaccgtgctgctgtgggtgctgccagtagtggctattggcattggcggttgggtcatatacgcccgttcgcggcgtcgggtacgcgtggtgctggaagcgtttccagaacaaagcgtgccggaaggtaagcgtgccggatatgttgtttatctgccgggtattgtggtggcgttaattgtggctggcgtcagctactaccagactggcaattatcagcaggtgaaaatctggcagcaggccacggcacaggctccggcgttactggacagggcgctggatccgaaagccgatccgctcaacgaagaagagatgtcgcgccttgcgctggggatgcgtactcaactgcaaaaaaatccgggagatatagaaggctggattatgttgggccgcgttggcatggcgctgggtaacgccagtatcgccaccgatgcatacgccactgcgtatcgcctcgatccgaaaaacagcgatgctgcactgggatacgctgaagcgttgacacgttcatctgatcccaacgacaaccgcctcggcggcgaactgctgcgccagttggtgagaacggaccatagcaatatccgtgtgttaagcatgtatgcatttaatgcctttgagcagcaacgatttggcgaagccgttgccgcgtgggagatgatgttgaaactcttacctgccaacgatactcgccgtgcggtgatcgaacgtagtatcgcgcaggcgatgcaacatttgtcgccgcaggagagtaaataa

SEQ ID NO: 5320 - protein, 350 aa, Escherichia coli
MRFLLGVLMLMISGSALATIDVLQFKDEAQEQQFRQLTEELRCPKCQNNSIADSNSMIATDLRQKVYELMQEGKSKKEIVDYMVARYGNFVTYDPPLTPLTVLLWVLPVVAIGIGGWVIYARSRRRVRVVLEAFPEQSVPEGKRAGYVVYLPGIVVALIVAGVSYYQTGNYQQVKIWQQATAQAPALLDRALDPKADPLNEEEMSRLALGMRTQLQKNPGDIEGWIMLGRVGMALGNASIATDAYATAYRLDPKNSDAALGYAEALTRSSDPNDNRLGGELLRQLVRTDHSNIRVLSMYAFNAFEQQRFGEAVAAWEMMLKLLPANDTRRAVIERSIAQAMQHLSPQESK

SEQ ID NO: 5321 - DNA, 558 bp, Escherichia coli
atgaagcgcaaggtattgttaattccgttgattatcttcctggcgattgccgcggcgctgctgtggcagctggcgcgtaatgccgaaggggatgatccgaccaatctggaatcggcgctcattggcaagccagtgccgaagtttcgcctcgaatcactggacaatccggggcagttttatcaggcggatgtgctgactcagggcaaaccggtgctgcttaacgtctgggcgacctggtgtccgacctgccgtgcggaacatcaatatctgaatcagctttctgcgcagggcatccgcgtggtcggcatgaactataaagacgatcgccagaaggcaatcagctggctgaaagagctgggcaatccttacgcgctaagcctgtttgatggcgacggcatgttagggctggatctcggtgtctatggcgcgccagaaacgttccttattgacggcaacggcatcattcgctatcgccatgcgggcgatctcaatcctcgcgtctgggaagaagagatcaagccactgtgggagaaatacagtaaggaggccgcacaatga

SEQ ID NO: 5322 - protein, 185 aa, Escherichia coli
MKRKVLLIPLIIFLAIAAALLWQLARNAEGDDPTNLESALIGKPVPKFRLESLDNPGQFYQADVLTQGKPVLLNVWATWCPTCRAEHQYLNQLSAQGIRVVGMNYKDDRQKAISWLKELGNPYALSLFDGDGMLGLDLGVYGAPETFLIDGNGIIRYRHAGDLNPRVWEEEIKPLWEKYSKEAAQ

SEQ ID NO: 5323 - DNA, 1944 bp, Escherichia coli
atgatgccagaaattggtaacgggctgctgtgtctggcgctaggaattgcgctgctgctgtccgtgtatccgctatggggcgtggcgcgcggggacgcgcgcatgatggcgtcttcccgcttgtttgcctggctgctgtttatgtctgtggctggcgcatttctggtgctggtcaatgctttcgtggtcaacgactttaccgtcacctatgttgccagcaactccaatacccagcttccggtgtggtatcgcgtggcggctacctggggcgcgcatgaaggctcgctcctgctgtgggtgctgctgatgagcggctggacctttgcggtagcgatttttagtcagcgtattccgctggatattgtggcccgcgtactggcgataatggggatggtcagcgtcggctttttgctgttcattctctttacctctaacccgttctcacgcacgttgccgaacttcccgattgaaggtcgcgatcttaacccgctgttacaggatccggggctgatcttccatccgcctctgctttatatggggtacgtcggcttctcggtggcgtttgcttttgccattgcatctttgttgagtgggcgtctggacagcacttatgcgcgttttactcgtccgtggacgctggctgcgtggatcttcctgacgctcggcattgtgctcggttccgcatgggcctattacgaactcggctggggcggctggtggttctgggatccggtagaaaacgcctcgtttatgccgtggctggtggggactgcgctgatgcactcactggcggtcactgaacaacgcgccagcttcaaagcgtggacattactgctggcaatcagtgccttctcgttgtgtctactggggactttcctggtgcgttccggcgtgctggtatcggtacacgcgtttgcgtctgatccggcgcgcggtatgtttatcctcgcctttatggtgctggtgattggcggttcgctgctgctgtttgccgcgcgtggacacaaagttcgctcacgcgtaaacaatgcgctgtggtcgcgggaatctttgctgttagcgaacaacgttttgctggtcgccgcgatgctggtggtgttgctggggacgttgctgccgctggtgcacaagcaactgggactgggcagtatttcgattggcgaaccgttcttcaacaccatgtttacctggttgatggtgccgtttgcgctactgcttggtgtcggccctctggtgcgctggggacgcgatcgcccacgtaaaatccgcaatttgttgattatcgccttcatctctacgctggtgctgtcgctgctgttgccgtggctgttcgaaagcaaagttgtggcgatgacagtgctcggcctggcaatggcctgctggattgcggtgctggcaattgcggaagctgcgctgcgtatttcacgcggcacgaaaaccaccttcagttattgggggatggtggcggctcacctggggctggcagtgacaattgttggcattgcttttagtcagaactatagcgttgagcgtgatgtgcgcatgaagtccggcgatagcgtcgatattcatgaatatcgcttcaccttccgtgatgtcaaagaggtgaccggtccgaactggcgtggcggtgtggcgactatcggcgtaacgcgagatggcaagccggaaacagtgctgtatgcagaaaaacgttattacaacactgccgggtcgatgatgaccgaagcggcgattgacggtggcatcacgcgtgacctgtacgcggcactcggtgaagagctggaaaacggcgcgtgggccgtgcgtctttactacaaaccatttgttcgctggatttgggcgggcgggctgatgatggcgttgggcggactgctgtgtctgtttgatcctcgctatcgtaagcgcgtgaacccgcagaaaactgcgccggaggctgcatga

SEQ ID NO: 5324 - protein, 647 aa, Escherichia coli
MMPEIGNGLLCLALGIALLLSVYPLWGVARGDARMMASSRLFAWLLFMSVAGAFLVLVNAFVVNDFTVTYVASNSNTQLPVWYRVAATWGAHEGSLLLWVLLMSGWTFAVAIFSQRIPLDIVARVLAIMGMVSVGFLLFILFTSNPFSRTLPNFPIEGRDLNPLLQDPGLIFHPPLLYMGYVGFSVAFAFAIASLLSGRLDSTYARFTRPWTLAAWIFLTLGIVLGSAWAYYELGWGGWWFWDPVENASFMPWLVGTALMHSLAVTEQRASFKAWTLLLAISAFSLCLLGTFLVRSGVLVSVHAFASDPARGMFILAFMVLVIGGSLLLFAARGHKVRSRVNNALWSRESLLLANNVLLVAAMLVVLLGTLLPLVHKQLGLGSISIGEPFFNTMFTWLMVPFALLLGVGPLVRWGRDRPRKIRNLLIIAFISTLVLSLLLPWLFESKVVAMTVLGLAMACWIAVLAIAEAALRISRGTKTTFSYWGMVAAHLGLAVTIVGIAFSQNYSVERDVRMKSGDSVDIHEYRFTFRDVKEVTGPNWRGGVATIGVTRDGKPETVLYAEKRYYNTAGSMMTEAAIDGGITRDLYAALGEELENGAWAVRLYYKPFVRWIWAGGLMMALGGLLCLFDPRYRKRVNPQKTAPEAA

SEQ ID NO: 5325 - DNA, 480 bp, Escherichia coli
atgaatattcgccgtaaaaaccgcttgtggattgcctgtgccgtgctggcggggctggcgctgactatcggtctggtgctatatgcgctgcgctcgaatatcgatctcttttatacgccgggggagattctctacggcaagcgtgaaactcagcagatgccggaagtcggtcagcgtctgcgcgttggcgggatggtgatgccggggagtgtgcagcgcgatcccaattcgctaaaagtaactttcaccatttacgacgctgaaggttcagtagatgtctcttacgaaggcattttgccggatctgttccgtgaagggcagggcgttgtggtgcagggcgaactggaaaaaggcaatcatatcctcgcgaaagaagtgctggcgaaacacgatgaaaactacacgccgccagaagttgagaaagcgatggaagctaaccaccgtcgcccggcgagtgtttataaggacccagcatcatga

SEQ ID NO: 5326 - protein, 159 aa, Escherichia coli
MNIRRKNRLWIACAVLAGLALTIGLVLYALRSNIDLFYTPGEILYGKRETQQMPEVGQRLRVGGMVMPGSVQRDPNSLKVTFTIYDAEGSVDVSYEGILPDLFREGQGVVVQGELEKGNHILAKEVLAKHDENYTPPEVEKAMEANHRRPASVYKDPAS

SEQ ID NO: 5327 - DNA, 210 bp, Escherichia coli
atgacccctgcatttgcttcctggaatgaatttttcgcaatgggcggttacgccttttttgtctggttggcggtggtgatgaccgttattccgctggtggttttggtcgtgcactcggtgatgcaacatcgcgcaattctgcgtggcgtggcgcaacagcgggcgcgtgaggcgcgtttacgtgctgcgcaacagcaggaggctgcatga

SEQ ID NO: 5328 - protein, 69 aa, Escherichia coli
MTPAFASWNEFFAMGGYAFFVWLAVVMTVIPLVVLVVHSVMQHRAILRGVAQQRAREARLRAAQQQEAA

SEQ ID NO: 5329 - DNA, 762 bp, Escherichia coli
ttgttcgagtctggtatcgaaactatgtggaaaacactgcatcaactggcgatcccaccacggctgtatcaaatctgtggctggtttataccgtggctggcaattgccagtgtggtcgtgcttaccgtcggctggatctgggggttcggctttgctccggctgattatcagcagggaaatagctaccgcattatctacctgcatgtgcctgcggcgatctggtcgatgggcatttatgcatcaatggcggtggcagcgtttattggcctggtctggcagatgaaaatggccaacctggcggtggcggcgatggcccccattggtgccgtgtttacctttattgccctggttaccggctctgcatggggaaaaccgatgtggggcacctggtgggtatgggatgcacgtctgacttctgaactggtgctgctgtttctgtatgttggtgtcattgccctgtggcacgccttcgacgaccgtcgtctggctggccgtgcggcaggtatcctggtgctgattggcgtggtgaatctgccgattattcattactccgttgagtggtggaacaccctgcatcagggatcaacgcggatgcagcaaagtatcgatccggcgatgcgttcgccgctgcgctggtcgatttttggcttcctgctcctgtctgccacgctgacgctgatgcggatgcgtaatttgattttgctgatggaaaaacgccgtccgtgggtgagtgaactgatactgaaaagaggccgtaaatga

SEQ ID NO: 5330 - protein, 253 aa, Escherichia coli
MFESGIETMWKTLHQLAIPPRLYQICGWFIPWLAIASVVVLTVGWIWGFGFAPADYQQGNSYRIIYLHVPAAIWSMGIYASMAVAAFIGLVWQMKMANLAVAAMAPIGAVFTFIALVTGSAWGKPMWGTWWVWDARLTSELVLLFLYVGVIALWHAFDDRRLAGRAAGILVLIGVVNLPIIHYSVEWWNTLHQGSTRMQQSIDPAMRSPLRWSIFGFLLLSATLTLMRMRNLILLMEKRRPWVSELILKRGRK

SEQ ID NO: 5331 - DNA, 660 bp, Escherichia coli
atgttctggcgcattttccgtcttgagctgcgcgtagcgtttcgccatagcgccgaaatcgccaacccgctgtggttcttcctgattgtaattaccctttttccgctcagtatcggtccggagccgcaactgctggcgcgtattgcgccgggcattatctgggttgccgcgctgctttcatccttgctggcactcgagcgactgttccgtgacgatttgcaggacggcagtcttgaacaattgatgttgttgccgttacccttgcccgccgctgtgctggcgaaggtgatggcgcactggatggtaaccggtctgccgttacttatcctttcgcccctggtagcaatgctactgggaatggatgtttatggctggcaagtgatggcgttaacgctactgctgggaacccctacgcttggctttcttggtgcgccgggcgtggcgctgacagtgggacttaagcgcggtggtgtgctgctcagcatactggtgttaccgctgactatcccattactcatctttgccaccgccgcgatggacgcggcttctatgcatttgcccgttgatgggtatctggcaattttaggcgcgttgctggcaggcaccgcgacattaagtccttttgcgacggcggcagcgttacgaatcagcattcaataa

SEQ ID NO: 5332 - protein, 219 aa, Escherichia coli
MFWRIFRLELRVAFRHSAEIANPLWFFLIVITLFPLSIGPEPQLLARIAPGIIWVAALLSSLLALERLFRDDLQDGSLEQLMLLPLPLPAAVLAKVMAHWMVTGLPLLILSPLVAMLLGMDVYGWQVMALTLLLGTPTLGFLGAPGVALTVGLKRGGVLLSILVLPLTIPLLIFATAAMDAASMHLPVDGYLAILGALLAGTATLSPFATAAALRISIQ

SEQ ID NO: 5333 - DNA, 624 bp, Escherichia coli
gtgggtatgcttgaagccagagagttactttgcgagcgggatgaacgaaccttatttagtggtttatcatttacgctgaacgcaggagagtgggtacaaatcaccggtagcaacggcgcggggaagacaacgcttctccgtttgctgacggggttgtctcgccctgacgcaggcgaggttctctggcaagggcagcccttgcatcaggtacgcgacagctaccatcaaaacctgttatggataggccatcagccggggatcaaaacccggctgacggcgttagaaaatctgcacttttatcatcgcgatggcgataccgcacaatgtctggaagccctggcgcaggccgggcttgccggattcgaagatattccggtaaatcaactttctgccgggcaacaacgccgcgtcgctttagcgcgtctgtggttgacccgtgccacgttatggatactcgacgagccttttaccgcgattgacgttaacggcgtcgatcgtctgacccagcgtatggcgcagcatacggagcagggggggattgtgattctgactacccaccagccgctcaacgttgctgaaagtaaaattcgccgcatttcactgacgcaaacgggggccgcatga

SEQ ID NO: 5334 - protein, 207 aa, Escherichia coli
MGMLEARELLCERDERTLFSGLSFTLNAGEWVQITGSNGAGKTTLLRLLTGLSRPDAGEVLWQGQPLHQVRDSYHQNLLWIGHQPGIKTRLTALENLHFYHRDGDTAQCLEALAQAGLAGFEDIPVNQLSAGQQRRVALARLWLTRATLWILDEPFTAIDVNGVDRLTQRMAQHTEQGGIVILTTHQPLNVAESKIRRISLTQTGAA

SEQ ID NO: 5335 - DNA, 603 bp, Escherichia coli
atgggaaattctgaccgtaagcctggtctgattaagcgcctgtggaaatggtggcgtacccccagccgtctggcgctagggacgctgctgttgatcggttttgtcggcggcatcgtcttctggggcggctttaacaccgggatggaaaaagccaataccgaagagttctgcattagctgccacgaaatgcgtaacacggtgtatcaggaatacatggattccgtgcactacaacaaccgtagcggcgtccgtgcgacctgtccggattgtcacgttccgcacgagtttgtgccaaagatgatacgcaagctcaaagcaagtaaagagctgtatggtaaaatttttggcgttattgacacgccgcagaaatttgaagctcatcgcctgacgatggcacagaatgagtggcggcgcatgaaggacaacaactcgcaggagtgccgtaactgtcacaacttcgagtatatggatacaaccgcccagaaatcggttgccgcgaagatgcatgaccaggcggtgaaagatgggcaaacctgtattgattgccataaagggatagcgcacaagctgcccgacatgcgtgaagtcgagccaggtttttaa

SEQ ID NO: 5336 - protein, 200 aa, Escherichia coli
MGNSDRKPGLIKRLWKWWRTPSRLALGTLLLIGFVGGIVFWGGFNTGMEKANTEEFCISCHEMRNTVYQEYMDSVHYNNRSGVRATCPDCHVPHEFVPKMIRKLKASKELYGKIFGVIDTPQKFEAHRLTMAQNEWRRMKDNNSQECRNCHNFEYMDTTAQKSVAAKMHDQAVKDGQTCIDCHKGIAHKLPDMREVEPGF

SEQ ID NO: 5337 - DNA, 450 bp, Escherichia coli
atgaaaagccatgacctgaagaaagcgctgtgtcaatggacggcgatgctggccctggtggtaagcggcgcggtttgggcggctaatggcgtcgattttagccagtcgccggaagtatccgggacgcaggaaggggccattcggatgccaaaagagcaggatcggatgccgctgaactatgtgaatcagccgccaatgatcccgcatagcgttgaaggttatcaggtaacgaccaataccaaccgctgcttgcagtgccacggtgtcgaaagttatcgcaccactggcgcgccgcgcattagtcctactcactttatggacagcgacggcaaagtgggcgcggaagtggctccgcgtcgttatttctgtctgcaatgtcacgtaccgcaggccgataccgcgccaatcgtggggaatacctttaccccatcaaaaggttacgggaaataa

SEQ ID NO: 5338 - protein, 149 aa, Escherichia coli
MKSHDLKKALCQWTAMLALVVSGAVWAANGVDFSQSPEVSGTQEGAIRMPKEQDRMPLNYVNQPPMIPHSVEGYQVTTNTNRCLQCHGVESYRTTGAPRISPTHFMDSDGKVGAEVAPRRYFCLQCHVPQADTAPIVGNTFTPSKGYGK

SEQ ID NO: 5339 - DNA, 864 bp, Escherichia coli
atggcaaatcgtaaacgtgacgccgggcgcgaggcgctggagaaaaaaggctggtggcgcagtcaccgttggttagtgttacgtcgcctttgtcagttcttcgtgctggggatgtttttgagcggtccgtggtttggtgtgtggatcttgcacggcaactacagcagtagcctgttattcgacaccgttccactgaccgatccgctgatgacactgcaaagtcttgccagcggtcatctgcctgccacggtggcgttgaccggtgcggtgattatcaccgtgctctacgccctggcaggaaagcgattattttgcagctgggtctgtccgctgaacccgattaccgacttagcaaattggttacgcagacgatttgacctcaatcagtctgcgacgatccctcgccatattcgctacgtgctgttggtggtcattctggtgggatcggccttaactggcacgctcatctgggaatggatcaaccccgtttctctgatggggcgtagcctggtaatgggcttcggcagcggcgcgctgcttattctcgcgctgtttttatttgatctactggtcgttgaacacggctggtgcgggcacatttgtccggttggtgcactgtatggcgtgctgggtagcaaaggtgtgattaccgttgcggccaccgatcggcagaaatgtaaccgctgtatggattgttttcatgtttgcccggaaccgcatgtgctacgtgccccggtgctggatgaacaaagcccggtgcaggtcaccagccgcgattgcatgacgtgcggtcgctgcgtggatgtctgttctgaggatgtatttacaataactacacgatggagttcgggagcgaaatcatga

SEQ ID NO: 5340 - protein, 287 aa, Escherichia coli
MANRKRDAGREALEKKGWWRSHRWLVLRRLCQFFVLGMFLSGPWFGVWILHGNYSSSLLFDTVPLTDPLMTLQSLASGHLPATVALTGAVIITVLYALAGKRLFCSWVCPLNPITDLANWLRRRFDLNQSATIPRHIRYVLLVVILVGSALTGTLIWEWINPVSLMGRSLVMGFGSGALLILALFLFDLLVVEHGWCGHICPVGALYGVLGSKGVITVAATDRQKCNRCMDCFHVCPEPHVLRAPVLDEQSPVQVTSRDCMTCGRCVDVCSEDVFTITTRWSSGAKS

SEQ ID NO: 5341 - DNA, 696 bp, Escherichia coli
atgtcccggtcagcgaaacctcaaaatggtcgccgccgctttctgcgcgatgtcgttcgcacagcaggcgggctggctgccgtgggtgtggcgctggggttacaacagcaaaccgcacgcgcatctggcgtgcggttgcgcccgcccggagccataaacgagaacgcctttgccagtgcctgtgtgcgttgcggtcagtgtgttcaggcttgcccttacgacaccttaaaactggcgaccctggcctctggtctgtcggcgggcacgccatattttgtcgcacgggatattccttgcgaaatgtgtgaggacattccgtgcgccaaagtgtgcccgagcggtgcgctggatcgtgagatcgaatcgatcgacgacgcgcggatggggctggcggtactggtggaccaggaaaactgtctcaactttcaggggctgcgctgcgatgtttgttatcgcgaatgcccgaaaattgatgaggccatcaccctggagctggagcgcaacacgcgtaccggtaagcacgcccgctttctgccgacggttcacagcgacgcctgtaccggctgcggtaagtgcgaaaaagtgtgcgtgctggaacaaccggcaatcaaggtgttaccgctgtcactggcgaaaggggagttaggtcaccattaccgcttcggctggctggaggggaacaatggcaaatcgtaa

SEQ ID NO: 5342 - protein, 231 aa, Escherichia coli
MSRSAKPQNGRRRFLRDVVRTAGGLAAVGVALGLQQQTARASGVRLRPPGAINENAFASACVRCGQCVQACPYDTLKLATLASGLSAGTPYFVARDIPCEMCEDIPCAKVCPSGALDREIESIDDARMGLAVLVDQENCLNFQGLRCDVCYRECPKIDEAITLELERNTRTGKHARFLPTVHSDACTGCGKCEKVCVLEQPAIKVLPLSLAKGELGHHYRFGWLEGNNGKS

SEQ ID NO: 5343 - DNA, 2487 bp, Escherichia coli
atgaaactcagtcgtcgtagctttatgaaagctaacgccgttgcggccgctgcggcggctgccggtctcagcgtgccgggcgttgcccgcgccgttgttggtcagcaggaagccattaaatgggataaagcgccgtgccgtttctgcggtacgggttgcggcgttctggtcggaacgcagcaggggcgtgtggtggcctgtcagggcgacccggacgcaccggttaaccgtggcctgaactgcattaagggctatttcctgcccaaaatcatgtacggtaaagaccgtttgacgcagccgctgctgcgtatgaaaaacggtaaatatgacaaagaaggcgaatttaccccaatcacctgggatcaggccttcgatgtgatggaagataaattcaaaaccgccctgaaagaaaaagggccggaatcgatcggtatgttcggttctggtcagtggactatctgggaaggttatgccgcgtccaagttgttcaaagcgggcttccgttcgaacaacatcgacccgaacgcgcgtcactgtatggcgtcggcagtagttggctttatgcgtacctttggtatggatgagccgatgggctgctatgacgacatcgagcaggctgacgcgtttgtgctgtggggctccaacatggcggagatgcacccgatcctctggtcgcgcatcactaaccgtcgtctttctaaccagaacgtcaccgtggcggtgctttctacctaccagcatcgtagcttcgagctggcggataacggcatcatctttacgccgcaatctgacctggtgatcctgaactatatcgccaactatatcattcaaaacaatgcgataaatcaggacttcttcagcaaacacgttaacctgcgcaaaggggcgacggacatcggctacggtttacgtccgacccatccgctggaaaaagcagcgaagaatccgggttctgacgcctccgaaccgatgagctttgaagattacaaagccttcgttgctgaatatacgctggaaaaaaccgccgaaatgaccggcgtgccgaaagaccagttagaacaactggcgcagctgtatgccgatccgaacaagaaagtcatctcctactggacgatgggcttcaaccagcatacccgtggtgtgtgggccaacaacctggtctacaacctgcacctgctgaccggcaaaatttcccagccgggttgcggtccgttctccctgaccgggcagccttccgcgtgtggtactgcgcgtgaagtgggcacctttgctcaccgtctgcctgcggacatggtggtgactaacgagaaacaccgtgatatctgcgagaagaagtggaatatcccgagcggcaccattccggcgaaaatcggtctgcacgcggtggcacaagaccgtgcgctgaaagacggcaaactgaatgtttactggaccatgtgtaccaataacatgcaggccggaccgaacattaatgaagagcgtatgccgggctggcgcgatccgcgcaactttatcatcgtttccgatccgtatccgacagtcagtgcgctggccgccgacttgatcctgccgaccgcaatgtgggtagagaaagagggcgcttacggtaacgccgaacgccgtactcagttctggcgtcagcaggtacaggcaccgggcgaagcgaaatcggatctctggcagttagtccagttctcccgccgctttaaaactgaagaagtatggccggaagagctgctggcgaagaaaccggaactgcgtggcaaaacgctgtacgaagttctgtatgccaccccggaagtgagcaaattcccggtatccgaactggcggaagatcagctgaacgatgaatcccgcgagctgggcttctatctgcaaaaagggctgttcgaagagtacgcatggtttggtcgcggtcacggtcacgatctggcaccgttcgatgactaccacaaagcgcgcggtctgcgctggccggtggtgaacggtaaagaaacgcagtggcgttacagcgaaggtaacgacccgtacgtgaaagcgggcgaaggctataagttctacggtaaaccggatggtaaagcggtgatcttcgcgctgccgttcgaaccggcggcggaagcaccggatgaagagtacgacctgtggctctctaccggacgcgtcctggagcactggcacaccggcagtatgactcgccgtgtgccggaactgcaccgcgccttcccggaagcggtcctgtttattcacccgttggatgcgaaagcgcgcgatctgcgccgtggcgacaaagtgaaagtggtttctcgccgtggcgaagtgatctcgattgtcgaaacgcgcggccgtaaccgtccaccgcagggcctggtgtacatgccgttcttcgacgccgcacagctggttaacaaactgacgctggatgcgaccgatccgctctcgaaagagacggacttcaagaagtgcgcggtcaaactggagaaggtgtaa

SEQ ID NO: 5344 - protein, 828 aa, Escherichia coli
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEDKFKTALKEKGPESIGMFGSGQWTIWEGYAASKLFKAGFRSNNIDPNARHCMASAVVGFMRTFGMDEPMGCYDDIEQADAFVLWGSNMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 5345 - DNA, 264 bp, Escherichia coli
atgcacactaactggcaagtttgcagcctggtcgtgcaggccaaaagcgaacgaatttcagacatcagcacccaactgaacgcctttaccggctgtgaagttgctgtcagcgacgcgccgagcggtcagttgattgtggtggtggaagcagaagacagcgaaacgctgatccaaaccattgagtcagtacgcaacgtagagggcgtgctggcggtgtcgctggtttatcaccagcaggaagagcaaggtgaggaaacaccatga

SEQ ID NO: 5346 - protein, 87 aa, Escherichia coli
MHTNWQVCSLVVQAKSERISDISTQLNAFTGCEVAVSDAPSGQLIVVVEAEDSETLIQTIESVRNVEGVLAVSLVYHQQEEQGEETP

SEQ ID NO: 5347 - DNA, 495 bp, Escherichia coli
gtgaagattgatgcatcccgtcggggcatactcactggtcgctggcgcaaagccagtaacggtatccgtccgccctggtccggtgatgaatctcattttctgacccattgcacccgctgcgacgcctgtattaatgcttgtgaaaacaacattctgcaacgcggcgcgggtggctatccgagcgttaatttcaaaaataacgagtgcagcttctgttacgcctgcgcgcaggcttgccccgaatcgctattttctccgcgccacaccagggcctgggatttgcagttcaccattggggacgcgtgcctggcgtatcagtcagttgaatgccgccgctgtcaggatagctgtgagccaatggcaattatctttcgcccgacgctctccgggatctaccagccgcaacttaatagccaactttgcaacggatgtggagcatgtgcagccagctgtccggtatcagccataactgcggagtatctccatgcacactaa

SEQ ID NO: 5348 - protein, 164 aa, Escherichia coli
MKIDASRRGILTGRWRKASNGIRPPWSGDESHFLTHCTRCDACINACENNILQRGAGGYPSVNFKNNECSFCYACAQACPESLFSPRHTRAWDLQFTIGDACLAYQSVECRRCQDSCEPMAIIFRPTLSGIYQPQLNSQLCNGCGACAASCPVSAITAEYLHAH

SEQ ID NO: 5349 - DNA, 489 bp, Escherichia coli
atgaagaccattctacctgcagtattgtttgccgctttcgccaccacttccgcctgggcggcagaaagcgtccagccactggaaaaaatcgcaccttatccacaagctgaaaaaggcatgaagcgtcaggtgattcagttaactccgcaagaagatgaatctaccctgaaagtagaactgttaatcggtcagacgctggaagtcgactgcaatttgcatcgtctcggcgggaagctggaaagcaaaacgctggaaggctggggctatgattattatgtctttgataaagttagctcgccggtttccacgatgatggcctgcccggatggcaagaaagagaagaaatttgtcaccgcgtatctgggcgatgccggaatgctgcgttataacagcaagctgccgatcgtggtgtatacgccagacaatgtggatgtgaagtaccgcatctggaaggcggaagagaaaattgacaacgcggttgttcgctaa

SEQ ID NO: 5350 - protein, 162 aa, Escherichia coli
MKTILPAVLFAAFATTSAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRIWKAEEKIDNAVVR

SEQ ID NO: 5351 - DNA, 1524 bp, Escherichia coli
atgagcgccacgttggggacctatttacgcgagctggagcctgaatggtcgatgaccatggtggagcgcctggagggtgtcgcgcaggagagttcgaacggctggaacaacgccggaaccgggcattctgcactgatggaactgaactacaccccgcaaaacgccgatggcagcatcagtattgaaaaagcagtcgccattaacgaagcatttcagatttcgcgccagttctgggcgcaccaggtcgagcgcggcgtgctgcgtacaccgcgttcatttatcaataccgttccgcatatgagctttgtctggggcgaggataatgttaatttcctgcgagcccgttacgccgcgttgcaacaaagctcgctgtttcgcggtatgcgttactctgaagatcacgcgcagatcaaagagtgggcaccgttagtgatggaagggcgcgatccgcaacagaaagtggcagccacgcgtacggaaattggcactgatgtgaactatggcgagatcacccgccagttaattgcttccttgcagaagaaatctaatttttcgctgcaactcagcagcgaagtccgcgccctaaagcgtaatgacgataacacctggaccgttaccgttgccgatctgaaaaatggcactgcacagaacatccgcgccaaatttgtctttatcggcgcgggcggtgcggcgctgaagctgttacaggaatcggggattccggaagcgaaagactacgccggtttcccggtgggcggacagttccttgtttcggaaaatccggacgtggttaatcaccatctggcgaaggtttacggtaaagcatccgttggcgcaccgccgatgtcggttccgcatatcgatacccgtgtgctggacggtaaacgcgtcgtgttgtttgggccatttgccaccttctcaactaaattcctcaaaaacggttcattgtgggatctgatgagttccaccaccacctctaacgtgatgccgatgatgcacgtcgggctggataatttcgatctggtgaaatatctggtgagtcaggtgatgttgagtgaagaggatcgttttgaagcgttgaaagagtactatccgcaggcgaaaaaagaggactggcgtttgtggcaagcggggcagcgcgtgcagattatcaagcgtgatgccgataaaggtggcgtactgcgtctcggtactgaagtggtcagtgaccagcaagggaccattgccgcgctgctgggggcatcgccaggtgcgtcaaccgccgcgccgattatgttgaatctgctggaaaaagtatttggcgatcgcgtttccagcccgcaatggcaggcaacgttgaaggcgatcgttccgtcttatggacgcaagctgaacggtgatgtagcggcaacagaacgcgagttgcagtacaccagcgaagtgctggggctgaaatacgacaagccgcaggcagcagatagtacgccgaaaccgcagttgaaaccgcaacccgttcaaaaagaagtggcggatattgcgttgtaa

SEQ ID NO: 5352 - protein, 507 aa, Escherichia coli
MSATLGTYLRELEPEWSMTMVERLEGVAQESSNGWNNAGTGHSALMELNYTPQNADGSISIEKAVAINEAFQISRQFWAHQVERGVLRTPRSFINTVPHMSFVWGEDNVNFLRARYAALQQSSLFRGMRYSEDHAQIKEWAPLVMEGRDPQQKVAATRTEIGTDVNYGEITRQLIASLQKKSNFSLQLSSEVRALKRNDDNTWTVTVADLKNGTAQNIRAKFVFIGAGGAALKLLQESGIPEAKDYAGFPVGGQFLVSENPDVVNHHLAKVYGKASVGAPPMSVPHIDTRVLDGKRVVLFGPFATFSTKFLKNGSLWDLMSSTTTSNVMPMMHVGLDNFDLVKYLVSQVMLSEEDRFEALKEYYPQAKKEDWRLWQAGQRVQIIKRDADKGGVLRLGTEVVSDQQGTIAALLGASPGASTAAPIMLNLLEKVFGDRVSSPQWQATLKAIVPSYGRKLNGDVAATERELQYTSEVLGLKYDKPQAADSTPKPQLKPQPVQKEVADIAL

SEQ ID NO: 5353 - DNA, 105 bp, Escherichia coli
ttgcctgatgcgacgctgacgcgtcttatcagcatacgccacatccggcaaaccatgccggatgtggcacatcattacaacgcaatatccgccacttctttttga

SEQ ID NO: 5354 - protein, 34 aa, Escherichia coli
MPDATLTRLISIRHIRQTMPDVAHHYNAISATSF

SEQ ID NO: 5355 - DNA, 1644 bp, Escherichia coli
atggaacttcttgtacttgtctggcggcagtatcgctggccatttatcagtgtgatggcgctaagcctcgccagtgcggcattaggcattggcttaattgcttttatcaatcagcgccttatcaaaacggcggataccagtctactggtgttgccggagtttctgggattattgctgctgttgatggcagtcactctcggatcgcaactggcgctcaccactttggggcatcacttcgtttaccgactgcgtagtgaatttatcaagcggattctggatacccatgtcgagcgcattgaacaacttggtagcgcctcgttgctggcggggttaaccagcgatgtgcgcaatatcaccattgcttttgtgcgtctgccggaactggtgcaggggatcattctcactatcggttcagcggcgtatttgtggatgctgtcgggcaaaatgttgctggtaacggctatctggatggcagtcaccatctggggtggttttatactggtggcgcgggtgtacaaacatatggcgaccctgcgtgaaactgaagataagctgtacacggattttcaaaccgtactcgaagggcgcaaagagctgactctgaaccgtgaacgcgccgagtatgtgtttaacaacctctacattcstgatgcgcaagagtatcgccatcatattatccgcgcagacaccttccatcttagtgccgtgaactggtcaaacatcatgatgctgggcgcaatcggcctggtgttctggatggcgaacagtctcggttgggctgataccaacgttgccgcgacctattcgttgacgctgttattcctgcgtacgccgctgctttcggcggttggcgcattaccgacgctgctgacggcgcaggtggcgtttaacaagctgaacaaattcgcgctcacacctttcaaagcagagtttccacgcccgcaggcgtttcccaactggcaaacgctggagctgcgtaatgtgacgtttagctatcaggataacgcgttttccgttgggccgattaacctcaccattaaacgtggcgagctgctgtttctgattggtggcaacggtagtggaaaatcgacgctggcgatgttgctgacgggcttgtaccagccacaaaatggcgaaatcttgctggatggcaaacctgtcagcggcgaacaaccggaagattatcgaaaactgttttcggcagtgtttaccgatgtctggctgtttgatcaactgctggggccggaggggcaacccgctaacccgcaactggttgagaagtggctggcgcagctgaaaattgctcataagcttgagttaagcaacgggcgtattgttaacctgaagttatcaaaagggcagaaaaaacgcgtggcgctgttgctggcgctggcagaagaacgcgatattatcctgctggatgaatgggcggcggatcaggatccacacttccgtcgtgagttttatcaggtgctgctgccgctgatgcaggagatgggtaaaactattttcgccatcagtcatgatgatcattactttatccacgccgaccgcctgctggaaatgcgcaacgggcaacttagcgagctgacaggcgaagagcgcgatgctgcttcgcgtgatgccgttgcccggacggcataa

SEQ ID NO: 5356 - protein, 547 aa, Escherichia coli
  Xaa 216: Xaa is any amino acid
MELLVLVWRQYRWPFISVMALSLASAALGIGLIAFINQRLIKTADTSLLVLPEFLGLLLLLMAVTLGSQLALTTLGHHFVYRLRSEFIKRILDTHVERIEQLGSASLLAGLTSDVRNITIAFVRLPELVQGIILTIGSAAYLWMLSGKMLLVTAIWMAVTIWGGFILVARVYKHMATLRETEDKLYTDFQTVLEGRKELTLNRERAEYVFNNLYIXDAQEYRHHIIRADTFHLSAVNWSNIMMLGAIGLVFWMANSLGWADTNVAATYSLTLLFLRTPLLSAVGALPTLLTAQVAFNKLNKFALTPFKAEFPRPQAFPNWQTLELRNVTFSYQDNAFSVGPINLTIKRGELLFLIGGNGSGKSTLAMLLTGLYQPQNGEILLDGKPVSGEQPEDYRKLFSAVFTDVWLFDQLLGPEGQPANPQLVEKWLAQLKIAHKLELSNGRIVNLKLSKGQKKRVALLLALAEERDIILLDEWAADQDPHFRREFYQVLLPLMQEMGKTIFAISHDDHYFIHADRLLEMRNGQLSELTGEERDAASRDAVARTA

SEQ ID NO: 5357 - DNA, 651 bp, Escherichia coli
atgttggatctgtttgctgatgctgaaccgtggcaagaaccactggcggctggagcagtgattttgcaccgttttgcttttaacgctgcggagcaactgatccgcgatattaatgacgttgccagccagtcgccgtttcgccagatggtcactccaggcggatataccatgtcggtggcgatgaccaactgtgggcatctgggctggacgacccatcggcaaggttatctctattcgcccattgatccgcaaacaaataaaccgtggcccgccatgccgcagagttttcatcatttatgtcaacgtgcggctacggcggcgggctatccagatttccagccagatgcctgtttgatcaaccgctacgttcctggcgcgaaactgtcgctgcatcaggataaagacgaaccggatctgcgcgcgccaattgtttctgtttctctgggcttacccgcgatttttcaatttggcggcctgaaacgaaatgatccgctcaaacgtttgttgttggaacatggcgatgtggtggtatgggggggtgagtcgcggctgttttatcatggcattcaaccgttgaaagtggggggtcatccactcaccaccgactgccgctacaacctgacattccgtcaggcaggtaaaaaagaataa

SEQ ID NO: 5358 - protein, 216 aa, Escherichia coli
MLDLFADAEPWQEPLAAGAVILHRFAFNAAEQLIRDINDVASQSPFRQMVTPGGYTMSVAMTNCGHLGWTTHRQGYLYSPIDPQTNKPWPAMPQSFHHLCQRAATAAGYPDFQPDACLINRYVPGAKLSLHQDKDEPDLRAPIVSVSLGLPAIFQFGGLKRNDPLKRLLLEHGDVVVWGGESRLFYHGIQPLKVGGHPLTTDCRYNLTFRQAGKKE

SEQ ID NO: 5359 - DNA, 1065 bp, Escherichia coli
atgaaatacgccacatgcttaactgacgatcaacgctggcaatctgtcttagcccgcgactcgaatgccgacggcgaattcgttttcgccgtgcgcaccacgggtatcttttgccgtccgtcttgccgagccagacatgccttgcgggaaaatgtctccttctacgcaaatgccagcgaggcgcttgccgctggctttcgtccctgcaaacgttgtcagccagacaaagccaatcccctgcaacatcgccttgataaaattacccacgcctgccgacttctggaacaggaaacgcctgtaacgctggaagccttagccgaccaggtggcgatgagtccatttcatttgcatcggttgtttaaagcgactaccggaatgacgcctaaagcctggcaacaggcctggcgcgctcgccgtttgcgcgaattgctggcgaaaggggtgagcgtgactacatctattcttaacgccggattccccgacagcagcagttactaccgcaaagccgacgaaacgctgggcatgacggctaaacaattccgtcacggtggcgaaaatctggcggtgcgttacgcgctggctgattgtgagctgggccgttgcctggtggcagaaagtgagcgggggatttgcgcgatattactgggcgatgatgacgcgacactaatcagcgagttacagcagatgtttcccgctgccgacagcgcgcttgctgatcttacgtttcagcaacatgtgcgtgaagtgatcgccagcctcaatcaacgcgatacgccgctgacgttaccgctggacattcgcggcactgcttttcagcaacaagtctggcaggcactgcgcacgataccttgcggtgaaaccgtcagttatcagcaactggctaatgccatcggcaaaccgaaagcggtacgggccgttgccagtgcctgtgccgccaacaagctggctatcgttataccttgtcatcgggtggtccgtggtgatggcactctttccggttaccgctggggcgtgtcgcgcaaagcgcaactgctgcgccgcgaagctgaaaatgaggaaaggtaa

SEQ ID NO: 5360 - protein, 354 aa, Escherichia coli
MKYATCLTDDQRWQSVLARDSNADGEFVFAVRTTGIFCRPSCRARHALRENVSFYANASEALAAGFRPCKRCQPDKANPLQHRLDKITHACRLLEQETPVTLEALADQVAMSPFHLHRLFKATTGMTPKAWQQAWRARRLRELLAKGVSVTTSILNAGFPDSSSYYRKADETLGMTAKQFRHGGENLAVRYALADCELGRCLVAESERGICAILLGDDDATLISELQQMFPAADSALADLTFQQHVREVIASLNQRDTPLTLPLDIRGTAFQQQVWQALRTIPCGETVSYQQLANAIGKPKAVRAVASACAANKLAIVIPCHRVVRGDGTLSGYRWGVSRKAQLLRREAENEER

SEQ ID NO: 5361 - DNA, 1056 bp, Escherichia coli
atggaaataagctttacccgcgtggcactgctggctgccgcgctcttctttgttggttgcgatcaaaaaccacaacccgccaaaacccacgctactgaagttaccgttcttgaaggcaaaactatgggtaccttctggcgtgccagcatcccgggcattgacgccaaacgcagtgccgaacttaaagaaaagattcagacccaactggacgctgacgatcagctgctttcgacctataaaaaagattccgcgctgatgcgctttaacgactcgcaaagtttgtcgccgtggccggtaagtgaagcgatggccgatatcgtcactacctcgctgcgcattggcgcgaagaccgatggcgcgatggatataaccgtcgggccgctggtgaatctgtggggctttggtccggaacaacaaccggttcaaattccgagccaggaacagatcgatgcgatgaaagccaaaaccggcttacagcacctgacggtgattaatcagtcccaccagcaatatctgcaaaaagacctgccggatttatatgtcgatctctctaccgtcggtgaaggttatgcggcggatcacctggcacgcttgatggagcaggaagggatttcccgctatctggtatcggtgggcggcgcgctgaacagccgtggtatgaacggtgcaggccagccgtggcgggtagcgattcaaaagccaaccgataaagaaaacgcggttcaggccgtggtggatatcaacggtcatgggattagtacctctggcagctaccgtaactattacgaactggacggcaaacgtctttctcatgttatcgatccgcaaaccgggcgtcctatcgaacacaatctggtatccgtgacggtgattgccccgacggcgctggaggccgatgcctgggatactggcttaatggtgctcgggccggagaaagccaaagaggttgttcgccgggaagggctggcggtttatatgatcaccaaagagggcgatagctttaaaacctggatgtcgccgcagtttaaaagcttccttatcagcgaaaaaaattaa

SEQ ID NO: 5362 - protein, 351 aa, Escherichia coli
MEISFTRVALLAAALFFVGCDQKPQPAKTHATEVTVLEGKTMGTFWRASIPGIDAKRSAELKEKIQTQLDADDQLLSTYKKDSALMRFNDSQSLSPWPVSEAMADIVTTSLRIGAKTDGAMDITVGPLVNLWGFGPEQQPVQIPSQEQIDAMKAKTGLQHLTVINQSHQQYLQKDLPDLYVDLSTVGEGYAADHLARLMEQEGISRYLVSVGGALNSRGMNGAGQPWRVAIQKPTDKENAVQAVVDINGHGISTSGSYRNYYELDGKRLSHVIDPQTGRPIEHNLVSVTVIAPTALEADAWDTGLMVLGPEKAKEVVRREGLAVYMITKEGDSFKTWMSPQFKSFLISEKN

SEQ ID NO: 5363 - DNA, 1092 bp, Escherichia coli
atgaaagttaaagtactgtccctcctggtcccagctctgctggtagcaggcgcagcaaacgctgctgaagtttacaacaaagacggcaacaaattagatctgtacggtaaagtagacggcctgcactatttctctgacgacaagtctgtagatggcgaccagacctacatgcgtcttggcttcaaaggtgaaactcaggttactgaccagctgaccggttacggccagtgggaatatcagatccagggcaacagcgctgaaaacgaaaacaactcctggacccgtgtggcattcgcaggtctgaaattccaggatgtgggttctttcgactacggtcgtaactacggcgttgtttatgacgtaacttcctggaccgacgtactgccagaattcggtggcgacacttacggttctgacaacttcatgcagcagcgtggtaacggcttcgcgacctaccgtaacaccgacttcttcggtctggttgacggcctgaactttgctgttcagtaccagggtaaaaacggtagcgtaagcggcgaaggcatgaccaacaacggtcgtggtgctctgcgtcagaacggcgacggcgttggcggatctatcacttatgattacgaaggcttcggtatcggtggtgcgatctccagctccaaacgtactgacgatcagaacagcccgctgtacatcggtaacggcgaccgtgctgaaacctacactggtggtctgaaatacgacgctaacaacatctacctggctgctcagtacacccagacctacaacgcaactcgcgtaggttccctgggttgggcgaacaaagcacagaacttcgaagctgttgctcagtaccagttcgacttcggtctgcgtccgtccctggcttacctgcagtctaaaggtaaaaacctgggtcgtggctacgacgacgaagatatcctgaaatatgttgatgttggtgcgacctactacttcaacaaaaacatgtccacctacgttgactacaaaatcaacctgctggacgacaaccagttcactcgtgacgctggcatcaacactgataacatcgtagctctgggcctggtttaccagttctaa

SEQ ID NO: 5364 - protein, 363 aa, Escherichia coli
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 5365 - DNA, 2580 bp, Escherichia coli
gtgacgatgggtgtaatggtacaaagcgccgttaacgcctggctgaaagataaaagttaccagattgtcgacattacccacgcaatccaaaagcgcgtcgatacctggcgttacgtgacctggcagatctacgacaacattgccgcgacgacctccccctcctccggcgaaggtttacaagagacgcgactgaaacaggatgtctactatctggagaaaccacgccgcaaaacggaagcgttaatctttggctctcacgacaactcaacgcttgagatgactcaacggatgtccacctatctggacacattgtggggcgcagaaaatgtaccgtggtcgatgtattacctgaatggtcaggataacagtctggtgctgatctcaaccctgcctctcaaagatctcacctccggatttaaagaatcgaccgtcagcgacattgttgattcacgtcgtgcagagatgttacaacaggccaacgccctcgatgaacgcgaaagtttttctaacatgcgccgcctggcctggcagaacggtcattactttaccttgcgtaccacgttcaaccagccgggacatctggcaacggtcgtggcttttgatctgccgattaatgatttgatcccaccgggtatgccgctggacagtttccgccttgagccagacgcgacggcaacgggaaacaatgaaaatgagaaagaagggacggatagcgtcagtatccactttaacagtacgaagattgaaatctcctcggcactcaactctaccgatatgcgcctggtctggcaggttccttacggcaccttactgctggatacgttgcaaaacattctgctgccactgctgctgaacatcggtttgctggcgctggcgttatttggctataccacattccgccatttctccagccgcagtacagaaagcgtccccagcacggcggtcaataacgaattgcgcattttacgggcaattaatgaagagatagtctcattgctgccgctcggcctgctggtgcacgatcaggaatcgaaccgcacggtcataagtaacaaaattgccgatcatttgctgccgcatttgaatctgcaaaacatcactaccatggcggagcagcatcaggggattattcaggcgacgatcaataacgagctgtatgagatccgcatgttccgcagccaggttgcgccgcgcacacaaattttcattattcgcgatcaggatcgcgaagtgctggtaaacaagaaactcaagcaggcgcagcgtctgtatgagaaaaaccagcaggggcggatgacctttatgaaaaacattggcgatgcgctgaaagaacccgcacagtccctggcggagagcgcggctaaactcaacgccccggaaggcaaacaactggcgaatcaggcagatgtgctggtgcggctggtcgatgaaatacagttagcgaacatgcttgcggacgatagctggaaaagtgagacggagctgttctccgtgcaggatttaattgatgaagtagtgccttcagtgttgcctgccatcaagcgtaaaggtctgcaactgctgattaacaatcatctgaaagcacacgatatgcgccgcggcgatcgcgatgccttacgacgtattttgctgctactgatgcaatatgccgtgacctcaacgcaattaggaaaaatcacccttgaggttgatcaggatgagtcctccgaagaccgcctgacgttccgcattctggacactggagaaggcgtaagcattcatgaaatggataatttgcacttcccgtttatcaaccagacccaaaacgatcgctatggcaaggcggacccgctggcattctggctgagcgatcaactggcgcgtaaactgggcggtcatttaaacatcaaaacgcgggatgggcttggtacacgctactctgtgcatatcaaaatgctcgcaactgacccggaagttgaagaggaagaagagcgattactggatgatgtctgcgtaatggtggatgttacttcggcagaaattcggaatattgtcactcgccagttagaaaattggggtgcaacctgtatcacacccgatgaaagattaattagtcaagattatgatatctttttaacggataatccgtctaatcttactgcctctggcttgcttttaagcgatgatgagtctggcgtacgggaaattgggcctggtcaattgtgcgtcaatttcaatatgagcaacgctatgcaggaagcggtcttacaattaattgaagtgcaactggcgcaggaagaggtgacagaatcgcctctgggcggagatgaaaatgcgcaactccatgccagcggctattatgcgctctttgtagacacagtaccggatgatgttaagaggctatatactgaagcagcaaccagtgactttgctgcgttagcccaaacggctcatcgtcttaaaggcgtatttgccatgctaaatctggtacccggcaagcagttatgtgaaacgctggaacatctgattcgtgagaaggatgttccaggaatagaaaaatacatcagcgacattgacagttatgtcaagagcttgctgtag

SEQ ID NO: 5366 - protein, 859 aa, Escherichia coli
MTMGVMVQSAVNAWLKDKSYQIVDITHAIQKRVDTWRYVTWQIYDNIAATTSPSSGEGLQETRLKQDVYYLEKPRRKTEALIFGSHDNSTLEMTQRMSTYLDTLWGAENVPWSMYYLNGQDNSLVLISTLPLKDLTSGFKESTVSDIVDSRRAEMLQQANALDERESFSNMRRLAWQNGHYFTLRTTFNQPGHLATVVAFDLPINDLIPPGMPLDSFRLEPDATATGNNENEKEGTDSVSIHFNSTKIEISSALNSTDMRLVWQVPYGTLLLDTLQNILLPLLLNIGLLALALFGYTTFRHFSSRSTESVPSTAVNNELRILRAINEEIVSLLPLGLLVHDQESNRTVISNKIADHLLPHLNLQNITTMAEQHQGIIQATINNELYEIRMFRSQVAPRTQIFIIRDQDREVLVNKKLKQAQRLYEKNQQGRMTFMKNIGDALKEPAQSLAESAAKLNAPEGKQLANQADVLVRLVDEIQLANMLADDSWKSETELFSVQDLIDEVVPSVLPAIKRKGLQLLINNHLKAHDMRRGDRDALRRILLLLMQYAVTSTQLGKITLEVDQDESSEDRLTFRILDTGEGVSIHEMDNLHFPFINQTQNDRYGKADPLAFWLSDQLARKLGGHLNIKTRDGLGTRYSVHIKMLATDPEVEEEEERLLDDVCVMVDVTSAEIRNIVTRQLENWGATCITPDERLISQDYDIFLTDNPSNLTASGLLLSDDESGVREIGPGQLCVNFNMSNAMQEAVLQLIEVQLAQEEVTESPLGGDENAQLHASGYYALFVDTVPDDVKRLYTEAATSDFAALAQTAHRLKGVFAMLNLVPGKQLCETLEHLIREKDVPGIEKYISDIDSYVKSLL

SEQ ID NO: 5367 - DNA, 696 bp, Escherichia coli
ttgacagttatgtcaagagcttgctgtagcaaggtagcctattacatgaacaatatgaacgtaattattgccgatgaccatccgatagtcttgttcggtattcgcaaatcacttgagcaaattgagtgggtgaatgttgtcggcgaatttgaagactctacagcactgatcaacaacttgccgaaactggatgcacatgtgttgattaccgatctctccatgcctggcgataagtacggcgatggcattaccttaatcaagtacatcaagcgccatttcccaagcctgtcgatcattgttctgaccatgaacaacaacccggcgattcttagtgcggtattggatctggatatcgaagggatcgtgctgaaacaaggtgcaccgaccgatctgccgaaagctctcgccgcgctgcagaaagggaagaaatttaccccggaaagcgtttctcgcctgttggaaaaaatcagtgctggtggttatggtgacaagcgtctctcgccaaaagagagtgaagttctgcgcctgtttgcggaaggcttcctggtgaccgagatcgctaaaaagctgaaccgcagtattaaaaccatcagtagccagaagaaatctgcgatgatgaagctgggtgtcgagaacgatattgctctgctgaattatctctcttctgtgacgttaagtccggcagataaagactaa

SEQ ID NO: 5368 - protein, 231 aa, Escherichia coli
MTVMSRACCSKVAYYMNNMNVIIADDHPIVLFGIRKSLEQIEWVNVVGEFEDSTALINNLPKLDAHVLITDLSMPGDKYGDGITLIKYIKRHFPSLSIIVLTMNNNPAILSAVLDLDIEGIVLKQGAPTDLPKALAALQKGKKFTPESVSRLLEKISAGGYGDKRLSPKESEVLRLFAEGFLVTEIAKKLNRSIKTISSQKKSAMMKLGVENDIALLNYLSSVTLSPADKD

SEQ ID NO: 5369 - DNA, 2850 bp, Escherichia coli
ttgaaataccttgcttcttttcgtacaaccctgaaagcctcgcgctacatgttcagagcattggcgttagtgctctggctgttgattgctttttcatccgttttttacatcgttaatgcgttacatcagcgagaatcggaaattcgtcaggaatttaatctgagttccgatcaggctcagcgctttattcaacgcacctctgatgtgatgaaagagctgaagtacatagctgaaaatcgcttatcggcagaaaacggtgtgctttccccgcgtggacgagaaacgcagacggatgtgcctgcgtttgaaccgctgtttgctgactctgattgttccgcaatgagtaacacctggcgaggttctctggagtcattggcgtggtttatgcgctactggcgcgataatttttctgcggcttacgatctaaaccgggtatttttaatcggcagcgataacctctgcatggctaatttcggtctgcgtgatatgccagtggaacgcgataccgcgttaaaagctttgcatgaacgcattaataaatatcgaaatgcaccacaagatgatagtggcagtaacctctactggatcagcgaaggtccgcgccctggcgtcgggtatttttacgccttgacgccagtttatctggcgaatcggttgcaggcgcttttgggtatcgagcaaaccatccggatggagaactttttcttacctggtacgttgccgatgggggttaccattcttgatgaaaatggtcataccctgatttcgcttaccggaccagaaagcaaaattaagggcgatcctcgctggatgcaggaacgctcctggtttggctatacggaagggttccgcgaactggtgctgaagaaaaatctgccaccctcatcgctaagcatcgtttattcagtgccagttgataaggtgctggaacgcattcgcatgttgatccttaacgcaattttgctgaatgtgcttgccggagctgcattgtttactctcgcgcggatgtacgagcggcgtattttcattccggcggaaagcgacgccctgcgactggaagaacatgagcagtttaatcgcaagattgtcgcctccgcgccagtgggtatctgcattttgcgtaccgctgatggcgtcaatattttaagtaacgaactggcgcatacctatctcaatatgcttacgcatgaggaccgccaacggctgacacaaattatctgtgggcagcaggtcaattttgttgatgtcctgaccagcaacaatactaatctgcaaatcagcttcgtccattcgcgctatcgtaatgaaaacgtggccatttgtgtgctggtggatgtttcttcgcgcgtgaagatggaagagtcgttgcaggagatggcacaagcagcggaacaggcgagccagtcaaaatcgatgttcctggccaccgtcagtcatgagctgcgaacgccgctgtatggcattatcggtaacctggatctgttgcaaaccaaagagttaccgaaaggcgtcgatcgtctggtgacggcaatgaacaactcttccagcctgttgttgaaaattatcagcgatattctcgatttctcgaaaattgaatcagaacagttgaagatcgaaccgcgtgagttttcaccgcgtgaagtgatgaaccacatcaccgccaactatttaccgctggtggtacgcaagcagttaggcttgtactgctttattgaaccggatgtgccagtggccttaaatggcgacccgatgcgtttacagcaggtcatctccaacctgttgagtaacgccataaaattcaccgataccggctgtatagttttgcatgttcgcgctgatggcgattatctctctatccgtgttcgcgataccggcgtggggataccggcgaaagaagtggtgcgtttgtttgatcccttcttccaggtcggaacgggcgtacagcgtaacttccaggggactggtctgggtctggcgatttgtgaaaaactgatcagcatgatggacggcgacatctcggtagattcagaaccgggaatgggcagccagtttaccgtgcgtattccgttatacggcgctcagtacccgcagaaaaaaggtgtggaagggttgagtggtaaacgctgctggctggcggtccgcaatgcgtcgctctgtcagttcctggaaaccagtttgcagcgcagcggcatcgtcgttacaacatacgaagggcaggaaccgactcccgaagatgtgttaattactgacgaggtagtgaacaaaaaatggcagggcagagcggtagtgaccttctgtcgtcgccatattggtattccgctggagaaagcgccaggggagtgggtacacagtgtggctgctccgcatgagctaccggcattgttggcgcgtatttatttgatcgagatggagagcgacgatcctgctaacgctctgccgtcgacggacaaagcggtcagcgataatgacgatatgatgattctggtcgtagatgatcatccgattaaccggagtctgctggcagatcagttgggatcgttgggctatcaatgtaaaaccgcgaatgatggcgtcgatgcgcttaatgtacttaacaagaatcatattgatatcgtgcttagcgacgtcaatatgccaaatatggatggttaccgcttgacgcaacgcattcgtcagttgggactgacgttgccggtaatcggagtaactgctaatgcgttggctgaagagaagcagcggtgtctggagtccggtatggacagttgcctgtcgaagccggtaacgctggatgtgataaaacagacgctgacggtatatgccgagagggtcaggaaatcgcgggaatcgtag

SEQ ID NO: 5370 - protein, 949 aa, Escherichia coli
MKYLASFRTTLKASRYMFRALALVLWLLIAFSSVFYIVNALHQRESEIRQEFNLSSDQAQRFIQRTSDVMKELKYIAENRLSAENGVLSPRGRETQTDVPAFEPLFADSDCSAMSNTWRGSLESLAWFMRYWRDNFSAAYDLNRVFLIGSDNLCMANFGLRDMPVERDTALKALHERINKYRNAPQDDSGSNLYWISEGPRPGVGYFYALTPVYLANRLQALLGIEQTIRMENFFLPGTLPMGVTILDENGHTLISLTGPESKIKGDPRWMQERSWFGYTEGFRELVLKKNLPPSSLSIVYSVPVDKVLERIRMLILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPQKKGVEGLSGKRCWLAVRNASLCQFLETSLQRSGIVVTTYEGQEPTPEDVLITDEVVNKKWQGRAVVTFCRRHIGIPLEKAPGEWVHSVAAPHELPALLARIYLIEMESDDPANALPSTDKAVSDNDDMMILVVDDHPINRSLLADQLGSLGYQCKTANDGVDALNVLNKNHIDIVLSDVNMPNMDGYRLTQRIRQLGLTLPVIGVTANALAEEKQRCLESGMDSCLSKPVTLDVIKQTLTVYAERVRKSRES

SEQ ID NO: 5371 - DNA, 1827 bp, Escherichia coli
atgcattatatgaagtggatttatccacgccgcttacgcaatcaaatgatcctgatggcaatcctgatggtcattgtcccaacgcttactattggttatatcgtagaaacggaaggacgttcagcagtcttatctgaaaaagagaaaaaactttctgccgtggtcaacctgcttaatcaggcgctaggcaatcgctacgatctctacatcgacttaccgcgtgaggagcgtatccgcgcattaaatgcagaacttgcccccattaccgaaaatatcactcacgccttccctggcatcggcgctggttattacaacaaaacgctggatgcgataatcacctacgcgccttcagcgctatatcagaataatgtgggcgttaccattgccgcagatcaccctggtcgcgaagtcatgcgtacaaatacccctttggtttattcaggcaggcaggtgcgcggcgatattttgaattcaatgattcccattgagcgtaatggtgaaatcctcggctatatctgggccaatgaattaaccgaagatattcgccgccaggcctggaaaatggatgtgaggattatcattgtgctcaccgccggtttgctgataagcctgctgttgattgtccttttctcccgtcgcctgagcgccaatatagatatcatcaccgatggcctctcgactctggctcaaaatattcccactcgattaccacaattgcccggtgaaatggggcaaatcagtcagagtgttaacaacctcgcccaggcactgcgtgaaacgcgaacacttaacgatctgattattgaaaacgctgccgatggcgtcattgccattgaccgccagggtgatgtaaccaccatgaacccagcagcagaagtcatcactggctatcaacgtcatgaactggtagggcagccttactccatgttgttcgacaatactcagttctacagtccagtactggatacgctggaacatggcaccgaacatgtagcactggagatcagttttccaggccgtgaccgcaccattgaactcagtgtcacgaccagtcgtattcataacacgcacggtgaaatgataggtgctttggtgattttctctgatttaactgcccgcaaagaaacccagcgccgcatggcgcaagcagaacgcctcgccacactgggtgagctgatggctggcgtggcgcatgaagtacgtaatccgctaacagctattcgtggttatgtacagatcttgcgccaacaaacccgtgacccaatacatcaggaatatctgtccgtagtactcaaagaaatcgattcaattaacaaagttattcagcaattgctcgaattttcacgtccacgccacagtcaatggcaacaagtcagcctcaatgcattggttgaagaaactctggtactggtacaaaccgccggcgtacaagcgcgggtcgacttcataagcgaactggataatgaattaagcccgattaacgccgatcgtgaactgctcaaacaggtactactgaatatcctgatcaatgccgtccaggctatcagtgcacgagggaaaattcgcattcgaacctggcagtatagcgactcgcaacaggccatttcgatagaggacaacggcagtggcattgatctctcgctgcaaaaaaagatcttcgatccctttttcactaccaaagcctcaggaaccgggcttggtctggcgttaagtcaacgcatcattaatgcccatcagggtgatattcgcgtcgccagtttgccgggctacggcgcaaccttcacgcttattttaccgatcaacccgcagggaaatcagactgtatga

SEQ ID NO: 5372 - protein, 608 aa, Escherichia coli
MHYMKWIYPRRLRNQMILMAILMVIVPTLTIGYIVETEGRSAVLSEKEKKLSAVVNLLNQALGNRYDLYIDLPREERIRALNAELAPITENITHAFPGIGAGYYNKTLDAIITYAPSALYQNNVGVTIAADHPGREVMRTNTPLVYSGRQVRGDILNSMIPIERNGEILGYIWANELTEDIRRQAWKMDVRIIIVLTAGLLISLLLIVLFSRRLSANIDIITDGLSTLAQNIPTRLPQLPGEMGQISQSVNNLAQALRETRTLNDLIIENAADGVIAIDRQGDVTTMNPAAEVITGYQRHELVGQPYSMLFDNTQFYSPVLDTLEHGTEHVALEISFPGRDRTIELSVTTSRIHNTHGEMIGALVIFSDLTARKETQRRMAQAERLATLGELMAGVAHEVRNPLTAIRGYVQILRQQTRDPIHQEYLSVVLKEIDSINKVIQQLLEFSRPRHSQWQQVSLNALVEETLVLVQTAGVQARVDFISELDNELSPINADRELLKQVLLNILINAVQAISARGKIRIRTWQYSDSQQAISIEDNGSGIDLSLQKKIFDPFFTTKASGTGLGLALSQRIINAHQGDIRVASLPGYGATFTLILPINPQGNQTV

SEQ ID NO: 5373 - DNA, 1386 bp, Escherichia coli
atgactgctattaatcgcatccttattgtggatgatgaagataatgttcgccgtatgctgagcaccgcttttgcactacaaggattcgaaacacattgtgcgaacaacgggcgcacagcattacacctgtttgccgatattcaccctgacgtggtgttgatggatatccgcatgccagagatggacggcatcaaggcactaaaggagatgcgcagccatgagacccggacacccgttattctgatgacggcctatgctgaagtggaaaccgccgtcgaagcactacgctgcggagccttcgactatgttatcaaaccgtttgatctcgatgagttgaatttaatcgttcagcgcgctttacaactccagtcaatgaaaaaagagatccgtcatctgcaccaggcactgagcaccagctggcaatgggggcacattctcaccaacagcccggcgatgatggacatctgcaaagacaccgccaaaattgccctttctcaggccagcgtcttgattagcggtgaaagcggcaccgggaaagagttgattgccagagcgattcactacaattcgcggcgggcaaaggggccgttcattaaagtcaactgcgcggcgctgccggaatcgttgctcgaaagtgaactgtttggtcatgaaaaaggtgcatttactggtgcacaaaccttgcgtcagggattatttgaacgtgccaacgaaggtactttgctcctcgacgaaattggcgaaatgccgctggtactgcaagccaaattactacgcattctgcaggaacgggaatttgaacggattggcggccatcagaccataaaagttgatatccgcatcattgctgccaccaaccgcgacttgcaggcaatggtgaaagaaggcaccttccgtgaagatctcttttatcgccttaacgttattcatttaatactgccgcctctgcgcgatcgccgggaagatatttccctgttagctaatcactttttgcaaaaattcagtagtgagaatcagcgcgatattatcgacatcgatccgatggcaatgtcactgcttaccgcctggtcatggccgggaaatattcgagagctttccaacgttattgaacgcgccgtcgtgatgaattcaggcccgatcattttttctgaggatcttccgccgcagattcgtcagccagtctgtaatgctggtgaagcaaaaacagcccctgtcggtgagcgtaatttaaaagaggaaattaaacgcgtcgaaaaacgcatcattatggaagtgctggaacaacaagaaggaaaccgaacccgcactgctttaatgctgggcatcagtcgccgtgcattgatgtataaactccaggaatacggtatcgatccggcggatgtataa

SEQ ID NO: 5374 - protein, 461 aa, Escherichia coli
MTAINRILIVDDEDNVRRMLSTAFALQGFETHCANNGRTALHLFADIHPDVVLMDIRMPEMDGIKALKEMRSHETRTPVILMTAYAEVETAVEALRCGAFDYVIKPFDLDELNLIVQRALQLQSMKKEIRHLHQALSTSWQWGHILTNSPAMMDICKDTAKIALSQASVLISGESGTGKELIARAIHYNSRRAKGPFIKVNCAALPESLLESELFGHEKGAFTGAQTLRQGLFERANEGTLLLDEIGEMPLVLQAKLLRILQEREFERIGGHQTIKVDIRIIAATNRDLQAMVKEGTFREDLFYRLNVIHLILPPLRDRREDISLLANHFLQKFSSENQRDIIDIDPMAMSLLTAWSWPGNIRELSNVIERAVVMNSGPIIFSEDLPPQIRQPVCNAGEAKTAPVGERNLKEEIKRVEKRIIMEVLEQQEGNRTRTALMLGISRRALMYKLQEYGIDPADV

SEQ ID NO: 5375 - DNA, 663 bp, Escherichia coli
atgaaaacaaaattgatgacattacaagacgccaccggcttctttcgtgacggcatgaccatcatggtgggcggatttatggggattggcactccatcccgcctggttgaagcattactggaatctggtgttcgcgacctgacattgatagccaatgataccgcgtttgttgataccggcatcggtccgctcatcgtcaatggtcgagtccgcaaagtgattgcttcacatatcggcaccaacccggaaacaggtcggcgcatgatatctggtgagatggacgtcgttctggtgccgcaaggtacgctaatcgagcaaattcgctgtggcggagctggacttggtggttttctcaccccaactggtgtcggcagcgtcgtagaggaaggcaaacagacactgacactcgacggtaaaacctggctgctcgaacgcccgctgcgcgccgacctggcgctaattcgcgctcatcgttgcgacacacttggcaacctgacctatcaccttagcgcccgcaactttaaccccctgatagcccttgcggctgatatcacgctggtagagccggatgaactggtcgaaaccggcgagctgcaacctgaccatattgtcacccctggtgccgttatcgaccacatcatcgtttcacaggagagcaaataa

SEQ ID NO: 5376 - protein, 220 aa, Escherichia coli
MKTKLMTLQDATGFFRDGMTIMVGGFMGIGTPSRLVEALLESGVRDLTLIANDTAFVDTGIGPLIVNGRVRKVIASHIGTNPETGRRMISGEMDVVLVPQGTLIEQIRCGGAGLGGFLTPTGVGSVVEEGKQTLTLDGKTWLLERPLRADLALIRAHRCDTLGNLTYHLSARNFNPLIALAADITLVEPDELVETGELQPDHIVTPGAVIDHIIVSQESK

SEQ ID NO: 5377 - DNA, 651 bp, Escherichia coli
atggatgcgaaacaacgtattgcgcgccgtgtggcgcaagagcttcgtgatggtgacatcgttaacttagggatcggtttacccacaatggtcgccaattatttaccggagggtattcatatcactctgcaatcagaaaacggcttcctcggtttaggcccggtcacaacagcgcatcccgatctggtgaacgctggcggacaaccgtgcggcattttacccggcgcagccatgtttgatagcgccatgtcatttgcgctaatccgtggcggtcatattgatgcctgcgtgctcggcggtttgcaagtagacgaagaagcaaacctcgcgaactgggtagtgcctgggaaaatggtgcccggtatgggtggcgcgatggatctggtgaccgggtcgcgcaaagtgatcatcgccatggaacattgcgccaaagatggttcagcaaaaattttgcgccgctgcaccatgccactcactgcgcaacatgcggtgcatatgctggttactgaactggctgtctttcgttttattgacggcaaaatgtggctcaccgaaattgccgacgggtgtgatttagccaccgtgcgtgccaaaacagaagctcggtttgaagtagctgccgatctgaatacgcaacggggtgatttatga

SEQ ID NO: 5378 - protein, 216 aa, Escherichia coli
MDAKQRIARRVAQELRDGDIVNLGIGLPTMVANYLPEGIHITLQSENGFLGLGPVTTAHPDLVNAGGQPCGILPGAAMFDSAMSFALIRGGHIDACVLGGLQVDEEANLANWVVPGKMVPGMGGAMDLVTGSRKVIIAMEHCAKDGSAKILRRCTMPLTAQHAVHMLVTELAVFRFIDGKMWLTEIADGCDLATVRAKTEARFEVAADLNTQRGDL

SEQ ID NO: 5379 - DNA, 1323 bp, Escherichia coli
atgattggtcgcatatcgcgttttatgacgcgttttgtcagccgatggcttcccgatccactgatctttgccatgttgctgacattgctaacattcgtgatcgcgctttggttaacaccacaaacgccgatcagcatggtgaaaatgtggggtgacggtttctggaacttgctggcgtttggtatgcagatggcgcttatcatcgttaccggtcatgcccttgccagctccgcgccggtgaaaagtttgctgcgtactgccgcctccgccgcaaagacgcccgtacagggcgtcatgctggttactttcttcggttcagttgcttgtgtcatcaactggggatttggtttggttgtcggtgcaatgttcgcccgtgaagtcgcccggcgagtacccggttctgattatccgttgctcattgcctgcgcctacattggttttctcacctggggtggcggtttctctggctcaatgcctctgttggctgcaacaccgggcaacccggttgagcatatcgccgggctgatcccggtgggcgatactctgttcagtggttttaatattttcatcactgtggcgttgattgtggtgatgccatttatcacccgcatgatgatgccaaaaccgtctgacgtggtgagtatcgatccgaaactactcatggaagaggctgattttcaaaagcaactaccgaaagatgctccaccgtccgagcgactggaagaaagccgtattctgacgttgatcatcggcgcactcggtatcgcttacctggcgatgtacttcagcgaacatggcttcaacatcaccatcaataccgtcaacctgatgtttatgattgcgggtctgctgctacataaaacgccaatggcttatatgcgtgctatcagcgcggcagcacgcagtaccgccggtattctggtgcaattccccttctacgcggggatccaactgatgatggagcactccggtctgggcggactcattaccgaattcttcatcaatgttgcgaacaaagacaccttcccggtcatgaccttttttagttctgcactgattaacttcgccgttccgtctggcggcgggcactgggttattcaggggccgttcgtgatgcccgcagcccaggcgctgggcgctgatctcggtaaatcggtaatggcgatcgcctacggcgagcaatggatgaacatggcacaaccgttctgggcgctgccagcactggcaatcgccggactcggtgtccgcgacatcatgggctattgcatcactgccctgctcttctccggcgtcattttcgtcattggtttaacgctgttctga

SEQ ID NO: 5380 - protein, 440 aa, Escherichia coli
MIGRISRFMTRFVSRWLPDPLIFAMLLTLLTFVIALWLTPQTPISMVKMWGDGFWNLLAFGMQMALIIVTGHALASSAPVKSLLRTAASAAKTPVQGVMLVTFFGSVACVINWGFGLVVGAMFAREVARRVPGSDYPLLIACAYIGFLTWGGGFSGSMPLLAATPGNPVEHIAGLIPVGDTLFSGFNIFITVALIVVMPFITRMMMPKPSDVVSIDPKLLMEEADFQKQLPKDAPPSERLEESRILTLIIGALGIAYLAMYFSEHGFNITINTVNLMFMIAGLLLHKTPMAYMRAISAAARSTAGILVQFPFYAGIQLMMEHSGLGGLITEFFINVANKDTFPVMTFFSSALINFAVPSGGGHWVIQGPFVMPAAQALGADLGKSVMAIAYGEQWMNMAQPFWALPALAIAGLGVRDIMGYCITALLFSGVIFVIGLTLF

SEQ ID NO: 5381 - DNA, 1185 bp, Escherichia coli
atgaaaaattgtgtcatcgtcagtgcggtacgtactgctatcggtagttttaacggttcactcgcttccaccagcgccatcgacctgggggcgacagtaattaaagccgccattgaacgtgcaaaaatcgattcactacacgttgatgaagtgattatgggtaacgtgttgcaagccggactggggcaaaatccggcacgtcaggcgctgctaaaaagcggactggctgaaacggtgtgcggattcacggtcaataaagtgtgtggttcgggtcttaaaagtgtggcgcttgccgcccaggcaattcaggcaggtcaggcgcagagcattgtggcggggggtatggaaaatatgagtttagcgccctacttactcgatgcaaaagcacgctctggttatcgtcttggagacggacaggtttatgacgtaatcctgcgcgatggtctgatgtgcgccacccatggttatcatatggggattaccgccgaaaacgtggctaaagagtacggaattacccgtgaaatgcaggatgaactggcgctacattcacagcgtaaagcggcagccgcaattgagtccggtgcttttacagccgaaatcgtcccggtaaatgttgtcactcggaagaaaaccttcgtcttcagtcaagacgaattcccgaaagcggattctacggctgaagcgttaggcgcattgcgcccggccttcgataaagcaggaacagtcaccgccgggaacgcgtctggcattaacgacggtgctgccgctctggtgattatggaagaatcttcggcgctggcagcaggccttacccccctggctcgcattaaaagttatgccagcggtggcgtgccccccgcattgatgggtatggggccagtacctgccacgcaaaaagcgttacaactggcggggctgcaactggcggatattgatctcattgaggctaatgaagcatttgctgcacagttccttgccgttgggaaaaccctgggctttgagcctgagaaagtgaatgtcaacggcggggccatcgcgctggggcatcctatcggtgccagtggtgctcgtattctggtcacactattacatgcaatgcaggcacgcgataaaacgctggggctggcaacactgtgcattggtggcggccagggaattgcgatggtgattgaacgattgaattaa

SEQ ID NO: 5382 - protein, 394 aa, Escherichia coli
MKNCVIVSAVRTAIGSFNGSLASTSAIDLGATVIKAAIERAKIDSLHVDEVIMGNVLQAGLGQNPARQALLKSGLAETVCGFTVNKVCGSGLKSVALAAQAIQAGQAQSIVAGGMENMSLAPYLLDAKARSGYRLGDGQVYDVILRDGLMCATHGYHMGITAENVAKEYGITREMQDELALHSQRKAAAAIESGAFTAEIVPVNVVTRKKTFVFSQDEFPKADSTAEALGALRPAFDKAGTVTAGNASGINDGAAALVIMEESSALAAGLTPLARIKSYASGGVPPALMGMGPVPATQKALQLAGLQLADIDLIEANEAFAAQFLAVGKTLGFEPEKVNVNGGAIALGHPIGASGARILVTLLHAMQARDKTLGLATLCIGGGQGIAMVIERLN

SEQ ID NO: 5383 - DNA, 777 bp, Escherichia coli
atgcgaaagatttttcttccgttgttactggtggcgctttcgcctgtcgctcacagtgaaggtgtgcaggaagtcgagattgatgcaccgctctctggctggcatccggcagagggtgaagatgccagtttttcacaaacgatcaattacccggcgtcgtccgccaacatggcagatgatcaaaatatctcagcgcagatccgcggcaaaataaagaattatgctgcggcgggtaaagttcagcagggccggctggtggtcaacggtgccagtatgccgcagagaattgaatcagatggttcttttgcacgcccttatattttcactgaaggcagcaacagcgtgcaggtcatcagcccagatgggcaaagccgacaaaaaatgcagttttactcaacgccgggtgctggggcgattcgcgcacgtttacggctggttctctcgtgggatacggacaataccgacctcgatcttcatgtcgttacgcctgacggtgaacatgcctggtacggtaacaccgtgctgaaaaacagtggtgcactggatatggatgtcacgacagggtacggccccgagattttcgccatgccagcgccagttcacggccgttatcaggtgtatatcaactactatggcggacgcagcgaaacggaattaactacggcccaactgacgctgatcaccgatgaagggtcggtcaatgagaaacaggaaacttttattgtaccgatgcgtaatgctggcgaactgacgctggtgaaaagttttgactggtga

SEQ ID NO: 5384 - protein, 258 aa, Escherichia coli
MRKIFLPLLLVALSPVAHSEGVQEVEIDAPLSGWHPAEGEDASFSQTINYPASSANMADDQNISAQIRGKIKNYAAAGKVQQGRLVVNGASMPQRIESDGSFARPYIFTEGSNSVQVISPDGQSRQKMQFYSTPGAGAIRARLRLVLSWDTDNTDLDLHVVTPDGEHAWYGNTVLKNSGALDMDVTTGYGPEIFAMPAPVHGRYQVYINYYGGRSETELTTAQLTLITDEGSVNEKQETFIVPMRNAGELTLVKSFDW

SEQ ID NO: 5385 - DNA, 1650 bp, Escherichia coli
gtgaactggtacagaatcgtctggctattggcgttggtaactctgccaacgcttgcggaggagacgccgttacaactggcgctgcggggcgcgcagcacgatcaactgtatcagctgtcgtcatcaggcgtgaccaaagtctcggtattacctgacacgctcaccacgccattagggagtttgtggaaactgtatatttacgcctggctggaggatacccatcaaccggagcagccataccagtgtcgcggcaactccccggaagaggtttattgttgtcaggctggggagagcataacgcgcgattccgcgctggtacgttcctgtggactctattttgcgccgcagcggttgcatattggcgcagatatgtgggggcaatactggcaacagcgtcaggcacctgcgtggttagcgtctcttactacactgaagccagaaacctcggtaacggttaaatcgctgcttgattcattagcgacattacctgcgcaaaacaaagctcaggaagtcttactggatgtggtgctggacgaggcgaaaatcggtgtcgcatccatgctcggtagtcgggtacgggtgaaaacctggagttggtttgccgatgataaacaggaaatccgtcagggtggttttgctggctggttaaccgatggtacaccgctgtgggttactggcagtggcaccagcaaaacggtactgacccgttatgcgacggcgcttaatcgggttttgccagtgccgacgcaggttgccagtgggcaatgtgtgttggtggatctgtttgctcgttatccgctgaagaaagttactgaggaaaagagtacgacggcagtcaaaccaggcgtgctcaatgggcgctatcgtgtgacgtttgccaatggtaaccacatgacatttgtcagccacggtgagacaacgttactgacggtaaagggcaaactgaaattacagtcgcatctcgatcgtgaagagtacgttgccagagttctggatcgcgaggcgaaaagtacgcctcctgaggcagcgaaagccatgaccgtggcgattcgcacgtatttacagcaaaacgccgatcgcgatggtgattgcctgagcatcccggacagtagcgctacccagcgcgtttcagcttcgccagccactgtaggcgcgcggacgatgaccgcctggacgcaggatctcatctatgcgggcgatccggttcattatcatggcagccgggttaccgaagggacgctttcctggcggcacgctactgcccaggcggggcagggagagcgttatgatcagatacttgcgtttgcttatcccgacaacaaccttagccgctggggagcgccacgctcaacctgccagttattacccaaagcgaaagcctggctggcgaaaaaaatgccgcagtggcggcgcgtgttacaagatgaaatggggtataacgaacctgacgtgtttgcggtctgccgcttagtctcaggtttcccctataccgatcggcagcagaaacggctgtttattcgtaacttctttacgcttcaggatcggctggatttaacccatgagtatctgcacctggcctttgatggttatcccaccgggcttgatgagaactatatcgaaacgctgacccgacaattattaatggactaa

SEQ ID NO: 5386 - protein, 549 aa, Escherichia coli
MNWYRIVWLLALVTLPTLAEETPLQLALRGAQHDQLYQLSSSGVTKVSVLPDTLTTPLGSLWKLYIYAWLEDTHQPEQPYQCRGNSPEEVYCCQAGESITRDSALVRSCGLYFAPQRLHIGADMWGQYWQQRQAPAWLASLTTLKPETSVTVKSLLDSLATLPAQNKAQEVLLDVVLDEAKIGVASMLGSRVRVKTWSWFADDKQEIRQGGFAGWLTDGTPLWVTGSGTSKTVLTRYATALNRVLPVPTQVASGQCVLVDLFARYPLKKVTEEKSTTAVKPGVLNGRYRVTFANGNHMTFVSHGETTLLTVKGKLKLQSHLDREEYVARVLDREAKSTPPEAAKAMTVAIRTYLQQNADRDGDCLSIPDSSATQRVSASPATVGARTMTAWTQDLIYAGDPVHYHGSRVTEGTLSWRHATAQAGQGERYDQILAFAYPDNNLSRWGAPRSTCQLLPKAKAWLAKKMPQWRRVLQDEMGYNEPDVFAVCRLVSGFPYTDRQQKRLFIRNFFTLQDRLDLTHEYLHLAFDGYPTGLDENYIETLTRQLLMD

SEQ ID NO: 5387 - DNA, 4605 bp, Escherichia coli
atggatacccaacgattccaatcccaatttcattggcatttatcgtttaaattttctggcgcgatagcagcgtgcttgtccctgtctcttgtgggaacagggcttgctaatgctgatgattcgcttccttccagtaactatgtgccgcccgccgggggaacattctttttgctcgctgacagcagttttagcagcagtgaagaggcgaaagtgcgactggaagcgccggggcgtgattatcggcgctatcagatggaagagtacggcggcgtggacgttcgcctgtatcgtattcctgacccgatggcatttttgcgccagcagaaaaacctgcatcgcattgtggtgcaaccgcaatatctgggcgacggactgaacaatacgctgacctggctgtgggataactggtacggcaaatctcgccgcgtgatgcagcgtactttctcttctcagtcacggcagaatgtgactcaggcgttacccgaattacagctcggtaatgccattattaaaccttcccgttatgtacagaacaaccagttttcaccgctgaaaaaatatccactagtggaacagttccgttacccactatggcaggctaaaccggtcgagccgcaacaaggggtaaaactggaaggcgcatccagcaatttcatttcgccgcagccgggcaacatctatattcctctcggcaaacaagagccgggactgtacctcgtcgaggcgatggtgggtgggtatcgggcgacgacggtggtgtttgtttccgataccgtggcgcttagcaaagtgtcaggtaacgagcttctggtgtggaccgcggggaaaaaacagggtgaagcgaagcccggctcagagatcttgtggactgacggtcttggcgtgatgacccgcggtgtgaccgatggcagcggtaccttgcagttacaacatatatcgccagaacgttcatatattctgggtaaggatgctgaaggcggcgtttttgtctccgagaactttttctacgaaagcgaaatctacaacacccgcttgtatatctttaccgatcgcccgctatatcgcgcaggcgatcgtgtcgatgttaaagtgatgggccgcgagttccacgatccgttgcattcatcccccatcgtcagcgcaccggcgaagctttcggtgctggacgccaacggcagtctgttgcaaaccgtcaatgtcacgctggatgcgcgtaatggcgggcaggggagtttccgcctgccagaaaatgccgtcgccggaggttatgagttacgtcttgcttaccgcaaacaggtctatagcagcagttttcgcgtggcaaactacatcaaaccccattttgagattggtttagctctcgacaaaaaagagttcaaaactggcgaagcggtcagcggcaaactgcaactgctttacccggatggcgagccggtaaaagatgcccgcgtgcagttaagtttgcgcgctcagcaattatcaatggttggtaacgatttgcgttatgccggacgtttcccggtgtcgctggaaggcagtgaaacggtttccgacgataatggtcatgtggcgttgaatctccccgccgccgataaaccgagccgttatttgttaaccgtctccgccagtgacggcgcggcgtatcgagttaccaccaccaaagagatcctcattgaacgtggcctggcgcattactctttaagtaccgccgcacaatacagtaatagcggcgagtcggttgtgttccgttatgccgcgctggaatcttcaaaacaggttcctgttacgtatgaatggttgcgtctcgaagaccgcacgagtcacagcggagagctacagtcaggcggcaaatcctttaccgtcaatttcgctaaacctggcaactacaatctgacattacgcgataaagacggcttaattctcgccgggttaagccatgcagtcagcggtaagggcagcacgtcgcatactggtacggtagatatcgtggcagataaaacactgtatcagcctggcgaaaccgcgaagatgctgattaccttcccggagccaattgacgaagcattattgacgctggaacgcgatcgcgtggaacagcagtcgctgctatcgcatctggcaaactggctaacgctacaacgtttaaacgatacccagtatgaagcccgcgtaccggtgagcaattcctttgcgcctaacatcactttttcggtgctgtatacccgtaacggtcagtacagttttcagaacgccgggattaaagttgccgttccccagctggatatccgggtgaaaacggacaaaacccattaccagcctggtgaactggtcaatgtcgaattaacctcgtcgctgaaaggtaaacctgtttctgcgcagttaacggtaggcgtggtcgatgaaatgatctacgcgctgcaaccggaaatcgcgccgaatatcggcaaatttttctatccgctggggcgtaacaatgtgcgtaccagctccagtctgtcgtttatcagctacgatcaggcgctctccagcgagccggttgcgcctggcgcgactaaccgcagcgagcggcgagtaaaaatgctggaacgtccacggcgtgaagaggtggataccgcggcctggatgccgtcactcacaaccgataaacaaggcaaagcgtatttcacgttcctgatgcctgattcgttaacccgctggcgcatcaccgcgcgtgggatgaacggcgacgggctggtcgggcaggggcgtgcttatctgcgttcggaaaaaagtctctacatgaaatggagtatgccaacggtgtatcgcatgggcgacaaaccggcagcaggactgtttatcttcagtcagcaggataacgaaccggtggcgctggtgactaaatttgcaggcgctgagatgcgccagacgctgacgctgcacaaaggggcgaattatatttcgctgacgcagaatattcagcaatctggcttgttaagtgcagaactgcaacaaaatgggcaagtacaggacagcattagcacaaaactgtcttttgtggataacagctggcccgttgaacaacagaaaaacgtcatgctcggcggtggcgataatgcgctgacgttgcccgagcaggcgagcaatatccggctacaaagtagcgaaacgccgcaggagattttccgtaacaatcttgatgcattagtcgatgaaccgtggggtggcgtgatcaacaccggtagccgtctgatcccgctcagtctcgcctggcgttcgcttgccgatcatcaaagtgccgccgctaacgacattcgtcagatgattcaggataaccgtctgcggctgatgcaactggcggggcccggagcgcgctttacctggtggggtgaagatggcaatggcgacgccttcctcacggcatgggcatggtacgccgactggcaggccagccaggcgctcggcgtaacgcagcaaccggaatactggcaacatatgctcgacagttatgccgagcaggcggacaacatgccgttattgcatcgggcgctggtgctggcgtgggcacaggagatgaatctgccgtgcaaaacgttgttgaaagggttggatgaagctatcgcccggcgcggaactaaaactgaagatttctctgaggaagacaccagcgatatcaatgacagcctgatcctcgatacacctgaatctccactggcagatgcggtggcaaacgtcttaaccatgacgttgctgaaaaaagcgcagttgaagtccactgtgatgccacaggttcagcaatatgcgtgggataaagcagcaaacagcaatcagccgctggcgcacacggttgtgctgcttaatagcggtggcgacgctacccaggcggccgctattttaagtggtttgaccgctgagcaatccactattgagcgcgcgctggccatgaactggctggcgaaatatatggcgacgatgcctccagttgtgttgcctgcgcctgcgggcgcatgggctaaacataagttaactggagggggcgaagactggcgttgggttggtcagggtgtgccggacattctctcttttggtgacgaattatcgccgcaaaatgtgcaggtccgctggcgtgaaccggcaaaaacggctcaacaaagtaacattccggtgaccgttgaacgccagttgtatcggcttatccccggtgaagaagagatgagctttactctgctgccggtgaccagcaatgagattgacagcgatgcgctgtatctcgatgaaattacgcttaccagcgagcaggatgccgttctgcgctacggtcaggtggaagtaccgctcccgccaggggctgacgttgagaggactacgtggggcatttcggtcaataaacccaaccccgcgaaacagcaggggcaattgctggaaaaagcgcgaaatgaaatgggcgaactgggctatatggtgccggtgaaagaactgacgggaacggtcactttccgccatttgctgcgcttctcgcaaaaagggcaattcgttctgcctcctgctcgttatgtgcgttcctatgcacctgcacagcaaagtgttgcgccagggagcgaatggatcgggatgcaggtgaaataa

SEQ ID NO: 5388 - protein, 1534 aa, Escherichia coli
MDTQRFQSQFHWHLSFKFSGAIAACLSLSLVGTGLANADDSLPSSNYVPPAGGTFFLLADSSFSSSEEAKVRLEAPGRDYRRYQMEEYGGVDVRLYRIPDPMAFLRQQKNLHRIVVQPQYLGDGLNNTLTWLWDNWYGKSRRVMQRTFSSQSRQNVTQALPELQLGNAIIKPSRYVQNNQFSPLKKYPLVEQFRYPLWQAKPVEPQQGVKLEGASSNFISPQPGNIYIPLGKQEPGLYLVEAMVGGYRATTVVFVSDTVALSKVSGNELLVWTAGKKQGEAKPGSEILWTDGLGVMTRGVTDGSGTLQLQHISPERSYILGKDAEGGVFVSENFFYESEIYNTRLYIFTDRPLYRAGDRVDVKVMGREFHDPLHSSPIVSAPAKLSVLDANGSLLQTVNVTLDARNGGQGSFRLPENAVAGGYELRLAYRKQVYSSSFRVANYIKPHFEIGLALDKKEFKTGEAVSGKLQLLYPDGEPVKDARVQLSLRAQQLSMVGNDLRYAGRFPVSLEGSETVSDDNGHVALNLPAADKPSRYLLTVSASDGAAYRVTTTKEILIERGLAHYSLSTAAQYSNSGESVVFRYAALESSKQVPVTYEWLRLEDRTSHSGELQSGGKSFTVNFAKPGNYNLTLRDKDGLILAGLSHAVSGKGSTSHTGTVDIVADKTLYQPGETAKMLITFPEPIDEALLTLERDRVEQQSLLSHLANWLTLQRLNDTQYEARVPVSNSFAPNITFSVLYTRNGQYSFQNAGIKVAVPQLDIRVKTDKTHYQPGELVNVELTSSLKGKPVSAQLTVGVVDEMIYALQPEIAPNIGKFFYPLGRNNVRTSSSLSFISYDQALSSEPVAPGATNRSERRVKMLERPRREEVDTAAWMPSLTTDKQGKAYFTFLMPDSLTRWRITARGMNGDGLVGQGRAYLRSEKSLYMKWSMPTVYRMGDKPAAGLFIFSQQDNEPVALVTKFAGAEMRQTLTLHKGANYISLTQNIQQSGLLSAELQQNGQVQDSISTKLSFVDNSWPVEQQKNVMLGGGDNALTLPEQASNIRLQSSETPQEIFRNNLDALVDEPWGGVINTGSRLIPLSLAWRSLADHQSAAANDIRQMIQDNRLRLMQLAGPGARFTWWGEDGNGDAFLTAWAWYADWQASQALGVTQQPEYWQHMLDSYAEQADNMPLLHRALVLAWAQEMNLPCKTLLKGLDEAIARRGTKTEDFSEEDTSDINDSLILDTPESPLADAVANVLTMTLLKKAQLKSTVMPQVQQYAWDKAANSNQPLAHTVVLLNSGGDATQAAAILSGLTAEQSTIERALAMNWLAKYMATMPPVVLPAPAGAWAKHKLTGGGEDWRWVGQGVPDILSFGDELSPQNVQVRWREPAKTAQQSNIPVTVERQLYRLIPGEEEMSFTLLPVTSNEIDSDALYLDEITLTSEQDAVLRYGQVEVPLPPGADVERTTWGISVNKPNPAKQQGQLLEKARNEMGELGYMVPVKELTGTVTFRHLLRFSQKGQFVLPPARYVRSYAPAQQSVAPGSEWIGMQVK

SEQ ID NO: 5389 - DNA, 651 bp, Escherichia coli
gtggctacccataacctggcaaccgctatgagacacgggctgctggtgctgatttgctggctgtattgtgttgttgcccatagtgaaatgctaaatgtcgaacaatccgggctgtttcgcgcgtggtttgtgcgcattgcacaggaacagctccgccaggggccaagcccacgctggtatcaacaggattgcgcgggcctggtgcgatttgcggcgaacgaggcgctgaaagttcacgacagtaaatggctaaaaagtaacggtttatctaaccagtatttgccgccagagatgacgctaacacctgaacagcgtcaactggcgcaaaactggaatcaggggaatgggaaaaccggcccctatgtgaccgcgattaatttgattcagtacaacagccagtttattggccaggacataaaccaggcactgcctggcgatatgatttttttcgatcagggcgatgcccagcacttaatggtctggatggggcgttacatcatctaccacaccggaagcgccacgaaaactgacaacggaatgcgcgcagtcagtctgcaacaacttatgacatggaaggacacccgatggatacccaacgattccaatcccaatttcattggcatttatcgtttaaattttctggcgcgatag

SEQ ID NO: 5390 - protein, 216 aa, Escherichia coli
MATHNLATAMRHGLLVLICWLYCVVAHSEMLNVEQSGLFRAWFVRIAQEQLRQGPSPRWYQQDCAGLVRFAANEALKVHDSKWLKSNGLSNQYLPPEMTLTPEQRQLAQNWNQGNGKTGPYVTAINLIQYNSQFIGQDINQALPGDMIFFDQGDAQHLMVWMGRYIIYHTGSATKTDNGMRAVSLQQLMTWKDTRWIPNDSNPNFIGIYRLNFLAR

SEQ ID NO: 5391 - DNA, 1689 bp, Escherichia coli
atgagtggtgaaaaaaaggcgaaaggctggcggttttatggccttgttggttttggggcaatagcgctgctatccgctggcgtatgggcattacaatactctggcagtgggccagaaaaaacgttgtcgccactggtggtgcacaacaatctgcaaatcgatctcaatgagccggacctctttctcgacagcgactctctgagccagcttcccaaagatctccttaccattccgtttctccacgatgttctgagcgaagatttcgttttctattatcagaatcatgccgatcgtctgggcattgaaggcagcattcgccgcattgtctatgaacacgatctcacgctgaaagataagctcttttcgtcactcttagaccagcccgcgcaggcggcactgtggcacgataaacaaggccatctttctcattatatggtgctgatccagcgaagtggtttaagcaagctgctggagccattgctgtttgccgctaccagcgacagccagttaagtaaaacggaaatcagtagcatcaagataaatagtgaaactattcctgtttatcagttgcgctataacggcaataacgtcctgatgtttgcgacttatcaggacaaaatattggctttttccagttcggatatgctgtttaaagatgaccaacaggatactgaagccacggcgatcgcaagtgatttgttgagtggtaaaaaacgctggcaagccagctttggcctggaagagcgtactgccgaaaaaacgccagtacgccagcgcatcgtggtcagcgccaggttgctggggtttggctaccagcgattagtgccttcttttgctggcatgcgcttcgaaatgggtaacgacggctggcacagttttctggcgttaaacgatgaatccgccagcgtagatgccagtttcgattttacgccggtatggaacagtatgcctgccggagccagcttctgtgtggcggtgccgtattcacacggtattgccgaagagatgctttcgcacatcagccaggaaaacgacaagctgaatggggcgttagacggtggcgcggggctgtgctggtatgaagactcaaaattgcaaaccccactgtttgttggtcagtttgatggcactgccgaacaggcgcaattgccagggaaactgtttacgcaaaatattggtgcgcacgaaagcaaagcgccagaaggtgttttgccggtaagccagactcagcagggcgaagcgcaaatctggcgtcgcgaagtgagttcccgatacggtcagtatccgaaagcgcaggcggcgcaacccgatcaattaatgtcggattattttttccgcgtgtcgctggcgatgcaaaacaaaacgctgcttttctccctcgatgacacgctggttaataacgccctgcaagcactgaataaaacccgcccggcaatggtggatgtaatacccactgatggcatcgttccgctctatatcaatccacaaggaatggcgaaactgctgcgtaacgaaacgctgaccagtctgccgaagaatctcgaaccggttttttataacgccgcacaaactttattaatgccgaagctggacgctttatctcaacaaccgcgttatgtcatgaagctggcccagatggaacccggtgccgcctggcagtggctacccataacctggcaaccgctatga

SEQ ID NO: 5392 - protein, 562 aa, Escherichia coli
MSGEKKAKGWRFYGLVGFGAIALLSAGVWALQYSGSGPEKTLSPLVVHNNLQIDLNEPDLFLDSDSLSQLPKDLLTIPFLHDVLSEDFVFYYQNHADRLGIEGSIRRIVYEHDLTLKDKLFSSLLDQPAQAALWHDKQGHLSHYMVLIQRSGLSKLLEPLLFAATSDSQLSKTEISSIKINSETIPVYQLRYNGNNVLMFATYQDKILAFSSSDMLFKDDQQDTEATAIASDLLSGKKRWQASFGLEERTAEKTPVRQRIVVSARLLGFGYQRLVPSFAGMRFEMGNDGWHSFLALNDESASVDASFDFTPVWNSMPAGASFCVAVPYSHGIAEEMLSHISQENDKLNGALDGGAGLCWYEDSKLQTPLFVGQFDGTAEQAQLPGKLFTQNIGAHESKAPEGVLPVSQTQQGEAQIWRREVSSRYGQYPKAQAAQPDQLMSDYFFRVSLAMQNKTLLFSLDDTLVNNALQALNKTRPAMVDVIPTDGIVPLYINPQGMAKLLRNETLTSLPKNLEPVFYNAAQTLLMPKLDALSQQPRYVMKLAQMEPGAAWQWLPITWQPL

SEQ ID NO: 5393 - DNA, 2628 bp, Escherichia coli
atgagcgaccttgcgagagaaattacaccggtcaacattgaggaagagctgaagagctcctatctggattatgcgatgtcggtcattgttggccgtgcgctgccagatgtccgagatggcctgaagccggtacaccgtcgcgtactttacgccatgaacgtactaggcaatgactggaacaaagcctataaaaaatctgcccgtgtcgttggtgacgtaatcggtaaataccatccccatggtgactcggcggtttatgacacgatcgtccgtatggcgcagccattctcgctgcgttacatgctggtagacggtcagggtaacttcggttccatcgacggcgactctgcggcggcaatgcgttatacggaaatccgtctggcgaaaattgcccatgaactgatggctgatctcgaaaaagagacggtcgatttcgttgataactatgacggtacggaaaaaattccggacgtcatgccaaccaaaattcctaacctgctggtgaacggttcttccggtatcgccgtaggtatggcaaccaacatcccgccgcacaacctgacggaagtcatcaacggttgtctggcgtatatcgatgatgaagacatcagcattgaagggctgatggaacacatcccggggccggacttcccgacggcggcaatcattaacggtcgtcgcggtattgaagaagcttaccgtaccggtcgcggcaaggtatatatccgcgcccgtgccgaagtagaagttgacgccaaaaccggacgtgaaaccattatcgtccacgaaattccttatcaggtgaacaaagcgcgcctgatcgagaagattgcggaactggtaaaagaaaaacgcgtggaaggcatcagcgcgctgcgtgacgagtctgacaaagacggtatgcgcatcgtgattgaagtgaaacgcgacgcggtcggtgaagttgtgcttaacaacctctactcccagacccagttgcaggtttctttcggtatcaacatggtggcattgcaccatggtcagccgaagatcatgaacctgaaagacatcatcgcggcgtttgttcgtcaccgccgtgaagtagtgacccgtcgtactattttcgaactgcgtaaagctcgcgatcgtgctcatatccttgaagcattagccgtggcgctggcgaacatcgacccgatcatcgaactgatccgtcatgcgccgacgcctgcagaagcgaaaaccgcgctggttgcaaatccgtggcagctgggcaacgttgctgcgatgctggaacgtgcgggcgacgatgctgcgcgtccggaatggctggagccagagttcggcgtgcgtgatggtctgtactatctgaccgaacagcaagctcaggcgattctggatctgcgtctgcagaaactgaccggccttgagcacgaaaaactgctcgacgaatacaaagagctgctggatcagattgcggaactgttgcgtattctgggtagcgccgatcgtctgatggaagtgatccgcgaagagctggaactggttcgtgaacagttcggtgacaaacgtcgtaccgaaatcaccgctaacagcgccgacatcaacctggaagatctgatcacccaggaagatgtggtggtcacgctttctcaccagggttacgtgaagtatcagccgctttctgaatacgaagcgcagcgtcgtggcgggaaaggtaaatctgccgcacgtattaaagaggaagactttatcgaccgactgctggtggcgaacactcacgaccatattttgtgcttctccagccgtggtcgcgtctattcgatgaaggtttaccagttgccagaagctactcgtggcgcacgtggtcgtccgatcgtcaatctgctgccgctggaacaggacgaacgtatcaccgcgatcctgccggtgaccgagtttgaagaaggcgtgaaagtcttcatggcgaccgctaacggtaccgtgaagaaaactgtcctcaccgaattcaaccgtctgcgtaccgccggtaaagtggcgatcaaactggttgaaggcgatgagctgatcggcgttgacctgaccagcggcgaagacgaagtaatgctgttctccgctgaaggtaaagtggtgcgctttaaagagtcttctgtccgtgcgatgggctgcaacaccaccggtgttcgtggtattcgtttaggcgaaggcgataaagtcgtctctctgatcgtgcctcgtggcgatggcgcaatcctcaccgcaacgcagaacggttatggtaaacgtaccgcagtggcggaatacccaaccaagtcgcgtgcgacgaaaggggttatctccatcaaggttaccgaacgtaacggtttagtggttggcgcggtgcaggtagatgactgcgaccagatcatgatgatcaccgatgccggtacgctggtacgtactcgcgtttcggaaatcagcatcgtaggccgtaacacccagggcgtaatccttatccgtacttcggaagatgaaaacgtggtgggtctgcaacgtgttgctgaaccggttgacgaggaagatctggataccatcgacggcagtgccgcggaaggggacgatgaaatcgctccggaagtggacgttgacgacgagccagaagaagaataa

SEQ ID NO: 5394 - protein, 875 aa, Escherichia coli
MSDLAREITPVNIEEELKSSYLDYAMSVIVGRALPDVRDGLKPVHRRVLYAMNVLGNDWNKAYKKSARVVGDVIGKYHPHGDSAVYDTIVRMAQPFSLRYMLVDGQGNFGSIDGDSAAAMRYTEIRLAKIAHELMADLEKETVDFVDNYDGTEKIPDVMPTKIPNLLVNGSSGIAVGMATNIPPHNLTEVINGCLAYIDDEDISIEGLMEHIPGPDFPTAAIINGRRGIEEAYRTGRGKVYIRARAEVEVDAKTGRETIIVHEIPYQVNKARLIEKIAELVKEKRVEGISALRDESDKDGMRIVIEVKRDAVGEVVLNNLYSQTQLQVSFGINMVALHHGQPKIMNLKDIIAAFVRHRREVVTRRTIFELRKARDRAHILEALAVALANIDPIIELIRHAPTPAEAKTALVANPWQLGNVAAMLERAGDDAARPEWLEPEFGVRDGLYYLTEQQAQAILDLRLQKLTGLEHEKLLDEYKELLDQIAELLRILGSADRLMEVIREELELVREQFGDKRRTEITANSADINLEDLITQEDVVVTLSHQGYVKYQPLSEYEAQRRGGKGKSAARIKEEDFIDRLLVANTHDHILCFSSRGRVYSMKVYQLPEATRGARGRPIVNLLPLEQDERITAILPVTEFEEGVKVFMATANGTVKKTVLTEFNRLRTAGKVAIKLVEGDELIGVDLTSGEDEVMLFSAEGKVVRFKESSVRAMGCNTTGVRGIRLGEGDKVVSLIVPRGDGAILTATQNGYGKRTAVAEYPTKSRATKGVISIKVTERNGLVVGAVQVDDCDQIMMITDAGTLVRTRVSEISIVGRNTQGVILIRTSEDENVVGLQRVAEPVDEEDLDTIDGSAAEGDDEIAPEVDVDDEPEEE

SEQ ID NO: 5395 - DNA, 723 bp, Escherichia coli
atgaatgccgaaaaatcgccggtaaaccacaacgtagaccacgaagagatcgctaaatttgaagccgtcgcctcccgctggtgggatcttgaaggtgagttcaaaccgctgcaccgcattaacccgctgcgtctgggctatattgccgagcgtgctggcggtttatttggcaaaaaggtgctcgatgtcggttgtggcggcggcattctggccgagagtatggcgcgggagggcgcgacggtgaccggtctggatatgggctttgagccattgcaggtggcaaaactgcacgcactggaaagcggcattcaggtggattacgtgcaggaaaccgtggaagagcacgcggcaaaacatgccggacagtatgacgtggtgacctgtatggagatgctggagcacgtccccgatcctcagtcagtggtcagagcctgtgcgcaactggtgaaaccgggcggcgatgtctttttctcgacgcttaaccgcaacggcaagtcatggctgatggcggtggttggtgcggaatatattttgcgcatggtgcctaaaggtacacatgatgtgaagaagtttattaaaccggcagaattgctgggctgggtggatcagaccagtcttaaagaacggcatatgaccgggctgcattacaacccgatcactaattcctttaagctcggccccggcgtggatgtgaactatatgctgcacacgcagaataagtga

SEQ ID NO: 5396 - protein, 240 aa, Escherichia coli
MNAEKSPVNHNVDHEEIAKFEAVASRWWDLEGEFKPLHRINPLRLGYIAERAGGLFGKKVLDVGCGGGILAESMAREGATVTGLDMGFEPLQVAKLHALESGIQVDYVQETVEEHAAKHAGQYDVVTCMEMLEHVPDPQSVVRACAQLVKPGGDVFFSTLNRNGKSWLMAVVGAEYILRMVPKGTHDVKKFIKPAELLGWVDQTSLKERHMTGLHYNPITNSFKLGPGVDVNYMLHTQNK

SEQ ID NO: 5397 - DNA, 3711 bp, Escherichia coli
atgattgcatctcttttctctgctaacggtgccgcagcggtcattgattcatgccagggatatgatatcaaagcgaactgtcaggccagcaggcaaagcctttcaggcaatatgcaggactggagcatcgcggatgggcaatggttgattttttcgggtatggccaataatgccagcggtggcgcggtatttttgcagcacagtgctgaatttacgatatcaccacaaaatgaaacagggatgaccctgtttgctgataactcggttagtggcgaatataataatggtggggctatctttgctaaagaaaactcaacgataaatcttgcgaatgttattttcgacagtaatgttgcaggaggctatggcggagcaatctattctgccggtaccaatgataccggtgcagccgatttacgtgtcactaacgccgtatttcacaataacatcgctaatgacggcaaaggcggtgcaatttataccatcaataatgacgtctatttaagtgatgatgcttttaataataaccaggcatatacatcaacaagttatagtgatggggatggcggcgccattgatgttacggataatagtacggataacacacatctttcaggaaaaacgataattaataatacctcctttaccaataactatgcagaaggttatggcggcgcaatttataccagcagcaccacatccccgtatcttattgatatttctgttgatgataattatgaccaaaacaatggtgtgatgattgatgaaaataacagcgcctcgggatatgaccattcggcgacggcagcggcggggggctttatgtatatcggtcatagtgtggctgaatttaacattgccgccgataaaacgctggtaataggcaataccagcaacgatggcgcgattgattctcttgccggaacgggagtcatcgttaaagagggagcgggagagttagtcctcaatgccgacaataatgcgtttaccggcgagataagtatccagaatggcgaggtgacgttggggcgcagcgatgagttaatgaatgtcggcgacacgcactgtcagagcgatccgcaggattgctttggtctgatggtcggcagcactgttcattctgagtatcaggcagaactgaatgttggcaatacacaacaaacgtttgtgcactcattaaccggttttgctaatggcattttgaatatcgacgcaggcggcaatgttaccgtaaaccagggcggtttttccggctcgattcagggtgaaggacagttgacggtagcgcaagatggcagctatctcctgacaggggcgcagtcgatggcattaaccggcgatattgtggtggaagataacgccgtattgtcgctagcggggaatcaggccgatttacgggcaatgcagagcgatccgcaatcgatcgtgctaaatggcggagtattggatctctctgatttcaccacctgggatggcgatagctcatacaatgacggtctgcaaatcagcggcagcggggggacagtgattggcagtaatgatgtcgttgatatcagcagtggcgatgatttacatattggcggcagtgatgccagccagaatggcgtttatgtcgtcattaatgcgggggatcagcgcgtaacgctggcgaataacaacggttatctcggtaatacgcaaatcgcctccggtacgcttgaagtcagcgataattcgcaattggggaacacaagttacaaccgttcagtgatcttcacagatccccaacaacacagtgaaatggatgtgacgactgatgttgacactcgctcggctacaacaggtcagggcaggaatattgaaatgcgcgctgatggcgaaatacacgttgaggatggcgtagatacgcaatggggcgggttgatggcggatagtaccgggcaacaactggatagcgtaagcacgttgactaaaagtggcggcggtacgctggagttgaccgccagcggcactgcgacgtctgcggtacgtgtggaggacggaacgctaaaaggtgaagcggagaatattattccttatgtttcttcactgtgggtgggggaagacggtgtttttgaaaccgggcaaaatcaggatattcgttcaatcgatgccacctctggcggcgatatcgacataaccgatggtactgtgttgcgattgacgcagcaggatacgaaccaggcgctggatgcctcgctgtttagcggcgacggtacgctggtgaatgccaccgatggcgtgacgctggcaggtgagcttaataccaaccttgaaactgacagcctgacttatctttccgacgtgacggttaatggcaatctgaccaatacgtccggtgctgtcagtctgcaaaatggcgtcgctggcaacacgctgacggtaaatggtgattataccggcggcggtacgctactgctcgacagcgaattaaacggcgatgactcggcaagtgaccaactggtattgaacggtaatactgctggcaacacggccgtggtaattaaccccattacgggtattggtgaaccgacatctacaggtattaaagtggttgatttcgcagctgatcccacgcagtttcaaaacaatgcgcagttcagtctggcaggaagcggctacgtcaatatgggggcgtatgactacacgctggtggaagataacaacgactggtatctgcgatcacaagaagtcaatccgacgccgccgcctgatccagacccgactccagatcctgatcccacgccggatcccgacccaacccccgacccggaacctacgcctgcctaccagccggtgttgaatgccaaagttggtggatattttaataacctgcgggcggcaaatcaggcatttgtgatggagcgacgcgatcacgctggtggcgatggtcagacgctgaatttacgcgttatcggcgggcgttatcattacacggcggtagggcagttggctcagcatgaagacacttctacggtgcagcttagcggcaacctgtttagcgggcactggggtgatgatggcgagtggatgcttgggattgttggtggctacagcgataaccagggcgacagccgctcgaatatgaccggaactcgcgccgataaccagaaccacggttatgccgttgggctgacctcaagctggtatcagcacggtaatcagaagcagggggcctggttggatagctggctgcaatatgcgtggtttaacaatgatgtttccgaacaagacgatggcgtggatcattaccactcgtcggggattatcgcctcgctggaagccggttatcagtggttaccggggcatggtgtggtgattgaaccgcagacgcaggtgatttatcagggcgtgcagcaggatgattttaccgccgctaaccatgcgcgcgtgtcacaatcgcagggtgatgatattcagacgcggctgggtttacacagcgaatggcgtactgctgttggtgtcacgccaacgttagatctgaattattatcacgatccccatgcgacggaaattgaagaagatggcagcactatcagtgacgatgcggtgaagcaacggggtgaaataaaagtgggaataacgggcaatatcagtcagcgagtttcgctgcgcggcagcgtggcgtggcagaaagggagtgatgattttgcccagacggcagggtttttgtcgatgacagtgaaatggtaa

SEQ ID NO: 5398 - protein, 1236 aa, Escherichia coli
MIASLFSANGAAAVIDSCQGYDIKANCQASRQSLSGNMQDWSIADGQWLIFSGMANNASGGAVFLQHSAEFTISPQNETGMTLFADNSVSGEYNNGGAIFAKENSTINLANVIFDSNVAGGYGGAIYSAGTNDTGAADLRVTNAVFHNNIANDGKGGAIYTINNDVYLSDDAFNNNQAYTSTSYSDGDGGAIDVTDNSTDNTHLSGKTIINNTSFTNNYAEGYGGAIYTSSTTSPYLIDISVDDNYDQNNGVMIDENNSASGYDHSATAAAGGFMYIGHSVAEFNIAADKTLVIGNTSNDGAIDSLAGTGVIVKEGAGELVLNADNNAFTGEISIQNGEVTLGRSDELMNVGDTHCQSDPQDCFGLMVGSTVHSEYQAELNVGNTQQTFVHSLTGFANGILNIDAGGNVTVNQGGFSGSIQGEGQLTVAQDGSYLLTGAQSMALTGDIVVEDNAVLSLAGNQADLRAMQSDPQSIVLNGGVLDLSDFTTWDGDSSYNDGLQISGSGGTVIGSNDVVDISSGDDLHIGGSDASQNGVYVVINAGDQRVTLANNNGYLGNTQIASGTLEVSDNSQLGNTSYNRSVIFTDPQQHSEMDVTTDVDTRSATTGQGRNIEMRADGEIHVEDGVDTQWGGLMADSTGQQLDSVSTLTKSGGGTLELTASGTATSAVRVEDGTLKGEAENIIPYVSSLWVGEDGVFETGQNQDIRSIDATSGGDIDITDGTVLRLTQQDTNQALDASLFSGDGTLVNATDGVTLAGELNTNLETDSLTYLSDVTVNGNLTNTSGAVSLQNGVAGNTLTVNGDYTGGGTLLLDSELNGDDSASDQLVLNGNTAGNTAVVINPITGIGEPTSTGIKVVDFAADPTQFQNNAQFSLAGSGYVNMGAYDYTLVEDNNDWYLRSQEVNPTPPPDPDPTPDPDPTPDPDPTPDPEPTPAYQPVLNAKVGGYFNNLRAANQAFVMERRDHAGGDGQTLNLRVIGGRYHYTAVGQLAQHEDTSTVQLSGNLFSGHWGDDGEWMLGIVGGYSDNQGDSRSNMTGTRADNQNHGYAVGLTSSWYQHGNQKQGAWLDSWLQYAWFNNDVSEQDDGVDHYHSSGIIASLEAGYQWLPGHGVVIEPQTQVIYQGVQQDDFTAANHARVSQSQGDDIQTRLGLHSEWRTAVGVTPTLDLNYYHDPHATEIEEDGSTISDDAVKQRGEIKVGITGNISQRVSLRGSVAWQKGSDDFAQTAGFLSMTVKW

SEQ ID NO: 5399 - DNA, 2286 bp, Escherichia coli
atgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaaccattatcaaggctgccgcagacctgatctcccgtgatgcgccggattatcagtatctcgccgcacgtctggcgatcttccacctgcgtaaaaaagcctacggtcagtttgagccgcctgcgctgtacgaccatgtggtgaaaatggtcgagatgggcaaatacgataatcatctgctggaagactacacggaagaagagttcaagcagatggacacgtttatcgatcacgaccgtgatatgaccttctcttatgctgccgttaagcagctggaaggcaaatatctggtacagaaccgcgtgaccggcgaaatctacgaaagcgcccagttcctttatattctggttgccgcgtgcctgttctcgaactacccgcgtgaaacgcgcctgcaatacgtgaagcgtttttacgacgcggtttccacatttaaaatttcgctgccgacgccaatcatgtccggcgtgcgtaccccgactcgtcagttcagctcctgcgtgctgatcgagtgcggcgacagcctggattccattaacgccacctccagcgcgattgttaaatacgtttcccagcgtgccgggatcggcatcaacgccgggcgtattcgtgcgctgggtagcccgattcgcggtggcgaagcgttccataccggttgtattccgttctacaaacatttccagaccgcggtgaaatcctgctctcagggcggtgtgcgcggcggtgcggcaacgctgttctacccgatgtggcatctggaagtggaaagcctgctggtgttgaaaaacaaccgtggggttgaaggcaaccgcgtgcgtcatatggactacggggttcaaatcaacaaactgatgtatacccgcctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcatctaccggtcgtatctatattcagaacgttgaccactgcaatacccatagcccgtttgatccggccatcgcgccagtgcgccagtctaacctgtgcctggaaatcgccctgccgaccaaaccgctgaacgacgtcaacgacgagaacggtgaaatcgcgctgtgtacgctgtctgctttcaacctgggcgcaattaacagcctggatgaactggaagagctggcaattctggcagtacgcgcactcgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcgtctaatgaactggcgaaagagcaaggcgcgtgcccgtggtttaacgaaaccacttacgcgaaagggatcctgccgatcgatacctataagaaagatctggatgccatcgctaatgagccgctgcattacgactgggaagcactgcgtgagtcaatcaaaacgcacggcctgcgtaactccacgctttctgccctgatgccgtccgagacttcttcgcagatctctaacgccactaacggtattgaaccgccgcgcggctacgtcagcatcaaagcgtcgaaagacggtattctgcgccaggtggtgccggactacgagcatctgcacgacgcctatgagctgctgtgggaaatgccgggtaacgatggctacctgcaactggtgggtatcatgcagaaatttatcgatcagtcgatctctgctaacaccaactacgatccgtcacgtttcccgtcaggaaaagtgccgatgcagcagttgctgaaagacctgctcactgcctacaaattcggggtcaaaacgctgtattatcagaacacccgtgacggcgcagaagacgcgcaggacgatctggtgccgtcaatccaggacgatggctgcgaaagcggcgcatgtaagatctga

SEQ ID NO: 5400 - protein, 761 aa, Escherichia coli
MNQNLLVTKRDGSTERINLDKIHRVLDWAAEGLHNVSISQVELRSHIQFYDGIKTSDIHETIIKAAADLISRDAPDYQYLAARLAIFHLRKKAYGQFEPPALYDHVVKMVEMGKYDNHLLEDYTEEEFKQMDTFIDHDRDMTFSYAAVKQLEGKYLVQNRVTGEIYESAQFLYILVAACLFSNYPRETRLQYVKRFYDAVSTFKISLPTPIMSGVRTPTRQFSSCVLIECGDSLDSINATSSAIVKYVSQRAGIGINAGRIRALGSPIRGGEAFHTGCIPFYKHFQTAVKSCSQGGVRGGAATLFYPMWHLEVESLLVLKNNRGVEGNRVRHMDYGVQINKLMYTRLLKGEDITLFSPSDVPGLYDAFFADQEEFERLYTKYEKDDSIRKQRVKAVELFSLMMQERASTGRIYIQNVDHCNTHSPFDPAIAPVRQSNLCLEIALPTKPLNDVNDENGEIALCTLSAFNLGAINSLDELEELAILAVRALDALLDYQDYPIPAAKRGAMGRRTLGIGVINFAYYLAKHGKRYSDGSANNLTHKTFEAIQYYLLKASNELAKEQGACPWFNETTYAKGILPIDTYKKDLDAIANEPLHYDWEALRESIKTHGLRNSTLSALMPSETSSQISNATNGIEPPRGYVSIKASKDGILRQVVPDYEHLHDAYELLWEMPGNDGYLQLVGIMQKFIDQSISANTNYDPSRFPSGKVPMQQLLKDLLTAYKFGVKTLYYQNTRDGAEDAQDDLVPSIQDDGCESGACKI

SEQ ID NO: 5401 - DNA, 1275 bp, Escherichia coli
ttgagatacaggatgcggcgtgaacgccttatccggcctacggctcggttttgtaggcctgataagatgcgccagcgtcgcatcaggcacaggatgcggcgtaaaatgccttatccggcattaaactcccaacaggacacattcatggcatataccaccttttcacagacgaaaaatgatcagctcaaagaaccaatgttctttggtcagccggtcaacgtggctcgctacgatcagcaaaaatatgacatcttcgaaaagctgatcgaaaagcagctctctttcttctggcgtccggaagaagttgacgtctcccgcgaccgtatcgattaccaggcactacctgaacacgaaaaacacatctttatcagcaatctgaaatatcagacgctgctggattccattcagggtcgcagtccgaacgtggcactgctgccgctgatctcgatcccggaactggaaacctgggtagaaacctgggcgttctcagaaacgattcattcccgctcctatacccatatcatccgtaatatcgttaacgatccgtctgttgtctttgacgatatcgttaccaacgagcagatccagaaacgtgcggaggggatctccagctattacgatgaactgatcgaaatgaccagctactggcatctgctgggcgaaggcacccacaccgttaacggtaaaaccgtaaccgttagcctgcgcgagctgaagaaaaaactgtatctctgcctgatgagcgttaacgcgctggaagcgatccgcttctacgtcagctttgcctgctctttcgcattcgctgaacgtgagctgatggaaggtaacgccaaaattattcgcctgattgcccgcgacgaagccctgcacctgaccggcacccagcatatgctgaatctgctgcgcagcggcgcggatgatccggagatggcggaaattgccgaagaatgtaagcaggagtgctatgacctgtttgtccaggcggcacagcaagagaaagactgggcggattatctgttccgtgatggttcgatgattggtctgaataaagacatcctctgccagtacgttgaatacatcaccaatatccgtatgcaggcagtcggtttggatctgccgttccagacgcgctccaacccgatcccgtggatcaacacctggctggtgtctgataacgtgcaggttgctccgcaggaagtggaagtcagttcttatctggtcgggcagattgacgcggaagtggacaccgacgatttgagtaacttccagctctga

SEQ ID NO: 5402 - protein, 424 aa, Escherichia coli
MRYRMRRERLIRPTARFCRPDKMRQRRIRHRMRRKMPYPALNSQQDTFMAYTTFSQTKNDQLKEPMFFGQPVNVARYDQQKYDIFEKLIEKQLSFFWRPEEVDVSRDRIDYQALPEHEKHIFISNLKYQTLLDSIQGRSPNVALLPLISIPELETWVETWAFSETIHSRSYTHIIRNIVNDPSVVFDDIVTNEQIQKRAEGISSYYDELIEMTSYWHLLGEGTHTVNGKTVTVSLRELKKKLYLCLMSVNALEAIRFYVSFACSFAFAERELMEGNAKIIRLIARDEALHLTGTQHMLNLLRSGADDPEMAEIAEECKQECYDLFVQAAQQEKDWADYLFRDGSMIGLNKDILCQYVEYITNIRMQAVGLDLPFQTRSNPIPWINTWLVSDNVQVAPQEVEVSSYLVGQIDAEVDTDDLSNFQL

SEQ ID NO: 5403 - DNA, 255 bp, Escherichia coli
atggcccgcgttaccctgcgcattactggcacacaactgctgtgccaggatgaacacccttcgcttctggcagcgctggaatcccacaatgtggcggttgagtaccagtgccgcgaaggttactgcggctcctgtcgcacccgactggtcgcaggccaggtggactggattgccgaaccgttagcttttattcagccgggggaaattttgccctgttgttgccgggcaaaaggcgatattgaaatcgagatgtga

SEQ ID NO: 5404 - protein, 84 aa, Escherichia coli
MARVTLRITGTQLLCQDEHPSLLAALESHNVAVEYQCREGYCGSCRTRLVAGQVDWIAEPLAFIQPGEILPCCCRAKGDIEIEM

SEQ ID NO: 5405 - DNA, 651 bp, Escherichia coli
atggcagtttcagcaaaacacgacgaatttaatcactggtgggcaacagagggcgactgggttgaagagcctaactatcgccgtaatggtatgagcggggtgcaatgcgtcgagcgcaacggcaaaaagctgtatgtaaagcgcatgacgcatcatctgtttcattccgtacgttatccgttcggccgaccaacgattgtccgtgaggttgcggtaattaaagaactggaacgggccggtgtcatcgtgccgaagatcgtttttggtgaagcggtgaaagttgagggtgaatggcgcgcgttgctggtgactgaagatatggcggggttcatcagcattgctgactggtatgcccggcatgcagtatcgccttattctgacgaagtacggcaagccatgttgaaagcagtggcgctggcgtttaagaaaatgcatagcgttaatcgtcagcatggctgttgttatgttcgccatatctatgtgaaaacagaaggtaaggcagaagctggttttcttgatctggagaaaagtcgtcgccgcttgcgtcgtgataaagcgattaatcatgacttccgccagctggaaaaatatctggagccgatccccaaagcggactgggagcaggtgaaagcatattactacgctatgtaa

SEQ ID NO: 5406 - protein, 216 aa, Escherichia coli
MAVSAKHDEFNHWWATEGDWVEEPNYRRNGMSGVQCVERNGKKLYVKRMTHHLFHSVRYPFGRPTIVREVAVIKELERAGVIVPKIVFGEAVKVEGEWRALLVTEDMAGFISIADWYARHAVSPYSDEVRQAMLKAVALAFKKMHSVNRQHGCCYVRHIYVKTEGKAEAGFLDLEKSRRRLRRDKAINHDFRQLEKYLEPIPKADWEQVKAYYYAM

SEQ ID NO: 5407 - DNA, 1077 bp, Escherichia coli
atgaaattgacgctgaaaaaccttagcatggcgatcatgatgagcactatagtcatgggaagtagtgcaatggcggcggacagcaacgaaaaaatagtcatcgcccatcgcggtgccagtggatatttgccggagcatacgctgccagcaaaagcgatggcgtatgcgcagggagcggattatctggaacaggatttggtgatgaccaaagacgaccatctggttgttctgcatgaccattatctcgatcgtgttactgatgttgccgatcgtttcccggatcgggcgcgcaaagacggtcgttactacgcgatagatttcacgctggatgaaattaagtcgctgaaatttaccgaaggtttcgatattgaaaacggtaaaaaagtgcagacttatccggggcgtttcccaatgggtaaatctgacttccgggtgcacacctttgaagaagagattgaatttgttcaggggttaaaccactctaccgggaaaaatatcggtatctatccagaaattaaagcgccgtggttccatcatcaggaagggaaggatattgcggcaaaaacgctggaagtgctgaagaaatatggttacaccggtaaggacgacaaagtttatttgcaatgttttgatgctgatgagctgaagcgtattaagaatgagctggaacctaaaatgggcatggatctcaatctggtacagctgattgcctataccgactggaatgaaacgcagcagaaacagccggacggaagctgggttaattacaattacgactggatgtttaagccgggtgccatgaaacaggtggcggaatatgctgatggtattggtccggattaccatatgttgattgaggagacatcgcagccgggtaatatcaaactcactggcatggtgcaagatgctcagcagaataaactggtagtgcatccttataccgtgcggtcagataaactgcctgaatacactactgatgtgaatcagttatatgatgctctgtataacaaagcgggtgtaaatgggctatttactgatttccctgataaggcagtaaaattccttaataaagagtaa

SEQ ID NO: 5408 - protein, 358 aa, Escherichia coli
MKLTLKNLSMAIMMSTIVMGSSAMAADSNEKIVIAHRGASGYLPEHTLPAKAMAYAQGADYLEQDLVMTKDDHLVVLHDHYLDRVTDVADRFPDRARKDGRYYAIDFTLDEIKSLKFTEGFDIENGKKVQTYPGRFPMGKSDFRVHTFEEEIEFVQGLNHSTGKNIGIYPEIKAPWFHHQEGKDIAAKTLEVLKKYGYTGKDDKVYLQCFDADELKRIKNELEPKMGMDLNLVQLIAYTDWNETQQKQPDGSWVNYNYDWMFKPGAMKQVAEYADGIGPDYHMLIEETSQPGNIKLTGMVQDAQQNKLVVHPYTVRSDKLPEYTTDVNQLYDALYNKAGVNGLFTDFPDKAVKFLNKE

SEQ ID NO: 5409 - DNA, 1359 bp, Escherichia coli
atgttgagtatttttaaaccagcgccacacaaagcgcgcttacctaccgcggagatcgatccgacttatcgtcgattgcgctggcaaattttcctggggatattctttggctatgctgcttactatttggttcgtaagaactttgcgctcgctatgccttatctggttgagcagggattctcacgcggtgatttaggttttgccctttcggggatctcgattgcttatggattttcgaaattcatcatgggttcggtatcggatcgctcgaatccgcgcgttttcctgcccgcaggtttgattctggcggcggcagtgatgttgtttatgggctttgtgccatgggcgacgtcgagcattgcggtgatgtttgtactgttgttcctctgcggttggttccaggggatggggtggccgccgtgtggtcgtactatggtgcactggtggtcgcagaaagaacgtggcggcattgtgtcagtgtggaactgtgcgcacaacgtcggtggtggtattccgccgctgctgttcctgctggggatggcctggttcaatgactggcacgcggcgctctatatgcccgctttctgcgccattctggtggcactgttcgcctttgcgatgatgcgcgataccccgcaatcctgtggcctgccgccgatcgaagagtacaaaaatgattatccggacgactataacgaaaaagcggaacaggagctgaccgcgaagcagatcttcatgcagtacgtgctgccgaacaaactgctgtggtatatcgccatcgccaacgtgttcgtttatctgctgcgttacggcatcctcgactggtcaccgacttatctgaaagaggttaagcatttcgcgctggataaatcctcctgggcctacttcctttatgaatatgcaggtattccgggcaccctgctgtgcggctggatgtcggataaagtctttcgtggtaaccgtggggcaaccggcgtcttctttatgacactggtgaccatcgcgactatcgtttactggatgaacccggcaggtaacccaaccgtcgatatgatttgtatgattgttatcggcttcctgatctatggccctgtgatgctgatcggtctacatgcgctggaactggcaccgaaaaaagcggcaggtacggcagcgggttttaccgggctgtttggttacctcggcggttcggtggcggcgagcgcgattgttggctacaccgtggacttcttcggctgggatggcggctttatggtaatgattggcggcagcattctggcggttatcttgttgattgttgtgatgattggcgaaaaacgtcgccatgaacaattactgcaaaaacgcaacggaggctaa

SEQ ID NO: 5410 - protein, 452 aa, Escherichia coli
MLSIFKPAPHKARLPTAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQKRNGG

SEQ ID NO: 5411 - DNA, 1629 bp, Escherichia coli
atgaaaactcgcgactcgcaatcaagtgacgtgattatcattggcggtggcgcaacgggagccgggattgcccgcgactgtgccctgcgcgggctgcgcgtgattttggttgagcgccacgacatcgcaaccggtgccaccgggcgtaaccacggcctgctgcacagcggtgcgcgctatgcggtaaccgatgcggaatcggcccgcgaatgtattagtgaaaaccagattctgaaacgcattgcacgtcactgcgtagaaccaaccaacggcctgtttatcaccctgccggaagatgacctctccttccaggccacttttatccgcgcctgcgaagaagcagggatcaacgcagaagccattgagccgcagcaagcgcgcattatcgaacctgccgttaacccggcactgattggcgcggtgaaagttccggatggcaccgttgatccatttcgtctgacagcagcaaacatgctggatgccaaagaacacggtgccgttatccttaccgctcatgaagtcacggggctgattcgtgaaggcgcgacggtgtgcggtgttcgtgtacgtaaccatctcaccggcgaaattcaggcacttcatgcgcctgtcgtagttaatgccgccgggatctgggggcaacacattgccgaatatgccgatctgcgcattcgcatgttcccggcgaaaggatcgctgctgatcatggatcaccgcattaatcagcatgtgatcaaccgctgccgcaaaccttccgacgccgatattctggtgcctggcgataccatttcgctgattggcaccacctctttacgtattgattacaacgagattgacgataatcgagtgacggcagaagaagttgatattctgctgcgtgaaggggaaaaactggcccccgtgatggcgaaaacgcgcattttgcgggcctactctggcgtacgcccgctggttgccagcgatgacgatccgagcgggcgtaacgtcagccgtggcatcgtgctgctcgaccatgctgaacgcgatggtctggacgggtttatcaccatcaccggtggcaaactgatgacctatcggctgatggcggaatgggctaccgacgccgtatgccgcaaactgggaaacacgcgcccctgtacgaccgccgatctggcacttcctggttcacaggaacccgctgaagttaccttgcgtaacgtcatctccctgcctgccccgctgcgcggttctgcggtttatcgtcatggcgatcgcacgcctgcctggctgagcgaaggccgtctgcaccgtagcctggtatgtgagtgcgaagcggtaactgcgggtgaagtgcagtacgcggtagaaaatttaaacgttaatagcctgctggatttacgccgtcgtacccgtgtggggatgggcacctgccagggcgagctctgcgcctgccgcgctgccggactgctgcaacgttttaacgtcacgacgtccgcgcaatctatcgagcaactttccaccttcctaaacgaacgctggaaaggcgtgcaacccatcgcctggggagatgcactgcgcgaaagcgaatttacccgctgggtttatcagggattgtgtggtctggagaaggagcagaaagatgcgctttga

SEQ ID NO: 5412 - protein, 542 aa, Escherichia coli
MKTRDSQSSDVIIIGGGATGAGIARDCALRGLRVILVERHDIATGATGRNHGLLHSGARYAVTDAESARECISENQILKRIARHCVEPTNGLFITLPEDDLSFQATFIRACEEAGINAEAIEPQQARIIEPAVNPALIGAVKVPDGTVDPFRLTAANMLDAKEHGAVILTAHEVTGLIREGATVCGVRVRNHLTGEIQALHAPVVVNAAGIWGQHIAEYADLRIRMFPAKGSLLIMDHRINQHVINRCRKPSDADILVPGDTISLIGTTSLRIDYNEIDDNRVTAEEVDILLREGEKLAPVMAKTRILRAYSGVRPLVASDDDPSGRNVSRGIVLLDHAERDGLDGFITITGGKLMTYRLMAEWATDAVCRKLGNTRPCTTADLALPGSQEPAEVTLRNVISLPAPLRGSAVYRHGDRTPAWLSEGRLHRSLVCECEAVTAGEVQYAVENLNVNSLLDLRRRTRVGMGTCQGELCACRAAGLLQRFNVTTSAQSIEQLSTFLNERWKGVQPIAWGDALRESEFTRWVYQGLCGLEKEQKDAL

SEQ ID NO: 5413 - DNA, 1260 bp, Escherichia coli
atgcgctttgatactgtcattatgggcggcggcctcgccggattactctgtggcctgcaactgcaaaaacacggcctgcgctgtgccattgtcactcgtggtcaaagcgcgctgcatttctcatctggatcgctggatttgctgagccatctgccggatggtcaaccggtgacagacattcacagtggactggaatctttgcgtcagcaggcacctgcccatccttacactcttctcgggccacaacgcgtgctcgatctcgcttgccaggcgcaggcattaatcgctgaaagcggtgcgcaattgcagggcagcgtagagctggctcaccagcggattacaccgctaggcactctgcgctcaacctggctaagttcgccagaagtccctgtctggccgctgcccgcgaagaaaatatgcgtggtgggaattagcggcctgatggattttcaggcgcatcttgcggcggcttcgttgcgcgaactcgaccttgccgttgaaaccgcagaaatagaactgccggaactggatgtcctgcgcaataacgccaccgagtttcgcgcggtgaatatcgcccgtttccttgataacgaagaaaactggccgctgataattgatgcgctaatccctgtcgccaatacctgtgaaatgatcctgatgcccgcctgtttcggcctggccgatgacaaactgtggcgttggctgaatgaaaaactaccttgttcactgatgcttctgccaacactaccaccttcagtgctggggatacgtctgcaaaaccagttgcagcgtcagtttgtgcgtcagggcggtgtgtggatgccaggcgatgaagtgaaaaaagtgacctgtaaaaatggcgtggtgaatgaaatctggacgcgcaatcacgccgatatcccgctgcgcccacgatttgcggtgcttgcgagcggcagtttctttagcggcggactggtggcagaacgtgacggcattcgcgagccgattctcggccttgatgtgctacaaaccgctacgcggggtgaatggtataagggcgatttttttgcgccgcagccgtggcagcagttcggtgtaaccactgatgaggcgctacgcccgtcgcaggcggggcaaaccattgagaacctgtttgccatcggttcggtgctgggcggatttgatcccatcgcccagggatgcggcggcggtgtttgtgccgtcagtgctttacatgccgctcaacagattgcccaacgcgcaggaggccaacaatga

SEQ ID NO: 5414 - protein, 419 aa, Escherichia coli
MRFDTVIMGGGLAGLLCGLQLQKHGLRCAIVTRGQSALHFSSGSLDLLSHLPDGQPVTDIHSGLESLRQQAPAHPYTLLGPQRVLDLACQAQALIAESGAQLQGSVELAHQRITPLGTLRSTWLSSPEVPVWPLPAKKICVVGISGLMDFQAHLAAASLRELDLAVETAEIELPELDVLRNNATEFRAVNIARFLDNEENWPLIIDALIPVANTCEMILMPACFGLADDKLWRWLNEKLPCSLMLLPTLPPSVLGIRLQNQLQRQFVRQGGVWMPGDEVKKVTCKNGVVNEIWTRNHADIPLRPRFAVLASGSFFSGGLVAERDGIREPILGLDVLQTATRGEWYKGDFFAPQPWQQFGVTTDEALRPSQAGQTIENLFAIGSVLGGFDPIAQGCGGGVCAVSALHAAQQIAQRAGGQQ

SEQ ID NO: 5415 - DNA, 1191 bp, Escherichia coli
atgaatgacaccagcttcgaaaactgcattaagtgcaccgtctgcaccaccgcctgcccggtgagccgggtgaatccgggttatccggggccaaaacaagccgggccggatggcgagcgtctgcgtttaaaagatggcgcactgtatgacgaggcgctgaaatattgcatcaactgcaaacgttgtgaagtcgcctgcccgtccgatgtgaagattggcgatattatccagcgcgcgcgggcgaaatatgacaccacacgcccgtcgctgcgtaattttgtgttgagtcataccgacctgatgggtagcgtttccacgccgttcgcacccatcgtcaacaccgctacctcgctgaaaccggtgcggcagttgcttgatgcggcgttaaaaatagaccaccgtcgcacgctaccgaaatactccttcggtacgttccgtcgctggtatcgcagcgtggcggctcagcaagcgcagtataaagaccaggtcgctttctttcacggctgcttcgttaactacaaccatccgcagctaggcaaagatttaattaaagtgctcaacgcgatgggtaccggcgtacaactgctcagcaaagaaaaatgctgcggcgtaccgctgatcgccaacggttttaccgataaagcacgcaaacaggcaattacgaatgtagagtcgatccgcgaagctgtgggagtaaaaggcattccggtgattgccacctcctcaacgtgtacatttgccctgcgcgacgaatacccggaagtgctgaatgtcgacaacaaaggcttacgcgatcacatcgaactggcgacccgctggctgtggcgcaagctggacgaaggcaaaacgttaccgctgaaaccgctgccgctaaaagtggtttatcacactccgtgccatatggaaaaaatgggctggacgctctacaccctggagctgttgcgtaaaatcccggggcttgagttaacggtgctggattcccagtgctgcggtattgcgggaacttacggtttcaaaaaagagaactaccccacctcacaagccatcggcgcaccactgttccgccagatagaagaaagcggcgcagatctggtggtcaccgactgcgaaacctgtaaatggcagattgagatgtcgacaagccttcgctgcgaacatccgattacgctgctggcccaggcgctggcttaa

SEQ ID NO: 5416 - protein, 396 aa, Escherichia coli
MNDTSFENCIKCTVCTTACPVSRVNPGYPGPKQAGPDGERLRLKDGALYDEALKYCINCKRCEVACPSDVKIGDIIQRARAKYDTTRPSLRNFVLSHTDLMGSVSTPFAPIVNTATSLKPVRQLLDAALKIDHRRTLPKYSFGTFRRWYRSVAAQQAQYKDQVAFFHGCFVNYNHPQLGKDLIKVLNAMGTGVQLLSKEKCCGVPLIANGFTDKARKQAITNVESIREAVGVKGIPVIATSSTCTFALRDEYPEVLNVDNKGLRDHIELATRWLWRKLDEGKTLPLKPLPLKVVYHTPCHMEKMGWTLYTLELLRKIPGLELTVLDSQCCGIAGTYGFKKENYPTSQAIGAPLFRQIEESGADLVVTDCETCKWQIEMSTSLRCEHPITLLAQALA

SEQ ID NO: 5417 - DNA, 126 bp, Escherichia coli
atgtggttaccgggcatttttgcgtacacgattccgcgctcaatgtatacgttgcaacgcagtgaaaattcctctgaaaacgtctcgcaaaggctgaaactggcagatgtcaaaggcctgggataa

SEQ ID NO: 5418 - protein, 41 aa, Escherichia coli
MWLPGIFAYTIPRSMYTLQRSENSSENVSQRLKLADVKGLG

SEQ ID NO: 5419 - DNA, 960 bp, Escherichia coli
atgaccgaatcaacaacctcctccccgcatgatgcggtatttaaaacctttatgttcacacccgaaaccgcacgggattttctcgaaatacatttaccagaaccactgcgcaagctttgcaacctgcaaaccttacgcctggaacccaccagttttattgaaaaaagtttacgcgcttactactcggatgttttgtggtcggtggaaaccagcgacggtgacggctatatctactgcgtgattgaacatcaaagttctgcagaaaagaatatggcttttcgactaatgcgctatgccaccgccgccatgcagcgccatctggacaaaggctatgacagagtcccgctggtggtgccgttgctgttttatcatggcgaaacctcgccctacccatactcacttaactggctggatgagtttgatgatccgcaacttgcccggcagttgtacaccgaagcttttccgttggtggatatcaccatcgtacctgacgatgagatcatgcaacatcggcgtatagctctgctggaactgattcaaaagcatattcgcgaccgcgatttaatcggtatggtcgacaggatcaccacgcttttggttagaggcttcactaatgacagtcagctacaaacactgtttaattatctgctgcaatgcggcgatacctcccgtttcacccgttttattcaggagattgccgaacgttcaccactacaaaaggagagattaatgactattgctgaacggctgcggcaggaagggcatcaaattggctggcaggaaggtaaaattgaaggttggcaggaggggaaattggagggtttgcagaaaggcaaagtagaaggtatgcatgaacaagccattaaaattgccttgcgcatgctggaacagggctttgaacgtgagattgtgctggcgacaacccaactctctgatgctgatattccgaactgttattaa

SEQ ID NO: 5420 - protein, 319 aa, Escherichia coli
MTESTTSSPHDAVFKTFMFTPETARDFLEIHLPEPLRKLCNLQTLRLEPTSFIEKSLRAYYSDVLWSVETSDGDGYIYCVIEHQSSAEKNMAFRLMRYATAAMQRHLDKGYDRVPLVVPLLFYHGETSPYPYSLNWLDEFDDPQLARQLYTEAFPLVDITIVPDDEIMQHRRIALLELIQKHIRDRDLIGMVDRITTLLVRGFTNDSQLQTLFNYLLQCGDTSRFTRFIQEIAERSPLQKERLMTIAERLRQEGHQIGWQEGKIEGWQEGKLEGLQKGKVEGMHEQAIKIALRMLEQGFEREIVLATTQLSDADIPNCY

SEQ ID NO: 5421 - DNA, 186 bp, Escherichia coli
atgactattgctgaacggttacggcaggaaggacatcaaattggctggcaggagggtaaattagaaggcatgcatgaacaagccattaaaattgccttgcgcatgctggaacagggcattgatcgtgaccaggtgctcgcggccactcagctaagcgaagccgatctggcagcgaataaccactaa

SEQ ID NO: 5422 - protein, 61 aa, Escherichia coli
MTIAERLRQEGHQIGWQEGKLEGMHEQAIKIALRMLEQGIDRDQVLAATQLSEADLAANNH

SEQ ID NO: 5423 - DNA, 804 bp, Escherichia coli
atgaacgcattattaaccaatccctttaaagaacgtttacgcaagggcgaagtgcaaattggtctgtggttaagctcaacgactgcctatatggcagaaattgccgccacttccggttatgactggttgctgattgacggggagcatgcgccaaacaccattcaggatctttatcaccagctacaggcggtagcgccctatgccagccaccccgtgatccgtccggtggaaggcagtaagccgctgattaaacaagtcctggatattggcgcgcaaactctactgatcccgatggtcgatactgccgatcaggcacgtcaggtggtgtctgccacgcgctatcctccctacggtgagcgtggtgttggggccagtgtggcacgggctgcacgctggggacgcattgagaattacatggcgcaagtcaacgattcgctttgtctgttggtgcaggtggaaagtaaaacggcactggataacctggacgaaatcctcgatgttgaagggattgatggcgtgtttattggacctgcggatctttctgcgtcgttgggctacccggataacgccgggcacccggaagtgcagcgaattattgaaaccagcattcggcggatccgtgctgcgggtaaagctgctggttttctggctgtggctcctgatatggcgcagcaatgcctggcgtggggagcgaactttgtcgctgttggcgttgacacgatgctctacagcgatgccctggatcaacgactggcgatgtttaaatcaggcaaaaatgggccacgcgtaaaaggtagttattga

SEQ ID NO: 5424 - protein, 267 aa, Escherichia coli
MNALLTNPFKERLRKGEVQIGLWLSSTTAYMAEIAATSGYDWLLIDGEHAPNTIQDLYHQLQAVAPYASHPVIRPVEGSKPLIKQVLDIGAQTLLIPMVDTADQARQVVSATRYPPYGERGVGASVARAARWGRIENYMAQVNDSLCLLVQVESKTALDNLDEILDVEGIDGVFIGPADLSASLGYPDNAGHPEVQRIIETSIRRIRAAGKAAGFLAVAPDMAQQCLAWGANFVAVGVDTMLYSDALDQRLAMFKSGKNGPRVKGSY

SEQ ID NO: 5425 - DNA, 1290 bp, Escherichia coli
atgagcaccgctttgcttgacgccgtggtgaagaaaaaccgcgcgcgtttaattccgtttatgttggcgctgtatgtgctggcgtttctcgaccgttcgaatattggttttgccaaacagacctaccagattgataccgggctgagtaatgaagcttatgcgctgggagcaggcattttctttgtggtatacgcgtttctgggggttccggcgaatcttttgatgcgcaaactgggggccagaacctggattggtacgacaacactgctgtggggatttctttcggctgccatggcatgggccgatactgaagcgaaatttctgatcgttcgcactctgcttggtgctgcggaggccgggtttttccctggtatgatttatctcacttcgcaatggtttccgcagcgtaatcgcgccagcattatggggctgttctatatgggcgcaccgctggcgttaacactgggatcaccgctttccggcgcgctgctggagatgcatggatttatggggcatcccggctggttctggatgtttgtgattgaaggattgctggcagtcggcgctggggtattcacattcttttggcttgatgacacaccggagcaggcacgttttctgagtaaacaagaaaaaacgttacttatcaatcaactggcaagtgaagaacaacagaaagtgacttcgcgactgagcgatgcgttgcgtaatggccgagtctggcaactggcgattatctacctgaccattcaggtagcggtttacggattaattttcttcctgccgacccaggttgcggcattgctgggaacaaaagtgggctttacggcgtcggtggtcaccgccattccgtgggttgcggccttgtttgggacctggcttattccgcgctactccgataaaaccggcgaacggcgtaatgtcgcagcgctgacattactggcggcgggcattggtattggtctgtccgggctgctttctccagtactggcgatcgtagcactgtgtgttgcagccatcgggtttattgccgtgcaaccggtgttctggacgatgccgacacagcttctttccggtacggcgctggctgcggggattggttttataaacctgtttggtgcagtgggcgggtttattgccccgatcctgcgcgtgaaagcagaaacgttattttccagcgatgcggcgggattactgacgctggcagcggtggcggtcatcggttcgctgattattttcactctgcgtgtaaatcgcactgttgcgcagaccgacgtggcacatcattaa

SEQ ID NO: 5426 - protein, 429 aa, Escherichia coli
MSTALLDAVVKKNRARLIPFMLALYVLAFLDRSNIGFAKQTYQIDTGLSNEAYALGAGIFFVVYAFLGVPANLLMRKLGARTWIGTTTLLWGFLSAAMAWADTEAKFLIVRTLLGAAEAGFFPGMIYLTSQWFPQRNRASIMGLFYMGAPLALTLGSPLSGALLEMHGFMGHPGWFWMFVIEGLLAVGAGVFTFFWLDDTPEQARFLSKQEKTLLINQLASEEQQKVTSRLSDALRNGRVWQLAIIYLTIQVAVYGLIFFLPTQVAALLGTKVGFTASVVTAIPWVAALFGTWLIPRYSDKTGERRNVAALTLLAAGIGIGLSGLLSPVLAIVALCVAAIGFIAVQPVFWTMPTQLLSGTALAAGIGFINLFGAVGGFIAPILRVKAETLFSSDAAGLLTLAAVAVIGSLIIFTLRVNRTVAQTDVAHH

SEQ ID NO: 5427 - DNA, 1206 bp, Escherichia coli
atgaccctaccaaaaattaaacaggttcgcgcctggtttactggcggtgcgatagcagaaaaaggcgctggcggcggtgattatcacgaccagggggcgaatcactggatagacgatcatattgccaccccgatgagtaaataccgcgattacgagcagtcacgccagtcatttggcattaacgttcttggcacgttggttgttgaagtcgaagcagaaaacggccagaccggattcgccgtttcgacagccggtgaaatgggctgttttattgtcgaaaaacaccttaaccgtttcattgagggtaaatgtgtcagtgatatcaaactgatccacgatcaaatgctcaatgccaccctgtattactccggctctggtggcctggtgatgaatacgatttcctgtgtcgatctggctctgtgggatctgttcggcaaagtggtcgggcttccggtttataaacttttaggcggcgcagttcgtgatgagattcagttctacgccacaggtgcgcgtccggatctggcaaaagagatgggctttatcggtggcaaaatgccgacgcactgggggccacatgatggcgatgcggggatccgcaaagatgccgctatggtcgcggatatgcgtgaaaaatgcggtgaggatttctggttaatgctcgactgctggatgagtcaggacgtgaactatgccaccaaactggcccacgcttgcgcgccctataacctgaaatggatcgaagagtgcctgccgccacagcagtatgaaggttatcgcgaactgaaacacaacgcaccagcggggatgatggtcaccagcggtgagcaccacggcacactgcaatctttccgtacgctttcagaaaccggtatcgacattatgcagccggatgttggctggtgcggtggcttaaccacgctggtggaaattgccgcaatcgccaaatccagggggcaactggtggtgccacacggttcgtctgtttactcccaccatgcggtgatcaccttcaccaatacgccattcagcgaattcctgatgaccagcccggattgttcaacgatgcgtccacaatttgatccgattctgcttaatgagccagtaccggtgaatggtcgtattcataaatcagtgcttgataaacccggtttcggcgtcgaactcaatcgtgactgcaatttgaaacgcccctacagccactaa

SEQ ID NO: 5428 - protein, 401 aa, Escherichia coli
MTLPKIKQVRAWFTGGAIAEKGAGGGDYHDQGANHWIDDHIATPMSKYRDYEQSRQSFGINVLGTLVVEVEAENGQTGFAVSTAGEMGCFIVEKHLNRFIEGKCVSDIKLIHDQMLNATLYYSGSGGLVMNTISCVDLALWDLFGKVVGLPVYKLLGGAVRDEIQFYATGARPDLAKEMGFIGGKMPTHWGPHDGDAGIRKDAAMVADMREKCGEDFWLMLDCWMSQDVNYATKLAHACAPYNLKWIEECLPPQQYEGYRELKHNAPAGMMVTSGEHHGTLQSFRTLSETGIDIMQPDVGWCGGLTTLVEIAAIAKSRGQLVVPHGSSVYSHHAVITFTNTPFSEFLMTSPDCSTMRPQFDPILLNEPVPVNGRIHKSVLDKPGFGVELNRDCNLKRPYSH

SEQ ID NO: 5429 - DNA, 783 bp, Escherichia coli
atgttggaatcaagcaaagttcccgccctgacacgggctattgatattctcaatttgattgcccggattggcccctgtagtgctgcgacgatcattgacacattggggatccctaaaagcacagcctatttgctgcttaatgaactcaggcgtcagcgttttcttagccttgatcaccaggaaaatttttgtttgtggaccaggctggtggagctttccggtcatgcgttaagcaagatggatctccgggaactggctcgaccgcgtttgacgcaactgatggataccaccgggctgttatgtcacctggggattattgataacggcagcgcttattacattttgaaagtggagtcatcagccactatcagcgtgcgttcccatgaaggaaaaagcctttcgctttatcgctccggaattggtaaatgcctgcttgcctggcaacctgcagctgtacagaaaagtattatcgaagagctggtctgggagcagatgacacccaccaccattacccatccacaacggctctacgaggaactggcgcgtattcgccgccagggctggagctatgacaacggcgaagattacgccgatgtccgttgtgtcgctgcgccggtgtttaacgccaataacgagcttaccgctgcgatctcggtggtcggtacccgcttacaaatcaatgaagaataccgtgattatctggcgggcaaagccattgcctgcgccagggatatttcacgtctgttgggatggaaaagtccctttgacttacaggcctcataa

SEQ ID NO: 5430 - protein, 260 aa, Escherichia coli
MLESSKVPALTRAIDILNLIARIGPCSAATIIDTLGIPKSTAYLLLNELRRQRFLSLDHQENFCLWTRLVELSGHALSKMDLRELARPRLTQLMDTTGLLCHLGIIDNGSAYYILKVESSATISVRSHEGKSLSLYRSGIGKCLLAWQPAAVQKSIIEELVWEQMTPTTITHPQRLYEELARIRRQGWSYDNGEDYADVRCVAAPVFNANNELTAAISVVGTRLQINEEYRDYLAGKAIACARDISRLLGWKSPFDLQAS

SEQ ID NO: 5431 - DNA, 1203 bp, Escherichia coli
atgttaaaagtggaaatgttatccaccggggatgaagtgttacacgggcaaatcgttgacactaacgctgcctggctggccgattttttctttcatcaggggctgccattatctcgccgcaatacggtgggggataaccttgatgacttagtcaccattcttcgcgaacgtagtcagcacgccgatgtgttgatcgttaacggcgggctgggaccgaccagtgatgatttaagcgcactcgccgctgcgacagcaaaaggtgaaggcctggtgctgcatgaagcctggctcaaagagatggaacgctatttccatgaacggggacgagtaatggcaccgagcaaccgtaaacaagcggagctgcctgccagtgctgaatttatcaataacccggtaggcactgcctgtggttttgccatacagcttaatcgttgcctgatgttctttacccccggcgtaccgtcagaatttaaggtgatggtcgagcacgaaatcctgccgcgcctgcgcgagcgtttttctttaccacagccgccggtttgcctgcgtttgactacctttggtcgttcggaaagcgatctggcacaaagcctggacactctacaactgccgccgggcgtaacaatgggctatcgctcctcaatgccgattatcgaactgaaactcaccggaccggcaagcgaggaacaggcgatggaaaaactgtggctggacgttaaacgtgttgccggacagagcgtgattttcgaaggcaccgaaggactgcccgcgcagatcagtcgcgaattgcagagccgccagttcagcctgacgctgagcgagcaattcaccggtggtttattggctttgcaactttctcgcgcagatgctccattgctggcgtgtgaagtggttccttcacaggaggaaaccctggcgcaaacggcgcactggattacagaacggcgggcgaaccattttgctgggttggcactggctgtttctggtctggaagatgagcatctcaactttgcactagccacgccagacggcactttcgctttgcgtgtacatttcagtgccacacgctacagtctggctattcgccaggaagtctgcgcaatgatggcgcttaatatgctacgccgttggttaaacggccaggacatcgccagcgagcatggctggattgaggttgttgagtccatgaccttatctgtctga

SEQ ID NO: 5432 - protein, 400 aa, Escherichia coli
MLKVEMLSTGDEVLHGQIVDTNAAWLADFFFHQGLPLSRRNTVGDNLDDLVTILRERSQHADVLIVNGGLGPTSDDLSALAAATAKGEGLVLHEAWLKEMERYFHERGRVMAPSNRKQAELPASAEFINNPVGTACGFAIQLNRCLMFFTPGVPSEFKVMVEHEILPRLRERFSLPQPPVCLRLTTFGRSESDLAQSLDTLQLPPGVTMGYRSSMPIIELKLTGPASEEQAMEKLWLDVKRVAGQSVIFEGTEGLPAQISRELQSRQFSLTLSEQFTGGLLALQLSRADAPLLACEVVPSQEETLAQTAHWITERRANHFAGLALAVSGLEDEHLNFALATPDGTFALRVHFSATRYSLAIRQEVCAMMALNMLRRWLNGQDIASEHGWIEVVESMTLSV

SEQ ID NO: 5433 - DNA, 543 bp, Escherichia coli
atgaaaaaaattgcgctagcaggtctggccggaatgctgttggtttctgcatcggtcaatgcaatgagcatcagcggccaggcgggtaaagaatacaccaatattggtgtcggttttgggactgaatcgacgggcctggcgttaagcggtaactggacacataacgacgacgacggtgatgccgcgggcgtggggctggggttgaatctgcctctcgggccattaatggcgaccgttggcggaaaaggcgtttacaccaacccgaacgatggtgatgaaggttatgcagcggcagttggcggtggtttgcagtggcaaattggtgacagcttccgcttgtttggtgagtattactactctccggattcgctctccagcggaattaaaagttatgaagaagcgaatgctggcgcgcgttacaccattatgcgtccagtcagcattgaggctggctaccgttacctgaacctggcaggtaaaaatggcaatcgtgataacgccattgctgatggtccgtatgttggggtaaatgccagcttctga

SEQ ID NO: 5434 - protein, 180 aa, Escherichia coli
MKKIALAGLAGMLLVSASVNAMSISGQAGKEYTNIGVGFGTESTGLALSGNWTHNDDDGDAAGVGLGLNLPLGPLMATVGGKGVYTNPNDGDEGYAAAVGGGLQWQIGDSFRLFGEYYYSPDSLSSGIKSYEEANAGARYTIMRPVSIEAGYRYLNLAGKNGNRDNAIADGPYVGVNASF

SEQ ID NO: 5435 - DNA, 426 bp, Escherichia coli
gtgcgacaacggaccattgtatgccctttgattcaaaatgatggtgcttatttgctgtgtaaaatggccgacgatcgcggcgttttccccggtcaatgggcgctttcgggtggcggcgtggagcctggcgaacgaattgaagaggcactacgccgcgaaattcgcgaagaactgggagaacagctgcttttgacagaaatcacgccgtggaccttcagcgatgatattcgcaccaagacgtatgcagatggtcgcaaggaagagatttatatgatttacctgatttttgactgcgtttctgccaacagagaagtgaaaataaacgaagagtttcaggactacgcgtgggtaaaacctgaagatctggtgcattatgatttgaatgttgccacccgaaaaacgttacgtttgaaaggtcttctttaa

SEQ ID NO: 5436 - protein, 141 aa, Escherichia coli
MRQRTIVCPLIQNDGAYLLCKMADDRGVFPGQWALSGGGVEPGERIEEALRREIREELGEQLLLTEITPWTFSDDIRTKTYADGRKEEIYMIYLIFDCVSANREVKINEEFQDYAWVKPEDLVHYDLNVATRKTLRLKGLL

SEQ ID NO: 5437 - DNA, 603 bp, Escherichia coli
gtgttagctttttgccgatcttcgttgaagtcaaaaaaatatttcatcattttactggcgctcgctgcaattgctggactgggtactcatgccgcctggagtagcaatggtttgccacgcatcgacaataaaacactggccagactggcacagcagcacccggttgtcgttttgtttcgccatgctgaacgttgcgatcgttcaaccaatcaatgcttgtcagataaaacaggtattacggtcaaaggtacccaggatgcccgagaactgggcaacgcttttagtgctgatatccctgattttgatctctattccagtaataccgtccggactattcagtcggcgacctggttttcggcgggtaaaaagctgacggtagataaacgatttcttcaatgcggtaatgagatttatagtgcaattaaagacttacaacgcaaagcacctgataaaaatatcgttatttttacccataatcattgcctgacatatattgctaaagataagcgtgatgcgacatttaaacctgattatctggatggtttagtcatgcatgtggaaaaaggcaaagtttatctggatggggaattcgttaaccactaa

SEQ ID NO: 5438 - protein, 200 aa, Escherichia coli
MLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRFLQCGNEIYSAIKDLQRKAPDKNIVIFTHNHCLTYIAKDKRDATFKPDYLDGLVMHVEKGKVYLDGEFVNH

SEQ ID NO: 5439 - DNA, 1173 bp, Escherichia coli
gtggacaggtattcaatgacggatggaaaaaaaatgtcaggatttttgcctttttcgcgaccagcaatgggcgtagaggaactcgctgcagttaaagaggttctcgaatccggttggatcacaaccggtccgaagaatcaggcgcttgaacaagctttttgccagttgacgggaaatcagcatgccatcgcggtcagttcagccaccgccggaatgcatatcacgctaatggcgttggaaattggcaagggcgatgaagtgattacgccttccctgacctgggtttcaaccctcaatatgatttccttgctgggtgcaacgccggtaatggtggatgtcgaccgcgatacgctgatggtcacgcctgaagcgatcgaagcagccattacaccacgcactaaagccatcattccggtgcattatgccggtgcgccagcagatattgacgccattcgcgccattggcgaacgttacggcatcgcagttatcgaagatgctgcccatgccgtcggtacgtattacaaagggcgacatattggcgcaaaaggtactgctattttttcgtttcacgccatcaaaaatattacctgtgcggaaggtggcctgattgttactgataatgaaaatcttgcccgccagctgcggatgctgaaatttcacggtctgggtgtcgatgcctatgacagacatacctggggccgtgcaccgcaggctgaagtcttaacgccgggctataagtacaatctgaccgatattaacgccgcgattgccctgacacagttagtcaaattagagcacctcaacacccgtcggcgcgaaattgcccagcaatatcagcaagcactggcagctctcccctttcagccattaagccttcccgcctggccgcacgttcatgcctggcatctgtttattattcgtgtcgatgaacaacgttgtggtatcagtcgcgatgcgttgatggaagcgttaaaagaaagaggcattggtaccgggttacatttccgcgccgctcacacacaaaaatattatcgcgagcgttttcccacgctgtcgttaccgaataccgaatggaatagcgaacgcatctgttcgttgccgctgttcccggatatgaccaccgccgatgccgaccgcgtcatcacagcccttcagcaactcgcaggacaatga

SEQ ID NO: 5440 - protein, 390 aa, Escherichia coli
MDRYSMTDGKKMSGFLPFSRPAMGVEELAAVKEVLESGWITTGPKNQALEQAFCQLTGNQHAIAVSSATAGMHITLMALEIGKGDEVITPSLTWVSTLNMISLLGATPVMVDVDRDTLMVTPEAIEAAITPRTKAIIPVHYAGAPADIDAIRAIGERYGIAVIEDAAHAVGTYYKGRHIGAKGTAIFSFHAIKNITCAEGGLIVTDNENLARQLRMLKFHGLGVDAYDRHTWGRAPQAEVLTPGYKYNLTDINAAIALTQLVKLEHLNTRRREIAQQYQQALAALPFQPLSLPAWPHVHAWHLFIIRVDEQRCGISRDALMEALKERGIGTGLHFRAAHTQKYYRERFPTLSLPNTEWNSERICSLPLFPDMTTADADRVITALQQLAGQ

SEQ ID NO: 5441 - DNA, 969 bp, Escherichia coli
atgtttgaaatccaccctgttaagaaagtctcggtggttattcccgtttataacgagcaggaaagcttaccggaattaatcaggcgcaccaccgcagcctgtgaatcactggggaaagagtatgaaatcctgctgattgatgacggcagtagcgataattccgcgcatatgctggtcgaagcctcacaagcggagggcagccatattgtgtctatcttgcttaaccgcaattacgggcaacattcagcgattatggcgggattcagtcacgtcaccggcgacttaattattaccctcgatgccgatctccagaatccgccagaggaaatcccccgtctggtggcaaaagccgatgaaggttacgacgtggtagggactgtacgccagaaccgccaggacagctggtttcgtaaaaccgcttcaaagatgattaaccggcttattcagcgcaccacaggcaaagcgatgggtgactatggttgtatgctgcgcgcctatcgccgtcatattgtcgatgcgatgttgcactgccatgaacgcagcacctttatcccgattctggcgaatatcttcgcccgccgtgccattgaaattccagtgcaccatgccgagcgtgagtttggtgaatccaaatacagctttatgcgcctgattaatttgatgtacgacctggtgacctgtcttaccacaacgccgctacgtatgttgagtttgctcggcagcattattgcgattggcggttttagcattgcggtgctgctggtgattttacgcctgaccttcggaccccaatgggcggcagaaggcgtctttatgctatttgccgtgctgtttacttttattggcgctcagtttatcggcatgggattgctcggtgaatatatcggcaggatctacaccgatgtccgcgcccgcccccgctattttgttcagcaagttatccgtccatccagcaaggaaaatgaataa

SEQ ID NO: 5442 - protein, 322 aa, Escherichia coli
MFEIHPVKKVSVVIPVYNEQESLPELIRRTTAACESLGKEYEILLIDDGSSDNSAHMLVEASQAEGSHIVSILLNRNYGQHSAIMAGFSHVTGDLIITLDADLQNPPEEIPRLVAKADEGYDVVGTVRQNRQDSWFRKTASKMINRLIQRTTGKAMGDYGCMLRAYRRHIVDAMLHCHERSTFIPILANIFARRAIEIPVHHAEREFGESKYSFMRLINLMYDLVTCLTTTPLRMLSLLGSIIAIGGFSIAVLLVILRLTFGPQWAAEGVFMLFAVLFTFIGAQFIGMGLLGEYIGRIYTDVRARPRYFVQQVIRPSSKENE

SEQ ID NO: 5443 - DNA, 1983 bp, Escherichia coli
atgaaaaccgtcgtttttgcctaccacgatatgggatgcctcggtattgaagccctgctggctgccggttacgaaattagcgccatttttacccatactgataatcccggtgaaaaagccttttatggttcggttgcccgactggcagcggaaagaggcattccagtttatgcgccggataacgttaatcatccgttgtgggtggaacgcattgcccaactatcaccagaggtgattttctctttttattatcgccatcttatttgcgatgagattttgcagctcgctccgagaggtgcatttaatctgcatggttcgctgttaccaaaatatcgtggtcgcgcgccgctgaactgggtgctggtgaacggtgaaacggaaactggcgttacattgcaccgaatggtgaaacgtgccgatgccggggccattgtggcacaactgcgcgttgccattgcgccagacgatatcgccattacgctgcatcataaattgtgccatgccgcgcgccagctactggaacagacattacccgccattaaacacggtaatattctggaaatcgcccagcgcgaaaacgaagccacctgttttggtcgcagaacgccggatgacagtttcctcgaatggcataagtcggcatccgtactgcacaacatggtgcgtgccgttgccgatccgtggccgggtgccttcagctatgttggcaatcagaaattcaccgtctggtcgtcgcgtgttcatcctcatgccagcaaagcacagccggggagcgtgatttctgttgcaccactgctgattgcctgtggcgatggcgcgctggaaatcgtcactggacaggcgggcgacggcattactatgcagggctcgcaattagcgcagacgctgggcctggtgcaaggttcacgcttgaatagccagcctgcctgtgccgcccgacgccgtacccgggtactcatcctcggggtgaatggctttattggcaaccatctgacagaacgcctgctgcgcgaagatcattatgaagtttacggtctggatattggcagcgatgcgataagccgttttctgaatcatccgcattttcactttgtcgaaggcgatatcagtattcattccgaatggattgagtatcacgtcaaaaaatgtgatgtcgtgttgccgctggtggcgatagccacgccgattgaatatacccgcaacccgctgcgcgtatttgaactcgatttcgaagagaatctgcgcattatccgctactgcgtgaagtaccgtaagcgaatcatcttcccgtcgacttcagaagtttatgggatgtgtagcgataaatacttcgatgaggaccattctaatttaatcgtcggcccggtgaataaaccacgctggatttattcggtgtctaaacaattacttgatcgagtgatctgggcctatggcgaaaaagaaggtttacagttcaccctcttccgcccgtttaactggatggggccacgactggataaccttaatgcagcgcgaattggcagctcccgcgctattacgcaactcattctcaatctggtagaaggttcaccgattaagctgattgatggcggaaaacaaaaacgctgctttactgatattcgggatggtatcgaggcgttataccgcattatcgaaaatgcgggaaatcgctgcgatggcgaaattatcaacattggcaatcctgagaacgaagcgagcattgaagaactgggggagatgctgctggcgagcttcgaaaaacatccgctgcgccattacttcccaccgtttgcgggctttcgtgttgtcgaaagtagcagctactatggcaaaggatatcaggacgtagagcatcgtaaaccgagcatccgcaatgcccgccgctgcctgaactgggaaccgaaaattgatatgcaggaaaccatcgacgaaacgctggatttcttcctgcgcaccgttgatcttacggataaaccatcatga

SEQ ID NO: 5444 - protein, 660 aa, Escherichia coli
MKTVVFAYHDMGCLGIEALLAAGYEISAIFTHTDNPGEKAFYGSVARLAAERGIPVYAPDNVNHPLWVERIAQLSPEVIFSFYYRHLICDEILQLAPRGAFNLHGSLLPKYRGRAPLNWVLVNGETETGVTLHRMVKRADAGAIVAQLRVAIAPDDIAITLHHKLCHAARQLLEQTLPAIKHGNILEIAQRENEATCFGRRTPDDSFLEWHKSASVLHNMVRAVADPWPGAFSYVGNQKFTVWSSRVHPHASKAQPGSVISVAPLLIACGDGALEIVTGQAGDGITMQGSQLAQTLGLVQGSRLNSQPACAARRRTRVLILGVNGFIGNHLTERLLREDHYEVYGLDIGSDAISRFLNHPHFHFVEGDISIHSEWIEYHVKKCDVVLPLVAIATPIEYTRNPLRVFELDFEENLRIIRYCVKYRKRIIFPSTSEVYGMCSDKYFDEDHSNLIVGPVNKPRWIYSVSKQLLDRVIWAYGEKEGLQFTLFRPFNWMGPRLDNLNAARIGSSRAITQLILNLVEGSPIKLIDGGKQKRCFTDIRDGIEALYRIIENAGNRCDGEIINIGNPENEASIEELGEMLLASFEKHPLRHYFPPFAGFRVVESSSYYGKGYQDVEHRKPSIRNARRCLNWEPKIDMQETIDETLDFFLRTVDLTDKPS

SEQ ID NO: 5445 - DNA, 891 bp, Escherichia coli
atgaccaaagtcggcttacgcattgatgtcgatacctttcgtggcacccgtgaaggcgtgccgcgtctgctggaaatcttgagtaagcataatattcaggccagcatttttttcagcgtcggcccggacaatatgggccgccatctctggcgactggtgaagccacagtttttgtggaagatgctgcgctcaaacgcggcatcgctttatggctgggatattttactggcaggtacggcctggccaggtaaagagattggtcatgccaatgccgatatcattcgtgaagcggctaaacatcacgaagtcggcctgcacgcctgggatcaccatgcctggcaagcccatagcggtaattgggatcggcaaacaatgatcgacgatattgcacgcggccttcgcaccctggaagagattatcggtcaaccggtaacctgttctgccgctgctggctggcgtgctgaccaacaggtgatcgaagcaaaagaagcgttccatttgcgctacaacagcgattgtcgtggggcgatgccgtttcgtccattgctcgaatcaggaacccctggcactgcgcaaattccggtgaccttacccacctgggatgaagtgattggtcgggatgtgaaagcagaagattttaacggttggttactcaaccgcatccagcgagataaaggcacgccggtttataccattcatgccgaagttgaaggctgcgcttatcagcataattttgtggatctcctgaaacgcgcagctcaggaaggcgtgacattttgccctttaagcgaactgttatcagggacgttgccgctcggacaagttgttcgcggaaatattgccggacgtgaaggctggctgggttgccaacaaattgcgggtagtcactga

SEQ ID NO: 5446 - protein, 296 aa, Escherichia coli
MTKVGLRIDVDTFRGTREGVPRLLEILSKHNIQASIFFSVGPDNMGRHLWRLVKPQFLWKMLRSNAASLYGWDILLAGTAWPGKEIGHANADIIREAAKHHEVGLHAWDHHAWQAHSGNWDRQTMIDDIARGLRTLEEIIGQPVTCSAAAGWRADQQVIEAKEAFHLRYNSDCRGAMPFRPLLESGTPGTAQIPVTLPTWDEVIGRDVKAEDFNGWLLNRIQRDKGTPVYTIHAEVEGCAYQHNFVDLLKRAAQEGVTFCPLSELLSGTLPLGQVVRGNIAGREGWLGCQQIAGSH

SEQ ID NO: 5447 - DNA, 1653 bp, Escherichia coli
atgaaatcggtacgttaccttatcggcctcttcgcatttattgcctgctattacctgttaccgatcagcacgcgtctgctctggcaaccagatgaaacgcgttatgcggaaatcagtcgggaaatgctggcatccggcgactggattgttccccatctgttagggctacgttatttcgaaaaacccattgccggatactggattaacagcattgggcaatggctatttggcgcgaataactttggtgtgcgggcaggcgttatctttgcgaccctgttaactgccgcgctggtgacctggtttactctgcgcttatggcgcaataaacgtctggctttactcgccacagtaatttatctctcattgtttattgtctatgccatcggcacttatgccgtgctcgatccgtttattgccttctggctggtggcgggaatgtgcagcttctggctggcaatgcaggcacagacgtggaaaggcaaaagcgcaggatttttactgctgggaatcacctgcggcatgggggtgatgaccaaaggttttctcgcccttgccgtgccggtattaagcgtgctgccatgggtagcaacgcaaaaacgctggaaagatctctttatttacggctggctggcggttatcagttgcgtactgacggttctcccctggggactggcgatagcgcagcgggagcctgacttctggcactattttttctgggttgagcatattcaacgctttgcactggatgatgcccaacatagagcgccgttctggtactacttgccagtcatcattgccggtagcctgccgtggctgggattactccccggtgcactgtacgctggctggaaaaaccgcaagcattccgcaaccgtctatttgttgagctggacgataatgccgctgctgtttttctccgtcgctaaaggcaaattgcccacctatattctttcctgctttgcacctctggcaatgctgatggcgcattacgcgttgctggcagcaaaaaataatcctctggcgttgcggattaatggctggattaacatcgcttttggcgtcactggcattattgccacatttgtggtctccccctggggaccaatgaacacaccggtgtggcaaaccttcgagagctataaagtcttttgtgcctggtctattttttcgctatgggcttttttcggctggtacaccttaacaaacgtcgaaaagacctggccttttgccgcgctttgcccgctggggctggcgttgctggtaggattttcaattcctgacagagtcatggaaggaaaacatccgcaattttttgtcgagatgacacaagaatcacttcagccaagccgctatattcttactgatagcgtcggtgttgccgcaggtctggcatggagcctgcaacgcgatgacatcatcatgtatcgccagacaggtgagttgaaatatggccttaattatccggatgcaaaagggagatttgtcagcggtgatgagttcgcaaactggcttaatcaacatcgtcaggaggggattattacactcgtgctttcggttgaccgcgatgaagatatcaacagtctcgccattccgcccgcagatgtcatcgatcgtcaggagcgtctggtgctaattcagtatcggcccaaatga

SEQ ID NO: 5448 - protein, 550 aa, Escherichia coli
MKSVRYLIGLFAFIACYYLLPISTRLLWQPDETRYAEISREMLASGDWIVPHLLGLRYFEKPIAGYWINSIGQWLFGANNFGVRAGVIFATLLTAALVTWFTLRLWRNKRLALLATVIYLSLFIVYAIGTYAVLDPFIAFWLVAGMCSFWLAMQAQTWKGKSAGFLLLGITCGMGVMTKGFLALAVPVLSVLPWVATQKRWKDLFIYGWLAVISCVLTVLPWGLAIAQREPDFWHYFFWVEHIQRFALDDAQHRAPFWYYLPVIIAGSLPWLGLLPGALYAGWKNRKHSATVYLLSWTIMPLLFFSVAKGKLPTYILSCFAPLAMLMAHYALLAAKNNPLALRINGWINIAFGVTGIIATFVVSPWGPMNTPVWQTFESYKVFCAWSIFSLWAFFGWYTLTNVEKTWPFAALCPLGLALLVGFSIPDRVMEGKHPQFFVEMTQESLQPSRYILTDSVGVAAGLAWSLQRDDIIMYRQTGELKYGLNYPDAKGRFVSGDEFANWLNQHRQEGIITLVLSVDRDEDINSLAIPPADVIDRQERLVLIQYRPK

SEQ ID NO: 5449 - DNA, 336 bp, Escherichia coli
atgatctggttaacattagtctttgccagcttgcttagcgttgccgggcagttgtgtcagaaacaggcaacctgctttgcggcggtaaacaaacggcgcaaacatatcgtgctgtggctgggactggcgctggcttgtcttggccttgccatggtgctctggctgctggtcttgcagaacgtaccggtaggcattgcctacccgatgttaagtctgaattttgtctgggtaacgctggctgcagtaaaactgtggcacgagccggtatcgctgcgtcactggtgtggggtggcgttcattattggcggcattgtgatcctcgggagtacggtgtaa

SEQ ID NO: 5450 - protein, 111 aa, Escherichia coli
MIWLTLVFASLLSVAGQLCQKQATCFAAVNKRRKHIVLWLGLALACLGLAMVLWLLVLQNVPVGIAYPMLSLNFVWVTLAAVKLWHEPVSLRHWCGVAFIIGGIVILGSTV

SEQ ID NO: 5451 - DNA, 387 bp, Escherichia coli
atgggcctgatgtggggattattcagcgtcattatcgcctccgctgcgcaattaagcatgggttttgcggcgagtcatctgccgccaatgacgcacttatgggattttatcgcggcgctgttagcttttggcctggatgcccggatactgttactcgggctgctgggttatctgctttccgttttttgttggtataaaacactacataaacttgcgctaagcaaagcctatgccttgctcagtatgagttatgtgctggtatggattgcttcaatggtacttcccggctgggaagggactttttcgctgaaagcactactgggagtagcctgtattatgagcgggttgatgctgattttcctgcccacaacaaaacaacgttactga

SEQ ID NO: 5452 - protein, 128 aa, Escherichia coli
MGLMWGLFSVIIASAAQLSMGFAASHLPPMTHLWDFIAALLAFGLDARILLLGLLGYLLSVFCWYKTLHKLALSKAYALLSMSYVLVWIASMVLPGWEGTFSLKALLGVACIMSGLMLIFLPTTKQRY

SEQ ID NO: 5453 - DNA, 297 bp, Escherichia coli
gtgaaaactcttagcaaacaggataatgcaatggaatggctggtcaaaaaatcgtgctgcaataaacaagataacagacatgtaattatgctctgcgatgctggcggcgcgataaaaatgatcgccgaagtgaagagtgacttcgccgtgaaagtgggggatttactctcgcctttgcagaatgcgctttactgtattaatcgtgaaaagctgcacacggtgaaagtcctttctgcaagctgttatagccccgatgagtgggaacggcagtgtaaagcggcagggaaaactcagtaa

SEQ ID NO: 5454 - protein, 98 aa, Escherichia coli
MKTLSKQDNAMEWLVKKSCCNKQDNRHVIMLCDAGGAIKMIAEVKSDFAVKVGDLLSPLQNALYCINREKLHTVKVLSASCYSPDEWERQCKAAGKTQ

SEQ ID NO: 5455 - DNA, 1356 bp, Escherichia coli
atgatcttctctgactggccgtggcgtcactggcggcaagtgcggggagaagccatcgccttacgtctcaatgacgagcaactcaactggcgcgaactttgtgctcgcgtcgatgaattagcctccagctttgcggtgcagggtgtggttgagggcagcggcgtgatgttgcgggcgtggaatacgccgcaaacgctgctggcctggctggcgttactgcaatgcggggcgcgggtgttgcccgtgaaccctcagctgccgcaaccgctgcttgaggaattgctgcccaatcttacgctgcaatttgcgctggtgccggaaggggaaaacacgtttccggcgttagcgtcgctgcacattcagctggttgaaggcgcacatgccgcggcgtggcagccgacgcgtctgtgctcaatgacgttaacctctggttccactggcttgccgaaagccgctgttcatacttatcaggctcatcttgccagcgccgaaggggtgttatcgctgattccttttggtgatcacgatgactggttgctctctttaccgctgtttcacgtctccggtcagggaattatgtggcgctggttatacgctggtgcgcggatgacggtgcgtgataaacagccattggagcagatgctggcaggctgtactcacgcttcactggtgccaacacaactctggcgtttgctggttaaccgtagttccgtttccctgaaagcggttttacttggcggcgcggctatcccggtcgagttgacggaacaggcgcgcgagcaggggattcggtgcttttgcggctatggtctgaccgagtttgcctccacagtgtgtgcgaaagaagccgacggtctggcagacgttggttcgccgctgccgggtcgggaagtgaaaatcgttaatgatgaagtgtggctgcgggctgccagtatggcagaaggttactggcgtaacgggcaacgggttccactggttaatgacgaaggctggtacgccacgcgcgatcgcggtgagatgcataatggcaagttgaccattgtcggacgtttagacaatctattcttcagtggcggtgagggtattcagccggaagaagtcgagcgcgttattgctgcacatcctgcggttttgcaggtgtttatcgttcccgttgccgacaaggagtttggtcatcggccggtagcggtggtggagtatgaccagcaaagcgttgatcttgacgaatgggtgaaagataagctggctcgttttcaacaaccggtgcgctggctgactctgccgccggagctgaaaaacggcggtattaaaatttcacgtcaggcgctaaaagagtgggtgaaacgccagcaataa

SEQ ID NO: 5456 - protein, 451 aa, Escherichia coli
MIFSDWPWRHWRQVRGEAIALRLNDEQLNWRELCARVDELASSFAVQGVVEGSGVMLRAWNTPQTLLAWLALLQCGARVLPVNPQLPQPLLEELLPNLTLQFALVPEGENTFPALASLHIQLVEGAHAAAWQPTRLCSMTLTSGSTGLPKAAVHTYQAHLASAEGVLSLIPFGDHDDWLLSLPLFHVSGQGIMWRWLYAGARMTVRDKQPLEQMLAGCTHASLVPTQLWRLLVNRSSVSLKAVLLGGAAIPVELTEQAREQGIRCFCGYGLTEFASTVCAKEADGLADVGSPLPGREVKIVNDEVWLRAASMAEGYWRNGQRVPLVNDEGWYATRDRGEMHNGKLTIVGRLDNLFFSGGEGIQPEEVERVIAAHPAVLQVFIVPVADKEFGHRPVAVVEYDQQSVDLDEWVKDKLARFQQPVRWLTLPPELKNGGIKISRQALKEWVKRQQ

SEQ ID NO: 5457 - DNA, 927 bp, Escherichia coli
atggacgcgggggtggttctgcgcgacaggcggttaaaaacccgcgacgggctgtatgtttgcctgcgtgagggcgagcgcgaagggtggggggagatctccccactgccgggcttcagtcaggaaacctgggaagatgcgcaaagtgtgctgcttgcctgggtaaataactggctggcaggcgattgcgagataccgcagatgccttccgttgcctttggcgtaagttgtgcattggcggagctggcagagacgctcccgcaggcggccaattaccgtgcggcgccgctgtgtaatggcgatcctgacgatctgatcctcaaacttgccgatatgcctggcgagaaagtggcgaaggtcaaagtgggattgtacgaagccgtgcgcgacggcatggtggtgaatctgttgctggaggcaattccggatctgcatttgcgtcttgacgcgaaccgcgcctggacaccgctgaaaggccagcagtttgccaaatacgttaacccggattatcgccaccgcatcgcgtttctcgaagagccgtgcaaaacccgcgatgattcgcgtgcgtttgcccgtgaaaccggcattgccattgcctgggatgaaagcttgcgcgagccggattttgcctttgtagctgaagagggcgtgcgcgcggtagttatcaaacccacgctcacgggcagcctggataaagtacgcgagcaagtgcaggcggcgcatgcgctggggctgacggcggtgatcagctcttccattgagtcgagcttaggtctaacgcaactggcgcggattgctgcctggttaacgccagacaccattccgggactggacacgctggatctgatgcaggcgcagcaggttcgtcgctggccggggagcccactgccgttagtggacgttgatgcactggagcggctgttatga

SEQ ID NO: 5458 - protein, 308 aa, Escherichia coli
MDAGVVLRDRRLKTRDGLYVCLREGEREGWGEISPLPGFSQETWEDAQSVLLAWVNNWLAGDCEIPQMPSVAFGVSCALAELAETLPQAANYRAAPLCNGDPDDLILKLADMPGEKVAKVKVGLYEAVRDGMVVNLLLEAIPDLHLRLDANRAWTPLKGQQFAKYVNPDYRHRIAFLEEPCKTRDDSRAFARETGIAIAWDESLREPDFAFVAEEGVRAVVIKPTLTGSLDKVREQVQAAHALGLTAVISSSIESSLGLTQLARIAAWLTPDTIPGLDTLDLMQAQQVRRWPGSPLPLVDVDALERLL

SEQ ID NO: 5459 - DNA, 858 bp, Escherichia coli
atgatttatcctgatgaagcaatgctttacgcaccggttgaatggcacgactgctccgaaggttttgaggacattcgttatgaaaaatccaccgacggtatcgcaaaaatcaccattaatcgtccgcaggtgcgcaatgccttccgtcctctgacggtaaaagagatgatccaggcgctggcggatgcgcgttatgacgacaacatcggcgtgatcattctgactggtgcaggcgataaagcgttctgctccggtggtgaccagaaagtacgtggtgattacggcggctataaagatgattccggcgtacatcacctgaacgtgctggacttccagcgtcagatccgtacctgtccgaaaccggttgtcgcgatggtggctggatactccatcggcggtggtcacgtcctgcacatgatgtgcgacctgactatcgcggctgataatgccatcttcggccagactggcccgaaagtcggttccttcgacggcggctggggcgcttcctatatggcgcgcattgttgggcagaaaaaagcacgtgaaatctggttcctgtgccgtcagtacgacgcaaaacaggcgctggatatgggcctggtgaacaccgttgtacctctggcggatctggaaaaagagaccgtgcgctggtgccgtgaaatgttgcaaaacagcccgatggcactgcgctgcctgaaagctgcgctgaatgccgactgtgacggtcaggcaggtctgcaggagctggcaggtaacgccaccatgctgttctatatgacggaagaaggtcaggaaggtcgcaacgctttcaaccagaaacgtcagcctgatttcagcaaatttaaacggaatccgtaa

SEQ ID NO: 5460 - protein, 285 aa, Escherichia coli
MIYPDEAMLYAPVEWHDCSEGFEDIRYEKSTDGIAKITINRPQVRNAFRPLTVKEMIQALADARYDDNIGVIILTGAGDKAFCSGGDQKVRGDYGGYKDDSGVHHLNVLDFQRQIRTCPKPVVAMVAGYSIGGGHVLHMMCDLTIAADNAIFGQTGPKVGSFDGGWGASYMARIVGQKKAREIWFLCRQYDAKQALDMGLVNTVVPLADLEKETVRWCREMLQNSPMALRCLKAALNADCDGQAGLQELAGNATMLFYMTEEGQEGRNAFNQKRQPDFSKFKRNP

SEQ ID NO: 5461 - DNA, 759 bp, Escherichia coli
atgatcctgcacgcgcaggcaaaacacggcaaaccaggtttaccctggttggtgtttttgcacggtttttctggcgattgccatgaatggcaagaagtgggcgaggcgtttgccgactactcgcggttgtatgttgatctcccaggtcacggtggttcagcgacgatcagcgtcgatggatttgatgatgtcaccggcttattgtgtaaaacgctggttagttacaacatacttaacttctggctggtggggtactcgcttggcggacgggtggcgatgatggcggcttgccaggagccggcggggctttgtggagttgttgtcgaaggcgggcatcctggattgcaaaatgctgaacaacgcgcggaacgtcagcgttccgatcgccaatgggcgcagcgttttcgtacagaaccgttaacggcggtatttgccgattggtatcaacagcctgtttttgcctcgctcaatgacgatcaacgccgggagctggtggcgctgcgcagcaacaataatggcgcaacccttgccgccatgctggaggcgacttctctcgccgtccagcccgatttacgtgctaaccttagcgcccgcacatttgcgttttattatttatgtggtgaacgtgacagcaaattccgcgctctggcggcggaactggctgccgactgccatgtcattcctcgcgccggacataacgcgcaccgggaaaatcccgctggcgtaatcgcaagtctggcgcagatcttgcgtttctga

SEQ ID NO: 5462 - protein, 252 aa, Escherichia coli
MILHAQAKHGKPGLPWLVFLHGFSGDCHEWQEVGEAFADYSRLYVDLPGHGGSATISVDGFDDVTGLLCKTLVSYNILNFWLVGYSLGGRVAMMAACQEPAGLCGVVVEGGHPGLQNAEQRAERQRSDRQWAQRFRTEPLTAVFADWYQQPVFASLNDDQRRELVALRSNNNGATLAAMLEATSLAVQPDLRANLSARTFAFYYLCGERDSKFRALAAELAADCHVIPRAGHNAHRENPAGVIASLAQILRF

SEQ ID NO: 5463 - DNA, 1860 bp, Escherichia coli
atgctggcgcaggcattgtccgtggttccgaccccgagcaagagtggcaggaaatcgacaacaaagcggcagggctgcgtactttattacaaatggaatagtaatgagtcgcatcattaccgattcatatcaataatctatttttgtagctccttatacttagccgcaatattgataccggacaaactcatgtcagtaagcgcatttaaccgacgctgggcggcggtcattctggaagcattaacgcgtcacggcgtcagacacatctgtatcgcccctggctcgcgttctacaccgttaacgttagcggcggcggagaattccgcatttattcatcatacccatttcgatgagcgtggactggggcatctggcactggggctggcgaaagtcagcaagcagccggtggcggtgattgtgacctccggcacggcggtagcaaatctctatccggcactgattgaagctgggttaaccggagaaaaactgatcctgttaaccgccgatcgcccgccggagctgattgactgcggcgcgaatcaggcgattcgtcagccgggaatgttcgcctctcaccccacgcacagtatttcactgccgcgcccgacccaggatatccccgcacgttggctggtttctaccatcgaccacgctctcggtacgcttcatgctggtggagtccatatcaactgcccgtttgctgaaccgctgtatggcgaaatggacgacaccgggattagctggcaacagcggctgggcgactggtggcaggacgacaaaccgtggctgcgtgaagcgcctcgtcgggaaagtgaaaaacagcgtgactggttcttctggcgacaaaagcgcggcgtggtggttgccgggcgcatgagtgcggaagagggcaaaaaagttgcactgtgggcgcaaactcttggctggccgctgattggcgacgtgctgtcgcaaaccggacagccgctgccgtgtgccgatctctggttaggcaatgccaaagcgaccagcgaactgcaacaggcacaaatagtggtgcaactgggaagcagcctgacggggaaacgactcctccaatggcaggcaagctgtgaaccagaagagtactggattgttgatgacattgaagggcgacttgatccggcacaccatcgcggacgtcgcttaattgccaatattgccgactggctggagctgcatccggcagaaaaacgccagccctggtgcgttgaaatcccgcgcctggcggaacaggcaatgcaggcggttattgcccgtcgcgatgcgtttggcgaagcgcaactggcgcatcgcatcagcgactacttgcctgaacaggggcaattgtttgtcggtaacagcctggtggtgcgtctgattgatgcgctttcgcaacttccggcaggttacccggtgtacagcaaccgtggtgccagcggtatcgacgggctgctctcgactgccgccggcgttcagcgggcaagcggcaaaccgacgctggcgattgtgggcgatctctccgcactttacgatctcaacgcgctggcgttattgcgccaggtttccgcaccgctggtattaattgtggtgaacaacaacggcgggcaaattttttcgctgttgccaacgccgaaaagcgagcgcgagcgtttctatctgatgccgcaaaacgtccattttgagcacgccgctgcgatgttcgagctgaaatatcatcgtccgcaaaactggcaggaacttgaaacgacactagtcgatgcctggcgtacgccgaccaccacggtgattgaaatggtggttaacgacaccgatggtgcgcaaacgctccagcaacttctggcgcaggtaagccatttatga

SEQ ID NO: 5464 - protein, 619 aa, Escherichia coli
MLAQALSVVPTPSKSGRKSTTKRQGCVLYYKWNSNESHHYRFISIIYFCSSLYLAAILIPDKLMSVSAFNRRWAAVILEALTRHGVRHICIAPGSRSTPLTLAAAENSAFIHHTHFDERGLGHLALGLAKVSKQPVAVIVTSGTAVANLYPALIEAGLTGEKLILLTADRPPELIDCGANQAIRQPGMFASHPTHSISLPRPTQDIPARWLVSTIDHALGTLHAGGVHINCPFAEPLYGEMDDTGISWQQRLGDWWQDDKPWLREAPRRESEKQRDWFFWRQKRGVVVAGRMSAEEGKKVALWAQTLGWPLIGDVLSQTGQPLPCADLWLGNAKATSELQQAQIVVQLGSSLTGKRLLQWQASCEPEEYWIVDDIEGRLDPAHHRGRRLIANIADWLELHPAEKRQPWCVEIPRLAEQAMQAVIARRDAFGEAQLAHRISDYLPEQGQLFVGNSLVVRLIDALSQLPAGYPVYSNRGASGIDGLLSTAAGVQRASGKPTLAIVGDLSALYDLNALALLRQVSAPLVLIVVNNNGGQIFSLLPTPKSERERFYLMPQNVHFEHAAAMFELKYHRPQNWQELETTLVDAWRTPTTTVIEMVVNDTDGAQTLQQLLAQVSHL

SEQ ID NO: 5465 - DNA, 1296 bp, Escherichia coli
gtgcaatcacttactacggcgctggaaaatctactgcgccatttgtcgcaagagattccggcgacacccggcattcgggttatcgatattcctttccctctcaaagacgcttttgatgccttgagctggctggccagtcagcaggtgtatccgcaattctactggcaacaacgtaatggtgatgaagaagctgccgtcctgggtgcgattacccgttttacgtcgttggaccaggcacaacgttttcttcgccagcacccggaacacgccgacttacgcatctgggggttgaatgcgtttgacccgtcgcagggcaatttacttttaccacgcctggaatggcgacgttgtggcggtaaagccacgctgcggctgacgctattcagcgaaagctcccttcagcacgatgcaatcaaggcaaaagaatttatcgccacactggtgagtatcaagcccctgcctggattacatttaaccaccacgcgagaacaacactggccggacaaaacgggctggacgcaattaatcgaactggcaacgaaaaccatcgccgaaggcgagctcgacaaagttgtgcttgctcgggcaaccgacctgcatttcgcaagtccggtcaatgcggcagcgatgatggctgccagtcgtcggctcaatctgaattgctaccatttttacatggcctttgatggcgaaaatgcttttcttggttcttcaccggaacggttatggcggcggcgtgacaaagcgctgcgtaccgaagcgctggcgggaacggtagcaaatcatcctgatgataagcaggcgcagcagttaggtgagtggctgatggcggatgataaaaaccagcgcgagaacatgttggtggtggaagatatctgccaacgattgcaggccgatacccaaacgctggatgttttaccgccgcaggtactgcgtctacgtaaagtacagcatcttcgccgctgtatctggacttcactcaacaaagcggatgatgtgatctgtttacatcagttgcagccaacggcagcagttgctggcttaccgcgcgatctggcgcgacagtttatcgcccgtcacgaaccgttcactcgagaatggtacgccggttctgcgggctatctctcattacagcaaagtgaattctgcgtttccctgcgctcagcaaaaatcagcggcaatatcgtgcggctatatgctggcgcaggcattgtccgtggttccgaccccgagcaagagtggcaggaaatcgacaacaaagcggcagggctgcgtactttattacaaatggaatag

SEQ ID NO: 5466 - protein, 431 aa, Escherichia coli
MQSLTTALENLLRHLSQEIPATPGIRVIDIPFPLKDAFDALSWLASQQVYPQFYWQQRNGDEEAAVLGAITRFTSLDQAQRFLRQHPEHADLRIWGLNAFDPSQGNLLLPRLEWRRCGGKATLRLTLFSESSLQHDAIKAKEFIATLVSIKPLPGLHLTTTREQHWPDKTGWTQLIELATKTIAEGELDKVVLARATDLHFASPVNAAAMMAASRRLNLNCYHFYMAFDGENAFLGSSPERLWRRRDKALRTEALAGTVANHPDDKQAQQLGEWLMADDKNQRENMLVVEDICQRLQADTQTLDVLPPQVLRLRKVQHLRRCIWTSLNKADDVICLHQLQPTAAVAGLPRDLARQFIARHEPFTREWYAGSAGYLSLQQSEFCVSLRSAKISGNIVRLYAGAGIVRGSDPEQEWQEIDNKAAGLRTLLQME

SEQ ID NO: 5467 - DNA, 306 bp, Escherichia coli
atgtctaatcagtttggtgatacacgtattgatgatgacctgacgctgcttagtgaaacactggaagaggtgctccgctcctctggcgatcccgccgatcagaaatatgttgagctgaaagcgcgtgcagaaaaagcgctggatgatgtgaaaaaacgggttagccaggcttcagacagttattactatcgggcgaagcaggctgtttatcgtgctgatgactacgtccacgaaaaaccctggcaaggaattggtgtgggtgcggccgttgggctggttctgggactgttgctggcacgccgttaa

SEQ ID NO: 5468 - protein, 101 aa, Escherichia coli
MSNQFGDTRIDDDLTLLSETLEEVLRSSGDPADQKYVELKARAEKALDDVKKRVSQASDSYYYRAKQAVYRADDYVHEKPWQGIGVGAAVGLVLGLLLARR

SEQ ID NO: 5469 - DNA, 462 bp, Escherichia coli
atgatcgactggcaagatctgcatcattctgatttatccgtttctcagctttatgccttattacaactgcgttgtgcggtatttgtagtggaacaaaactgtccttaccaggatatcgatggtgacgatctggagggagaaaatcgccacattctcggttggcataacgggacactggtggcgtatgcgaggattctgaaaagtgacgacgaactgcaacccgttgtgattggtcgggtgattgtcagcgaagccttacgcggtgaaaaaatcggtcagcaattgatgagtaaggcgctggaatcgtgtactcgccgctggccggagaagccgatttatctgggggcgcaggcgcatttacaaaacttttatgggcaatttggtttcatccctgtgaccgatatttatgaagaagatggtatcccacacattgggatggcacgcgaggtaattcaggcgtaa

SEQ ID NO: 5470 - protein, 153 aa, Escherichia coli
MIDWQDLHHSDLSVSQLYALLQLRCAVFVVEQNCPYQDIDGDDLEGENRHILGWHNGTLVAYARILKSDDELQPVVIGRVIVSEALRGEKIGQQLMSKALESCTRRWPEKPIYLGAQAHLQNFYGQFGFIPVTDIYEEDGIPHIGMAREVIQA

SEQ ID NO: 5471 - DNA, 918 bp, Escherichia coli
atggaattaatttttttaggtacttcagccggtgtgccaacccgtacgcgtaatgtcacggcaatattgcttaacctgcaacatccgacccagagcggactttggttatttgactgcggtgaaggcacccagcatcagctactgcataccgcctttaaccctggaaaactggacaagatttttatcagtcaccttcatggcgatcatctctttggtttacccggcttactgtgcagtcgttctatgtcaggcattatccaacccttaacgatttatggtccgcacggtatccgtgaatttgtggagaccgcgctgcggattagcggctcatggaccgattatccgctggaaattgtcgaaattggtgctggcgaaattttcgatgatggcctgcgcaaagtgaccgcttatccgatggaacacccactggaatgttatggttatcgtattgaagaacatgataaaccaggtgcattaaatgcccaggcattaaaagctgctggcgtgccgcctggcccgctgtttcaggaattaaaagcgggcaaaacaatcatgctggatgatggaaggcagattaatggcgcagattacttagccgttccagtgccgggtaaagcgctcgctattttcggcgataccggcccctgcgatgccgcgctggagctggctaaaggcgtcgacgtaatggttcacgaagcgactctggatatggcgatggaggccaaagccaacagtcgcggccatagttctacacgccaggcggcggcactagcccgtgaggctggagtcggtaagctaatcattacccacgtcagctcgcgctatgatgacaaaggttgtcagcacctgttacgtgaatgtcggtcaattttcccggcgactgaactggcgaatgatttcgcggtgtttagcatttaa

SEQ ID NO: 5472 - protein, 305 aa, Escherichia coli
MELIFLGTSAGVPTRTRNVTAILLNLQHPTQSGLWLFDCGEGTQHQLLHTAFNPGKLDKIFISHLHGDHLFGLPGLLCSRSMSGIIQPLTIYGPHGIREFVETALRISGSWTDYPLEIVEIGAGEIFDDGLRKVTAYPMEHPLECYGYRIEEHDKPGALNAQALKAAGVPPGPLFQELKAGKTIMLDDGRQINGADYLAVPVPGKALAIFGDTGPCDAALELAKGVDVMVHEATLDMAMEAKANSRGHSSTRQAAALAREAGVGKLIITHVSSRYDDKGCQHLLRECRSIFPATELANDFAVFSI

SEQ ID NO: 5473 - DNA, 1743 bp, Escherichia coli
atgcgaaataaaaatataatcatgttgcttataagtagtttgattttgtcaggatgtgggccggaacctgaggataagaaaagtcagcaacaacaatctactacacccactgaccagcaagtgcttgccgcgcaacaagcggcaacaaaagtggctgagcaaagcgccgccaaagccgctgcagacgcgaaagccttagcccagcaagaagtgcaacaatattcagacaaacaggctttgctggggcgattgcaggcggctccaaaatatcaacatgcagccagagaaaaagcagcctcccaaatcgcaaatccaggaaccgctcgctaccagcagttcgatgataatccggttaagcaggtagcgcaaaacccgttggcgacgtttagccttgacgtcgataccggcagttatgcgaatgtgcggcgtttccttaatcaagggctgttacctccgccagacgctgtgcgggtggaggagatagtcaattatttcccgtctgactgggatatcaaagacaaacaatctattccggcctctaagccaatacctttcgctatgcgctacgaattggcacctgcaccctggaatgaacagcgaacattgctgaaagttgatatcctggcgaaagatcgcaaaagtgaagagttacccgcttctaatctggtctttcttatcgacacgtctggttcaatgatttctgatgaacgtttgccacttatccagtcttcgttgaaattattggtcaaagaacttcgtgagcaggataacattgccatcgtgacctacgctggcgactctcgtattgcgttgccttctatctccggtagtcacaaggcggaaattaatgctgcaattgattcgctggatgcagaaggcagtaccaatggcggtgccgggctggagatggcttatcagcaggcagcgaaggggtttattaaaggtggtatcaatcgcattttattggccactgacggtgactttaacgttggcattgacgatccaaaatcgattgaatcaatggtcaaaaaacagcgtgagtccggtgttactctgtcgacgcttggcgtgggggatagcaattataacgaggcaatgatggtaagaattgccgatgttggtaacggcaactatagctacattgataccctctcagaggcgcagaaagtgttgaacagtgaaatgcggcagacgttgattaccgtagcaaaagatgtcaaagcgcaaattgagtttaaccccgcgtgggtaacggaataccgtcagataggttatgaaaagcgccaacttagggcagaggattttaataacgacaacgttgatgcgggtgatattggcgcaggtaaacatataacatttttatttgaattaacgctgaaagggcaaaaagcatcaattgataagttacgctatgccccggataacaaatcagcgaaatcggacaaaacaaaagaacttgcctggttaaagattcgttggaaatccccacagggaaaagaaagtcagttagttgaattcccgttggcattcgcaataaaggcaccttcagaagatatgcgttttcgcgcagcagtggctgcatatgggcaaaagttacgcggttctgaatacctgaataatacctcctggcagcagatcaaacagtgggctcagaaggcaaaaggggaagatccacagggttacagagcggaatttattcgcctgattggactggcgaaagatctggacaattcacaaaactaa

SEQ ID NO: 5474 - protein, 580 aa, Escherichia coli
MRNKNIIMLLISSLILSGCGPEPEDKKSQQQQSTTPTDQQVLAAQQAATKVAEQSAAKAAADAKALAQQEVQQYSDKQALLGRLQAAPKYQHAAREKAASQIANPGTARYQQFDDNPVKQVAQNPLATFSLDVDTGSYANVRRFLNQGLLPPPDAVRVEEIVNYFPSDWDIKDKQSIPASKPIPFAMRYELAPAPWNEQRTLLKVDILAKDRKSEELPASNLVFLIDTSGSMISDERLPLIQSSLKLLVKELREQDNIAIVTYAGDSRIALPSISGSHKAEINAAIDSLDAEGSTNGGAGLEMAYQQAAKGFIKGGINRILLATDGDFNVGIDDPKSIESMVKKQRESGVTLSTLGVGDSNYNEAMMVRIADVGNGNYSYIDTLSEAQKVLNSEMRQTLITVAKDVKAQIEFNPAWVTEYRQIGYEKRQLRAEDFNNDNVDAGDIGAGKHITFLFELTLKGQKASIDKLRYAPDNKSAKSDKTKELAWLKIRWKSPQGKESQLVEFPLAFAIKAPSEDMRFRAAVAAYGQKLRGSEYLNNTSWQQIKQWAQKAKGEDPQGYRAEFIRLIGLAKDLDNSQN

SEQ ID NO: 5475 - DNA, 978 bp, Escherichia coli
ttgcatatgaaaaaaataaattttgcttttattatattatttctgttttcactccctctgattattttttaccaaccctgggtgaatgcattaccgccaatgccccgacacgcaagtcctgagcaattagaaaaaacagttcgttatcttacacaaacagtgcatccacgtagcgccgacaatattgataatctgaataggtccgcagagtatataaaagaggtctttatcagtaacggtgccagagttaccgcgcaggatgtccccattacgggtggcccctacaaaaacattgttgctaattatggtcctgccgatggaccgctgattattattggtgcgcactatgactctgtcagtagttatgaaaacgatcaattgacctatacgccgggcgcggatgataacgccagcggcgtggcaggattactcgaactggcacgtttgttacagcagcagactccagggattggcgtccaactggtcgcctatgcgtcggaagaaccgcccttctttcgtagcgatgaaatggggagcgcggtacatgcagcttcgcttgagcgtccagtgaaattaatgatagcgctggagatgattggttattacgactctacgcctggtagccaggattacccttacccggcaatgtcctggctttatcccgatcggggagactttattgccgtggtcggcagaatgcaggatatcaacgccgttcgtcaggtaaaagcggcattgttgtcatcccgggatttatctgtttattctatgaatgccccaggttttattcccggtattgatttctctgatcaccttaattattggcaacacgatattcccgccgtaatgattactgacaccgctttttatcgtaataagcaataccacttgcccggtgatatcgcagacagattaaattatcagaaaatggctcaggtagtggatggagttacaaccttgttatacaacagtaaataa

SEQ ID NO: 5476 - protein, 325 aa, Escherichia coli
MHMKKINFAFIILFLFSLPLIIFYQPWVNALPPMPRHASPEQLEKTVRYLTQTVHPRSADNIDNLNRSAEYIKEVFISNGARVTAQDVPITGGPYKNIVANYGPADGPLIIIGAHYDSVSSYENDQLTYTPGADDNASGVAGLLELARLLQQQTPGIGVQLVAYASEEPPFFRSDEMGSAVHAASLERPVKLMIALEMIGYYDSTPGSQDYPYPAMSWLYPDRGDFIAVVGRMQDINAVRQVKAALLSSRDLSVYSMNAPGFIPGIDFSDHLNYWQHDIPAVMITDTAFYRNKQYHLPGDIADRLNYQKMAQVVDGVTTLLYNSK

SEQ ID NO: 5477 - DNA, 504 bp, Escherichia coli
atgggaatgattggctattttgcagaaattgactcagaaaagattaaccaactgcttgagtctactaaaaaacctttgatggataatatacatgacacgctttcaggattacgccgactggatattgataaacgctgggattttttacactttgggctgacaggcacctctgcttttgatcccgcgaagaatgacccgctgagtcgcgccgtgcttggtgaacacagcctagaagatggcatagatggcttcctgggattgacctggaatcaggagttagccgcgacaatcgaccgactggaatcactggatcgaagtgagctgcgtaaacagttttccattaagcgactcaatgaaatggagatttatccgggagtaaccttttcagaagagttagaggggcaactctttgcttcgatcatgcttgatatggaaaagctgattagcgcgtatcgacgtatgctgcgacaagggaatcatgcgctgacggttattgttgggtga

SEQ ID NO: 5478 - protein, 167 aa, Escherichia coli
MGMIGYFAEIDSEKINQLLESTKKPLMDNIHDTLSGLRRLDIDKRWDFLHFGLTGTSAFDPAKNDPLSRAVLGEHSLEDGIDGFLGLTWNQELAATIDRLESLDRSELRKQFSIKRLNEMEIYPGVTFSEELEGQLFASIMLDMEKLISAYRRMLRQGNHALTVIVG

SEQ ID NO: 5479 - DNA, 1458 bp, Escherichia coli
atgacaataactccacaaaacctgatcgcactgctaccgttgctgatcgtcggcttgacggtggtggttgtgatgctctccattgcgtggcgacgcaatcatttcctcaacgctacgctctcggttattgggcttaacgcggcgctggtttcgctctggtttgtcggccaggcgggcgctatggacgttacgccgctgatgcgcgttgatggtttcgccatgctttacaccgggctggtattgttggcgagcctcgccacctgtactttcgcctacccgtggcttgaaggctataacgacaacaaggacgagttctacctgttggtgttaattgccgcgctgggcgggatcctgctggcgaatgccaaccatctggcgtctctgttcctcggtatcgaactgatctctttgccgctgtttggcctggtcggttacgctttccgccagaaacgttcgctggaagccagtatcaaatacaccatcctttctgccgcagcgtcttctttcctgctgttcggtatggcgctggtgtatgcgcagtctggcgacctgtcgtttgtcgcactgggtaaaaacctcggcgacggtatgctcaacgagccgctgttgctggcaggttttggcctgatgattgttggcctcggtttcaaactctctctggtgccgttccacctgtggacgccagacgtataccagggcgcgcctgcgccggtttccactttcctggcgacggcgagcaaaatcgctatcttcggcgtggtgatgcgtttgttcctttacgcaccggtgggtgacagtgaagcgattcgcgtagtgctggcgattatcgcctttgcctccatcatcttcggtaacctgatggcgctgagccagaccaatatcaaacgtctgctcggttactcatctatctctcacctcggctatctgctggtggcgctgattgcgctgcaaaccggcgagatgtcgatggaagcggtaggggtttacctggtcggttatctgttcagcagcctcggcgcgttcggcgtggtcagcctgatgtccagcccgtatcgtggcccggatgctgattccctgttctcttaccgcggtctgttctggcatcgtccgatcctcgcggcagtgatgacggtgatgatgctttcactggctggtatcccaatgacgctgggctttatcggtaagttctacgtgctggcggtcggtgtccaggcacacttgtggtggctggtgggtgccgtggttgttggttcggcaatcggcctttactactacctgcgcgtggcggtgagcttatacctgcacgctccggaacaaccgggtcgcgatgcaccatcaaactggcagtacagcgcaggcggtatcgtggtgctgatctctgcactgttggtactggtgctgggtgtatggccacaaccgctgattagcattgtgcggttagcaatgccgctgatgtaa

SEQ ID NO: 5480 - protein, 485 aa, Escherichia coli [sequence omitted]

SEQ ID NO: 5481 - DNA, 1530 bp, Escherichia coli
atgttactaccctggctaatattaattccctttatcggcggcttcctgtgctggcagaccgaacgctttggcgtcaaggtgccgcgctggatcgcgctggtaaccatgggattgacgctggcgctgtcgctgcaactgtggttgcagggcggttattcactgacgcaatccgccggaattccgcagtggcagtctgaattcgacatgccgtggatcccgcgttttggtatctctattcatctcgccattgacggtctgtcgttgctgatggtcgtgctgaccggtctgctcggtgtgctggcggtactctgttcgtggaaagagatcgaaaaatatcagggcttcttccacctcaacctgatgtggatcctgggcggcgttatcggcgtgttccttgccatcgacatgttcctgttcttcttcttctgggaaatgatgctggtgccgatgtacttcctgatcgcactgtgggggcataaagcctctgacggtaaaacgcgtatcacggcggcaaccaagttcttcatttacacccaggcgagtggtctggtgatgttgatcgccatcctggcgctggttttcgttcactacaatgcgaccggcgtctggaccttcaactatgaagagctgctgaatacgccgatgtctaacggcgtggaatacctgttgatgctgggcttcttcatcgccttcgcagtgaaaatgccggtggttccgctgcatggctggttaccggatgcgcactcccaggcaccgaccgccggttccgttgacctcgcggggatcttgctgaaaaccgccgcttacggtctgttgcgtttctccttgccgctgttcccgaacgcgtcggcagagtttgcgccaatcgccatgtggctgggtgttatcggcatcttctatggtgcgtggatggccttcgcccagaccgatatcaaacgtctgatcgcctacacctcggtttcccacatgggcttcgtgctgattgctatctacaccggcagccagttggcctaccagggcgcggtaatccagatgattgcgcacggcttgtcggcggcgggtctgtttattctttgtggtcagctttatgaacgtatccatacccgcgacatgcgcatgatgggcggtctgtggagcaaaatgaaatggctgccagcactgtcgctgttctttgcggtggcaacgcttgggatgcctggcaccggtaacttcgtcggcgaatttatgattctgttcggcagcttccaggttgtcccggtgattaccgttatctctacctttgggctggtctttgcatctgtttattcgctggcgatgctgcatcgcgcttacttcggcaaagcgaaaagccagattgccagccaggaactgccagggatgtcgctgcgtgagctgtttatgatcctgttgctggtggtgctgctggtactgctgggcttctatccgcagccgattctggatacctcgcactccgcgattggcaatatccagcagtggtttgttaattccgttactactacaaggccgtaa

SEQ ID NO: 5482 - protein, 509 aa, Escherichia coli
MLLPWLILIPFIGGFLCWQTERFGVKVPRWIALVTMGLTLALSLQLWLQGGYSLTQSAGIPQWQSEFDMPWIPRFGISIHLAIDGLSLLMVVLTGLLGVLAVLCSWKEIEKYQGFFHLNLMWILGGVIGVFLAIDMFLFFFFWEMMLVPMYFLIALWGHKASDGKTRITAATKFFIYTQASGLVMLIAILALVFVHYNATGVWTFNYEELLNTPMSNGVEYLLMLGFFIAFAVKMPVVPLHGWLPDAHSQAPTAGSVDLAGILLKTAAYGLLRFSLPLFPNASAEFAPIAMWLGVIGIFYGAWMAFAQTDIKRLIAYTSVSHMGFVLIAIYTGSQLAYQGAVIQMIAHGLSAAGLFILCGQLYERIHTRDMRMMGGLWSKMKWLPALSLFFAVATLGMPGTGNFVGEFMILFGSFQVVPVITVISTFGLVFASVYSLAMLHRAYFGKAKSQIASQELPGMSLRELFMILLLVVLLVLLGFYPQPILDTSHSAIGNIQQWFVNSVTTTRP

SEQ ID NO: 5483 - DNA, 1542 bp, Escherichia coli
atgtacgcctcctggtatatgcgcggtgaagagggctactctcgcttcttcgcttacaccaacctgttcatcgccagcatggtagttctggtgcttgccgacaacctgctgctgatgtacctcggctgggaaggcgtgggcctgtgctcctatctgctgatcggtttctattacaccgatccgaagaatggcgcagcggcaatgaaagcgttcgtcgtgacccgtgtgggtgacgtcttcctcgctttcgcgctgttcattctttacaacgaactgggcaccctgaacttccgcgaaatggtggaactggcaccagcgcactttgctgacggcaataacatgctgatgtgggcgacgctgatgctgctgggcggtgcggtcggtaaatctgctcagttgccgttgcagacatggcttgccgacgcgatggcgggcccgacgcctgtctccgcgctgatccacgccgcaacaatggtaaccgcgggtgtctacctgatcgcccgtacccacggtctgttcctgatgacgccggaagttctgcatctggtgggcattgttggggcggttacgctgctgctggccggttttgcggcgctggtacagaccgacatcaaacgtgttctcgcttactctaccatgagccagattggctacatgttcctcgcgcttggcgtgcaggcatgggatgcggcgattttccacttgatgacccacgcgttctttaaagcactgctgttcctggcatccggttccgtcattctggcctgccatcacgaacagaacatctttaagatgggtggtctgcgtaaatctattccgctggtttatctctgcttcctggtgggcggcgcagcactgtcggcactgccgctggtcactgcgggcttcttcagtaaggatgagatcctcgcgggtgcgatggcgaatggacatatcaatctgatggtggcaggtctggtcggtgcatttatgacctcgctttacaccttccgtatgattttcatcgtcttccacggaaaagaacaaattcacgctcacgccgtgaaaggggtaactcacagcctgccgctgattgtgctgctgatcctttccaccttcgttggcgcactgattgtaccgccgctgcagggcgtgcttccgcaaacgacggagctggcgcacggcagcatgttgaccctggaaattacctctggcgtggtcgcggtggtcggcattctgctggctgcctggctatggctgggtaaacgtactctggtgacctccatcgccaacagtgcgccgggccgtctgctgggtacctggtggtacaacgcctggggctttgactggctgtacgacaaagtgttcgtcaagccgttcctgggtattgcctggttgctgaaacgcgatccgctgaactcaatgatgaacatcccggctgtcctttcccgctttgcaggtaaaggtctgctgttaagcgagaacggttatctgcgctggtatgtggcatccatgagcatcggtgcggtcgtggtgctggcactgttgatggtactgcgttga

SEQ ID NO: 5484 - protein, 513 aa, Escherichia coli
MYASWYMRGEEGYSRFFAYTNLFIASMVVLVLADNLLLMYLGWEGVGLCSYLLIGFYYTDPKNGAAAMKAFVVTRVGDVFLAFALFILYNELGTLNFREMVELAPAHFADGNNMLMWATLMLLGGAVGKSAQLPLQTWLADAMAGPTPVSALIHAATMVTAGVYLIARTHGLFLMTPEVLHLVGIVGAVTLLLAGFAALVQTDIKRVLAYSTMSQIGYMFLALGVQAWDAAIFHLMTHAFFKALLFLASGSVILACHHEQNIFKMGGLRKSIPLVYLCFLVGGAALSALPLVTAGFFSKDEILAGAMANGHINLMVAGLVGAFMTSLYTFRMIFIVFHGKEQIHAHAVKGVTHSLPLIVLLILSTFVGALIVPPLQGVLPQTTELAHGSMLTLEITSGVVAVVGILLAAWLWLGKRTLVTSIANSAPGRLLGTWWYNAWGFDWLYDKVFVKPFLGIAWLLKRDPLNSMMNIPAVLSRFAGKGLLLSENGYLRWYVASMSIGAVVVLALLMVLR

SEQ ID NO: 5485 - DNA, 330 bp, Escherichia coli
atgaacatgcttgccttaaccattattttgccattgattggcttcgtcctgctggcgttctcccgtgggcgctggtctgaaaacgtctcggcgatcgtcggcgttggctctgtgggcctggcggcgctggtaactgcctttatcggcgttgacttcttcgctaacggtgagcaggcatacagccagccgctgtggacgtggatgtcggtaggcgactttaacatcggttttaacctggtgctggacggcctgtcgctgaccatgcttctcggtggtcactggtgtgggtttccttattcacatgtacgcctcctggtatatgcgcggtga

SEQ ID NO: 5486 - protein, 109 aa, Escherichia coli
MNMLALTIILPLIGFVLLAFSRGRWSENVSAIVGVGSVGLAALVTAFIGVDFFANGEQAYSQPLWTWMSVGDFNIGFNLVLDGLSLTMLLGGHWCGFPYSHVRLLVYAR

SEQ ID NO: 5487 - DNA, 303 bp, Escherichia coli
atgatccccttacaacatggactgatcctcgcggcaatcttattcgttcttggcttaaccggtctggttatccgtcgcaatctgctgtttatgctgattggtctggaaatcatgattaacgcctctgcgctggcctttgtggtcgccggaagctactggggccagaccgacggtcaggtgatgtacattctcgccatcagcctcgcggcggcggaagcgagtatcggccttgcgctgctgctgcaacttcaccgtcgtcgccagaacctgaacatcgattcagtaagtgagatgcgcggatga

SEQ ID NO: 5488 - protein, 100 aa, Escherichia coli
MIPLQHGLILAAILFVLGLTGLVIRRNLLFMLIGLEIMINASALAFVVAGSYWGQTDGQVMYILAISLAAAEASIGLALLLQLHRRRQNLNIDSVSEMRG

SEQ ID NO: 5489 - DNA, 555 bp, Escherichia coli
atggagttcgctttttatatctgtggcctgatagccatacttgcgaccttgcgagtgatcacccataccaatccggtacacgcgctgctgtacctgattatttcgctgctggcgatctctggggtgttcttctcactgggcgcttacttcgccggtgcgctggaaattatcgtctatgcgggtgccattatggtgctgttcgtgttcgtggtgatgatgctcaacctgggcggttcagaaatcgaacaggaacgccagtggctgaaaccgcaggtgtggattggtccggcgattttgtcagccatcatgctggtggtgattgtttacgccattctcggtgttaacgatcaaggtatcgacggtacgccaatcagtgctaaagcagtgggtattacgctgttcgggccttacgtactggcggtggaactggcttctatgctgctgctcgcgggtctggttgtggccttccacgtcggtcgtgaagagcgtgcgggtgaagtgctgagcaatcgtaaagacgacagcgcgaaaagaaaaacggaggagcacgcatga

SEQ ID NO: 5490 - protein, 184 aa, Escherichia coli
MEFAFYICGLIAILATLRVITHTNPVHALLYLIISLLAISGVFFSLGAYFAGALEIIVYAGAIMVLFVFVVMMLNLGGSEIEQERQWLKPQVWIGPAILSAIMLVVIVYAILGVNDQGIDGTPISAKAVGITLFGPYVLAVELASMLLLAGLVVAFHVGREERAGEVLSNRKDDSAKRKTEEHA

SEQ ID NO: 5491 - DNA, 543 bp, Escherichia coli
atgaccttaaaagaattgttagtaggtttcggcacccaggttcgtagtatctggatgatcggcctgcacgcgttcgccaaacgcgaaacgcgaatgtacccggaagagccggtctatctgccgccccgttatcgtggtcgtatcgttctgacccgcgatccggacggcgaagagcgttgcgtagcctgtaacctctgcgcggtagcctgcccggtcggctgtatctcgctgcaaaaagcagaaaccaaagacggtcgctggtatccggaatttttccgcatcaacttctcacgctgcattttctgtggtctgtgcgaagaagcctgtccgaccacggcgattcagttaaccccggatttcgaaatgggggaatacaagcgccaggatctggtttacgagaaagaggatctgctgatctccggtccgggcaaatacccggaatataacttctaccggatggcaggtatggcaatcgacggcaaagataagggcgaagcagagaacgaagccaagcctatcgacgtcaagagcctgttaccgtaa

SEQ ID NO: 5492 - protein, 180 aa, Escherichia coli
MTLKELLVGFGTQVRSIWMIGLHAFAKRETRMYPEEPVYLPPRYRGRIVLTRDPDGEERCVACNLCAVACPVGCISLQKAETKDGRWYPEFFRINFSRCIFCGLCEEACPTTAIQLTPDFEMGEYKRQDLVYEKEDLLISGPGKYPEYNFYRMAGMAIDGKDKGEAENEAKPIDVKSLLP

SEQ ID NO: 5493 - DNA, 978 bp, Escherichia coli
atgagttggatatcaccggaactgattgagatcctgctgaccgtccttaaagcggtggtgatcctgctggtggtagtcacctgtggggcattcatgagctttggcgaacgtcgcctgctgggtctgttccagaaccgttatggacctaaccgtgttggctggggcggttcgctccagctggttgcggacatgatcaaaatgttctttaaagaagactggatcccgaaattctcggatcgtgtcatctttaccctggcaccgatgattgcctttacctcgctgctgctggcctttgcaattgtgccagtcagtccgggttgggtggttgccgacctgaacatcgggattttgttcttcctgatgatggcaggtctggcggtttacgcggtgctgtttgcgggctggtcaagtaacaacaaatattcgctgctgggggcgatgcgtgcttctgcgcagaccctgagctacgaagtgttcctcgggctttccctgatgggcgtggtggcgcaggccggttcattcaacatgaccgacatcgtcaatagccaggcgcatgtgtggaacgtcatcccgcaattctttggttttattacctttgccatcgcgggcgtggcggtgtgtcaccgtcacccgtttgaccagccggaagccgagcaggaactggcggatggttaccacattgaatattccggtatgaagttcggtctgttcttcgtgggcgaatacatcgggattgtgaccatctctgcactgatggtgacgctgttcttcggtggctggcaaggcccgttgttaccgccattcatctggttcgcgctgaaaaccgcgttctttatgatgatgttcattttgattcgtgcgtcgttaccgcgtccgcgttatgaccaggtaatgtccttcggctggaaaatctgcctgccgctgacgctgatcaacttgctggtaacggcggctgtcattctctggcaggcgcaataa

SEQ ID NO: 5494 - protein, 325 aa, Escherichia coli
MSWISPELIEILLTVLKAVVILLVVVTCGAFMSFGERRLLGLFQNRYGPNRVGWGGSLQLVADMIKMFFKEDWIPKFSDRVIFTLAPMIAFTSLLLAFAIVPVSPGWVVADLNIGILFFLMMAGLAVYAVLFAGWSSNNKYSLLGAMRASAQTLSYEVFLGLSLMGVVAQAGSFNMTDIVNSQAHVWNVIPQFFGFITFAIAGVAVCHRHPFDQPEAEQELADGYHIEYSGMKFGLFFVGEYIGIVTISALMVTLFFGGWQGPLLPPFIWFALKTAFFMMMFILIRASLPRPRYDQVMSFGWKICLPLTLINLLVTAAVILWQAQ

SEQ ID NO: 5495 - DNA, 2727 bp, Escherichia coli
atggctacaattcatgtagacggcaaagaatacgaggtcaacggagcggacaacctgctggaagcttgtctgtctctgggccttgatattccttacttttgctggcatccggcgctgggaagcgtcggtgcttgccgccagtgtgcggtgaagcaataccaaaacgcggaagacacgcgtggtcgcctggtgatgtcctgtatgacaccggcttccgatggcacctttatttccattgacgacgaagaagcgaaacagttccgtgaaagtgtggtcgagtggttaatgaccaaccacccgcacgactgtccggtatgtgaagagggcggtaactgccatcttcaggatatgactgtgatgaccggacacagcttccgtcgctaccgtttcaccaaacgtacccaccgtaatcaggatttagggccgttcatctctcacgaaatgaaccgctgcatcgcctgctaccgctgtgtgcgttactacaaagattacgctgacggtacggacctgggcgtttacggtgcgcacgacaacgtctacttcggtcgcccggaagacggcacgctggaaagcgaattttccggtaacctggtcgaaatttgcccgaccggcgtatttaccgacaaaacgcactccgagcgttacaaccgtaaatgggatatgcagtttgcgccgagcatctgccagcaatgttccatcggctgtaacatcagccccggcgagcgttatggcgaactgcgtcgtatcgaaaaccgttacaacggtacggtaaaccactacttcctctgcgaccgtggtcgtttcggttacggctacgtcaacctgaaagatcgtccgcgtcagccagtacagcgtcggggcgatgatttcattaccctcaacgccgaacaggcaatgcagggcgcagcagatattctgcgtcagtcgaagaaagtgatcggcattggttctccgcgcgccagcgtggaaagcaactttgcgctgcgtgagctggtgggcgaagaaaacttctacaccggtatcgctcacggtgagcaggaacgtctgcaactggcgctgaaagtgctgcgtgaaggcggcatttatactccggctctgcgcgaaatcgaatcttacgatgcggtactggtgctgggcgaagacgttacccagaccggcgcgcgcgtcgcgctggcagttcgtcaggcggtgaaaggtaaagcgcgcgaaatggcggcagcacagaaagtggctgactggcagattgcggcaatcctcaacatcggccaacgtgcgaagcatccgctgtttgttaccaacgttgatgacacccgtctggatgatatcgcggcgtggacttaccgcgcaccggttgaagatcaggcgcgtttaggttttgccatcgcccatgcgctggataactccgcgccagcggttgacggtattgaacctgagctgcaaagcaaaatcgacgtcatcgtgcaggcactggcaggtgcgaagaaaccgttgattatctccgggacgaacgccggtagcgctgaagtgattcaggctgcggctaacgtggcgaaagccctgaaaggtcgcggcgctgacgtcggtatcaccatgattgcccgttccgtcaacagcatggggctgggcattatgggcggtggatcgcttgaagaagcgttaaccgaactggaaaccggacgcgccgacgcggtggtggtgctggaaaacgatctgcatcgtcacgcttccgctacccgcgtgaatgctgcgctggctaaagcgccgctggtgatggtggttgaccatcaacgcacagcgattatggaaaacgcccatctggtactttctgctgccagctttgctgaaagcgacggtacggtgattaacaacgaaggccgtgcccaacgtttcttccaggtttacgatccggcttattacgacagcaaaactgtcatgctggaaagctggcgttggttacactcgctgcacagcaccttgctgagccgtgaagtggactggacgcagctcgaccacgtgattgacgctgttgtggcgaaaatcccggaactggcaggtatcaaagatgctgcgccggatgcgacattccgtattcgtgggcagaaactggcccgtgaaccgcatcgctatagcggtcgtaccgccatgcgcgccaatatcagcgttcatgagccgcgtcagccgcaggatattgacaccatgttcaccttctcgatggaaggtaacaaccagccgaccgcgcaccgttcgcaagtgccgtttgcctgggcgccaggctggaactccccgcaggcgtggaacaaattccaggacgaagtgggcggcaaactgcgttttggcgatccgggcgtgcgtctgtttgaaaccagcgaaaacggcctggattacttcaccagcgtaccggcacgcttccagccgcaggacgggaaatggcgtatcgcgccgtactaccacctgtttggcagcgatgaattgtcacagcgtgctccggtcttccagagccgtatgccgcagccgtacatcaaactcaacccagcggatgccgcgaagttgggtgtgaacgctggtacacgcgtctcctttagttacgatggcaacacggtcacgctgccggttgaaatcgccgaagggctgacagcagggcaggtgggcttgccgatgggtatgtccggcattgctccggtgctggctggcgcgcatcttgaggatctcaaggaggcacaacaatga

SEQ ID NO: 5496 - protein, 908 aa, Escherichia coli
MATIHVDGKEYEVNGADNLLEACLSLGLDIPYFCWHPALGSVGACRQCAVKQYQNAEDTRGRLVMSCMTPASDGTFISIDDEEAKQFRESVVEWLMTNHPHDCPVCEEGGNCHLQDMTVMTGHSFRRYRFTKRTHRNQDLGPFISHEMNRCIACYRCVRYYKDYADGTDLGVYGAHDNVYFGRPEDGTLESEFSGNLVEICPTGVFTDKTHSERYNRKWDMQFAPSICQQCSIGCNISPGERYGELRRIENRYNGTVNHYFLCDRGRFGYGYVNLKDRPRQPVQRRGDDFITLNAEQAMQGAADILRQSKKVIGIGSPRASVESNFALRELVGEENFYTGIAHGEQERLQLALKVLREGGIYTPALREIESYDAVLVLGEDVTQTGARVALAVRQAVKGKAREMAAAQKVADWQIAAILNIGQRAKHPLFVTNVDDTRLDDIAAWTYRAPVEDQARLGFAIAHALDNSAPAVDGIEPELQSKIDVIVQALAGAKKPLIISGTNAGSAEVIQAAANVAKALKGRGADVGITMIARSVNSMGLGIMGGGSLEEALTELETGRADAVVVLENDLHRHASATRVNAALAKAPLVMVVDHQRTAIMENAHLVLSAASFAESDGTVINNEGRAQRFFQVYDPAYYDSKTVMLESWRWLHSLHSTLLSREVDWTQLDHVIDAVVAKIPELAGIKDAAPDATFRIRGQKLAREPHRYSGRTAMRANISVHEPRQPQDIDTMFTFSMEGNNQPTAHRSQVPFAWAPGWNSPQAWNKFQDEVGGKLRFGDPGVRLFETSENGLDYFTSVPARFQPQDGKWRIAPYYHLFGSDELSQRAPVFQSRMPQPYIKLNPADAAKLGVNAGTRVSFSYDGNTVTLPVEIAEGLTAGQVGLPMGMSGIAPVLAGAHLEDLKEAQQ

SEQ ID NO: 5497 - DNA, 1338 bp, Escherichia coli
atgaaaaacattatccgtactcccgaaacgcatccgctgacctggcgtctgcgcgatgacaaacagccagtgtggctggacgaatatcgcagcaaaaacggttacgaaggcgcgcgtaaggcgctgaccgggttgtctccggacgaaatcgttaatcaggtaaaagactctggtctgaaagggcgcggtggcgcaggcttctcgactggcctgaagtggagcctgatgccgaaagacgaatccatgaatatccgttacctactgtgtaacgccgatgaaatggagccgggcacctataaagaccgtctgctgatggagcaactgccgcacctgctggtggaaggcatgctcatctccgcgtttgcgctgaaagcttaccgtggctatatcttcctgcgcggcgaatatatcgaagcggcagtgaatctacgccgtgccattgccgaagccaccgaagcgggtctgcttggcaaaaacattatgggaacaggttttgatttcgaactgttcgtccataccggggcagggcgctacatctgcggtgaagaaacagcgttaatcaactccctggaagggcgtcgcgctaacccacgctcgaaaccgcccttcccggcaacctccggtgcatggggtaaaccaacctgcgttaacaacgtcgaaaccctgtgtaacgttccggcgatcctcgctaacggcgtggagtggtatcagaacatctcgaaaagtaaagatgctggcaccaagctgatgggcttctctggtcgggtgaaaaatccgggtctgtgggaactgccgttcggcaccaccgcacgcgagatcctcgaagactacgccggtggtatgcgtgacggtctgaaattcaaagcctggcagccaggcggcgcggggactgacttcctgaccgaagcgcaccttgacctgccgatggaattcgaaagtatcggtaaagcgggaagccgtctgggtacggcgctggcgatggcggttgaccacgagatcaacatggtgtcgctggtgcgtaacctggaagagtttttcgcccgtgagtcctgcggctggtgtacgccatgtcgcgacggtctgccgtggagcgtgaaaattctacgtgcgctggagcgtggcgaaggccagccgggcgatatcgaaacacttgagcaactgtgtcgattcttaggcccgggtaaaactttctgtgcccacgcacctggtgcagtggagccgttacagagcgccatcaaatatttccgcgaagaatttgaggcgggaatcaaacagccgttcagcaatacccatttgattaatgggattcagccgaacctgctgaaagagcgctggtaa

SEQ ID NO: 5498 - protein, 445 aa, Escherichia coli
MKNIIRTPETHPLTWRLRDDKQPVWLDEYRSKNGYEGARKALTGLSPDEIVNQVKDSGLKGRGGAGFSTGLKWSLMPKDESMNIRYLLCNADEMEPGTYKDRLLMEQLPHLLVEGMLISAFALKAYRGYIFLRGEYIEAAVNLRRAIAEATEAGLLGKNIMGTGFDFELFVHTGAGRYICGEETALINSLEGRRANPRSKPPFPATSGAWGKPTCVNNVETLCNVPAILANGVEWYQNISKSKDAGTKLMGFSGRVKNPGLWELPFGTTAREILEDYAGGMRDGLKFKAWQPGGAGTDFLTEAHLDLPMEFESIGKAGSRLGTALAMAVDHEINMVSLVRNLEEFFARESCGWCTPCRDGLPWSVKILRALERGEGQPGDIETLEQLCRFLGPGKTFCAHAPGAVEPLQSAIKYFREEFEAGIKQPFSNTHLINGIQPNLLKERW

SEQ ID NO: 5499 - DNA, 501 bp, Escherichia coli
atgcacgagaatcaacaaccacaaaccgaggcttttgagctgagtgcggcagagcgtgaagcgattgagcacgagatgcaccactacgaagacccgcgtgcggcgtccattgaagcgctgaaaatcgttcagaagcagcgtggctgggtgccggatggcgcgatccacgcgatcgccgatgtgctgggtattccggcgagcgacgtcgaaggcgtggcaacgttttatagccagatcttccgtcagccagtaggccgccatgtgatccgttattgcgacagcgtggtctgtcacatcaacggttaccagggtattcaggcggcgctggagaaaaaactgaacatcaaaccagggcaaacgacatttgacggtcgcttcacgctgctgccaacttgctgcctggggaactgtgataaagggccaaacatgatgatcgatgaggacactcacgcgcatctgaccccggaagcgatccctgaactgctggagcggtataaatga

SEQ ID NO: 5500 - protein, 166 aa, Escherichia coli
MHENQQPQTEAFELSAAEREAIEHEMHHYEDPRAASIEALKIVQKQRGWVPDGAIHAIADVLGIPASDVEGVATFYSQIFRQPVGRHVIRYCDSVVCHINGYQGIQAALEKKLNIKPGQTTFDGRFTLLPTCCLGNCDKGPNMMIDEDTHAHLTPEAIPELLERYK

SEQ ID NO: 5501 - DNA, 1803 bp, Escherichia coli
atggtgaacaatatgaccgacttaaccgcgcaagaacccgcctggcagacccgcgatcatcttgatgatccggtgattggcgaactgcgcaaccgttttgggccggatgcctttactgttcaggcgactcgcaccggggttcccgttgtgtggatcaagcgtgaacaattactggaagtgggcgatttcttaaagaaactgccgaaaccttacgtcatgctgtttgacttacacggcatggacgaacgtctgcgcacacaccgcgaagggttacctgccgcggatttttccgttttctaccatctgatttctatcgatcgtaaccgcgacatcatgctgaaggtggcgctggcagaaaacgacctgcacgtaccgacctttaccaaattattcccgaacgctaactggtatgagcgtgaaacctgggatctatttggcattacattcgacggtcacccgaacctgcgccgcatcatgatgccgcaaacctggaaaggtcacccgctgcgtaaagattacccggcgcgcgctaccgaattctcgccgtttgagctgaccaaagccaaacaggatctggagatggaagccctgaccttcaaaccggaagagtgggggatgaagcgcggcaccgaaaatgaggacttcatgttcctcaacctcggtccgaaccacccgtctgcgcacggtgctttccgtatcgttttgcagcttgatggcgaagagattgtcgactgcgtaccagacatcggttaccaccaccgtggtgcggagaaaatgggcgaacgccagtcctggcacagctacattccgtataccgaccgtatcgaatacctcggcggctgcgttaacgaaatgccttatgtgctggcggtagagaaactggctgggatcaccgtgccggatcgcgttaacgtcattcgcgtaatgctctccgaactgttccgcatcaacagtcacctgctgtatatctccacctttattcaggacgtcggcgcgatgacgccagtgttcttcgcctttaccgatcgtcagaaaatttacgatctggtggaagcaatcactggttttcgtatgcacccggcgtggttccgtattggcggcgtagcgcacgacctgccgcgcggctgggatcgcctgctgcgtgagttcctcgactggatgccgaaacgtctggcgtcttacgagaaagcggcgctgcaaaacaccattctgaaaggtcgttcccagggcgttgccgcttacggcgcgaaagaggcgctggagtggggcaccaccggcgcgggcctgcgtgccaccgggatcgacttcgacgtgcgtaaggcgcgtccttattctggctatgaaaacttcgacttcgaaattccggtgggcggtggtgtttctgactgctacacccgcgtaatgctgaaagtagaagagttgcgccagagtctgcgtattcttgagcagtgcctcaacaacatgccggaaggcccgttcaaagcggatcacccgctgaccacgccgccgccgaaagagcgcacgctgcaacatatcgaaaccctgatcacccacttcctgcaagtgtcgtggggtccggtgatgcctgccaatgaatccttccagatggttgaggcgaccaaggggatcaacagttactacctgaccagcgacggcagcaccatgagttatcgcacccgtatccgtacgccgagttatgcgcatttgcagcaaattccggcggcgatccgcggcagcctggtgtctgacctgattgtttatctgggcagtatcgattttgttatgtcagatgtggaccgctaa

SEQ ID NO: 5502 - protein, 600 aa, Escherichia coli
MVNNMTDLTAQEPAWQTRDHLDDPVIGELRNRFGPDAFTVQATRTGVPVVWIKREQLLEVGDFLKKLPKPYVMLFDLHGMDERLRTHREGLPAADFSVFYHLISIDRNRDIMLKVALAENDLHVPTFTKLFPNANWYERETWDLFGITFDGHPNLRRIMMPQTWKGHPLRKDYPARATEFSPFELTKAKQDLEMEALTFKPEEWGMKRGTENEDFMFLNLGPNHPSAHGAFRIVLQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVAHDLPRGWDRLLREFLDWMPKRLASYEKAALQNTILKGRSQGVAAYGAKEALEWGTTGAGLRATGIDFDVRKARPYSGYENFDFEIPVGGGVSDCYTRVMLKVEELRQSLRILEQCLNNMPEGPFKADHPLTTPPPKERTLQHIETLITHFLQVSWGPVMPANESFQMVEATKGINSYYLTSDGSTMSYRTRIRTPSYAHLQQIPAAIRGSLVSDLIVYLGSIDFVMSDVDR

SEQ ID NO: 5503 - DNA, 549 bp, Escherichia coli
atgggcaagctcaatgacatggttaactggggtcgtaaaaactcaatttggccgtataacttcggtctttcctgctgttacgttgagatggtgacttcgtttaccgcggtgcatgacgtggcgcgttttggcgctgaagtattgcgtgcttcgccgcgtcaggctgacctgatggtggttgcaggaacctgctttaccaaaatggcaccggttattcagcgtttgtatgaccagatgctggaaccaaaatgggttatctcaatgggtgcctgtgccaactccggcggtatgtacgatatttattccgttgtgcagggcgttgataaattcatcccggttgatgtgtatatcccgggctgtccgccgcgtcctgaagcgtacatgcaggcactgatgctgttgcaggaatctatcggtaaagaacgtcgtccgctctcctgggtggttggcgatcagggcgtttatcgcgccaatatgcaatcagagcgcgaacgcaagcgcggtgaacgcattgccgttaccaacctgcgtacacctgacgagatttaa

SEQ ID NO: 5504 - protein, 182 aa, Escherichia coli
MGKLNDMVNWGRKNSIWPYNFGLSCCYVEMVTSFTAVHDVARFGAEVLRASPRQADLMVVAGTCFTKMAPVIQRLYDQMLEPKWVISMGACANSGGMYDIYSVVQGVDKFIPVDVYIPGCPPRPEAYMQALMLLQESIGKERRPLSWVVGDQGVYRANMQSERERKRGERIAVTNLRTPDEI

SEQ ID NO: 5505 - DNA, 444 bp, Escherichia coli
atgagtatgtcaacatccactgaagtcatcgctcatcactgggcattcgctatctttcttatcgttgccattggcctgtgttgcctgatgctggtaggcggttggtttttaggcggtcgcgcacgcgcgaggtcaaaaaacgttccgtttgaatccggtatcgactcggtcggctccgcccgcttacgcctgtccgccaagttttatctggtggccatgttcttcgttatcttcgacgttgaagcgctgtatctgttcgcatggtcaacctctatccgcgaaagcggctgggtaggctttgtggaagctgcaatttttatttttgtgttactggcaggtctggtttatctggtgcgtattggcgcgctggactggacgcccgcgcgttcacgccgcgagcgtatgaacccggaaacgaacagtatcgctaatcgtcaacgctaa

SEQ ID NO: 5506 - protein, 147 aa, Escherichia coli
MSMSTSTEVIAHHWAFAIFLIVAIGLCCLMLVGGWFLGGRARARSKNVPFESGIDSVGSARLRLSAKFYLVAMFFVIFDVEALYLFAWSTSIRESGWVGFVEAAIFIFVLLAGLVYLVRIGALDWTPARSRRERMNPETNSIANRQR

SEQ ID NO: 5507 - DNA, 939 bp, Escherichia coli
atgataagtgcaaatcgtccgataattaacctcgacctcgatctgctgagaacatttgttgctgttgccgatctgaacacttttgctgccgcagctgccgctgtgtgtcgtactcagtccgccgtaagtcagcaaatgcagcgtctggaacaactcgttgggaaagaactgttcgctcgtcacggtcgcaacaaactgttaactgaacatggcattcaacttcttggttacgccaggaaaatcctgcgttttaatgatgaggcctgctcatcattaatgttcagtaatcttcagggcgtgttaactatcggtgcttcagatgaatctgccgatacgatcttacctttcctgttaaatcgcgtgagttcggtttatccgaaactagcgctggatgtccgcgttaaacgtaatgcctacatggcagaaatgctggaatcccaggaagtggatttgatggtaaccacccatcgtccttctacctttaaggcattgaacctgcgtacctcgccaacacactggtactgcgcagcggaatacgtattgcaaaaaggtgagccgatccctcttgtgttgctggatgatccaagtccgtttcgcgatatggtgctggcgacgcttaataaagcagatattccctggcgactggcttatgtcgcctcgacgcttccggccgttcgtgcggcagtgaaagccggtcttggcgtgacggcaaggccggtcgagatgatgagtccggacctgcgtgtgctgagtggagtagatggcttaccgccgctacctgataccgaatatttgctgtgctatgacccgtccagtaataatgagctggcccaggtgatctatcaggcgatggagagctaccataatccgtggcaatacagcccaatgtctgctccggaaggagatgactcattgttgattgaaagggatatcgagtaa

SEQ ID NO: 5508 - protein, 312 aa, Escherichia coli
MISANRPIINLDLDLLRTFVAVADLNTFAAAAAAVCRTQSAVSQQMQRLEQLVGKELFARHGRNKLLTEHGIQLLGYARKILRFNDEACSSLMFSNLQGVLTIGASDESADTILPFLLNRVSSVYPKLALDVRVKRNAYMAEMLESQEVDLMVTTHRPSTFKALNLRTSPTHWYCAAEYVLQKGEPIPLVLLDDPSPFRDMVLATLNKADIPWRLAYVASTLPAVRAAVKAGLGVTARPVEMMSPDLRVLSGVDGLPPLPDTEYLLCYDPSSNNELAQVIYQAMESYHNPWQYSPMSAPEGDDSLLIERDIE

SEQ ID NO: 5509 - DNA, 111 bp, Escherichia coli
atgatgatatttccgcattacggagagtttaacagcgtgatgatttccgaggtgtcacaatgggggcaaggcgtgaaactattgttaagcggaattaatgaatggggatga

SEQ ID NO: 5510 - protein, 36 aa, Escherichia coli
MMIFPHYGEFNSVMISEVSQWGQGVKLLLSGINEWG

SEQ ID NO: 5511 - DNA, 1218 bp, Escherichia coli
atgtcccccattgaaaaatccagcaaattagagaatgtctgttatgacatccgtggtccggtgctgaaagaagcaaaacgcctggaagaagaaggtaacaaggtactgaaactgaacatcggcaaccctgccccgttcggttttgacgcgccagatgaaattctcgttgacgtgatacgcaacctgcctaccgctcaagggtattgcgattccaaaggtctttactccgcgcgtaaagccatcatgcagcactaccaggctcgtggcatgcgtgatgttaccgtggaagatatttacatcggcaatggtgtatcggagcttatcgttcaggcaatgcaggcattgctgaacagcggggacgaaatgttggttcctgcacctgattacccactatggaccgcagcggtttcgctctccagcggtaaagcggtgcattatctttgcgatgaatcctctgactggttcccagacctcgatgatattcgcgctaaaattacgcctcgtacgcgtgggatcgttattatcaacccaaataacccaaccggcgcggtatattccaaagagcttttaatggagattgtggagattgcacgtcagcataatctcattatcttcgccgatgaaatttatgacaaaattctctacgacgacgctgagcatcactccattgcgccgctggcacctgacctgctgaccattacctttaacggactgtcgaaaacgtaccgcgttgcaggcttccgtcaggggtggatggtgttgaacgggccgaaaaaacacgccaaaggttacatcgaaggtctggaaatgctggcttcaatgcgcctgtgtgctaacgttcctgcgcaacacgccattcagaccgcactgggtggttatcagagcatcagtgaatttattacccctggcggtcgtctttatgagcagcgtaaccgcgcgtgggaattgatcaacgatattccgggcgtttcctgcgtgaaacctcgtggtgcgctgtatatgttcccgaaaatcgacgccaaacgctttaacattcacgacgatcagaaaatggtgctggatttcctgttgcaggaaaaagtcctgttggtgcaagggacggcattcaactggccgtggccggatcacttccgcattgtcacgctaccgcgtgtcgatgatatcgagctgtctttgagcaagttcgcgcgtttcctttctggttatcatcagctgtaa

SEQ ID NO: 5512 - protein, 405 aa, Escherichia coli
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPRGALYMFPKIDAKRFNIHDDQKMVLDFLLQEKVLLVQGTAFNWPWPDHFRIVTLPRVDDIELSLSKFARFLSGYHQL

SEQ ID NO: 5513 - DNA, 600 bp, Escherichia coli
atgaaacagagccatttttttgcccatctctcccgcctgaaactcattaaccgctggccgctaatgcgcaacgtgcggacggaaaatgtgtccgaacacagtttgcaggtagcgatggtcgcccatgcgctggcagctatcaaaaatcgtaaatttggcggtaatgtcaacgccgaacgtatcgctttactggcgatgtaccacgatgcttcagaagtgctcaccggagatctccctactccggtgaaatacttcaattcgcaaatcgctcaggaatacaaggctattgaaaaaatcgctcagcaaaaactggtcgatatggttccggaagagctgcaggatatctttgcgccgttaattgacgagcatgcatatagcgatgaagaaaaatcgctggtgaaacaggcagatgcactgtgtgcatatctgaaatgcctggaagaacttgcggccggaaataatgaattcttgctggcaaaaacgcgactggaagcgacgcttgaagcgcgccgcagccaggagatggactacttcatggaagtatttgttcccagcttccatctttcgctcgatgagattagccaggattcaccgctgtaa

SEQ ID NO: 5514 - protein, 199 aa, Escherichia coli
MKQSHFFAHLSRLKLINRWPLMRNVRTENVSEHSLQVAMVAHALAAIKNRKFGGNVNAERIALLAMYHDASEVLTGDLPTPVKYFNSQIAQEYKAIEKIAQQKLVDMVPEELQDIFAPLIDEHAYSDEEKSLVKQADALCAYLKCLEELAAGNNEFLLAKTRLEATLEARRSQEMDYFMEVFVPSFHLSLDEISQDSPL

SEQ ID NO: 5515 - DNA, 1833 bp, Escherichia coli
gtgaacggtgaattgatttgggttctttcattactggccgttgccatcgtcttgtttgcgacgggcagagtgcgtatggatgcggtcgctttgtttgttattgtcgcgtttgcattaagcggaacgctgacggtccccgaagtattttccggcttttccgatcctaacgttgtcctgattgccgccttgtttattattggcgatggtttggtccgtaccggtgttgccactgtaatggggacatggctggtcaaagtggcgggcaacagtgaaatcaaaatgttggttttgttgatgctgaccgtcgcggggcttggcgcgtttatgagttcaaccggcgttgtcgctatctttattcccgtggtgttaagcgttgccatgcgtatgcaaacgtcgccgtcgcgcctgatgatgccgttaagttttgccgggctgataagcggcatgatgacgctggtggcgacgccgccgaacctggtagtcaacagtgaattgctgcgtgaaggctatcatggttttagtttctttagcgtaacacctattggcctggtcgtgctggtgctgggtattttgtatatgttagtgatgcgtttcatgctgaaaggggatacccagaccccgcagcgcgaaggctggacgcgccgaacctttcgcgatcttatccgtgaatatcgactgaccgggcgtgcgcgacgtctggctattcgccccggatcgccaatgattggtcaacggctggacgatctcaaattacgtgaacgttatggtgctaacgtcatcggtgttgaacgctggcggcgttttcgtcgcgttatcgtgaacgttaatggggtttctgaatttcgcgcgcgtgacgttttgcttattgatatgtctgcggctgatgtcgatctccggcaattttgtagtgagcaattgctggagccgatggtactgcgcggcgagtatttttctgaccaggcccttgatgtgggcatggcagagatttcattaattcctgagtcagaacttattggtaaatcggtgcgcgaaattggttttcgtacccgctacggattgaatgtagtggggctaaagcgcaatggcgtggcgctggaaggttcgctggcggatgagcctctgctgctgggcgatatcatcctggttgtgggtaactggaaactgatcggtatgctggccaaacagggccgcgacttcgtagcgctgaacttaccggaagaggtgagtgaagcatcgcccgcgcacagccaggcaccccatgcgattttctgtctggtgctaatggtggcgttaatgctgaccgatgaaattcctaatcctgttgccgctattatcgcctgcctgctgatggggaaattccgctgtatagatgctgaaagcgcctataaatccattcactggccgagcattattttgatcgttgggatgatgccatttgctgtggcattacagaaaacgggaggtgtcgcgctggcggtgaaagggctgatggacattggcggcggttacgggccacatatgatgctgggttgtttgtttgtcttgtcagcggttattgggctatttatctctaataccgcgacggcggtgttgatggctccgattgcgctggctgctgccaaaacgatgggtgtgtcgccttatccatttgcgatggtcgtggcgatggcagcatccgccgcctttatgacgccggtttcttcaccggttaacacactggttttaggtccgggaaattacagcttcagtgactttgtgaagttgggggtaccgttcaccattatcgtgatggcggtttgtgtggtgatgatcccgatgctgtttccgttttga

SEQ ID NO: 5516 - protein, 610 aa, Escherichia coli
MNGELIWVLSLLAVAIVLFATGRVRMDAVALFVIVAFALSGTLTVPEVFSGFSDPNVVLIAALFIIGDGLVRTGVATVMGTWLVKVAGNSEIKMLVLLMLTVAGLGAFMSSTGVVAIFIPVVLSVAMRMQTSPSRLMMPLSFAGLISGMMTLVATPPNLVVNSELLREGYHGFSFFSVTPIGLVVLVLGILYMLVMRFMLKGDTQTPQREGWTRRTFRDLIREYRLTGRARRLAIRPGSPMIGQRLDDLKLRERYGANVIGVERWRRFRRVIVNVNGVSEFRARDVLLIDMSAADVDLRQFCSEQLLEPMVLRGEYFSDQALDVGMAEISLIPESELIGKSVREIGFRTRYGLNVVGLKRNGVALEGSLADEPLLLGDIILVVGNWKLIGMLAKQGRDFVALNLPEEVSEASPAHSQAPHAIFCLVLMVALMLTDEIPNPVAAIIACLLMGKFRCIDAESAYKSIHWPSIILIVGMMPFAVALQKTGGVALAVKGLMDIGGGYGPHMMLGCLFVLSAVIGLFISNTATAVLMAPIALAAAKTMGVSPYPFAMVVAMAASAAFMTPVSSPVNTLVLGPGNYSFSDFVKLGVPFTIIVMAVCVVMIPMLFPF

SEQ ID NO: 5517 - DNA, 651 bp, Escherichia coli
gtgcggtgcaaaggttttctgtttgatcttgatggaacgctggtggattccctgcctgcggtagaacgggcgtggagcaactgggccagacgtcatgggttatcgccggaagaggtgctggctttcattcacggtaaacaggcgatcacctctctgcgccattttatggcgggcaaatccgaggcagacattgccgccgagtttacgcgtctggagcacatcgaggccacggaaaccgaaggtattaccgcgcttccgggggcaatcgccttactcaatcatttgaataaagcaggtattccgtgggctattgtgacttctggctccatgccggtagcgcgagcgcgtcataaaatagcggggcttcccgcgccagaggtgtttgtaaccgctgagcgggtgaagcgcggaaaaccagaacctgatgcgtatctgttaggcgcgcagctgctggggcttgcgccgcaggagtgtgttgtggtggaagatgctcccgctggcgtgctttcaggtctggcggcgggttgccatgttattgcggttaatgccccggcagataccccgcgcctgaatgaagtcgatttagtcctccacagtctggagcaaattactgtgaccaaacagccaaatggcgatgttattattcagtga

SEQ ID NO: 5518 - protein, 216 aa, Escherichia coli
MRCKGFLFDLDGTLVDSLPAVERAWSNWARRHGLSPEEVLAFIHGKQAITSLRHFMAGKSEADIAAEFTRLEHIEATETEGITALPGAIALLNHLNKAGIPWAIVTSGSMPVARARHKIAGLPAPEVFVTAERVKRGKPEPDAYLLGAQLLGLAPQECVVVEDAPAGVLSGLAAGCHVIAVNAPADTPRLNEVDLVLHSLEQITVTKQPNGDVIIQ

SEQ ID NO: 5519 - DNA, 495 bp, Escherichia coli
atggaaatgaccaacgcgcaacgtcttattttgtctaaccagtacaagatgatgactatgctcgatccggcaaatgctgaacgttaccgtcgcctgcaaacaatcattgagcgtggttatggattacagatgcgtgaactggatcgcgagtttggcgagctgaaagaagaaacctgccgcactatcatcgacattatggagatgtatcatgcgttgcatgtttcctggtctaatttgcaggaccagcaatccatcgatgaacgtcgtgtcaccttcctcggctttgacgccgccactgaagcacgttacctcggttatgtccgctttatggttaatgtggaagggcgctatacccattttgacgctggaactcacggttttaacgcccaaacgccaatgtgggaaaaatatcagcgcatgcttaatgtgtggcatgcctgcccgcgtcagtaccatttgagcgccaacgaaattaatcaaattattaacgcctga

SEQ ID NO: 5520 - protein, 164 aa, Escherichia coli
MEMTNAQRLILSNQYKMMTMLDPANAERYRRLQTIIERGYGLQMRELDREFGELKEETCRTIIDIMEMYHALHVSWSNLQDQQSIDERRVTFLGFDAATEARYLGYVRFMVNVEGRYTHFDAGTHGFNAQTPMWEKYQRMLNVWHACPRQYHLSANEINQIINA

SEQ ID NO: 5521 - DNA, 456 bp, Escherichia coli
atgtcaacgccggataatcgttctgttaatttttttagcttgtttcgccggggacagcattactcaaagacgtggccgctggaaaaacgccttgccccagtctttgtcgaaaatcgcgttatcaagatgacgtgttatgcgatccgttttatgccgccgatcgccgtatttactctctgctggcagattgccctgggcggtcagcttgggccggcagttgccactgcgctgttcgccttaagtttacccatgcagggattgtggtggctgggcaagcgttctgtaacgccattacctcctgcaatcctcaactggttttatgacgttcgcggtaaattgcaggagtctggacaggtgttggcacccgttgaaggcaagcctgattaccaggcattagctgacacgcttaagcgtgccttcaaacaactggataaaactttccttgatgatttgtaa

SEQ ID NO: 5522 - protein, 151 aa, Escherichia coli
MSTPDNRSVNFFSLFRRGQHYSKTWPLEKRLAPVFVENRVIKMTCYAIRFMPPIAVFTLCWQIALGGQLGPAVATALFALSLPMQGLWWLGKRSVTPLPPAILNWFYDVRGKLQESGQVLAPVEGKPDYQALADTLKRAFKQLDKTFLDDL

SEQ ID NO: 5523 - DNA, 1203 bp, Escherichia coli
atgtcgagtaagttagtactggttctgaactgcggtagttcttcactgaaatttgccatcatcgatgcagtaaatggtgaagagtacctttctggtttagccgaatgtttccacctgcccgaagcacgtatcaaatggaaaatggacggcaataaacaggaagcggctttaggtgcaggcgccgctcacagcgaagcgctcaactttatcgttaatactattctggcacaaaaaccagaactgtctgcgcagctgactgctatcggtcaccgtatcgtacacggcggcgaaaagtataccagctccgtagtgatcgatgagtctgttattcagggtatcaaagatgcagcttcttttgcaccgctgcacaacccggctcacctgatcggtatcgaagaagctctgaaatctttcccacagctgaaagacaaaaacgttgctgtatttgacaccgcgttccaccagactatgccggaagagtcttacctctacgccctgccgtacaacctgtacaaagagcacggcatccgtcgttacggcgcgcacggcaccagccacttctatgtaacccaggaagcggcaaaaatgctgaacaaaccggtagaagaactgaacatcatcacctgccacctgggcaacggtggttccgtttctgctatccgcaacggtaaatgcgttgacacctctatgggcctgaccccgctggaaggtctggtcatgggtacccgttctggtgatatcgatccggcgatcatcttccacctgcacgacaccctgggcatgagcgttgacgcaatcaacaaactgctgaccaaagagtctggcctgctgggtctgaccgaagtgaccagcgactgccgctatgttgaagacaactacgcgacgaaagaagacgcgaagcgcgcaatggacgtttactgccaccgcctggccaaatacatcggtgcctacactgcgctgatggatggtcgtctggacgctgttgtattcaccggtggtatcggtgaaaatgccgcgatggttcgtgaactgtctctgggcaaactgggcgtgctgggctttgaagttgatcatgaacgcaacctggctgcacgtttcggcaaatctggtttcatcaacaaagaaggtacccgtcctgcggtggttatcccaaccaacgaagaactggttatcgcgcaagacgcgagccgcctgactgcctga

SEQ ID NO: 5524 - protein, 400 aa, Escherichia coli
MSSKLVLVLNCGSSSLKFAIIDAVNGEEYLSGLAECFHLPEARIKWKMDGNKQEAALGAGAAHSEALNFIVNTILAQKPELSAQLTAIGHRIVHGGEKYTSSVVIDESVIQGIKDAASFAPLHNPAHLIGIEEALKSFPQLKDKNVAVFDTAFHQTMPEESYLYALPYNLYKEHGIRRYGAHGTSHFYVTQEAAKMLNKPVEELNIITCHLGNGGSVSAIRNGKCVDTSMGLTPLEGLVMGTRSGDIDPAIIFHLHDTLGMSVDAINKLLTKESGLLGLTEVTSDCRYVEDNYATKEDAKRAMDVYCHRLAKYIGAYTALMDGRLDAVVFTGGIGENAAMVRELSLGKLGVLGFEVDHERNLAARFGKSGFINKEGTRPAVVIPTNEELVIAQDASRLTA

SEQ ID NO: 5525 - DNA, 2145 bp, Escherichia coli
gtgtcccgtattattatgctgatccctaccggaaccagcgtcggtctgaccagcgtcagccttggcgtgatccgtgcaatggaacgcaaaggcgttcgtctgagcgttttcaaacctatcgctcagccgcgtaccggtggcgatgcgcccgatcagactacgactatcgtgcgtgcgaactcttccaccacgacggccgctgaaccgctgaaaatgagctacgttgaaggtctgctttccagcaatcagaaagatgtgctgatggaagagatcatcgcgaactaccacgctaacaccaaagacgctgaagtcgttctggttgaaggtctggtcccgacacgtaaacaccagtttgcccagtctctgaactacgaaatcgctaaaacgctgaatgcggaaatcgtcttcgttatgtctcagggcactgacaccccggaacagctgaaagagcgtatcgaactgacccgcaacagcttcggcggtgcaaaaaacaccaatattaccggcgttatcgttaacaaactgaacgctccggttgatgagcagggtcgtactcgcccggatctgtccgagatttttgacgactccaccaaagcaaaagtgaacaacgttgatccggcgaagctgcaagaatccagccctctgccggttctcggcgctgtgccgtggagctttgacctgatcgcgactcgtgcgatcgatatggctcgccacctgaatgcgaccatcatcaacgaaggcgacatcaatactcgccgcgttaaatccgtcactttctgcgcacgcagcattccgcacatgctggagcacttccgtgccggttctctgctggtgacttccgcagaccgccctgacgtgctggttgccgcgtgcctggctgccatgaacggcgtagaaatcggtgccctgctgctgactggcggctacgaaatggacgcgcgcatttctaaactgtgcgaacgtgctttcgctaccggcctgccggtatttatggtgaacaccaacacctggcagacttctctgagcctgcagagcttcaacctggaagttccggttgacgatcacgagcgtatcgagaaagttcaggaatacgttgctaactacatcaacgctgactggatcgattctctgactgccacttctgagcgcagccgtcgtctgtctccgccagcgttccgttatcagctgaccgaacttgcgcgcaaagcgggcaaacgtatcgttctgccggaaggtgacgaaccgcgtaccgttaaagcagccgctatctgtgctgaacgtggtatcgcaacttgcgtactgctgggtaatccagcagagatcaaccgtgttgcagcctctcagggtgtagaactgggtgcaggcattgaaatcgttgatccagaagtggttcgcgaaaactatgttggtcgtctggtcgaactgcgtaagaacaaaggcatgaccgaaaccgttgcccgcgaacagctggaagacaacgtggttctcggtacgctgatgctggaacaagatgaagttgatggtctggtttccggtgctgttcacaccaccgcaaacaccatccgtccgccgctgcagctgatcaaaactgcaccgggcagctccctggtatcttccgtgttcttcatgctgttgccggaacaggtttacgtttacggtgactgtgcgatcaacccggatccgaccgcagaacagctggcagaaatcgcgattcagtccgctgattccgctgcggccttcggtatcgaaccgcgcgttgctatgctctcctactccaccggtacttctggtgctggtagcgacgtagaaaaagttcgcgaagcaactcgtctggcgcaggaaaaacgtcctgatctgatgatcgacggtccgctgcagtacgacgctgcggtaatggctgacgttgcgaaatccaaagcaccgaactctccggttgcaggtcgcgctaccgtgttcatcttcccggatctgaacaccggtaacaccacctacaaagcggtacagcgttctgctgacctgatctctatcggaccgatgctgcagggtatgcgcaagccggttaacgacctgtcccgtggcgcactggttgatgatatcgtctacaccatcgcgctgactgcgattcagtctgcacagcagcagtaa

SEQ ID NO: 5526 - protein, 714 aa, Escherichia coli
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIIANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSTKAKVNNVDPAKLQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIDSLTATSERSRRLSPPAFRYQLTELARKAGKRIVLPEGDEPRTVKAAAICAERGIATCVLLGNPAEINRVAASQGVELGAGIEIVDPEVVRENYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 5527 - DNA, 1479 bp, Escherichia coli
atgcccgatacgttggtgattatcttttttgttgccattttaaccagccttgccacctgggtagttccggtgggcatgtttgacagtcaggaagtgcagtatcaggttgatggtcaaacaaaaacacgcaaagtcgtagatccacactcatttcgcattctgactaacgaagcaggcgaacctgagtatcaccgcgtacagctgttcacgacgggcgatgaacgcccgggtctgatgaacttcccgtttgaagggttaacctcaggatcgaaatacgggacagccgttggcatcatcatgtttatgctggtgattggcggcgcgtttggcattgtgatgcgtacaggaaccattgataacggtatcctggcgcttattcgccatacccgcggaaatgaaattctctttattcctgcgctgtttattctgttttcacttggcggcgcaatatttggtatgggagaagaggccgtcgcctttgccattatcatcgcaccgctaatggtccggctgggctatgacagtattaccaccgtccttgtgacctatattgccacgcaaatcggttttgccagttcgtggatgaacccgttttgtgtggttgttgctcagggtattgccggcgttccggtgctttctggctccgggttgcgcatcgtggtgtgggttatcgccactctgattggcctgatctttaccatggtgtacgcctcacgagtgaaaaagaatcctcttctgtcacgcgtgcatgagtccgaccgcttctttcgtgaaaagcaggctgatgttgaacaacgtccgtttacctttggtgactggctggtattgattgtcctgaccgccgtaatggtctgggttatttggggcgtgatcgttaatgcctggtttattcctgaaattgccagccagttcttcaccatgggtctggtgattggcatcatcggcgttgttttccgccttaacggcatgacggttaataccatggcttcatcctttaccgaaggggcgcgaatgatgatcgcccctgccctgctggtgggtttcgccaaagggattttgctgctggtcggtaatggtgaagcgggtgatgccagcgtgttaaataccatcctcaacagcattgccaatgccattagcggtctggataacgcagtcgcggcctggtttatgttgctcttccaggcggtatttaatttcttcgtgacgtccggttctggtcaggcggcgttaaccatgccgttactggcaccgcttggcgatctggtcggtgttaaccgtcaggttaccgtgctggcgttccagtttggtgatggcttcagccacatcatttacccaacctcagcttcgttaatggcgacgctcggtgtttgccgggtggacttccgtaactggctgaaggtgggtgcgaccctgcttggactgctgtttattatgtccagcgtcgtggtgatcggcgctcagttgatgggctaccactaa

SEQ ID NO: 5528 - protein, 492 aa, Escherichia coli
MPDTLVIIFFVAILTSLATWVVPVGMFDSQEVQYQVDGQTKTRKVVDPHSFRILTNEAGEPEYHRVQLFTTGDERPGLMNFPFEGLTSGSKYGTAVGIIMFMLVIGGAFGIVMRTGTIDNGILALIRHTRGNEILFIPALFILFSLGGAIFGMGEEAVAFAIIIAPLMVRLGYDSITTVLVTYIATQIGFASSWMNPFCVVVAQGIAGVPVLSGSGLRIVVWVIATLIGLIFTMVYASRVKKNPLLSRVHESDRFFREKQADVEQRPFTFGDWLVLIVLTAVMVWVIWGVIVNAWFIPEIASQFFTMGLVIGIIGVVFRLNGMTVNTMASSFTEGARMMIAPALLVGFAKGILLLVGNGEAGDASVLNTILNSIANAISGLDNAVAAWFMLLFQAVFNFFVTSGSGQAALTMPLLAPLGDLVGVNRQVTVLAFQFGDGFSHIIYPTSASLMATLGVCRVDFRNWLKVGATLLGLLFIMSSVVVIGAQLMGYH

SEQ ID NO: 5529 - DNA, 528 bp, Escherichia coli
  n 4, 5, 6, 7, 8: n is any nucleotide
atgnnnnntactgaatgggtggatattgtcaatgaagagaacgaagtcattgcacaagccagccgggaacaaatgcgggcacagtgtctgcgtcatcgtgcaacttatatcgtcgtgcatgatggcatgggcaaaattctggtccagcgtcgtaccgagacaaaagactttttacccggcatgttagatgcgaccgcaggcggtgtagtccaggccgatgagcagctgctggaatccgcgcgtcgcgaagcggaagaagagttgggcattgccggtgtcccctttgccgagcacgggcagttctatttcgaagataaaaattgccgtgtctggggcgcgttgttcagctgcgtctctcacggtcccttcgctctacaggaagatgaagtcagtgaagtttgctggctgacgccggaagaaatcaccgcacgctgcgatgagttcactccagactcgctgaaagcgctggcgttgtggatgaagcgcaatgccaaaaatgaagccgtagagactgaaacggcagaatga

SEQ ID NO: 5530 - protein, 175 aa, Escherichia coli
  Xaa 2, 3: Xaa is any amino acid
MXXTEWVDIVNEENEVIAQASREQMRAQCLRHRATYIVVHDGMGKILVQRRTETKDFLPGMLDATAGGVVQADEQLLESARREAEEELGIAGVPFAEHGQFYFEDKNCRVWGALFSCVSHGPFALQEDEVSEVCWLTPEEITARCDEFTPDSLKALALWMKRNAKNEAVETETAE

SEQ ID NO: 5531 - DNA, 420 bp, Escherichia coli
  n 402, 403, 404, 405, 406: n is any nucleotide
atgaaactgatgtttgcatcggacattcatgggtcgttaccggcgacggaacgtgttctggagttgtttgtccaaagcggtgcccagtggctggtgatccttggcgacgtgttgaatcatggcccgcgtaatgctttaccggagggttacgcgccagccaaagtcgctgaacggcttaatgaagtggcacataaggttatcgctgtgcgcggcaactgcgacagcgaagtggatcaaatgctgctgcatttcccgataaccgcgccgtggcaacaggtattactggaaaaacaacgtctgtttttgacgcatggtcatctttttggcccggaaaatctacctgctttaaaccagaacgatgtgctggtgtacggtcatacccatctgccagtggcagaacannnnncattcattcattaa

SEQ ID NO: 5532 - protein, 139 aa, Escherichia coli
  Xaa 134, 135, 136: Xaa is any amino acid
MKLMFASDIHGSLPATERVLELFVQSGAQWLVILGDVLNHGPRNALPEGYAPAKVAERLNEVAHKVIAVRGNCDSEVDQMLLHFPITAPWQQVLLEKQRLFLTHGHLFGPENLPALNQNDVLVYGHTHLPVAEXXXFIH

SEQ ID NO: 5533 - DNA, 645 bp, Escherichia coli
atgagtaaacccgctatcacgctttggtcagatgcccattttttctccccttatgtgttatccgcctgggtggcgttgcaggagaaaggcctgtcgtttcatatcaagaccatcgacctcgacagcggtgaacatttgcagccgacgtggcaaggttacggtcagacacgccgtgtgccgttattacaaatcgatgattttgagttgagtgaatcttctgccattgcggagtatctggaagatcgatttgcgccaccgacctgggaacgtatttatccgcttgatttagaaaatcgtgcgcgagcacgacagattcaggcctggctgcgcagcgatctgatgcccatccgcgaagaacgcccgacggatgttgtctttgcgggggcgaaaaaagcgccactaacggccgagggaaaagccagtgcagagaaactgttcgcgatggcagaacatttgttagcactgggtcagccgaatttatttggtgaatggtgcattgctgatactgatctggcgctaatgattaaccgcctggtactacatggcgatgaggtgccggaacgcctggtggattatgcgacattccagtggcagcgagcgtctgtccagcgttttattgcactttcggcgaagcaatctggctga

SEQ ID NO: 5534 - protein, 214 aa, Escherichia coli
MSKPAITLWSDAHFFSPYVLSAWVALQEKGLSFHIKTIDLDSGEHLQPTWQGYGQTRRVPLLQIDDFELSESSAIAEYLEDRFAPPTWERIYPLDLENRARARQIQAWLRSDLMPIREERPTDVVFAGAKKAPLTAEGKASAEKLFAMAEHLLALGQPNLFGEWCIADTDLALMINRLVLHGDEVPERLVDYATFQWQRASVQRFIALSAKQSG

SEQ ID NO: 5535 - DNA, 648 bp, Escherichia coli
atgatcgatctctatttcgccccgacacccaatggtcacaaaattacgctgtttctcgaagaagcagggctggattatcgcttaataaaggtagacctggggaaaggaggtcagtttcgcccggaatttttgcgcatttcgcctaacaacaaaattccggcaattgttgatcattctccagccgatggcggcgaaccgctaagcctctttgagtctggtgccattttgttgtatctggctgagaaaacgggactctttttgagtcatgaaacgcgtgaacgcgccgtcacattacagtggttattctggcaggtaggcggactggggccgatgcttgggcaaaatcatcattttaatcacgcagccccccaaaccattccttacgctattgaacgttatcaggttgaaactcagcgtctgtaccatgtactgaacaagcggctggaaaattcgccctggctgggaggcgagaactacagcattgcggatattgcctgctggccgtgggttaatgcctggactcgccagcgaattgacctcgcaatgtatccggcagtcaagaactggcatgagcggatccgttcacgccctgccaccgggctggcactgctaaaagcacaacacggtgatgagcgttcggatagttaa

SEQ ID NO: 5536 - protein, 215 aa, Escherichia coli
MIDLYFAPTPNGHKITLFLEEAGLDYRLIKVDLGKGGQFRPEFLRISPNNKIPAIVDHSPADGGEPLSLFESGAILLYLAEKTGLFLSHETRERAVTLQWLFWQVGGLGPMLGQNHHFNHAAPQTIPYAIERYQVETQRLYHVLNKRLENSPWLGGENYSIADIACWPWVNAWTRQRIDLAMYPAVKNWHERIRSRPATGLALLKAQHGDERSDS

SEQ ID NO: 5537 - DNA, 363 bp, Escherichia coli
atggcacaacctgccgctattattcgtataaagaaccttcgtttacgtacgtttatcggaattaaggaagaagaaattaacaaccgtcaggatattgttatcaatgtgacgatccactaccccgccgataaagcgcgcactagcgaagatatcaacgatgcgctgaattatcgcaccgtaacgaaaaacattattcagcatgtagagaataaccgtttctctttgctggaaaaattaactcaggatgtgctcgatatcgcacgtgaacatcactgggtgacgtatgctgaagtggagatcgataaactgcacgcgctgcgctacgccgattcggtatccatgaccttaagctggcagcgttaa

SEQ ID NO: 5538 - protein, 120 aa, Escherichia coli
MAQPAAIIRIKNLRLRTFIGIKEEEINNRQDIVINVTIHYPADKARTSEDINDALNYRTVTKNIIQHVENNRFSLLEKLTQDVLDIAREHHWVTYAEVEIDKLHALRYADSVSMTLSWQR

SEQ ID NO: 5539 - DNA, 894 bp, Escherichia coli
atgaacatagtgatcaccggagggacgggattaattggtcgctatttgattccacgtttgctggacctgggccatcaaatcacggtagtgacgcgtaacccgcagaaagccagttccgttctcggccctcgggtgacactatggcaagggcttgccggacaaagcaacctcaacggcgttgatgcggtaatcaacctggccggagaaccgattgctgataaacgctggactcacgagcaaaaagagcgtctctgccaaagccgctggaatatcacgcaaaaactggtcgatttgattaatgccagcgacacgccaccgtcggtactcatttccggctcggcaacgggctattatggcgacttaggtgaagtggtggttaccgaagaggaaccgccgcataacgaatttacccataaactctgcgcccgctgggaagaaattgcctgccgggcacaaagtgacaaaacgcgagtgtgcctgctgcgtaccggcgtagtgctggcaccggatggcggtattctcggtaaaatgctgccgccgtttcgtcttggcctgggcgggccgattggttccggtcggcagtatctggcctggattcatattgatgatatggtcaacggcattctctggctgctggataacgagctgcgcgggccatttaatatggtttcgccctacccggtgcgcaatgaacaatttgcccatgcactgggtcatgcgctgcatcgcccggccattttgcgcgtccctgcgaccgccattcggttgttaatgggcgaatcttcagttctggtattaggcggtcaacgcgcgctgccaaaaaagctggaagaagcgggttttgcgtttcgctggtacgatttagaagaggcgctggcggatgtcgttcgctga

SEQ ID NO: 5540 - protein, 297 aa, Escherichia coli
MNIVITGGTGLIGRYLIPRLLDLGHQITVVTRNPQKASSVLGPRVTLWQGLAGQSNLNGVDAVINLAGEPIADKRWTHEQKERLCQSRWNITQKLVDLINASDTPPSVLISGSATGYYGDLGEVVVTEEEPPHNEFTHKLCARWEEIACRAQSDKTRVCLLRTGVVLAPDGGILGKMLPPFRLGLGGPIGSGRQYLAWIHIDDMVNGILWLLDNELRGPFNMVSPYPVRNEQFAHALGHALHRPAILRVPATAIRLLMGESSVLVLGGQRALPKKLEEAGFAFRWYDLEEALADVVR

SEQ ID NO: 5541 - DNA, 891 bp, Escherichia coli
atgacaatatcgacaacttccacgccgcatgatgcggtatttaaatcttttttacgccatccagacaccgcgcgggattttattgatattcatcttcccgcgccgctgcgcaaactgtgtgatttaacgacgcttaaactggaaccaaatagttttattgatgaagacctgcggcaatattattccgacctcttgtggtctgtgaaaacgcaggagggagcgggttatatttatgtggtgatagagcaccaaagtaagccagaggaattaatggcttttcgcatgatgcgctattccattgcggcgatgcaaaaccatcttgatgcgggttataaagagcttccattagtgatcccgatgctgttttatcatggttgcagaagcccttatccatattcactctgctggcttgatgaatttgccgagcctgcgattgcccgcaaaatttattcatcggcttttccgctggtggatattaccgtggtgccggatgacgagattatgcaacatcgcaaaatggcgctgttggagttaattcagaaacatattcgtcagcgcgatctgttgggattagtcgaccaaattgtttcgctgctagttacagggaacactaatgacagacagctaaaagccctgtttaattacgtattacaaacgggggatgcccggcgtttccgtgcatttattggtgagatagcggaacgcgcaccacaagaaaaggagaaactgatgaccattgctgacagattacgtgaagaaggcgcaatgcagggcaaacacgaagaagccctgcgcattgctcaggagatgatggaaaaaggatttgaccacgaagtcatcctgacgctgacccgactttcaccagacgatcttatcgcgccaagccactaa

SEQ ID NO: 5542 - protein, 296 aa, Escherichia coli
MTISTTSTPHDAVFKSFLRHPDTARDFIDIHLPAPLRKLCDLTTLKLEPNSFIDEDLRQYYSDLLWSVKTQEGAGYIYVVIEHQSKPEELMAFRMMRYSIAAMQNHLDAGYKELPLVIPMLFYHGCRSPYPYSLCWLDEFAEPAIARKIYSSAFPLVDITVVPDDEIMQHRKMALLELIQKHIRQRDLLGLVDQIVSLLVTGNTNDRQLKALFNYVLQTGDARRFRAFIGEIAERAPQEKEKLMTIADRLREEGAMQGKHEEALRIAQEMMEKGFDHEVILTLTRLSPDDLIAPSH

SEQ ID NO: 5543 - DNA, 699 bp, Escherichia coli
ttgcaagcgaatgccggagatgtcataagcatcatcggatcgtcgggatcgggtaaaagtacctttctgcgctgcattaacttcctcgaaaaaccgagcgaaggatcgatcgtggtcaatggccagacgatcaatctggtgcgcgataaagatggtcaactcaaagtcgccgataaaaatcagctgcgcttattgcgcacacgcctgacgatggtatttcagcacttcaatctctggagccatatgacggtgctggaaaacgtcatggaagcgccgattcaggtgttgggcctgagcaagcaggaagcgcgcgagcgggcggtgaaatatctggcaaaagtcgggatagacgaacgtgcgcaggggaaatacccggtgcacctgtccggtggtcagcaacagcgtgtttctatcgcgcgggcgctagcgatggaaccggaagttttactgtttgatgaacctacttcagcgctcgatcctgaactggtaggcgaagtgttgcgtattatgcagcaactggcagaagaggggaaaaccatggtggtagtgactcacgaaatgggctttgctcgtcatgtttctactcacgtcattttcctccatcaggggaaaatagaagaagaaggggcgccggagcagttattcggtaacccgcaaagccctcgtctgcaacagttccttaaaggttcgctgaaataa

SEQ ID NO: 5544 - protein, 232 aa, Escherichia coli
MQANAGDVISIIGSSGSGKSTFLRCINFLEKPSEGSIVVNGQTINLVRDKDGQLKVADKNQLRLLRTRLTMVFQHFNLWSHMTVLENVMEAPIQVLGLSKQEARERAVKYLAKVGIDERAQGKYPVHLSGGQQQRVSIARALAMEPEVLLFDEPTSALDPELVGEVLRIMQQLAEEGKTMVVVTHEMGFARHVSTHVIFLHQGKIEEEGAPEQLFGNPQSPRLQQFLKGSLK

SEQ ID NO: 5545 - DNA, 717 bp, Escherichia coli
gtgatcgaaattttacatgaatactggaaaccgttgttgtggaccgacggttatcgctttactggcgtggcaatcactctgtggctgcttattttgtcggtagtgataggcggagttctggcgctgtttctggcgattggtcgtgtctccagtaataaatacatccagtttccaatctggttatttacctatatttttcgcggtacgccgctgtatgttcagttgctggtgttctattccggcatgtacacgcttgagattgttaagggaaccgaattccttaacgctttcttccgcagtggcctgaactgtaccgtgctggcgctgacgcttaacacctgcgcttacactaccgagatttttgccggggcaatccgttcagtgccgcatggggaaattgaagccgccagagcctatggcttctcgacctttaaaatgtatcgctgcattattttgccttctgcgctgcgtattgcgttaccggcatacagcaacgaagtgatcctgatgctgcactctactgcgctggcatttactgccacggtgccggatctgctgaaaattgcccgcgatattaacgccgccacatatcaaccttttaccgcttttggcattgccgcggtgctctatttaatcatctcttatgtcctgatcagcctctttcgtagagctgaaaaacgctggttgcagcatgtgaaaccttcttcaacgcactga

SEQ ID NO: 5546 - protein, 238 aa, Escherichia coli
MIEILHEYWKPLLWTDGYRFTGVAITLWLLILSVVIGGVLALFLAIGRVSSNKYIQFPIWLFTYIFRGTPLYVQLLVFYSGMYTLEIVKGTEFLNAFFRSGLNCTVLALTLNTCAYTTEIFAGAIRSVPHGEIEAARAYGFSTFKMYRCIILPSALRIALPAYSNEVILMLHSTALAFTATVPDLLKIARDINAATYQPFTAFGIAAVLYLIISYVLISLFRRAEKRWLQHVKPSSTH

SEQ ID NO: 5547 - DNA, 687 bp, Escherichia coli
atgttgtatgggttttcaggtgttattttacagggtgcgctcgtcacgctggagctggctatcagctctgtagtgctcgctgtaatcatcggtttaattggcgctggcggtaagctctcacaaaatcggctttcgggccttattttcgaagggtacaccacgctgattcgaggcgtgccggatttagtattgatgctgctgattttctacggtttgcagattgcgctaaacacggtgacggaggcgatgggcgtcgggcagattgatatcgatccgatggtcgctggtattattactctcggttttatctacggtgcttattttaccgaaacgttccgtggcgcgtttatggctgtgccgaaagggcatatagaggcggcgacggcgttcggttttactcgtgggcaagtgtttcggcggatcatgtttccggcgatgatgcgttacgccctgccaggcattggcaacaactggcaggtgattctcaaatctaccgctttggtttcgttactcggcctggaagatgtggtcaaagccacgcaactggcaggcaaaagtacctgggaaccgttctatttcgccatcgtctgtggcgtgatttacctggttttcaccaccgtttccaatggtgtgctgctgttccttgagcgccgctactccgtgggtgtgaagagggctgacctgtga

SEQ ID NO: 5548 - protein, 228 aa, Escherichia coli
MLYGFSGVILQGALVTLELAISSVVLAVIIGLIGAGGKLSQNRLSGLIFEGYTTLIRGVPDLVLMLLIFYGLQIALNTVTEAMGVGQIDIDPMVAGIITLGFIYGAYFTETFRGAFMAVPKGHIEAATAFGFTRGQVFRRIMFPAMMRYALPGIGNNWQVILKSTALVSLLGLEDVVKATQLAGKSTWEPFYFAIVCGVIYLVFTTVSNGVLLFLERRYSVGVKRADL

SEQ ID NO: 5549 - DNA, 783 bp, Escherichia coli
atgaaaaaactggtgctatcgctctctctggttctggccttctccagcgcaactgcggcatttgctgcgattccgcaaaacatccgcatcggtaccgatccgacctatgcgccatttgaatcaaaaaattcacaaggtgaactggttggcttcgatatcgatctggcgaaggagttgtgcaaacgcatcaatacgcaatgtacgtttgtcgaaaacccactcgatgcgttaatcccgtccttaaaagcgaagaagattgacgccatcatgtcatcgctttccattacggaaaaacgtcagcaagaaatagccttcaccgacaaactgtacgctgccgattctcgtttggtggtggcgaaaaattccgacattcagccgacagtcgaatcgctgaaaggcaaacggataggcgtattgcagggcaccacccaggagacgttcggtaacgaacactgggcaccaaaaggcattgaaatcgtttcttatcaggggcaggacaatatttattctgacctgactgccggacgtattgatgccgcgttccaggatgaggtcgcagccagcgaaggtttcctcaaacaacccgtcggtaaagattacaaattcggtggcccgtctgttaaagatgaaaaactgtttggcgtagggaccggcatgggcctgcgtaaagaagataacgaactgcgcgaggcactgaacaaagcctttgccgaaatgcgcgctgacggtacttacgagaaattagcgaaaaagtacttcgattttgatgtttatggtggttaa

SEQ ID NO: 5550 - protein, 260 aa, Escherichia coli
MKKLVLSLSLVLAFSSATAAFAAIPQNIRIGTDPTYAPFESKNSQGELVGFDIDLAKELCKRINTQCTFVENPLDALIPSLKAKKIDAIMSSLSITEKRQQEIAFTDKLYAADSRLVVAKNSDIQPTVESLKGKRIGVLQGTTQETFGNEHWAPKGIEIVSYQGQDNIYSDLTAGRIDAAFQDEVAASEGFLKQPVGKDYKFGGPSVKDEKLFGVGTGMGLRKEDNELREALNKAFAEMRADGTYEKLAKKYFDFDVYGG

SEQ ID NO: 5551 - DNA, 783 bp, Escherichia coli
atgaagaagtcgattctcgctctgtctttgttagtcggtctctccgcagcggcttccagctatgcggcgctaccggagacggtacgtatcggaaccgataccacctacgcaccgttctcatcgaaagatgccaaaggtgactttgttggctttgatatcgatctcggtaacgagatgtgcaaacggatgcaggtgaaatgtacctgggttgccagtgactttgacgcgctgatcccctcactgaaagcgaaaaaaatcgacaccattatttcgtcgctctccattaccgataaacgtcagcaggagatagccttctctgacaagctgtacgccgcagattctcgtttgattgccgccaaaggttcaccgattcagccaacgctggattcactgaaaggtaaacatgttggtgtgctgcagggatcaacccaggaagcatacgctaacgagacctggcgtagcaaaggcgtggatgtggtggcctatgccaaccaggatttggtctattccgatctggctgcaggacgtctggatgctgcgttacaagatgaagttgctgccagcgaaggtttccttaagcaacccgccggtaaagatttcgcctttgcaggcccatcagtgaaagacaaaaaatacttcggtgacggcaccggtgtagggctgcgtaaagatgatgctgaactgacggcggccttcaataaggcgcttaacgagctgcgtcaggacggcacctacgacaagatggcgaaaaagtatttcgactttaatgtctacggtgactga

SEQ ID NO: 5552 - protein, 260 aa, Escherichia coli
MKKSILALSLLVGLSAAASSYAALPETVRIGTDTTYAPFSSKDAKGDFVGFDIDLGNEMCKRMQVKCTWVASDFDALIPSLKAKKIDTIISSLSITDKRQQEIAFSDKLYAADSRLIAAKGSPIQPTLDSLKGKHVGVLQGSTQEAYANETWRSKGVDVVAYANQDLVYSDLAAGRLDAALQDEVAASEGFLKQPAGKDFAFAGPSVKDKKYFGDGTGVGLRKDDAELTAAFNKALNELRQDGTYDKMAKKYFDFNVYGD

SEQ ID NO: 5553 - DNA, 570 bp, Escherichia coli
atgaaacgactcattgtaggcatcagcggtgccagcggcgcgatttatggcgtgcgtttattacaggttctgcgcgatgtcacagatatcgaaacgcatctggtaatgagccaggcggcgcgccagaccttatccctcgaaacggatttttccctgcgcgaagtgcaggcgttagctgatgtgacacacgatgcgcgcgatattgctgccagcatttcttccggttctttccagacgttggggatggtgattttaccctgttcaatcaaaaccctgtccggcattgtccatagctatactgatggcttactgacccgtgcggcagatgtggtgctgaaagagcgtcgcccgttggtgctctgcgtgcgtgaaacgccactgcacttaggccatctgcgtttaatgactcaggcggcagaaatcggtgcggtgattatgcctcccgttccggcgttttatcatcgcccacaatcccttgatgatgtgataaatcagacggttaatcgtgttcttgaccagtttgcggtaacccttcctgaagatctctttgcccgctggcagggcgcataa

SEQ ID NO: 5554 - protein, 189 aa, Escherichia coli
MKRLIVGISGASGAIYGVRLLQVLRDVTDIETHLVMSQAARQTLSLETDFSLREVQALADVTHDARDIAASISSGSFQTLGMVILPCSIKTLSGIVHSYTDGLLTRAADVVLKERRPLVLCVRETPLHLGHLRLMTQAAEIGAVIMPPVPAFYHRPQSLDDVINQTVNRVLDQFAVTLPEDLFARWQGA

SEQ ID NO: 5555 - DNA, 1518 bp, Escherichia coli
atgtgcggtattgtcggtatcgccggtgttatgccggttaaccagtcgatttatgatgccttaacggtgcttcagcatcgcggtcaggatgccgccggcatcatcaccatagatgccaataactgcttccgtttgcgtaaagcgaacgggctggtgagcgatgtatttgaagctcgccatatgcagcgtttgcagggcaatatgggcattggtcatgtgcgttaccccacggctggcagctccagcgcctctgaagcgcagccgttttacgttaactccccgtatggcattacgcttgcccacaacggcaatctgaccaacgctcacgagttgcgtaaaaaactgtttgaagaaaaacgccgccacatcaacaccacttccgactcggaaattctgcttaatatcttcgccagcgagctggacaacttccgccactacccgctggaagccgacaacattttcgccgccatcgctgctacaaaccgcttaatccgcggcgcgtatgcctgtgtggcgatgatcatcggccacggtatggttgctttccgcgatcctaacgggattcgtccgctggtactgggaaaacgtgatattgacgagaaccgcacagaatatatggtcgcttccgaaagcgttgcgctcgatacgctgggctttgatttcctgcgtgacgtcgcgccgggcgaagcgatttacatcactgaagaaggacagttgtttacccgtcaatgtgctgacaatccggtcagcaatccgtgcctgtttgagtatgtatactttgcccgcccggactcgttcatcgacaaaatttccgtttacagcgcgcgcgtgaatatgggcaccaaactgggcgaaaaaattgcccgcgaatgggaagatctggatatcgacgtggtgatccctattccggaaacctcgtgtgatatcgcgctggaaattgcgcgtattctgggcaaaccgtaccgccagggcttcgttaaaaaccgctatgttggccgcaccttcatcatgccgggtcagcagctgcgtcgtaagtccgtgcgccgtaaactgaacgccaaccgcgccgagttccgcgataaaaacgtcctgctggtcgacgactctatcgtccgtggcaccacttctgagcagattattgagatggcacgcgaagccggagcgaagaaagtgtacctcgcttctgcggcaccggaaattcgcttcccgaacgtttacggtatcgatatgccgagcgccacggaactgatcgctcacggtcgcgaagtagatgaaattcgccagatcatcggtgctgacgggttgattttccaggatctgaacgatctgatcgaagccgttcgcgctgaaaacccggatatccagcagtttgaatgctcggtgttcaacggcgtctacgtcaccaaagacgttgatcagggctacctcgatttcctcgatactttacgtaatgacgacgccaaagcagtgcaacgtcagaacgaagtggaaaatctcgaaatgcataacgaaggatga

SEQ ID NO: 5556 - protein, 505 aa, Escherichia coli
MCGIVGIAGVMPVNQSIYDALTVLQHRGQDAAGIITIDANNCFRLRKANGLVSDVFEARHMQRLQGNMGIGHVRYPTAGSSSASEAQPFYVNSPYGITLAHNGNLTNAHELRKKLFEEKRRHINTTSDSEILLNIFASELDNFRHYPLEADNIFAAIAATNRLIRGAYACVAMIIGHGMVAFRDPNGIRPLVLGKRDIDENRTEYMVASESVALDTLGFDFLRDVAPGEAIYITEEGQLFTRQCADNPVSNPCLFEYVYFARPDSFIDKISVYSARVNMGTKLGEKIAREWEDLDIDVVIPIPETSCDIALEIARILGKPYRQGFVKNRYVGRTFIMPGQQLRRKSVRRKLNANRAEFRDKNVLLVDDSIVRGTTSEQIIEMAREAGAKKVYLASAAPEIRFPNVYGIDMPSATELIAHGREVDEIRQIIGADGLIFQDLNDLIEAVRAENPDIQQFECSVFNGVYVTKDVDQGYLDFLDTLRNDDAKAVQRQNEVENLEMHNEG

SEQ ID NO: 5557 - DNA, 489 bp, Escherichia coli
atggtctggattgattacgccataatcgcggtgattgctttttcctctctggttagcctgatccgcggctttgttcgtgaagtgttatcgctggtgacatggggttgtgctttctttgttgccagtcattactacacttacctgtcagtctggtttacgggctttgaagacgaactggttcgaaatgggattgccatcgcggtactgtttatcgctaccctgatcgttggtgctatcgtgaacttcgtgataggccagttggtggagaaaacggggttgtcaggcaccgatcgggtgttgggcgtctgtttcggtgcgttgcgcggtgtgttgattgttgctgccattctcttctttctcgactcctttaccggggtgtcgaaaagcgaagactggagcaaatcacagctgatcccgcagttcagttttatcatcagatggttttttgattatctgcaaagctcgtcaagtttcttgcccagagcgtaa

SEQ ID NO: 5558 - protein, 162 aa, Escherichia coli
MVWIDYAIIAVIAFSSLVSLIRGFVREVLSLVTWGCAFFVASHYYTYLSVWFTGFEDELVRNGIAIAVLFIATLIVGAIVNFVIGQLVEKTGLSGTDRVLGVCFGALRGVLIVAAILFFLDSFTGVSKSEDWSKSQLIPQFSFIIRWFFDYLQSSSSFLPRA

SEQ ID NO: 5559 - DNA, 663 bp, Escherichia coli
gtggcaagtaagtttcagaatcggttagtgggcacgatcgtgctggtagcgctgggggtgattgtacttccagggctgctggacgggcagaaaaaacattatcaggatgagttcgcggctatcccgctggtgccaaaagcgggcgatcgcgatgagcctgatatgatgccagccgccacccaggcgttgccgacgcagccgccggaaggcgcagcggaagaggtacgggcaggtgatgccgcagcaccgtcgctcgatccggccactattgcagccaataacaccgagtttgaaccggaacctgcaccggtcgtcccaccgaagccgaaaccggtggagccgcctaagccgaaggttgaagcaccacctgcgccgaagccagaaccgaagccggtcgtggaagaaaaagcagcgccaacgggtaaagcctatgttgtgcaactgggcgcgctgaaaaatgccgataaagtgaatgagattgtcggtaagctgcgcggtgccggttatcgggtttatacgtcgccatccacgccagtgcagggtaaaattacccgtattctggttgggccagatgcctcgaaagataagctgaaaggatcgctgggtgagctcaagcagctttctggcttaagtggcgtggtaatgggctatacaccgaattaa

SEQ ID NO: 5560 - protein, 220 aa, Escherichia coli
MASKFQNRLVGTIVLVALGVIVLPGLLDGQKKHYQDEFAAIPLVPKAGDRDEPDMMPAATQALPTQPPEGAAEEVRAGDAAAPSLDPATIAANNTEFEPEPAPVVPPKPKPVEPPKPKVEAPPAPKPEPKPVVEEKAAPTGKAYVVQLGALKNADKVNEIVGKLRGAGYRVYTSPSTPVQGKITRILVGPDASKDKLKGSLGELKQLSGLSGVVMGYTPN

SEQ ID NO: 5561 - DNA, 1269 bp, Escherichia coli
atgattatcaaacgcactcctcaagccgcgtcgcctctggcttcgtggctttcttatctggaaaacctgcacagtaaaactatcgatctcggccttgagcgcgtgagccaggtcgcggcgcgtcttggcgttctgaaaccagcgccatttgtgtttaccgttgcgggtactaatggcaaaggcaccacctgccgtacgctggagtcgattctgatggcggcagggtacaaagtgggcgtctacagttcgccgcatctggtgcgttataccgagcgcgtacgtgtgcagggtcaggaattgccgaaatcggcccacaccgcttcttttgcggagattgaatcggcacgcggtgatatttccctgacctatttcgagtacggtacgctctcggcgttgtggctgttcaagcaggcacaacttgacgtagtgattctggaagtagggctgggcggtcgtctggacgcaaccaatattgtcgatgccgatgtcgcggtagtaaccagtattgcgctggatcataccgactggctggggccagatcgtgaaagtattggtcgcgagaaagcaggtatctttcgcagcgaaaaaccggcaattgtcggtgagccggagatgccttctaccattgctgatgtggcgcaggaaaaaggtgcactgctacaacgtcggggcgttgagtggaactattccgtcaccgatcatgactggacgtttagcgatgctcacggcacgctggaaaatctgccgttgccgcttgtcccgcaaccgaatgccgcaacggcgctggcggcactgcgtgccagcgggctggaggtcagtgaaaatgccattcgcgacgggattgccagcgcaattttgccgggacgtttccagattgtgagcgagtcgccacgcgttatttttgatgtcgcgcataatccacatgcggcggaatatctcaccgggcgtatgaaagcgctaccgaaaaacgggcgcgtgctggcggttatcggtatgctacatgataaagatattgccggaactctggcctggttgaaaagcgtggttgatgactggtattgtgcgccactggaagggccgcgcggtgccacggcagaacaactgcttgagcatttgggtaacggcaaatcatttgatagcgttgcgcaggcatgggatgccgcaatggcggacgctaaagcggaagacaccgtgctggtgtgtggttcgttccacacggtcgcacatgtcatggaagtgattgacgcgaggagaagcggtggcaagtaa

SEQ ID NO: 5562 - protein, 422 aa, Escherichia coli
MIIKRTPQAASPLASWLSYLENLHSKTIDLGLERVSQVAARLGVLKPAPFVFTVAGTNGKGTTCRTLESILMAAGYKVGVYSSPHLVRYTERVRVQGQELPKSAHTASFAEIESARGDISLTYFEYGTLSALWLFKQAQLDVVILEVGLGGRLDATNIVDADVAVVTSIALDHTDWLGPDRESIGREKAGIFRSEKPAIVGEPEMPSTIADVAQEKGALLQRRGVEWNYSVTDHDWTFSDAHGTLENLPLPLVPQPNAATALAALRASGLEVSENAIRDGIASAILPGRFQIVSESPRVIFDVAHNPHAAEYLTGRMKALPKNGRVLAVIGMLHDKDIAGTLAWLKSVVDDWYCAPLEGPRGATAEQLLEHLGNGKSFDSVAQAWDAAMADAKAEDTVLVCGSFHTVAHVMEVIDARRSGGK

SEQ ID NO: 5563 - DNA, 999 bp, Escherichia coli
atggtctgttgggggcaaaaatggcattatgcgtccccaaagataaaactggcatcgaaccaggttcagacagaaaggtccctaatgagctggattgaacgaattaaaagcaacattactcccacccgcaaggcgagcattcctgaaggggtgtggactaagtgtgatagctgcggtcaggttttataccgcgctgagctggaacgtaatcttgaggtctgtccgaagtgtgaccatcacatgcgtatgacagcgcgtaatcgcctgcatagcctgttagatgaaggaagccttgtggagctgggtagcgagcttgagccgaaagatgtgctgaagtttcgtgactccaagaagtataaagaccgtctggcatctgcgcagaaagaaaccggcgaaaaagatgcgctggtggtgatgaaaggcactctgtatggaatgccggttgtcgctgcggcattcgagttcgcctttatgggcggttccatgggatctgtggtaggtgcgcgtttcgtgcgtgccgttgagcaggcgctggaagataactgcccactgatctgcttctccgcctctggtggcgcacgtatgcaggaagcactgatgtcgctgatgcagatggcgaaaacctctgcggcactggcaaaaatgcaggagcgcggcttgccgtacatctccgtgctgaccgacccgaccatgggcggtgtttctgcaagtttcgccatgctgggcgatctcaacatcgctgaaccgaaagcgttaattggctttgccggtccgcgagttatcgaacagaccgttcgcgaaaaactgccgccaggattccagcgcagtgaattcctgatcgagaagggcgcgatcgacatgatcgtccgtcgtccggaaatgcgcctgaaactggcgagcattctggcgaagttgatgaatctgccagcgccgaatcctgaagcgccgcgtgaaggcgtagtggtgccaccggtaccggatcaggaacctgaggcctga

SEQ ID NO: 5564 - protein, 332 aa, Escherichia coli
MVCWGQKWHYASPKIKLASNQVQTERSLMSWIERIKSNITPTRKASIPEGVWTKCDSCGQVLYRAELERNLEVCPKCDHHMRMTARNRLHSLLDEGSLVELGSELEPKDVLKFRDSKKYKDRLASAQKETGEKDALVVMKGTLYGMPVVAAAFEFAFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPNPEAPREGVVVPPVPDQEPEA

SEQ ID NO: 5565 - DNA, 660 bp, Escherichia coli
atggacctgatttatttcctcatcgattttatcctgcacattgacgtgcatctggcagagctggtcgcggagtacggcgtctgggtttatgccattttgttcttaattttgttctgtgaaaccggtctggtggtaacgccgtttttaccgggtgattcattgctgtttgttgccggagcgttggcatcactggagaccaacgatctcaacgtccatatgatggtggtgctgatgctgatcgccgcgattgtgggtgacgcggtcaattacactatcgggcggttgttcggtgaaaagttattcagtaatcccaattcgaaaattttccgtcgcagttatctcgacaaaacccatcagttttatgagaaacatggcggcaaaacgattattctcgcccgttttgtgccgatcgtcagaacgttcgccccgtttgttgcgggaatgggccacatgtcgtaccgtcatttcgccgcttataacgtgattggcgcactgttgtgggtactgctttttacctacgcaggctatttcttcggcacgctccccttcattcagagcaaccttaaactgatgattgttggcattatttttgtttcaatattgccaggtgttttcgaatttattcgccacaaacgcgcagcggcacgcgccgcaaaataa

SEQ ID NO: 5566 - protein, 219 aa, Escherichia coli
MDLIYFLIDFILHIDVHLAELVAEYGVWVYAILFLILFCETGLVVTPFLPGDSLLFVAGALASLETNDLNVHMMVVLMLIAAIVGDAVNYTIGRLFGEKLFSNPNSKIFRRSYLDKTHQFYEKHGGKTIILARFVPIVRTFAPFVAGMGHMSYRHFAAYNVIGALLWVLLFTYAGYFFGTLPFIQSNLKLMIVGIIFVSILPGVFEFIRHKRAAARAAK

SEQ ID NO: 5567 - DNA, 813 bp, Escherichia coli
atgtccgaccagcaacaaccgccagtttataaaattgcgctgggcattgagtacgacggcagtaggtattacggctggcaacggcagaatgaagtccgcagtgtgcaggagaagctggaaaaggcgctctcccaggtggcgaacgaacccatcaccgtcttctgcgccgggcgtactgacgcaggggtacacggtaccgggcaggtggtgcatttcgaaacgaccgcgcagcgcaaagacgctgcgtggacgttaggcgtaaatgcgaatttacctggtgacatcgccgtgcgttgggttaaagctgtacctgatgattttcatgcccgatttagcgccacggctcgccgttatcgctacatcatctacaatcatcggctgcgcccggcggtactgagtaaaggagtaacccatttttacgagccgctggacgctgaacggatgcatcgggctgcgcaatgcttgctgggcgagaatgatttcacctcgttccgtgcggtgcagtgtcagtcccggaccccgtggcgcaacgttatgcatattaatgtcacgcgtcacggtccttatgtggtggtagatatcaaagcgaatgcctttgtacatcatatggtcaggaatattgtcggcagcctgatggaagtcggtgcccacaaccagccggagagctggatagcagagttgctggcggcaaaggacagaacgctggcggcagcaacggcaaaagcggaagggctatatctggtcgcggtggattaccctgaccgatatgatcttccaaaaccgccaatgggcccgctatttctggcggactaa

SEQ ID NO: 5568 - protein, 270 aa, Escherichia coli
MSDQQQPPVYKIALGIEYDGSRYYGWQRQNEVRSVQEKLEKALSQVANEPITVFCAGRTDAGVHGTGQVVHFETTAQRKDAAWTLGVNANLPGDIAVRWVKAVPDDFHARFSATARRYRYIIYNHRLRPAVLSKGVTHFYEPLDAERMHRAAQCLLGENDFTSFRAVQCQSRTPWRNVMHINVTRHGPYVVVDIKANAFVHHMVRNIVGSLMEVGAHNQPESWIAELLAAKDRTLAAATAKAEGLYLVAVDYPDRYDLPKPPMGPLFLAD

SEQ ID NO: 5569 - DNA, 1014 bp, Escherichia coli
atgtctgaaggctggaacattgccgtcctgggcgcaactggcgctgtgggcgaagccctgcttgaaacgctggctgaacgtcagttcccggttggggaaatttatgcactggcacgtaacgaaagcgcaggcgaacaactgcgctttggtggtaagacaatcaccgtgcaggatgccgctgaattcgactggacgcaggcgcagctggcgttttttgtcgcaggcaaagaagctaccgctacctgggttgaagaagcaaccaactcaggttgtctggtgatcgacagcagcggattgtttgctctcgaacccgacgtaccgctggtggtgccggaagtaaacccgtttgtactgaccgattaccgcaaccggaatgtcatcgccgtaccagacagtctgaccagccaactgctggcggcactgaaaccgttaatcgatcagggcggtttgtcgcgtatcagcgttaccagcctgatttcagcctccgcccagggtaaaaaagcggtcgatgcgttagcggggcagagtgctaaattactcaatggcattccgattgacgaagaagatttcttcgggcgtcagctggcgttcaacatgctgccgttactgccggatagcgaaggtagcgtgcgtgaagaacgtcgtatcgttgacgaagtacgcaaaatcctgcaggacgaagggctgatgatttcggcaagcgtcgtccaggcaccggtattctacggtcatgcccagatggtcaactttgaagcactgcgtccgctggcggcagaagaagcgcgtgatgcgtttgctcagggcgaagatattgtgctctctgaagagaacgaattcccgactcaggtaggagatgcttctggtagtccgcatctttctgttggctgcgtacgtaatgactacggtatgccggagcaagtccagttctggtcggtggccgataacgttcgctttggcggcgcgctgatggcagtaaaaatcgccgagaaactggtgcaggagtatctgtactaa

SEQ ID NO: 5570 - protein, 337 aa, Escherichia coli
MSEGWNIAVLGATGAVGEALLETLAERQFPVGEIYALARNESAGEQLRFGGKTITVQDAAEFDWTQAQLAFFVAGKEATATWVEEATNSGCLVIDSSGLFALEPDVPLVVPEVNPFVLTDYRNRNVIAVPDSLTSQLLAALKPLIDQGGLSRISVTSLISASAQGKKAVDALAGQSAKLLNGIPIDEEDFFGRQLAFNMLPLLPDSEGSVREERRIVDEVRKILQDEGLMISASVVQAPVFYGHAQMVNFEALRPLAAEEARDAFAQGEDIVLSEENEFPTQVGDASGSPHLSVGCVRNDYGMPEQVQFWSVADNVRFGGALMAVKIAEKLVQEYLY

SEQ ID NO: 5571 - DNA, 1158 bp, Escherichia coli
ttgtcagagactgaaaaagggttaaaaatccttgttgatgaaaatatgccttatgcccgcgacttatttagccgtttgggtgaggtgaccgcggttcccgggcgtccaattcccgtcgctcaactggcagacgcggatgcgcttatggtgcgttcggtcacgaaagtgaatgaatctttgctggcaggaaaacccattaaatttgttggcactgccaccgcggggaccgaccatgtcgatgaagcctggttaaagcaggcgggaattggtttttccgctgcacctggctgtaatgcgattgcggtagtggaatatgttttctcctccctgctgatgcttgccgaacgcgatggattttcactgcacgagcgtaccgtggggatcgttggcgttggtaacgttggtcgtcgtttacaggcgcgactggaagcgttagggatcaaaaccttactttgcgatccgccccgcgccgaccgtggggatgagggtgatttccgctcgctggatgagttagtccagcatgcggatattctgactttccatacgccactctttaaagatggtccgtacaaaacgctgcatctggcggatgaaaaactgatccgcagcctgaaaccgggagcgatcctgattaacgcctgccgtggcgcagtcgtcgataataccgccctgctgacctgcctgagcgaaggccagaagttaagcgtagtgctggatgtctgggaaggcgaaccggaacttaacgtggaattgctgaaaaaagtggatatcggcacgccgcatatcgcaggctataccctggaaggtaaagcacgcggtactacgcaagtgtttgaagcttatagcaagtttattgggcatgaacagcacgttgcgctggatacattactgcccgcgccagagtttggtcgcattacgctgcatggcccgctcgatcaaccgacgctgaaaaggctggtgcatttggtgtatgatgtgcgccgcgatgacgcaccgctgcgtaaagtcgccgggataccgggtgagttcgataaactgcgcaaaaactatcttgagcgccgtgaatggtcatctctgtatgtgatttgtgatgacgccagtgcggcatcattgctgtgtaaactgggttttaacgccgttcatcatccggcacgttaa

SEQ ID NO: 5572 - protein, 385 aa, Escherichia coli
MSETEKGLKILVDENMPYARDLFSRLGEVTAVPGRPIPVAQLADADALMVRSVTKVNESLLAGKPIKFVGTATAGTDHVDEAWLKQAGIGFSAAPGCNAIAVVEYVFSSLLMLAERDGFSLHERTVGIVGVGNVGRRLQARLEALGIKTLLCDPPRADRGDEGDFRSLDELVQHADILTFHTPLFKDGPYKTLHLADEKLIRSLKPGAILINACRGAVVDNTALLTCLSEGQKLSVVLDVWEGEPELNVELLKKVDIGTPHIAGYTLEGKARGTTQVFEAYSKFIGHEQHVALDTLLPAPEFGRITLHGPLDQPTLKRLVHLVYDVRRDDAPLRKVAGIPGEFDKLRKNYLERREWSSLYVICDDASAASLLCKLGFNAVHHPAR

SEQ ID NO: 5573 - DNA, 114 bp, Escherichia coli
atgttccagccttcagacatggtggtttactccagaaatagcaaagctccctgccaatgttacagcagagagcatgaagaagagattaacgtgccggatgatgaacggcgttaa

SEQ ID NO: 5574 - protein, 37 aa, Escherichia coli
MFQPSDMVVYSRNSKAPCQCYSREHEEEINVPDDERR

SEQ ID NO: 5575 - DNA, 1005 bp, Escherichia coli
atgtcgattaagaagctcgaagatggtcgttatttgctggacatcaggccgaacggacgcaagggaaagcgcgtgcgtaaggtatttgacaaaaaatcggtagcggtggccactgaacgctacatcatggcgaacgctgaaaagcgggaatatatacagggctaccgtgatcgtcgaacgctaaatgatttgcttgagttgtggtggatgtatcacggccagcacaggcgtaaggcggaagaagaccgaaaacaactgcgcaacataattaatgagcttggcgctgatatgcaggctgtggatcttgataagctgaaaattatcgcgtggcgttctcaaaagatagctgaaggattgaaaccgtcatctgctaacaggtacatgaatcggttatccggaatgtttaccgtgctgaaaaaaataggtctttgggatgcagaacatccagtaaggggaatttctattctttatgtatctccacgagaaatggcgttcctgtcacagaaggaagtggcgctattgctcgatacactggagggcgactactggcgtgttgcgcttttgtgtttaagcacaggggcgcgctggagtgaagcttgtaagcttcgtggtgaacagatagttcataaccgtgtaacgtttcttgaaaccaaaaatggccggaagagaacagtgccaatttcgcaggcagtttgtgaggcgatcaaaaccagagaaacaggcagcttgtttgaggtgaagtaccgggaattctgcctggcgctgaaaagagttaagcccgatttaccaaaaggccaggctgcacatgtgctgcggcatacgttcgccagccattttgtgatgaacggaggaaacattattgcgcttcagaagattcttggtcacgcaaccattcagcaaacaatggcatatgcgcattttgcaccggattacctgcaggatgcggtggcccttaatccgctgaaaggtggcgtaagtgtccacgcagtgtccacgggggattaa

SEQ ID NO: 5576 - protein, 334 aa, Escherichia coli
MSIKKLEDGRYLLDIRPNGRKGKRVRKVFDKKSVAVATERYIMANAEKREYIQGYRDRRTLNDLLELWWMYHGQHRRKAEEDRKQLRNIINELGADMQAVDLDKLKIIAWRSQKIAEGLKPSSANRYMNRLSGMFTVLKKIGLWDAEHPVRGISILYVSPREMAFLSQKEVALLLDTLEGDYWRVALLCLSTGARWSEACKLRGEQIVHNRVTFLETKNGRKRTVPISQAVCEAIKTRETGSLFEVKYREFCLALKRVKPDLPKGQAAHVLRHTFASHFVMNGGNIIALQKILGHATIQQTMAYAHFAPDYLQDAVALNPLKGGVSVHAVSTGD

SEQ ID NO: 5577 - DNA, 288 bp, Escherichia coli
atgagcgaatcagagcttggggggttcattcaggtagcaccatatccacttgaagcggtgccatatcaactattcgccaagatgatcggccgcaaggaatccacagtcagaaccatgattgacgcagcaaagctaccgacaattgactttgtgaaaccaggttcagtaaagacgcgtgcatcagaaaactgggtatatctgccagcatttaacgaaggcatgcgcaaagcgttttttgagcaaccgaaagaacgccgcgacgcatggttgttgtggctgggactttag

SEQ ID NO: 5578 - protein, 95 aa, Escherichia coli
MSESELGGFIQVAPYPLEAVPYQLFAKMIGRKESTVRTMIDAAKLPTIDFVKPGSVKTRASENWVYLPAFNEGMRKAFFEQPKERRDAWLLWLGL

SEQ ID NO: 5579 - DNA, 207 bp, Escherichia coli
atgaccagccatatcatcagcgccattctgacccttgtttttattgagataggcgtaatagagatctatttgtttcgcaagttaacgggacatgaagaacgctttattgaactcagcattgaatatatcgccgcttataccaaaggacttttcccggcagctattggggcgatgtttatagcgtttgttatctggtttatcgggtga

SEQ ID NO: 5580 - protein, 68 aa, Escherichia coli
MTSHIISAILTLVFIEIGVIEIYLFRKLTGHEERFIELSIEYIAAYTKGLFPAAIGAMFIAFVIWFIG

SEQ ID NO: 5581 - DNA, 342 bp, Escherichia coli
atgaaacagcaacgtaattcacgctttcgcaatggtgcagaacgccacgctaaccgttttgctaccagtgcatcacgcagcaacatccgctacagcctgagtgatacacacgcaacgccggatggctacccagtaaaacaaatcggcgagcatgcctggctgattgagaaagctggaatcgtgatccacaaatgcccacacaatccgtttaccggaaaccgcatttttactctaagcagtggcgacaatcagttcgggcaggatttcacattatacgaagcacttcgcacggttgatcgtctgcttcgcgggcaaagttttattaaacaggctgatttataa

SEQ ID NO: 5582 - protein, 113 aa, Escherichia coli
MKQQRNSRFRNGAERHANRFATSASRSNIRYSLSDTHATPDGYPVKQIGEHAWLIEKAGIVIHKCPHNPFTGNRIFTLSSGDNQFGQDFTLYEALRTVDRLLRGQSFIKQADL

SEQ ID NO: 5583 - DNA, 288 bp, Escherichia coli
atgaccaaagaccatgcacaaggtgtatttatccgttttattgattttcgcggtgaactgttattacgtgcatccgctattgacggagtgactccggcgggtaaaaacggagccgacgaagccacttacgtttatctgaacggcacgcgactgcttctggaacttccgtaccagaccgtacgagaaatcattagcgaagctgaaaaggcacgccaggctaatggcgatgaaccctatatcgaaattatttgtatggattcagaagctgaaatacagaaagcagattaa

SEQ ID NO: 5584 - protein, 95 aa, Escherichia coli
MTKDHAQGVFIRFIDFRGELLLRASAIDGVTPAGKNGADEATYVYLNGTRLLLELPYQTVREIISEAEKARQANGDEPYIEIICMDSEAEIQKAD

SEQ ID NO: 5585 - DNA, 243 bp, Escherichia coli
atgggcaaagaatataaaactctcattaacaaagcacttgagcgtttttattttcgcttaagtgcatcaggcgctcatgctgaacgtgcggcccgtgactcattgaccagagcaatccgaagtctgtatgacgtggctttttacgctgatgatctggatgcacttaacgaactttccgagctgatctgtgccgcagaatgcggggaacatattgaaccgtataagctggggaatatcgcatga

SEQ ID NO: 5586 - protein, 80 aa, Escherichia coli
MGKEYKTLINKALERFYFRLSASGAHAERAARDSLTRAIRSLYDVAFYADDLDALNELSELICAAECGEHIEPYKLGNIA

SEQ ID NO: 5587 - DNA, 114 bp, Escherichia coli
atgagtatatttatctcatggcttgttctgattatttcggtggcctgcgctattgggattatgcgaattattcattcaataaaaaagattgaacgttttttcactggcgaataa

SEQ ID NO: 5588 - protein, 37 aa, Escherichia coli
MSIFISWLVLIISVACAIGIMRIIHSIKKIERFFTGE

SEQ ID NO: 5589 - DNA, 267 bp, Escherichia coli
atgaccattctggactacatcgctacccatccgggttgtagcggcggagaaatcgccgcagcactgaataccccaaccacagccatcaatgctgagttacgccgactctggcgcggcggcttagtcatcagaacaaaccgcagcacaggtggtcgcgctcgcaaagcaggaggccaagcttcttaccacgtaaacccgatgccgttcgggtgtagcaatccacttactcacatgtttaaccagctactgaaggaaaccagagcatga

SEQ ID NO: 5590 - protein, 88 aa, Escherichia coli
MTILDYIATHPGCSGGEIAAALNTPTTAINAELRRLWRGGLVIRTNRSTGGRARKAGGQASYHVNPMPFGCSNPLTHMFNQLLKETRA

SEQ ID NO: 5591 - DNA, 300 bp, Escherichia coli
atgagcaccatcaatcaccagaagctacgcgaactggcatttgccctgcaacgaatggcaacgcctcaaaaattactggtatttcgcgcaatgctctcgccgtctgctgtgctggcactgctggatgagctggagcacgccagaaccacggctcctgccattcgcctgacgctccatcatgaaatcgctgatttctgcgcgacgttgaaggcgccaggcgaaccggaaacaccggaagcaatacagcaagagctgctgcaacgcattgacaaggtttttgatttttttctgaaccagtaa

SEQ ID NO: 5592 - protein, 99 aa, Escherichia coli
MSTINHQKLRELAFALQRMATPQKLLVFRAMLSPSAVLALLDELEHARTTAPAIRLTLHHEIADFCATLKAPGEPETPEAIQQELLQRIDKVFDFFLNQ

SEQ ID NO: 5593 - DNA, 192 bp, Escherichia coli
atggcaaaccgcaaaccacaccgcgctatcgcggagcgtcgtcacatccagactgaaatcaaccgcagactttcccgcgcatcacgcgtcgcgcaaatcatgcacatcaatatgctgcatgagcgcagccacgcactatcaaacatttattccgcctctgttttcagctatctggcggatgatctgcactag

SEQ ID NO: 5594 - protein, 63 aa, Escherichia coli
MANRKPHRAIAERRHIQTEINRRLSRASRVAQIMHINMLHERSHALSNIYSASVFSYLADDLH

SEQ ID NO: 5595 - DNA, 366 bp, Escherichia coli
atgattctcgccaacgactttcttgaatacctgctcaacacagaacgtgatcttgccgctcgcgtgcgtgatcgttatgacatgtacctgaaatccctgcctgtaccgcagctcgctgacggaaagattgttattgatggtcgctacatgattgacagccacgagggaaattacaggctttaccgcattgaaggtggcaccccgtccgttattggcatttaccagcgcccatcctctgcaatcgtcgatgtgattgccgacagcatccgcatcacacatcgccatgccgacacagaagacaccgtgctggaaattcagcggctggctacagtctgccgcgacaccctgaatggcatgtcgaagtaa

SEQ ID NO: 5596 - protein, 121 aa, Escherichia coli
MILANDFLEYLLNTERDLAARVRDRYDMYLKSLPVPQLADGKIVIDGRYMIDSHEGNYRLYRIEGGTPSVIGIYQRPSSAIVDVIADSIRITHRHADTEDTVLEIQRLATVCRDTLNGMSK

SEQ ID NO: 5597 - DNA, 1536 bp, Escherichia coli
  n 1513, 1514, 1515, 1516, 1517: n is any nucleotide
atgacggcagagtacatcagggactggcaacaaccgcgccacgcagtggggcgtgaaggaacggggatccccgctcctgaatccgcgctttcctcctggctggatgcctaccgggtagagaacgagcgctgccaggaaatggctgatgcggcgttctccgcaacgccgctgggcaacctgattaataaaagcctggacgcacaggaaaaacaggacaaaaccatcacactggcaggagacgccagaaaacaggcacgcggcgcggtggatgaagccatggcttcgctgcgcctgctgccgtcctatctgcgcgatccgcttattcgccacctctccttcctgcgcaaaaaacaggaagccgatcgtcagaaaggcaaaaagagctggcaggctgaacgctacgcgcgcggaaacctgcgcaaaatattcgaacgtctggagcgcaccgatcaccgctggctgacacagggttatcgctcccttgccggacgcgaacgcctggatgatttgctttacctgccgcagctcaaccagcaccagatacagacgctggccaccatgacggcggcgatgttcagcagcaccttcgaaaaactctgcgatggctttggcgcgaccgatggcgaactgaccatggatgtaacgctgaaggcgtatcagatgctggcccgcatggcgttacacctgcacgccatgccgccacattacgaagctctgaacaagagcgatccggatacggaactgttaccgggcgcaatccttcgcctgacctgtgcggaatggtggaaacgcaaactgtggctgttacgttgcgagtggcgggaagaacaactccgcgccgcctgtctggtttccagaaaaacatcgccctatctgagccaggacgcgttaagcgagtttcgcgcacagcgcgagaaaacacgcgatttcctgaaaagtttcatgctggaaaacgaagacgggttcacgattgatctcgagacagtgtattacgcgggagtaagtaacccggttcaccgtaaggcagaaatgatggccaccatgaaggggctggaacttctggccgaagcccgtggcgacaaagcggtgtttctgaccatcacctgcccgtcaaaataccacgccacaacagagaacggtcatccgaatcccaaatggaacggggccaccatgcgcgactccagcgattacctggttaacacgttttttgcggcggtccgcaagaaactgaaccgcgacggcctgcgctggtatggcatccgcacggtggagcctcaccatgacggcaccgtgcactggcatatgatggtctttgctcatccggaagaaatcgacaccattgtgtcccacacccgcgatattgccattcaggaagatcgtcacgagctgggtgatgatattaccccacgctttaaggcggagtacgtcgacggctcaaaaggcacgccaaccagctacatcgccacctacatcggaaagaacctggacagccgcgccgtagatggcatcgacnnnnncattccattcattaattaa

SEQ ID NO: 5598 - protein, 511 aa, Escherichia coli
  Xaa 505, 506: Xaa is any amino acid
MTAEYIRDWQQPRHAVGREGTGIPAPESALSSWLDAYRVENERCQEMADAAFSATPLGNLINKSLDAQEKQDKTITLAGDARKQARGAVDEAMASLRLLPSYLRDPLIRHLSFLRKKQEADRQKGKKSWQAERYARGNLRKIFERLERTDHRWLTQGYRSLAGRERLDDLLYLPQLNQHQIQTLATMTAAMFSSTFEKLCDGFGATDGELTMDVTLKAYQMLARMALHLHAMPPHYEALNKSDPDTELLPGAILRLTCAEWWKRKLWLLRCEWREEQLRAACLVSRKTSPYLSQDALSEFRAQREKTRDFLKSFMLENEDGFTIDLETVYYAGVSNPVHRKAEMMATMKGLELLAEARGDKAVFLTITCPSKYHATTENGHPNPKWNGATMRDSSDYLVNTFFAAVRKKLNRDGLRWYGIRTVEPHHDGTVHWHMMVFAHPEEIDTIVSHTRDIAIQEDRHELGDDITPRFKAEYVDGSKGTPTSYIATYIGKNLDSRAVDGIDXXIPFIN

SEQ ID NO: 5599 - DNA, 810 bp, Escherichia coli
  n 12, 13, 14, 15, 16: n is any nucleotide
atgaatgaatgnnnnnaaaatgactcaatccttgcctggattcgaaatactgactgggcgaagattggatttaaaaatgatgccgatggtgacactgattcatacatgtggtttgaaacaggcgacaacggcaatgaatatttcaaatggagaagccgccagagcaccacaacaaaagacctgatgacgctgaaatgggatgcactaaatattcttgttaatgctgtcattaatggcagtcttggagttggttcgacgaatgcgttaggtggtagctctattgttcttggtgataatgacaccggatttaaacagaatggagacggtattctggatgtttatgctaatagtcagcgtgtattccgctttcagaatggagtggctattgcttttaaaaatattcaggccggggatggtaaaaaattcacgctatccagctccaacaactccacaaagaatgcaacgtttaatttatggggtgcttcaacccgtccagtagttgcagagttaggcgatgaggcaggatggcatttctatagccagcgaaatacagataactcggtaatattttctgttaacggtcagatacagcccagcaactgggggaattttgattcacgctatgtaaaagatgttcgcctgggtacgcgtgttgttcaattgatggcgcgtggtggtcgttatgaaaaagccggacacgcaattaccggattaagaatcattggtgaagtagatggcgatgatgaagccatcttcagaccaatacaaaaatacatcaatggcacatggtataacgtcgcacaggtgtaa

SEQ ID NO: 5600 - protein, 269 aa, Escherichia coli
  Xaa 4, 5, 6: Xaa is any amino acid
MNEXXXNDSILAWIRNTDWAKIGFKNDADGDTDSYMWFETGDNGNEYFKWRSRQSTTTKDLMTLKWDALNILVNAVINGSLGVGSTNALGGSSIVLGDNDTGFKQNGDGILDVYANSQRVFRFQNGVAIAFKNIQAGDGKKFTLSSSNNSTKNATFNLWGASTRPVVAELGDEAGWHFYSQRNTDNSVIFSVNGQIQPSNWGNFDSRYVKDVRLGTRVVQLMARGGRYEKAGHAITGLRIIGEVDGDDEAIFRPIQKYINGTWYNVAQV

SEQ ID NO: 5601 - DNA, 528 bp, Escherichia coli
atgcagcatttaaaaaatattaagtccggaaatccaaaaacaaaagaacaatatcagctaacaaaaaattttgatgttatctggttatggtccgaagacggtaaaaactggtatgaggaagtaaataactttcaggacgacaccataaagattgtatacgacgaaaataatattattgttgccataaccaaagatgcctcaacacttaatcccgaaggctttagcgtcgttgagattcccgatataacagccaatcgtcgtgccgatgattcagggaagtgggtgtttaaggacggaactgtggttaagcggatttatacagcagacgaacagcaacaacaggccgaatcacaaaaggccgcgttactttcagaagctgaatcagtcatccagcttctggaacgtgctgtcaggctgaatatggcaacagatgaggaacgtacacgactggaagcctgggaacgctacagcgttctggtcagccgcgtggatacggcaaagccagaatggccacaaaaaccagagtaa

SEQ ID NO: 5602 - protein, 175 aa, Escherichia coli
MQHLKNIKSGNPKTKEQYQLTKNFDVIWLWSEDGKNWYEEVNNFQDDTIKIVYDENNIIVAITKDASTLNPEGFSVVEIPDITANRRADDSGKWVFKDGTVVKRIYTADEQQQQAESQKAALLSEAESVIQLLERAVRLNMATDEERTRLEAWERYSVLVSRVDTAKPEWPQKPE

SEQ ID NO: 5603 - DNA, 534 bp, Escherichia coli
atgatgcacttaaaaaacattactgctggcaaccctaaaacaaaagagcaatatcagctaacaaagcaatttaacatcaaatggctttattcagatgatggaaaaaactggtatgaggaacaaaagaatttccagccagacactttgaaaatggtctatgaccataacggcgttattatttgtattgaaaaggatgtttcagcaattaatccggaaggcgcaagcgtcgttgaattacctgatattacagcaaatcgccgggctgatatttcggggaaatggatgttcaaagatggcgtagtgataaagcgaacttataccgaggaagagcagagacaacaagcggaaaatgaaaagcaaagcctgttgcaacttgtcagggataaaacccagctatgggactcacagctacggctgggcatcatttccgacgagaataagcagaaattaaccgagtggatgctctttgcgcagaaagtcgaatctacagacacctccagcctgccagtaacgtttcccgaacaaccagaatga

SEQ ID NO: 5604 - protein, 177 aa, Escherichia coli
MMHLKNITAGNPKTKEQYQLTKQFNIKWLYSDDGKNWYEEQKNFQPDTLKMVYDHNGVIICIEKDVSAINPEGASVVELPDITANRRADISGKWMFKDGVVIKRTYTEEEQRQQAENEKQSLLQLVRDKTQLWDSQLRLGIISDENKQKLTEWMLFAQKVESTDTSSLPVTFPEQPE

SEQ ID NO: 5605 - DNA, 600 bp, Escherichia coli
gtgctgattggctatgtaagggtatcaacaaatgaccagaatacagacctgcaacgaaacgctcttgtttgtgcaggatgtgaacaaatatttgaagataaattaagcgggacaaagacagaccgaccgggattaaaacgcgctttaaagcgccttcaaaaaggtgacacgctggttgtctggaaactggatcgcctcgggcgaagcatgaaacatctgatttctctcgtcggggaactacgggagcgagggattaattttcgcagtctgaccgacagcatagacacatcttctccaatggggcgttttttcttccacgtgatgggtgccctggctgaaatggaacgtgaattaattgttgaacgtacactggccgggctggcggcagcgcgcgcaagggggcgcacaggcggacgtcgaccgaagctgacaaaagaacagcatgagcaaatagcaaggctaatcaaaaacgggcacgacagaaaacaactggcaataatttacggcattggcacatcgacgatttatcgttatcaccctgtaggcgatatacagactgaagaaacaaccgggcagactcaggaaaatgaaaaccgctaa

SEQ ID NO: 5606 - protein, 199 aa, Escherichia coli
MLIGYVRVSTNDQNTDLQRNALVCAGCEQIFEDKLSGTKTDRPGLKRALKRLQKGDTLVVWKLDRLGRSMKHLISLVGELRERGINFRSLTDSIDTSSPMGRFFFHVMGALAEMERELIVERTLAGLAAARARGRTGGRRPKLTKEQHEQIARLIKNGHDRKQLAIIYGIGTSTIYRYHPVGDIQTEETTGQTQENENR

SEQ ID NO: 5607 - DNA, 489 bp, Escherichia coli
atgatgatgatctacggcatgtttgtttttgagctgcgcacgctgccgcatcagcagttacagcaaaacaaaagctggcggcatgtgaaaaatgaacgcgttaaccgttcagcaagctggcagtatatcggtgcaggtgatgatcgcatcgttctttctggtgtgctttatcctgaaattacaggtggcgaagtgtcgctgtcgctgctgaccacgcaggcgtatacaggacgaccctggcctttgattgatggcgtcgggcagatttacggcatgtatgtcctgactgaaacgaatacgacccgctccgagtttgatcgctacggtaaggcgaaaaagatagaattttcactgactcttgaacgctgtgatgaggatttgcgggagcgcctgcaatcctcatcgttcagtgatatgctgtccggcttcaaagataaggtgacatcatctcttaacagcgcggccagttcagttaaagggctgttctga

SEQ ID NO: 5608 - protein, 162 aa, Escherichia coli
MMMIYGMFVFELRTLPHQQLQQNKSWRHVKNERVNRSASWQYIGAGDDRIVLSGVLYPEITGGEVSLSLLTTQAYTGRPWPLIDGVGQIYGMYVLTETNTTRSEFDRYGKAKKIEFSLTLERCDEDLRERLQSSSFSDMLSGFKDKVTSSLNSAASSVKGLF

SEQ ID NO: 5609 - DNA, 2808 bp, Escherichia coli
atgaagactcttgatatccgggtcgctttcagcgccgttgacaggctgacccgacctgccgaaaacgcccgccgcctgatggggcagtttggtgactccatccagcgaacgcagggggcgatcaaaaatctcgagcgtcaggcgcgatcatttgagcgcgcccgcgacgctgtcagtaaagcggacgcgggcatcgtgaaagcacgacgccagcttaacgcccttaatcagttacaacgcacgggtacagtgctcagcgaaaaacaacaaaagctgatgcagcagttaagcacccggcttgaacgcctgaatgaatcgcgcacacgggaaattcagaaaatgcgggagcttggcggagaactgaaacgccacggcatttccctgacaggcagcgataacaccattcagcaggccatcagacgcaccgaacagtacaacaaccagcttgaacgcgaacggcaggcgcttgcgcgtgtaacgcgggcgcgtgagcggtattcgcgcgcgcaggaaaccgcgggaaaactgaaaacaggtggtgcgctggcaattggtgcggcagcggcgggcggctatgctgccgggcgttttttgcagcctgcgatcgggttcggcaaagagatgtcccgcgttcaggcactgacgcgaatcgacaaaaacagcccgcagtttaaggcgctgcgtgagcaggcgttaaaactgggctctgaaacgcagttcaccgcaggcgatgccgccagtgggcaggcatttcttgcaatggctggctttacaccacaggccattcaggctgcgctccctggcgtactgagcatggcaacggctggcggtatggacctcggtgagacggcggatattggctcaaatattctgacgcagttcggtctttctgctgaccagatggaccgggtcggcgacacactcaccgcagcgtttacccgtaccaacactgaccttcgcgcactgggtgaaaccatgaaatatgcaggtccggtggcgggtaagctgggaatatcgctggagcaggccgcagcgatggcgggcgtgctggcgaatatgggtatcagggggagtgatgctggtacggcaatgcgtgccagcctggctcgtctggcatcaccgccaaaggcggcagcagaggcgctgaaagagcttggcgtgtctgtctcggatgccgggggcaaaatgcgcccgatggaggatgtgctggctgacctttataaagctacccgcaaatacggggaagttgaccgggtatcgttctttaaggacattgccggagaagaggctttcacatcatttatggccctcgttgatgcggcaggtgacggctccttacccaaactgagaaaagaacttgaaggcgcgcgcggtgaggctgaacgcacggcaaaggttatggccaacaaccttgacggcgatctgaaatcactcagcagtgcatgggaagggttgcgcatccgcattgcagatctgattgacggtccgctgcgttctgtcacgcagtggctcacgcgtgtggtatcaaaggtgacggcgctggcgcaggcccatcccgcactgacgcgccagctactgattgcaggcggtgcactgctggcaatgactgcaacggttggctcgttgtcgctggctattggtgtgcttgctggcccgctggcaaaactgcgtcttggtttttccctcctgaccggatcaatgaatgctgtcagggttctgccagcactatggggaatggtgacgggttccgtttctttactgggaggcgctatcggggcgttgttcagtccggttggtcttatcgtggctgcgcttgccggagctgccgttcttatctggaaatactgggatcccatcagggcattttttgccggggtgttcagcgggattatggaaaggctgaccccgttgcgcgaaacctttgaacggtttggtcctgtttttgacgcaatcgggagtgggatcagccaggtgtttaactggtttaaatcgctgctgtcaccgatggagtccagcaaggaaactctggataaatgtaccagtgctggcgagatattcggtaacgttcttggcggtgcgttacagcttgttctgacacctgcaaaaatgttgctggatacgctggcgtggatacttgaaaagcttggtgtgcttccggatgaagcggaaagggcgcgcaagaaaatcgaagacgcacagcgtgcggccattcttcaggacaaggttgccttgcttcagggggacctggcgaaaatcaatccgccgaagcctgtggaaaatggcaatggcaccggaggtgataaccccaaagacaataaaccgctcacagacagcaataccggtacgctgcgcagactcagcaaaattgctgataacacaggtaagctggttgaggagacgaaaaaacgcattggccccggcgatattgtctttaaaaacctgccccgagcacttgctgttcgtggggagtggcaggagcggaagattgcgcaggtcagtaagcctgcccccgcaattaatatcacacccgtggtcccggctccgctgcctccggcgctggtccctgttgttgcggccagctcccgcccggtggcggaggctatacgatctccagtggcatcagttcctgtaacttcccgtaaccgggagcctgttgcctccggatttggtggtgaaattcatgttcatctgcataacgttgttacgcagaatccccgcgaactggcgaaactggtcggtgaaatggtcagggcagaaatggaacggcgcgcccgtgccgggcgtggcagtttttacgataaagattga

SEQ ID NO: 5610 - protein, 935 aa, Escherichia coli
MKTLDIRVAFSAVDRLTRPAENARRLMGQFGDSIQRTQGAIKNLERQARSFERARDAVSKADAGIVKARRQLNALNQLQRTGTVLSEKQQKLMQQLSTRLERLNESRTREIQKMRELGGELKRHGISLTGSDNTIQQAIRRTEQYNNQLERERQALARVTRARERYSRAQETAGKLKTGGALAIGAAAAGGYAAGRFLQPAIGFGKEMSRVQALTRIDKNSPQFKALREQALKLGSETQFTAGDAASGQAFLAMAGFTPQAIQAALPGVLSMATAGGMDLGETADIGSNILTQFGLSADQMDRVGDTLTAAFTRTNTDLRALGETMKYAGPVAGKLGISLEQAAAMAGVLANMGIRGSDAGTAMRASLARLASPPKAAAEALKELGVSVSDAGGKMRPMEDVLADLYKATRKYGEVDRVSFFKDIAGEEAFTSFMALVDAAGDGSLPKLRKELEGARGEAERTAKVMANNLDGDLKSLSSAWEGLRIRIADLIDGPLRSVTQWLTRVVSKVTALAQAHPALTRQLLIAGGALLAMTATVGSLSLAIGVLAGPLAKLRLGFSLLTGSMNAVRVLPALWGMVTGSVSLLGGAIGALFSPVGLIVAALAGAAVLIWKYWDPIRAFFAGVFSGIMERLTPLRETFERFGPVFDAIGSGISQVFNWFKSLLSPMESSKETLDKCTSAGEIFGNVLGGALQLVLTPAKMLLDTLAWILEKLGVLPDEAERARKKIEDAQRAAILQDKVALLQGDLAKINPPKPVENGNGTGGDNPKDNKPLTDSNTGTLRRLSKIADNTGKLVEETKKRIGPGDIVFKNLPRALAVRGEWQERKIAQVSKPAPAINITPVVPAPLPPALVPVVAASSRPVAEAIRSPVASVPVTSRNREPVASGFGGEIHVHLHNVVTQNPRELAKLVGEMVRAEMERRARAGRGSFYDKD

SEQ ID NO: 5611 - DNA, 156 bp, Escherichia coli
gtgtgctttgagcacattgaagactttgtggcagatattgccgttatttttaactggtcgcccgccgaaatcttcatgatgacgcccggcgaagtggttagctggcgtgagcgggcggcacttcgcagcgggaatgcagacaatgaagactcttga

SEQ ID NO: 5612 - protein, 51 aa, Escherichia coli
MCFEHIEDFVADIAVIFNWSPAEIFMMTPGEVVSWRERAALRSGNADNEDS

SEQ ID NO: 5613 - DNA, 366 bp, Escherichia coli
atgaaagagacgaaaaacatcgataccgaaaacacggtagttactgacactgtgaaagaaaccagtgagcgtggcgtaaaacttacccaaccaattgagcgaggcggcgaaaaaatcacgtatgtggagatcaccggggctattgagcaggctggatctctgcgagatttgtcgctgtctgatgtgctgaatctgaaagcggaatccatgtttacgctgctgtcacgcgtgacatcaccgcgactggatgaagtgacgatcaaaaaaatggcatcccgtgactttattcagttatgtgtggttgccgtaaattttttgagcggtgcggactctggcgggaagaacgaacaggcgacggaagcctga

SEQ ID NO: 5614 - protein, 121 aa, Escherichia coli
MKETKNIDTENTVVTDTVKETSERGVKLTQPIERGGEKITYVEITGAIEQAGSLRDLSLSDVLNLKAESMFTLLSRVTSPRLDEVTIKKMASRDFIQLCVVAVNFLSGADSGGKNEQATEA

SEQ ID NO: 5615 - DNA, 513 bp, Escherichia coli
atggctgtgccaaaacatcttcgcttttttacgctgtttgtggatggtgaaaacgaagtgggtaaggtgacgtccgtcactctgcctaagctgacgcgcaaaaccgacagctaccgggggggcggcatgatgggtgcggtaagcattgatctcggtctggaagactccgcgcttgatgcgagctttgtcatggggggcgcagttcgtgagctgttccttaagtatggcggcacgattgacggcacgctgctgcgttttgcgggtgaatactacaccgatgcagaaagtgacctgtatgaagtcgaaatgcgcggacgtgtgacggaaattgatatgggggaagccaaacagggcgaagccacatcacacacttacgccattaaaaacacctactacaagctgagtgttaacgatcgcccgttgtgggagattgacctgctgaacttcatttaccggaaggacggcaaggacattgtgcccgatcgcatccgttccgcgctcgggcttggctga

SEQ ID NO: 5616 - protein, 170 aa, Escherichia coli
MAVPKHLRFFTLFVDGENEVGKVTSVTLPKLTRKTDSYRGGGMMGAVSIDLGLEDSALDASFVMGGAVRELFLKYGGTIDGTLLRFAGEYYTDAESDLYEVEMRGRVTEIDMGEAKQGEATSHTYAIKNTYYKLSVNDRPLWEIDLLNFIYRKDGKDIVPDRIRSALGLG

SEQ ID NO: 5617 - DNA, 1185 bp, Escherichia coli
atgagtgaaactcgttttcatggtgcccgtgttacggaaaataccgacctggtaacagcgattaacgatgttgattccagcgttatcggtatcgtggcaacggcggatgatgcggacgcgaagctgttcccgctgaacaagcccacactgctgacccgcgtcaatgacgtgctgggaaaatgcgggacaacggggacgctttatcgtgcacttaaggccatcgcagaccaggtgagcacaaaggtgatcgtcgttcgcgtggctgaacacaaagaagaagacggaaagacgcaggatcaactggttatcggtggttctgaggatgacggcagctatacggggatgtatgcgctgcttgttgcagagcaggatgaaagcatcggataccgtccgcgtattctggccgcgccggagctggacacggaggctgtaacaaaatccctgtgcgtgattgcaggtaaactgcgcgcgtttgtgtatgcctcatgttacggctgtaacacgatggctgaggcgattacctaccgccagaaattcaacgaacgtgaggtgatgctcttatggccggacttcatcgcctacaacccgaaaagtggcaaaaacgaaacgttccccgcgcctgcctatgcgtgcggccttcgtgcgtacattgaccatgagcagggctggcacaaatcattgtccaacgttccggttaaaaatgtgctggggatgtcgaggcatgtgttctggtcgttgcaggccgaagacagcgatgccaacagcctcaacaacaaagaaatcacgaccattattcgtcgcaacgggttccgcttctggggcaaccgcacaccggaaacgaacgcctacatctttgaggtgtatacccgaaccgcacaggtgctggctgattcaattgcggaagcgcagtttgaaaccatcgacagtccactgacgcctgcgaatgtgaaggatgttatcagtgccatcagggcaaaactggattcgctggttactgccgggaaactgattggtgcggagtgctggtatgacgtggtggataacggcaccacgaatttacgtcaggggcgtgtgcgtattcgctacaaatatacgcccgttccgccactggaagacatggagctttaccagacgtttactgatgaatactttgaacccgcatttgcggtgctgggaggtgcctga

SEQ ID NO: 5618 - protein, 394 aa, Escherichia coli
MSETRFHGARVTENTDLVTAINDVDSSVIGIVATADDADAKLFPLNKPTLLTRVNDVLGKCGTTGTLYRALKAIADQVSTKVIVVRVAEHKEEDGKTQDQLVIGGSEDDGSYTGMYALLVAEQDESIGYRPRILAAPELDTEAVTKSLCVIAGKLRAFVYASCYGCNTMAEAITYRQKFNEREVMLLWPDFIAYNPKSGKNETFPAPAYACGLRAYIDHEQGWHKSLSNVPVKNVLGMSRHVFWSLQAEDSDANSLNNKEITTIIRRNGFRFWGNRTPETNAYIFEVYTRTAQVLADSIAEAQFETIDSPLTPANVKDVISAIRAKLDSLVTAGKLIGAECWYDVVDNGTTNLRQGRVRIRYKYTPVPPLEDMELYQTFTDEYFEPAFAVLGGA

SEQ ID NO: 5619 - DNA, 99 bp, Escherichia coli
ttgtatccgttaaatgattcggcaacaatcatcacccaccacgcgcgtaatctcacccctgcgccgttctcccgacccggcgacaacaaaaagcagtaa

SEQ ID NO: 5620 - protein, 32 aa, Escherichia coli
MYPLNDSATIITHHARNLTPAPFSRPGDNKKQ

SEQ ID NO: 5621 - DNA, 1101 bp, Escherichia coli
atgaccgacaccaccatgcaattgctcagtcagggcacagaccccgtgaaaatgccggattttgatattctcgcggagggtaaaacgctgtcaggcgtggcagagcgcctgatgagcctgtcactgaccgacaaccggggatttgaggcggaccagctcaccatcacgctggatgatgcggatggtcagttgcagctaccgccacggggcgcgcgcctgacggttctcattggctggaaaggagaaccgctgacagaaaaaggcacttacattgttgatgaaatcgctcacgaaggaccgccggacaggctgaccatttcggccagaagcgcagattttcgggatgaatttaacgttaaacgtgaggtgtcctggcatgatgtgaccgttgagcgtgtggtatccgccatcgctcatcggtacggtctgaaaccgcaaattagcgaaatgctgatggatatcgaaatcgaccacgccgaccagaccgaagaaagtgacatgtccttccttacgcgcatggcggaaatgctgggcgcaatcaccacggtaaaaagcggtaatctgttattcatcatgccaggcggtggcgtgaacgcgcagggaaaaccattgccatcgtttgccatcacacgcagcagcggcgatcgccatcagtttcgcattgctgaccgcgaggcgtatacgggtgtacgcgcctactggcttgatcttaattacgggaaaaagaaaaaagtcagcgtgaaacgccgcaaaccgaaaaaggagaaaagcagcagccgtgaaggtgattatatggaaggcgcggaaggcaatgtgtttgtgttacgcaagacttatcagaacgagcaggcagcaagacgcgcagcggcggcaaagtggcagcagctacaacgcggagccgcatcattctccatcatgctggcacgcggacgcgcagaactctaccccgaaatgcatggcacggtaacaggctttaaaagcgagattgataatcaggactggattattgcaaaagccgagcacaccattgataacagcggctttaccacacagcttgagcttgaggcaaaaatcccggaatggatagcagaaacagagtga

SEQ ID NO: 5622 - protein, 366 aa, Escherichia coli
MTDTTMQLLSQGTDPVKMPDFDILAEGKTLSGVAERLMSLSLTDNRGFEADQLTITLDDADGQLQLPPRGARLTVLIGWKGEPLTEKGTYIVDEIAHEGPPDRLTISARSADFRDEFNVKREVSWHDVTVERVVSAIAHRYGLKPQISEMLMDIEIDHADQTEESDMSFLTRMAEMLGAITTVKSGNLLFIMPGGGVNAQGKPLPSFAITRSSGDRHQFRIADREAYTGVRAYWLDLNYGKKKKVSVKRRKPKKEKSSSREGDYMEGAEGNVFVLRKTYQNEQAARRAAAAKWQQLQRGAASFSIMLARGRAELYPEMHGTVTGFKSEIDNQDWIIAKAEHTIDNSGFTTQLELEAKIPEWIAETE

SEQ ID NO: 5623 - DNA, 1023 bp, Escherichia coli
atgggaagagatataacgctgtaccctaaaaaagcaactagaaacgaacttaaaaattaccttgaaaatttaggttttaaaaggtgtaaacatttgtgggaatggccccaaggaacgttgaattactcttggtttgatgatacggacttcaaatctacagatggagtttcggctgatatatatcctgtttcaaatgacgaactacacatatctggtaataaatgggcattgcatgtgcgtaatttatatagcgctagttggcatgatgtaaaaatgcttaatgatgttctaaaaggcgcacggagtctttttggtggaacacttataggtgattatgggaaaaataggtacgctcctctatggaaggattctagtagtccgatcagtcgtggcatttcttcaatatttaatcatgtccatcatgagatttccgctgttaaacatgccttacctgaaccttctattaaattaaacctaccggaagatggcggcttatccgaatactttgattacatgcaatgtatggatcccagtagagttatatataatggattagtaccttttgcggttgctatgtttgaatattttttctctagagcttttcaaatacttataaagtacgatcctttcgcaatagcaaaaagaacatcgtataagcaaaaagttgattttgatattctgcttgagatagagaaaggaaatatttcaatagaaagtgttattgcaagaaattacacttttcaaaacttaacccacctaaacaaagcatataaagagtggctggatatagatgtgagagcgattctttataagaaaaaaagaattggaaaatcagttgattttcttgagaatcgaatttctgaaatcatacaatatagacatgggatagttcatcactttgagttggataggaccttaaatcgggatggatatattcatatattagatgcgatagaaaaaagcataattgaatttatccattacatagaaggcaaatacaaatttaaattaaatgcgtattaa

SEQ ID NO: 5624 - protein, 340 aa, Escherichia coli
MGRDITLYPKKATRNELKNYLENLGFKRCKHLWEWPQGTLNYSWFDDTDFKSTDGVSADIYPVSNDELHISGNKWALHVRNLYSASWHDVKMLNDVLKGARSLFGGTLIGDYGKNRYAPLWKDSSSPISRGISSIFNHVHHEISAVKHALPEPSIKLNLPEDGGLSEYFDYMQCMDPSRVIYNGLVPFAVAMFEYFFSRAFQILIKYDPFAIAKRTSYKQKVDFDILLEIEKGNISIESVIARNYTFQNLTHLNKAYKEWLDIDVRAILYKKKRIGKSVDFLENRISEIIQYRHGIVHHFELDRTLNRDGYIHILDAIEKSIIEFIHYIEGKYKFKLNAY

SEQ ID NO: 5625 - DNA, 261 bp, Escherichia coli
atgttccgttgtccgctttgtggcgcatctgcccgtatccgcacaagtcgtccggaaaatgattcaaacaccgtgcggcaaaagtattaccagtgtaacaatctggaatgcggcgtatgcttctcaacactggaagctttccataaattcacatcgaaacacgcctccggcgttcactcttcagaaggtatcccgtggcatgagctaccagcttcacacaggggaaacaatcagatgagtttgcctttacctaagaattaa

SEQ ID NO: 5626 - protein, 86 aa, Escherichia coli
MFRCPLCGASARIRTSRPENDSNTVRQKYYQCNNLECGVCFSTLEAFHKFTSKHASGVHSSEGIPWHELPASHRGNNQMSLPLPKN

SEQ ID NO: 5627 - DNA, 141 bp, Escherichia coli
atgtcgcaaaaatcgcttacagccatcacgttctgcgtgacggtaatcctcatcatctggatgttgcacggttcgctgtgcgaaatacggatgagtttctggggagcggagtttgcggcgttcttacagtgtaagcagtaa

SEQ ID NO: 5628 - protein, 46 aa, Escherichia coli
MSQKSLTAITFCVTVILIIWMLHGSLCEIRMSFWGAEFAAFLQCKQ

SEQ ID NO: 5629 - DNA, 120 bp, Escherichia coli
atgagctttccaaaaaatgaacgcttaagtttttttatttgtttaccgcaagcagggcaatacaatgctgaatcgctcacctctttctggcattcaggacatttgattaatgccatgtaa

SEQ ID NO: 5630 - protein, 39 aa, Escherichia coli
MSFPKNERLSFFICLPQAGQYNAESLTSFWHSGHLINAM

SEQ ID NO: 5631 - DNA, 894 bp, Escherichia coli
atgaaaaatataattttttctataggtgcatcatttatatcaattagtgtactgcctgttcacgcagcaactgaacataataacttcaatgcagtactccagtgccgagcaatagaaaataataaagacagactttcttgttacgataagtcaatacaaccgactcgaacgaaagttgctgaaaaattcgaaagcagagatcaatgccctgatgagaaagatgatgacagacgtttatcttgttatgatcgttttttttctccaacatttactccatctgtaaactcaaaatctaaaacggaaaagccagtaacaacagaggctcagcaaccaaatctttctgagatatctaaatgccgagcagaaaatgataaagaagccagactaaactgctacgataaactattcccacaggataaagctgttcaagctgaatcaaaattagagaaagccacagatgtaggaaaatggcacacatccattactacatcgccaattgatgattcgaaaaatgtaattttatcgttagaaagtgatgattatatcagaactccatttggagaagcggttactcctactctgtttatagcttgccgagaaaagaaaaccgaagtatttcttagttgggatgtatatttaggccttgaacaaaccagcatgctttatcgtcttgataaacagaaagcagttgagcgaaactggctagtatctacagatacaaaggctgttttttataaaggtaatgacattgatttcatccgaaaactagccaactcaaacaaaatgtatacaaaaataactccttataatgagagccctgtaagtgcaactttcaatttaaacggcctgtcaaacgcgctaaaaccacttcaagctgcttgtaactggaaatag

SEQ ID NO: 5632 - protein, 297 aa, Escherichia coli
MKNIIFSIGASFISISVLPVHAATEHNNFNAVLQCRAIENNKDRLSCYDKSIQPTRTKVAEKFESRDQCPDEKDDDRRLSCYDRFFSPTFTPSVNSKSKTEKPVTTEAQQPNLSEISKCRAENDKEARLNCYDKLFPQDKAVQAESKLEKATDVGKWHTSITTSPIDDSKNVILSLESDDYIRTPFGEAVTPTLFIACREKKTEVFLSWDVYLGLEQTSMLYRLDKQKAVERNWLVSTDTKAVFYKGNDIDFIRKLANSNKMYTKITPYNESPVSATFNLNGLSNALKPLQAACNWK

SEQ ID NO: 5633 - DNA, 996 bp, Escherichia coli
atgatacaacctatttccggccctcctcctgggcaaccaccaggtcagggagataacctgccgtctggcgcgggcaatcagcctttatccagtcagcaacgtacttcgctggaaagcttaatgacgaaagtgacctcactgacgcaacaacaaagagcagaactgtgggcgggtatcaggcacgatattggtctgtcgggagattcaccgctgctttcgcgtcacttccctgccgctgagcataatctggcgcaacgtctgttggccgcgcaaaaaagccattctgcccgccagcttttagcgcaattaggggagtatttacgtctggggaataatcgtcaggcggtcacggattatatccgtcataactttggtcagacgccgctgaatcagctctcaccggagcaattaaaaaccattctcaccctgttgcaggaagggaagatggttattccgcaaccacagcagcgcgaggcgaccgaccgtcctttattaccggcggagcacaatgcgctcaaacagctggtgaccaaacttgcggcagcaacgggggaacccagcaaacagatctggcaatcgatgctggaactttccggggtgaaagatggcgagttaattccagcgaaactgtttaaccatctggtgacctggctacaggcgcgtcagacgctaagccagcaaaatacgccgacactggaatcactacagatggcgctaaaacaacctttagatgccagtgaactggcggcgttatcggcatatatccagcaaaaatatggcctttctgcgcaatcatcgctttcttctgcccaggccgaggatattcttaaccagctttatcaacggcgggttaaagggattgagccgcgtgatatgcaaccgctgcttaatccttttccaccgatgatggacacgttgcaaaatatggcaacgcgtcccgcgctgtggatactgttagtcgcgattatcctgattctggtctggctggttcgttaa

SEQ ID NO: 5634 - protein, 331 aa, Escherichia coli
MIQPISGPPPGQPPGQGDNLPSGAGNQPLSSQQRTSLESLMTKVTSLTQQQRAELWAGIRHDIGLSGDSPLLSRHFPAAEHNLAQRLLAAQKSHSARQLLAQLGEYLRLGNNRQAVTDYIRHNFGQTPLNQLSPEQLKTILTLLQEGKMVIPQPQQREATDRPLLPAEHNALKQLVTKLAAATGEPSKQIWQSMLELSGVKDGELIPAKLFNHLVTWLQARQTLSQQNTPTLESLQMALKQPLDASELAALSAYIQQKYGLSAQSSLSSAQAEDILNQLYQRRVKGIEPRDMQPLLNPFPPMMDTLQNMATRPALWILLVAIILILVWLVR

SEQ ID NO: 5635 - DNA, 1179 bp, Escherichia coli
atgactgctgtaagccaaaccgaaacacgatcttctgccaatttttcgctcttccgcatcgcttttgcggtttttctcacctacatgaccgtaggtttaccgttgccggttatcccgctgtttgttcatcatgaactgggctatggcaacactatggtcggcattgccgtcgggattcagtttctggctacggtgctgacgcgtggttacgccgggcgactggccgatcaatatggcgcaaaacgttcggcgcttcaggggatgttagcttgtggtctggcggggggcgcgttactgctggcggcgattttgcccgtccccgcaccgttcaaatttgctctgttggtcgtcgggcgtttgattcttggctttggtgaaagccagttactgacgggcgctctgacctggggattaggcatcgttgggccaaaacattccggcaaagtgatgtcatggaacggaatggctatttacggtgccctcgctgttggtgcgccgcttggcctgttgattcatagccattacggttttgccgcattggcgctcaccacaatggcattacccttattggcgtgggcctgtaacggcacagtgcgcaaagtaccggccctggcgggggaacgtccatcgctgtggagcgttgtcgggcttatctggaaaccagggttaggtctggcactacaaggcgttggttttgcggttatcgggactttcgtttcgctctactttgccagcaaaggatgggcgatggcgggctttactcttaccgcgtttggcggcgcatttgtcgtgatgcgcgtcatgtttggctggatgccggaccgttttggcggcgtgaaagtggcgatcgtctctctgcttgtagaaacggtgggcttgttgctgctctggcaagccccaggggcgtgggtcgcattagcaggcgcggcattaactggagccggatgttcgcttatctttcctgcgctgggcgtggaggtggttaaacgcgtcccctcacacgttcgcggcaccgcactgggcggttacgccgcgtttcaggatatcgccctcggcgtctccgggccgcttgcgggaatgctggcgaccacgtttggttactcttcggtatttcttgccggggcgatctctgcggtgctgggaattattgtcacgatactgtcgtttcgtcggggttaa

SEQ ID NO: 5636 - protein, 392 aa, Escherichia coli
MTAVSQTETRSSANFSLFRIAFAVFLTYMTVGLPLPVIPLFVHHELGYGNTMVGIAVGIQFLATVLTRGYAGRLADQYGAKRSALQGMLACGLAGGALLLAAILPVPAPFKFALLVVGRLILGFGESQLLTGALTWGLGIVGPKHSGKVMSWNGMAIYGALAVGAPLGLLIHSHYGFAALALTTMALPLLAWACNGTVRKVPALAGERPSLWSVVGLIWKPGLGLALQGVGFAVIGTFVSLYFASKGWAMAGFTLTAFGGAFVVMRVMFGWMPDRFGGVKVAIVSLLVETVGLLLLWQAPGAWVALAGAALTGAGCSLIFPALGVEVVKRVPSHVRGTALGGYAAFQDIALGVSGPLAGMLATTFGYSSVFLAGAISAVLGIIVTILSFRRG

SEQ ID NO: 5637 - DNA, 1221 bp, Escherichia coli
atgaaacgtgcagtgattactggcctgggcattgtttccagcatcggtaataaccagcaggaagtcctggcatctctgcgtgaaggacgttcagggatcactttctctcaggagctgaaggattccggcatgcgtagccacgtctggggcaacgtaaaactggataccactggcctcattgaccgcaaagttgtgcgctttatgagcgacgcatccatttatgcattcctttctatggagcaggcaattgcagatgctggcctctccccggaagcttaccagaataacccgcgcgttggcctgattgcaggttccggcggcggttccccgcgtttccaggttttcggcgctgacgcaatgcgcggcccgcgcggcctgaaagcggttggcccgtatgtggtcaccaaagcgatggcatccggcgtttctgcctgcctcgccacgccgtttaaaattcacggcgttaactactccatcagctccgcgtgtgcgacttccgcacactgtatcggtaacgcagtagagcagatccaactgggcaaacaggacatcgtgtttgctggcggcggcgaagagctgtgctgggaaatggcttgcgaattcgacgcgatgggtgcgctgtctactaaatacaacgacaccccggaaaaagcctcccgtacttacgacgctcaccgtgacggtttcgttatcgctggcggtggcggtatggtagtggttgaagagctggaacacgcgctggcgcgtggtgctcacatctatgctgaaatcgttggctacggcgcaacctctgatggcgcagacatggttgctccgtctggcgaaggcgcagtgcgctgcatgaagatggcgatgcacggtgttgataccccaatcgactacctgaactctcatggtacttcgactccggttggcgacgtgaaagaactggcagctatccgtgaagtgttcggcgataagagcccggcgatttctgcaaccaaagcaatgaccggtcactcactgggcgctgctggcgtacaggaagctatctactctctgctgatgctggaacacggttttatcgccccgagcatcaacattgaagagctggacgagcaggctgcgggtctgaacatcgtgaccgaaacgaccgatcgcgaactgaccacagttatgtctaacagcttcggcttcggcggcactaacgccacgctggtaatgcgcaagctgaaagattaa

SEQ ID NO: 5638 - protein, 406 aa, Escherichia coli
MKRAVITGLGIVSSIGNNQQEVLASLREGRSGITFSQELKDSGMRSHVWGNVKLDTTGLIDRKVVRFMSDASIYAFLSMEQAIADAGLSPEAYQNNPRVGLIAGSGGGSPRFQVFGADAMRGPRGLKAVGPYVVTKAMASGVSACLATPFKIHGVNYSISSACATSAHCIGNAVEQIQLGKQDIVFAGGGEELCWEMACEFDAMGALSTKYNDTPEKASRTYDAHRDGFVIAGGGGMVVVEELEHALARGAHIYAEIVGYGATSDGADMVAPSGEGAVRCMKMAMHGVDTPIDYLNSHGTSTPVGDVKELAAIREVFGDKSPAISATKAMTGHSLGAAGVQEAIYSLLMLEHGFIAPSINIEELDEQAAGLNIVTETTDRELTTVMSNSFGFGGTNATLVMRKLKD

SEQ ID NO: 5639 - DNA, 2007 bp, Escherichia coli
gtgaaacactactccatacaacctgccaacctcgaatttaatgctgagggtacacctgtttcccgagattttgacgatgtctatttttccaacgataacggactggaagagacgcgttatgtttttctcgggggtaaccatctagaggcacgttttcctgaacatccacatcctctgtttgtggtagcagagagcggcttcggcaccggattaaacttcctgacgctatggcaggcatttgatcagtttcgcgaagcacatccgcaagcgcaattacaacgcttacatttcattagttttgagaaatttcccctcacccgtgcggatttagcgctggcgcatcaacactggccggagctggccccgtgggcggaacagcttcaggcgcagtggcctttgcccctgcccggttgccatcgtttattgctcgatgaaggccgcataacgctggatttatggtttggcgatataaacgaactgaccagccaactggacgattcgctaaatcaaaaagtagatgcctggtttctggacggctttgcgccagcgaaaaacccggatatgtggacgcaaaatctgtttaacgccatggcccgactggcgcgtccgggcagcacgctggcgacctttacgtctgccggttttgtccgtcgcggtttgcaggaagccggattcactatgcaaaaacgtaagggctttgggcgcaaacgggaaatgctttgtggggtgatggaacagacattacccctcccctgctccacgccgtggtttaaccgtacgggcagcaacaaacaggaagcggcaattattggaggcggtattgccagcgcgttgttgtcgctggcgctattgcgtcgcggctggcaggtaacgctttattgcgcggatgaggctcccgcactgggtgcttccggcaatcgccagggggcgttgtatccgttattaagcaaacacgatgaagcgctaaaccgttttttctctaatgcgtttacttttgctcgtcggttttacgatttattgcccgttaaatttgatcatgactggtgcggcgtcacgcagttaggctgggatgagaaaagccagcataaaatcgcacagatgttgtcgatggatttacccgcagaactggctgtagccgttgaggcaaatgcggttgaacaaattacgggcgttgcgacaaattgcagcggcattacttatccgcaaggtggctggctgtgtccagcagaactgacccgtaatgtgctgaaactggcgcaacagcagggtttgcagattcattatcaatatcagttacaggatttatcccgtaaggatgacggttggttgttgaattttgcaggagatcagcaagcaacacacagtgtagtggtactggcgaacgggcatcaaatcagccgtttcagccaaacgtcatctctgccagtatattcggtggccggtcaagtcagccatattccgacaacgccggaactggcggagctgaagcaggtgctgtgctatgacggttatctcacgccacaaaatacggcgaatcagcaccattgtattggtgccagttatcatcgcggcagcgaagagacggcgtacagtgatgaagatcagcagcagaatcgccagcggttgattgattgtttcccacacgcgcaatgggcaaaagaggttgatgtcagtggtaaagaggcgcgctgcggtgtgcgttgtgccactcgcgatcatctgccaatggtaggcaacgtgcctgattatgacgctacactcgtggaatatgcgtcgctggcggagaagaaagatgaagcggtaagcgcgccggtttatgacgatctctttatgtttgctgctttaggttcgcgcggtttgtgttctgccccgctgtgtgccgagattctggcagcacagatgagtgaagaaccgattccgatggatgccagtacgctggcggcgttaaatccgaataggttatgggtgcggaagttgttgaaaggtaaagcggttaaggcggggtaa

SEQ ID NO: 5640 - protein, 668 aa, Escherichia coli
MKHYSIQPANLEFNAEGTPVSRDFDDVYFSNDNGLEETRYVFLGGNHLEARFPEHPHPLFVVAESGFGTGLNFLTLWQAFDQFREAHPQAQLQRLHFISFEKFPLTRADLALAHQHWPELAPWAEQLQAQWPLPLPGCHRLLLDEGRITLDLWFGDINELTSQLDDSLNQKVDAWFLDGFAPAKNPDMWTQNLFNAMARLARPGSTLATFTSAGFVRRGLQEAGFTMQKRKGFGRKREMLCGVMEQTLPLPCSTPWFNRTGSNKQEAAIIGGGIASALLSLALLRRGWQVTLYCADEAPALGASGNRQGALYPLLSKHDEALNRFFSNAFTFARRFYDLLPVKFDHDWCGVTQLGWDEKSQHKIAQMLSMDLPAELAVAVEANAVEQITGVATNCSGITYPQGGWLCPAELTRNVLKLAQQQGLQIHYQYQLQDLSRKDDGWLLNFAGDQQATHSVVVLANGHQISRFSQTSSLPVYSVAGQVSHIPTTPELAELKQVLCYDGYLTPQNTANQHHCIGASYHRGSEETAYSDEDQQQNRQRLIDCFPHAQWAKEVDVSGKEARCGVRCATRDHLPMVGNVPDYDATLVEYASLAEKKDEAVSAPVYDDLFMFAALGSRGLCSAPLCAEILAAQMSEEPIPMDASTLAALNPNRLWVRKLLKGKAVKAG

SEQ ID NO: 5641 - DNA, 279 bp, Escherichia coli
atgatcgcggagtttgaatcacgcattctggcattaatcgacggtatggttgaccatgccagtgatgatgagttatttgccagtgggtatttgcgtggccacctgacattagccatcgcagaactggaaagtggtgacgaccactccgctcaggcggtacatacaaccgttagccagagtctggaaaaagccattggcgcgggtgaattgtcaccgcgtgaccaggcgctggttaccgatatgtgggaacacctgtttcagcaggcctcacagcagtaa

SEQ ID NO: 5642 - protein, 92 aa, Escherichia coli
MIAEFESRILALIDGMVDHASDDELFASGYLRGHLTLAIAELESGDDHSAQAVHTTVSQSLEKAIGAGELSPRDQALVTDMWEHLFQQASQQ

SEQ ID NO: 5643 - DNA, 549 bp, Escherichia coli
atgaacagtacacaccactatgagcagttgattgagatttttaatagctgctttgccgatgaatttaatacccgtctgattaaaggcgacgacgaaccgatctatcttcctgctgatgcggaagtaccgtataacagaatcgtcttcgctcatggcttttatgccagcgccatccacgagatttcgcactggtgtattgccgggaaagcgcgccgtgagctggttgatttcggttactggtattgcccggacggacgcgatgcccagacgcaaagtcagtttgaagatgttgaagtgaagccgcaggcgctggactggttgttctgcgtggcggcgggatatccgtttaatgttagctgcgacaatctggaaggggatttcgaaccggaccgcgtggtgtttcaacggcgggtacatgcgcaggtgatggattatctggcaaacggcattcccgaacgtccggcacgcttcattaaagcactacaaaattattatcacacgccggaacttacggcggaacaattcccgtggccggaagcgctcagctga

SEQ ID NO: 5644 - protein, 182 aa, Escherichia coli
MNSTHHYEQLIEIFNSCFADEFNTRLIKGDDEPIYLPADAEVPYNRIVFAHGFYASAIHEISHWCIAGKARRELVDFGYWYCPDGRDAQTQSQFEDVEVKPQALDWLFCVAAGYPFNVSCDNLEGDFEPDRVVFQRRVHAQVMDYLANGIPERPARFIKALQNYYHTPELTAEQFPWPEALS

SEQ ID NO: 5645 - DNA, 810 bp, Escherichia coli
atggaaacgtttaatagcctgtttatggtttccccgctgctgctgggagttctcttttttgtcgccatgctggcgggatttatcgactcgattgccggtggcggtgggttactcaccattccggcattgatggcggcggggatgtctcccgctaacgcgctggcaaccaataaactgcaagcctgtggtggctctatttccgccactatctactttattcgccgtaaagtggttagtttaagcgatcaaaaactcaatatcgccatgacttttgtcggctcaatgagtggcgcactgctggtgcaatacgttcaggctgatgtcttacggcagattttaccgatcctcgtaatttgtatcggcctctatttcttactgatgcccaaactgggagaagaagatcgccagcgtcggatgtatggactgccatttgcgctggtggcggggggctgcgtcggtttttacgatggattctttggcccggctgccggatcgttttacgcgctggccttcgttacgctgtgcggattcaacctcgccaaagccactgctcacgccaaattacttaacgcaacgtcaaacattggcggtctgctgctgtttattctcggcggcaaagtgatttgggcgacgggctttgtgatgctggtggggcagttcctcggcgcgcgcatgggttcaagactggtgttgagcaaaggacaaaagctgatccgcccgatgatcgttatcgtctcggcggtgatgagtgccaaattactttacgatagccatggacaggagatcctccactggttggggatgaactaa

SEQ ID NO: 5646 - protein, 269 aa, Escherichia coli
METFNSLFMVSPLLLGVLFFVAMLAGFIDSIAGGGGLLTIPALMAAGMSPANALATNKLQACGGSISATIYFIRRKVVSLSDQKLNIAMTFVGSMSGALLVQYVQADVLRQILPILVICIGLYFLLMPKLGEEDRQRRMYGLPFALVAGGCVGFYDGFFGPAAGSFYALAFVTLCGFNLAKATAHAKLLNATSNIGGLLLFILGGKVIWATGFVMLVGQFLGARMGSRLVLSKGQKLIRPMIVIVSAVMSAKLLYDSHGQEILHWLGMN

SEQ ID NO: 5647 - DNA, 825 bp, Escherichia coli
atgaacaaaaccgcgattgcgctgctggctctgcttgccagtagcgccagcctggcagcgacgccgtggcaaaaaataacccaacctgtgccgggtagcgcacaatcgataggcagtttttctaatggctgtatcgtcggtgctgacacgttgccgatacagtccgaacattatcaggtcatgcgtaccgatcagcgtcgctatttcgggcacccggatctggtgatgtttatccagcgtctgagtcgccaggtgagcaatctgggcatgggtacggtgctgattggcgatatggggatgcctgctggtggtcgtttcaacggcggtcacgccagccaccagaccggactggatgtcgatatcttcctgcaactgccaaaaacacgctggacctccgcgcagctcttgcgcccgcaagctctggacttagtttcccgcgacggtaaacacgttgtccccgcgctgtggaagccagaaattttcagcttgatcaaactcgccgcccaggacaaagacgtcacgcgcatttttgttaatccggcgattaaacaacaactttgtcttgatgcgggcaccgatcgcgactggttgcgcaaagtgcgaccctggttccagcatcgcgcgcatatgcatgtacgattacgttgtcctgccgatagtctggagtgtgaggatcaacctttaccgccaccaggcgatggttgcggggcagaactgcaaagctggtttgaacctccaaaaccgggaacaacaaagcctgagaagaagacaccgcctccgttgccgccttcctgccaggcgctactggatgagcacgtgatctaa

SEQ ID NO: 5648 - protein, 274 aa, Escherichia coli
MNKTAIALLALLASSASLAATPWQKITQPVPGSAQSIGSFSNGCIVGADTLPIQSEHYQVMRTDQRRYFGHPDLVMFIQRLSRQVSNLGMGTVLIGDMGMPAGGRFNGGHASHQTGLDVDIFLQLPKTRWTSAQLLRPQALDLVSRDGKHVVPALWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 5649 - DNA, 1086 bp, Escherichia coli
atggctggaaacacaattggacaactctttcgcgtaaccaccttcggcgaatcgcacgggctggcgctcggctgcatcgtcgatggtgttccgccaggcattccgctgacggaagcggacctgcaacatgaccttgatcgtcgtcgccctgggacatcgcgctataccacccagcgccgcgagccggatcaggtcaaaattctctccggtgtttttgaaggtgttactactggcaccagcatcggattgttgatcgaaaataccgaccagcgttctcaggattatagtgcgattaaggacgttttccgtccaggtcatgccgattacacctatgaacaaaaatacggcctgcgcgattatcgcggcggtggacgttcttccgcccgtgaaaccgccatgcgcgtggcggcaggggcgattgcaaaaaaatatctcgccgagaaatttggcattgagattcgcggttgcctgacccagatgggcgacattccgctggaaatcaaagactggtctcaggtcgagcaaaatccattcttctgcccggacccggacaaaatcgacgcgttagatgaactgatgcgcgcgctgaaaaaagaaggcgactctattggtgcgaaagtcaccgtcgttgccagtggcgtacccgccggacttggcgagccggtctttgaccgcctggatgccgacatcgcccatgcgctaatgagcattaacgcggtgaaaggtgtggaaattggtgatggttttgacgtggtagcgctgcgtggcagccagaaccgcgacgaaatcaccaaagacggtttccagagcaaccatgcgggcggcattcttggtggtatcagcagcgggcagaaaatcattgcccatatggcgctgaaaccgacctccagcattaccgtgccggggcgcactattaaccgctttggcgaagaagttgagatgatcaccaaaggccgtcacgatccttgtgttgggatccgcgcggtgccgatcgcagaagcgatgctggcgatcgttttaatggatcacctgctacggcagcgggcgcaaaatgccgatgtgaagactgatattccacgctggtaa

SEQ ID NO: 5650 - protein, 361 aa, Escherichia coli
MAGNTIGQLFRVTTFGESHGLALGCIVDGVPPGIPLTEADLQHDLDRRRPGTSRYTTQRREPDQVKILSGVFEGVTTGTSIGLLIENTDQRSQDYSAIKDVFRPGHADYTYEQKYGLRDYRGGGRSSARETAMRVAAGAIAKKYLAEKFGIEIRGCLTQMGDIPLEIKDWSQVEQNPFFCPDPDKIDALDELMRALKKEGDSIGAKVTVVASGVPAGLGEPVFDRLDADIAHALMSINAVKGVEIGDGFDVVALRGSQNRDEITKDGFQSNHAGGILGGISSGQKIIAHMALKPTSSITVPGRTINRFGEEVEMITKGRHDPCVGIRAVPIAEAMLAIVLMDHLLRQRAQNADVKTDIPRW

SEQ ID NO: 5651 - DNA, 933 bp, Escherichia coli
gtggataaaattttcgttgatgaagcagtaaatgagctgcaaaccattcaggacatgttgcgctggtcggtgagccgcttcagcgcggcgaatatctggtacggccacggcaccgataacccgtgggatgaagccgtgcaactggtgttgccttcgctctacctgccgctggatattccggaagacatgcgcaccgcgcgtctgacctccagcgaaaaacaccgtattgttgagcgcgtgatccgccgcgtcaacgagcgcattccggtggcttacctgaccaacaaagcctggttctgcggccatgaattttacgtcgatgaacgcgtgctggtgccgcgctcgccgattggtgaactgatcaacaataaatttgccggactcatcagcaagcaaccgcagcatattttagatatgtgtaccggtagcggctgcatcgccattgcctgtgcttatgccttcccggaagcggaagtcgacgcggtggacatctctccagacgcgctggcggttgctgaacagaacatcgaagaacacggtttgatccacaacgtcattccgattcgttccgacttgttccgtgacttgccgaaagtgcagtacgacctgatcgtcaccaacccgccgtacgtcgatgcggaagatatgtccgacctgccaaacgaataccgccacgagccggaactcggtctggcatctggcaccgacggcctgaaactgacgcgtcgcattctcggtaacgcggcagattacctcgctgatgatggcgtgctgatttgtgaagtgggcaacagcatggtacatcttatggaacaatatccggatgttccgttcacctggctggagtttgataacggcggcgatggtgtgtttatgctcaccaaagagcagcttattgccgcacgagaacatttcgcgatttataaagattaa

SEQ ID NO: 5652 - protein, 310 aa, Escherichia coli
MDKIFVDEAVNELQTIQDMLRWSVSRFSAANIWYGHGTDNPWDEAVQLVLPSLYLPLDIPEDMRTARLTSSEKHRIVERVIRRVNERIPVAYLTNKAWFCGHEFYVDERVLVPRSPIGELINNKFAGLISKQPQHILDMCTGSGCIAIACAYAFPEAEVDAVDISPDALAVAEQNIEEHGLIHNVIPIRSDLFRDLPKVQYDLIVTNPPYVDAEDMSDLPNEYRHEPELGLASGTDGLKLTRRILGNAADYLADDGVLICEVGNSMVHLMEQYPDVPFTWLEFDNGGDGVFMLTKEQLIAAREHFAIYKD

SEQ ID NO: 5653 - DNA, 498 bp, Escherichia coli
atggcggggactcgcaagattaagcaggacacgattgtccatcgaccacaacgcaagaaaatcagcgaagtaccggtgaaacggttgattcaggagcaggccgatgccagccattatttttccgatgagtttcagccgttattgaataccgaaggtccggtgaaatatgttcgcccggatgtaagccattttgaggcgaagaagttgcgacgcggtgattattcgccggaattgtttttggatttacacggtctgacgcagttgcaagccaagcaggagttaggcgcattgattgcagcctgccgccgtgaacatgtgttttgtgcctgcgtgatgcatgggcacgggaagcatattttgaagcagcaaacgccactgtggctggcgcaacatccgcatgtgatggcatttcaccaggcaccaaaagagtatggtggcgatgcggctttgttggtgctgattgaagtggaagagtggttgccgccggaattaccctga

SEQ ID NO: 5654 - protein, 165 aa, Escherichia coli
MAGTRKIKQDTIVHRPQRKKISEVPVKRLIQEQADASHYFSDEFQPLLNTEGPVKYVRPDVSHFEAKKLRRGDYSPELFLDLHGLTQLQAKQELGALIAACRREHVFCACVMHGHGKHILKQQTPLWLAQHPHVMAFHQAPKEYGGDAALLVLIEVEEWLPPELP

SEQ ID NO: 5655 - DNA, 858 bp, Escherichia coli
ttgagtacatttaagatgaaaatactgcgtttttgggcctgtttactcgtcctgatcttttcaagtactggtgggctggcggcgaagaaaattgcaacattggtgactccgataggattttctgctgttacaacccagattcattactatcttgaaattctgacgccagaaggcgttgcctatggcgtgtacaagcaacacagtcgtatgcttcaaacagaaaagttagatttagtcagttggagcggtaacacgactgcacctgagttgacagttgatgatggctatgaggtagcaaaatccaattgtgttggacttgaagcatatgatgctttatcgagtaggacgaattggatttgtgagaatatggtccttagcgtgtatcacgatggacctgtacaagggtgcccatggttagtttcaacatacactgatagtgttctcccgtatgatgtaccgaccccatatgtggggccaaaagtgcataactcgtcatgtcctgtctccgttgccacttatgatatttcgtggagtgaagattatgttgcccattcgaaagtgctgtcgttgcaatcgacgggcggaacgattgagaaaacgctgcccaccttcttgatggaaagcggcaagctctgtgacggcagagtgatggacgatcgaggtgcatactgccgctttgtggcgcaaatgatcaccttctccacctccggctgtgacagttcgaaagtgacggtcacacccaaccagcatcccatcactgacaagcaactgcacgacatggtagtgcgtgtcgataccagcagccgccagccgattgattccacctgccgcttccagtacacgctcaacgagctgtag

SEQ ID NO: 5656 - protein, 285 aa, Escherichia coli
MSTFKMKILRFWACLLVLIFSSTGGLAAKKIATLVTPIGFSAVTTQIHYYLEILTPEGVAYGVYKQHSRMLQTEKLDLVSWSGNTTAPELTVDDGYEVAKSNCVGLEAYDALSSRTNWICENMVLSVYHDGPVQGCPWLVSTYTDSVLPYDVPTPYVGPKVHNSSCPVSVATYDISWSEDYVAHSKVLSLQSTGGTIEKTLPTFLMESGKLCDGRVMDDRGAYCRFVAQMITFSTSGCDSSKVTVTPNQHPITDKQLHDMVVRVDTSSRQPIDSTCRFQYTLNEL

SEQ ID NO: 5657 - DNA, 528 bp, Escherichia coli
atgaacctaaaacggatatctctctgcgcggctgtactggcgacggtgctgctgacgccccatgttcaggcggctgacaacctgcatttctacggcaatttactcagtaaatcctgcacgctggtggtccagggcgaaacgctggcggaggtgcattttcccaccatcagccgtaaagacctgatggtgaccgggcagtcggcgcgggtgccagtggtgtttcagctcaaagattgcaaagggccagctcagtatgaagtccgggtgacgctgaccggtacagaagacagtgaacagcccggttttctggcgctggatgcatcttcggcggcgcaaggtgtcggaattggcatggaaaaaaccgatggaacaccggtgccgattaacaataccagcggcgcgacctttgtgctgagtaacggcaataacaatctgaattttaatgcctggctccaggcgaaaagcggccgggaagtgacgatgggtgaatttaccgcttttttaaccgcaacgtttgagtacatttaa

SEQ ID NO: 5658 - protein, 175 aa, Escherichia coli
MNLKRISLCAAVLATVLLTPHVQAADNLHFYGNLLSKSCTLVVQGETLAEVHFPTISRKDLMVTGQSARVPVVFQLKDCKGPAQYEVRVTLTGTEDSEQPGFLALDASSAAQGVGIGMEKTDGTPVPINNTSGATFVLSNGNNNLNFNAWLQAKSGREVTMGEFTAFLTATFEYI

SEQ ID NO: 5659 - DNA, 480 bp, Escherichia coli
atgaaacgactcgcatggtgcttactttacggttttgctggcctggcgcaggccgcgattaacgacgttacttttcacggcacgctggtttcgccacccgcctgtactatcagcgatggtaagacgatcgaagttgagtttcgcaacgtcattatcgacaacattaacggcgataatttccgtcaggatgtgccttacaccatcacatgtgaccccgatgtgcgcgacgacgcctgggagatgagcctgacctggacgggcagccaaaccccttatgatgattccgccattgaaacggacgttagcggcctggggattgagctacagcaaaacggccagccgtttaagctgggaacaccgttgaaaattgacccgtcaactccgccaacgctgcaagctgtgccggtgaaagccaatgatgcggcgctcagcgacggaaccttttctgcctacgcaacattacaggtggattaccaatga

SEQ ID NO: 5660 - protein, 159 aa, Escherichia coli
MKRLAWCLLYGFAGLAQAAINDVTFHGTLVSPPACTISDGKTIEVEFRNVIIDNINGDNFRQDVPYTITCDPDVRDDAWEMSLTWTGSQTPYDDSAIETDVSGLGIELQQNGQPFKLGTPLKIDPSTPPTLQAVPVKANDAALSDGTFSAYATLQVDYQ

SEQ ID NO: 5661 - DNA, 504 bp, Escherichia coli
atgaaagcgttctttctgaccggatctgccgcgctattgctggcctgtggcgtgaccgttttcccggcaatggcgggcggcaaaatcgtcaatctgacgttgcgcgtgctggtggatggaccgccgccctgttcggtaaagggaagcgcggtggagttcggcaatgtgattattaaaagcattgatggtgccaactaccgtcagccagtgggctacaccctgaactgctcaaacagtgtcagcgacgacctgcaaatgcagcttcaggccaccaccacgaccatcaacggcgaaacggtgctgagtactggaatcagcggttttggcattcgtattcagaatgccgctgaccattcgctggtggcagtgggtaacagtagctggctgccgttcaacatcaatactcagccagacttcgaagccgttccggtgaagcagagcggtgtggaactgatggcatcggagtttaacgcgaccatgaccatggtggtggactaccaatga

SEQ ID NO: 5662 - protein, 167 aa, Escherichia coli
MKAFFLTGSAALLLACGVTVFPAMAGGKIVNLTLRVLVDGPPPCSVKGSAVEFGNVIIKSIDGANYRQPVGYTLNCSNSVSDDLQMQLQATTTTINGETVLSTGISGFGIRIQNAADHSLVAVGNSSWLPFNINTQPDFEAVPVKQSGVELMASEFNATMTMVVDYQ

SEQ ID NO: 5663 - DNA, 753 bp, Escherichia coli
atgtcttataaattatcctgtccaatgctcgtcagcacagcgctgatggcactgcttaccaccgccagcctgacggcgcatgcatcggtcaccccggatcgcacccgtctggtgtttaacgaaagcgataaatcgatcagcgtgacgttgcgtaacaacaccgaaaagctgccttacctggcgcaaagctggctggaagacgagaagggcaacaaaatcacttcgccgctggcggtgctgccgcctgtgcagcgtattgacgctatgatgaacggccaggtgaagattcaggcgctgccggacattcacacgctgccgtccgaccgagaaagcctgttctactacaacgtgcgtgagatcccgccaaagtccgggaaagccaacaccctgcaaattgcgctgcaaacgcgcatcaagctgttctggcgaccaaaggcgctggagaagattgacatgagaagaccgtggcagtttaaggtcacactcacgcgcagtggccaggactataccgtcaataacccgacgccgtaccacgtcatcatcagcgatgccagcacacagaagaaagggctgactgccgccgggtttaaaccgctggtgatgccaccgaaaacgtcacaaccgttaaaggcaaaaatggcgagcgccccggtgctgacctatatcaatgactacggcgcgcgcatgccgctgatcttccgttgtgaagggaacacctgcaaggtggatgaagatcaaagcagcaaaggttga

SEQ ID NO: 5664 - protein, 250 aa, Escherichia coli
MSYKLSCPMLVSTALMALLTTASLTAHASVTPDRTRLVFNESDKSISVTLRNNTEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRRPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 5665 - DNA, 2346 bp, Escherichia coli
gtggcggcgctggggctgaaagaagggatagcaaaaagcctgcagtggacgcacaacgatgaatgccttaaaccaggtcaattagacgggatggaagtcgagaatgatttaagccagtcggcgttgctgctgacagtgccacaggcttacctcgaatataccagcagcgactgggaccctccctcacgttgggacgacggtattcctggcctgattgccgactacagcctcaatgcgcaaactcgccaccaggagcaggggggcgaggactcacatgatatcagcggcaacggtaccgttggggcgaacctgggggcatggcgtttccgtgcagactggcaaagtgattatcagcacacccgcagcaacgatgacgacgatgacagcagtaacagtacaacgagcaaaaactgggactggagccgttattacgcctggcgggccttaccctctttaaaagcgaagctgtcgctgggggaagattatctcaattccgatattttcgacggctttaactatatcggcagcagcgtcagcaccgatgaccagatgctgccgcccaacctgcgcggctatgcgccggatgtctccggcgtggcgcacagcagtgcaaaagtcaccattagccagatgggccgggtactttacgaaacccaggttcccgccgggccattccgcattcaggatatcggcgactccgtctccggcacactgcacgtccgcgttgaagaacagaatggtcaggtgcaggaatatgacgttaccaccgtatctatgccattcctcacgcgccaggggcaggtgcgttacaaagtgatgatggggcgtccggaagactggaaccacaagaccgaaggcggctttttctccggcggagaagcgtcatggggggtggcagatggctggtcgctctacggtggtgcgctggcagataaacactatcagtcggcggcgatgggggtggggcgcgacctcgcacagtttggcgcgctggcgttcgatgtgactcactcgcacgtcaacctggatcatgacagcgcatacggcaaaggaaaactggacggcaactcctttcgcgtgagctatgccaaagactttgacgaactcaacagccgcgtcacctttgcaggctaccgtttttctgaaaagaacttcatgaccatgagcgagtatctggacgcgaaccagtcggacatggcgcggaccggtaacgacaaagagatgtatacgatcacctataaccagaactttgccgctgcgggtgtttcgatctatctcaactactcccatcgtacttactgggatcgcccggaacagacaaactataacctgatgttttcccactattttaatatggggagcattcgcaacatgagcatctcggtgaccggctatcgctacgaatatgacgataatgcggataaggggatgtacctcagtatgagcattccgtggagcgacagcagcaccgtgacctacaacggttcctacggcagcggatcggacagcagccaggtcggttactttaagcgcgtcgatgacgcaacgcactaccaggttaacgttggcaccagcgagcagcacggcagcgtggatggttatctgagccacgacggttcgctggcgaaggttgatctcagcgccaactaccatgaaggggaataccgttcggcggggatcgccttacagggcggggcaacgctgaccgcgcatggtggggccctgcaccgtacccagaacatgggcggcacgcgcctgctgattgacgccgacgggattgccaacgtgccggtcgaaagcaacggcgcgccggtgtacaccaatatgtttggcaaggcggtggtcgccgatattaacaactactatcgcaatcaggcgtatatcgatttaaacaacttgccggaagatgcggaagccacccagtcggtggtgcaggcaaccctgacggaaggcgcaatcggctatcgcaaattcaaagtgatcagcgggcaaaaagcgatggcggtactgaggttgcgtgacggtagctacccgccgtttggcgcggaagtgaaaaatgacgagcagcagcaggttggcattgtggatgatgaaggcaatgtctatctggcgggggtcaatgcgggcgagcatatgatggtgttctgggaaggcagcgcacaatgcgagatcgtattgccgaagccgctacctgccgatttgttcagcggcctgttgttgccgtgtgaacaaaagggaacggcagcccctgattcttcagcgccagaaattaagcctgttattcaggaccagacgcggcaagtcacaccaacggaagcgccgacgtcaatttcagcaactcaataa

SEQ ID NO: 5666 - protein, 781 aa, Escherichia coli
MAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTVSMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 5667 - DNA, 750 bp, Escherichia coli
atgagtaagtttgccaaaacagccattgctgcggcgatggtcatgggcgcagttgtttccagttctgcttttgcagcaggcaacaacggtaccgcgcgcttctacggcaccattgaagactccccgtgctctatcgttccagacgatcacaaactggaagtcgatatgggtgacatcggtgcggctaaactgaccggcggtggcactaccacaccgaaagatttccagatccgtttacaggattgcgtgtttaccactgaaacaaacatggagaccacgttcaccggcactaactacgcggggccagccaacacggataactatgcgttattcaatgttgacagcggtgttgccatgaaccacgtgagcctggtaatcggcgatacccatggcaaaggttataaagtgggcgaaaagattgttcagccaatcgtgatggatacttcaaccagcaagggtaaagacaagcaaacgctgaactttaaagcctggctggtgggtgaaaccgatgcgccggatctcggccagttcgaaaccctgaccacattccagattacctatctctgctgtggggttattcaacacgcaacagatttacgactgtttcacaaacggatatgtgtatgcctaatcactcaaattttcggctgcggggaatcgcctgctatattgcgctggcaatctctggtggatcagtcaatgcatgggctgatgattcaattcaatttgacccccgtttccttgagttaa

SEQ ID NO: 5668 - protein, 249 aa, Escherichia coli
MSKFAKTAIAAAMVMGAVVSSSAFAAGNNGTARFYGTIEDSPCSIVPDDHKLEVDMGDIGAAKLTGGGTTTPKDFQIRLQDCVFTTETNMETTFTGTNYAGPANTDNYALFNVDSGVAMNHVSLVIGDTHGKGYKVGEKIVQPIVMDTSTSKGKDKQTLNFKAWLVGETDAPDLGQFETLTTFQITYLCCGVIQHATDLRLFHKRICVCLITQIFGCGESPAILRWQSLVDQSMHGLMIQFNLTPVSLS

SEQ ID NO: 5669 - DNA, 111 bp, Escherichia coli
atgcgaattatcaacaaaaaacaaaccattataatcaacaaaaatgaattgcttataaagcacactaaaaaaattataatgaccttaccattatttattgctaaaatttaa

SEQ ID NO: 5670 - protein, 36 aa, Escherichia coli
MRIINKKQTIIINKNELLIKHTKKIIMTLPLFIAKI

SEQ ID NO: 5671 - DNA, 486 bp, Escherichia coli
atgcaagtttttatcatgcgtcacggcgacgcagccctcgatgccgccagtgattcggttcgtcctctgaccactaacggttgtgacgaatctcgcctgatggcgaactggctgaaaggtcaaaaagtggaaatcgaacgcgttctggtgagcccgttcctgcgagccgagcaaacactggaagaagtaggggattgtctgaacctgccttccagtgcagaagttctgccggagttaacgccctgcggcgatgttggtctggtcggtgcctatttgcaggcgttgaccaatgaaggtgttgcttcggtactggtgatctcccacttaccgttagttgggtatctggttgccgagttatgtccgggcgaaacgccgcctatgtttaccacttcagcgattgccagcgtaacgcttgatgaaagcggaaaaggccaattcaactggcaaatgagcccttgtaatttgaagatggcaaaagcaatttaa

SEQ ID NO: 5672 - protein, 161 aa, Escherichia coli
MQVFIMRHGDAALDAASDSVRPLTTNGCDESRLMANWLKGQKVEIERVLVSPFLRAEQTLEEVGDCLNLPSSAEVLPELTPCGDVGLVGAYLQALTNEGVASVLVISHLPLVGYLVAELCPGETPPMFTTSAIASVTLDESGKGQFNWQMSPCNLKMAKAI

SEQ ID NO: 5673 - DNA, 2145 bp, Escherichia coli
atggaaatggcatcagcgtttactcttaatgttcgtctggacaacattgctatcatcaccatcgacgtaccgggtgagaaaatgaataccctcaaggcggaatttgcctcgcaggtacgcgccattattaagcaaatccgtgaaaacaaagagttgcgtggcgtggtgtttgtctccgcgaaaccagacaacttcattgctggcgcagacatcaacatgatcggcaactgcaaaacggcgcaagaagcggaagtactggcgcggcaggggcaacagttaatggcggagattcatgctttgcccattccggttatcgcggctattcatggcgcttgcctgggcggcgggctggagttggcgctggcgtgccacggtcgtgtttgtactgacgatcctaaaacggtgctcggtttgcctgaagtacaacttggattgttacccggttcaggcggtacccagcgtttaccgcgcctgataggtgtcagcacagcattagagatgatcctcaccggaaaacaacttcgggcgaaacaggcggtaaagttggggttggtggatgacgtcgttccgcactccatattgctggaagccgctgttgagctggcaaagcaggatcgcccatcttcacgccctctacctgtacgcgagcgtattctggcggggccgttaggtcgtgcgctgctgttcaaaatggtcggtaagaaaacagaacacaaaacgcaaggtaactatccggcgacagaacgcatcctggaggttgtcgaaacgggattagcgcagggcaccagcagcggctatgacgctgaagcacgggcgtttggcgaactggcgatgacgccgcaatcgcaggcgctgcgcaatatcttttttgccagtacggacgtgaagaaagatcccggcagtgatgcgccgcctgcgccattaaacagcgtggggattctaggtggtggcttgatgggcggcggtattgcttatgtcactgcttgtaaagcggggcttccggtcagaattaaagatatcaacccgcggggcataaatcatgcgctgaagtacagttgggatcagcttgagggcaaagttcgccgtcgtcatctcaaagccagcgaacgtgacaaacagctggcattaatctccggaacgacggactattgcggctttgcccatcgcgatctgattattgaagcggtgtttgaaaatctcgaattaaaacaacagatggtggcggaagtggagcaaaattgcgctactcataccatctttgcttcgaacacgtcatctttaccgattggcgatatcgccgctcacgccgcgcgacctgagcaagttattggcctgcatttcttcagtccggtggaaaaaatgccgctggtggagattattcctcatgcgagtacatcggcgcaaaccatcgccaccacggtaaaactggcgaaaaaacagggcaaaacgccaattgtcgtgcgtgacaaagccgggttttacgtcaatcgcatcttagcgccttacatcaatgaagctatccgcatgttgaccgaaggcgagcgtattgagcatatcgatgccgcgctagtgaaatttggttttccggtaggcccaatccaacttttggatgaggtaggaatcgacaccgggactaaaattatgcctgtactggaagccgcttatggagaacgttttagcgcgcctgcaaatgttgtttcttcaattttgaacgacgatcgcaaaggcagaaaaaatggtcggggtttctatctttatggtcagaaagggcgtaaaagcaaaaaacaggtcgatcccgccatttacccgctcattggcgcacaagggcaggggcgactctccgcaccgcaggttgctgaacggtgtgtgatgttgatgctgaatgaagcagtacgttgtctggacgagcaggttatccgtagcgtgcgtgacggggatataggcgcggtatttggcattggttttccgccatttctcggtggaccgttccgctatatcgattctctcggcgcaggcgaagtggttgcaataatgcaacgactggccacgcagtatggttcccgttttaccccttgcgatcgtttagttgagatgagcgagcgtggggaaagtttttggaaaacaactgcaactgacctgcaataa

SEQ ID NO: 5674 - protein, 714 aa, Escherichia coli
MEMASAFTLNVRLDNIAIITIDVPGEKMNTLKAEFASQVRAIIKQIRENKELRGVVFVSAKPDNFIAGADINMIGNCKTAQEAEVLARQGQQLMAEIHALPIPVIAAIHGACLGGGLELALACHGRVCTDDPKTVLGLPEVQLGLLPGSGGTQRLPRLIGVSTALEMILTGKQLRAKQAVKLGLVDDVVPHSILLEAAVELAKQDRPSSRPLPVRERILAGPLGRALLFKMVGKKTEHKTQGNYPATERILEVVETGLAQGTSSGYDAEARAFGELAMTPQSQALRNIFFASTDVKKDPGSDAPPAPLNSVGILGGGLMGGGIAYVTACKAGLPVRIKDINPRGINHALKYSWDQLEGKVRRRHLKASERDKQLALISGTTDYCGFAHRDLIIEAVFENLELKQQMVAEVEQNCATHTIFASNTSSLPIGDIAAHAARPEQVIGLHFFSPVEKMPLVEIIPHASTSAQTIATTVKLAKKQGKTPIVVRDKAGFYVNRILAPYINEAIRMLTEGERIEHIDAALVKFGFPVGPIQLLDEVGIDTGTKIMPVLEAAYGERFSAPANVVSSILNDDRKGRKNGRGFYLYGQKGRKSKKQVDPAIYPLIGAQGQGRLSAPQVAERCVMLMLNEAVRCLDEQVIRSVRDGDIGAVFGIGFPPFLGGPFRYIDSLGAGEVVAIMQRLATQYGSRFTPCDRLVEMSERGESFWKTTATDLQ

SEQ ID NO: 5675 - DNA, 1311 bp, Escherichia coli
atgggtcaggttttaccgctggttacccgccagggcgatcgtatcgccattgttagcggtttacgtacgccttttgcccgacaggcgacggcttttcatggcattcccgcggttgatttagggaagatggtggtaggcgaactgctggcacgcaccgagatccccgctgaagtgattgaacaactggtcttcggtcaggttgtgcaaatgccggaagcgcccaacattgcccgtgaaattgttcttggcactggaatgaatgtgcataccgatgcttacagcgttagccgcgcttgcgctaccagtttccaggcggttgcaaacgtcgcagaaagcctgatggcgggaactattcgagcggggattgccggtggggcagattcctcttccgtattgccaattggcgtcagtaaaaaactggcgcgcgtactggttgatgtcaacaaagcccgcacaatgagccagcgcctgaaacttttttctcgcttacgtttgcgtgacttaatgccggtgcctccggcagtggcggaatactccactggattacggatgggggacaccgcagagcaaatggcgaaaacctacggcatcacccgagaacagcaagatgcactggcgcaccgttcgcatcagcgtgccgctcaggcgtggtcagaaggtaaactcaaagaagaggtgatgactgcctttatccccccttataaacaaccgcttgtcgaagacaacaatattcgcggtaattcctctcttgctgattacgcaaagctgcgtccggcgtttgatcgtaaacacgggacggtaacggcggcaaacagtacgccgctgaccgatggcgcggcagcggtgatcctgatgactgaatcccgggcgaaagaattagggctggtaccgctggggtatctgcgcagctacgcatttactgcgatagatgtctggcaggacatgttgctcggtccagcctggtcaacaccgctggcgctggaacgtgccggattgacgatgggcgatctgacattgatcgatatgcacgaagcctttgccgcccagacgctggccaatattcagttgctgggtagcgaacgttttgctcgcgacgtactggggcgtgcacatgccactggcgaagtggacgagagcaaatttaacgtgcttggcggttcgattgcttatgggcatcccttcgcagcgaccggcgcgcggatgattacccagacattgcatgaacttcgccgtcgtggcggtggatttggtttagtgaccgcctgtgctgcgggtgggcttggcgcagcaatggttctggaggcggaataa

SEQ ID NO: 5676 - protein, 436 aa, Escherichia coli
MGQVLPLVTRQGDRIAIVSGLRTPFARQATAFHGIPAVDLGKMVVGELLARTEIPAEVIEQLVFGQVVQMPEAPNIAREIVLGTGMNVHTDAYSVSRACATSFQAVANVAESLMAGTIRAGIAGGADSSSVLPIGVSKKLARVLVDVNKARTMSQRLKLFSRLRLRDLMPVPPAVAEYSTGLRMGDTAEQMAKTYGITREQQDALAHRSHQRAAQAWSEGKLKEEVMTAFIPPYKQPLVEDNNIRGNSSLADYAKLRPAFDRKHGTVTAANSTPLTDGAAAVILMTESRAKELGLVPLGYLRSYAFTAIDVWQDMLLGPAWSTPLALERAGLTMGDLTLIDMHEAFAAQTLANIQLLGSERFARDVLGRAHATGEVDESKFNVLGGSIAYGHPFAATGARMITQTLHELRRRGGGFGLVTACAAGGLGAAMVLEAE

SEQ ID NO: 5677 - DNA, 285 bp, Escherichia coli
atgagtaaatgtagtgctgatgaaaccccggtttgctgctgtatggatgttggcaccattatggacaactccgactgcaccgcgtcttacagccgtgtgtttgcaaaccgcgcagaagcagaacaaacgctggcggcgctgactgaaaaagcccgtagcgtggaatccgaaccgtgcaaaatcaccccgactttcactgaagagtctgacggtgtgcgcctggatatcgatttcacttttgcctgcgaagctgaaatgctgatcttccagctgggtctgcgttaa

SEQ ID NO: 5678 - protein, 94 aa, Escherichia coli
MSKCSADETPVCCCMDVGTIMDNSDCTASYSRVFANRAEAEQTLAALTEKARSVESEPCKITPTFTEESDGVRLDIDFTFACEAEMLIFQLGLR

SEQ ID NO: 5679 - DNA, 1347 bp, Escherichia coli
atggtcatgagccagaaaaccctgtttacaaagtctgctctcgcagtcgcagtggcacttatctccacccaggcctggtcggcaggctttcagttaaacgaattttcttcctctggcctgggccgggcttattcaggggaaggtgcaattgccgatgatgcaggtaacgttagccgtaaccccgcattgattaccatgtttgaccgcccgacattttctgcgggtgcggtttatattgatccggatgtaaatatcagcggaacgtctccgtctggtcgtagcctgaaagccgataacatcgcgcctacggcatgggttccgaacatgcactttgttgcaccgattaacgaccaatttggttggggggcttcaattacctctaactatggtctggcgacagagtttaacgatacttatgcaggcggttctgtcggtggtaccaccgacctcgaaaccatgaacctgaacttaagcggtgcatatcgcttaaataatgcatggagctttggtcttggtttcaacgccgtctacgctcgcgcgaaaattgaacgtttcgcaggcgatctggggcaactggtggctggtcagattaggcaatctcctgcttggctgactcctcaggggcaagcattagcagctaccgccaacggcatcgacagtaataccaaaatcgctcacctgaacggtaaccagtggggctttggctggaacgccggtatcctgtatgaactggataaaaacaaccgctacgcattgacctaccgctctgaagtgaaaattgacttcaagggtaactacagcagcgatcttaacccggcttttaataactacggtttgccaattcctaccgcgacaggtggcgcaacgcagtcaggttatctgacgctgaacctgcctgaaatgtgggaagtgtcgggttataaccgtgttgctccgcagtgggcaattcactatagcctggcttacaccagctggagtcagttccagcagctgaaagcgacctcaacgagtggcgacacgctgttccagaaacatgaaggctttaaagatgcttaccgcatcgcgttgggtaccacttattactacgatgataactggaccttccgtaccggtatcgcctttgatgacagcccagttccggcacagaatcgttctatctccattccggaccaggaccgtttctggctgagtgcaggtacgacttacgcatttaataaagacgcttcagtcgacgttggtgtttcttatatgcacggtcagagcgtgaaaattaacgaaggcccatatcagttcgagtctgaaggtaaagcctggctgttcggtactaactttaactacgcgttctga

SEQ ID NO: 5680 - protein, 448 aa, Escherichia coli
MVMSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIRQSPAWLTPQGQALAATANGIDSNTKIAHLNGNQWGFGWNAGILYELDKNNRYALTYRSEVKIDFKGNYSSDLNPAFNNYGLPIPTATGGATQSGYLTLNLPEMWEVSGYNRVAPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 5681 - DNA, 756 bp, Escherichia coli
atgaagcttcgcctgtcggcgcttgctctgggaactacgcttctggtggggtgtgcgagttccggtacagatcagcaagggcgttctgacccgttagaagggtttaaccgcactatgtacaacttcaacttcaatgtattagacccgtatattgttcgaccggtcgctgtcgcctggcgtgattatgttccgcaacctgcgcgtaacggtttgagcaactttaccggcaaccttgaagaacctgcggtgatggttaactacttcttgcagggcgacccttatcaggggatggtccactttacccgctttttcctgaataccattttgggaatgggcggctttattgatgttgcagggatggcgaacccgaaactgcaacggactgaacctcaccgcttcggtagtacgcttggtcattatggtgtgggttatgggccgtacgttcaattaccgttctacggtagcttcacgctgcgtgatgacggtggtgatatggcggatagtctttacccggttctttcctggctgacctggccgatgtctgtgggtaaatggacgcttgaagggatagaaactcgtgcgcagttgttggattccgacggtctgctgcgtcagtcctccgatccttatattatggtgcgtgaagcgtacttccagcgtcatgatttcatcgctaatggcggtgaactcaaaccgcaggaaaatccgaacgcgcaagcgattcaggatgatttaaaagatatcgattctgaataa

SEQ ID NO: 5682 - protein, 251 aa, Escherichia coli
MKLRLSALALGTTLLVGCASSGTDQQGRSDPLEGFNRTMYNFNFNVLDPYIVRPVAVAWRDYVPQPARNGLSNFTGNLEEPAVMVNYFLQGDPYQGMVHFTRFFLNTILGMGGFIDVAGMANPKLQRTEPHRFGSTLGHYGVGYGPYVQLPFYGSFTLRDDGGDMADSLYPVLSWLTWPMSVGKWTLEGIETRAQLLDSDGLLRQSSDPYIMVREAYFQRHDFIANGGELKPQENPNAQAIQDDLKDIDSE

SEQ ID NO: 5683 - DNA, 933 bp, Escherichia coli
atggacaacgacaaaattgatcaacacagcgacgaaattgaagttgagagcgaagaaaaagagcgcggtaaaaaaatagaaatagatgaagaccgactcccctcccgggcgatggcaattcatgagcatatccgccaggatggtgaaaaagagctggaacgcgacgcaatggcgctactgtggtcagccattgcggcgggcctgtcgatgggcgcttcgctactggcaaaagggatatttcatgtcgaactggaaggcgtgccgggcagtttcttgctggagaatctcggttatacctttggttttattatcgtcataatggcccgccagcaattatttaccgaaaacaccgtaactgcggtactacccgtcatgcaaaaaccgacaatgagcaacgtcggcttacttatgcggttatggggcatcgtgctgctgggtaatattctcgggacaggtattgctgcgtgggcatttgaatatatgcctatcttcaatgaagaaactcgcgatgcatttgtcaaaatcggcatggatgtgatgaagaacacccccagcgagatgtttgccaacgcgatcatttccggctggctgatcgccactatggtatggatgtttcctgcagcgggtgcggcaaagattgtggtgattatattgatgacctggcttattgccctgggtgacaccacccacatcgttgtcggttctgttgaaatcctctatctggtgtttaacggcacgctgcactggagcgatttcatctggccctttgcactacctactttagcggggaacatctgcggcggcacctttatctttgcgttaatgagtcatgcacagattcgtaacgacatgagcaacaagcgcaaagcagaagcacgtcaaaaagcagaacgtgcggaaaacattaagaaaaatgataaaaacccggcataa

SEQ ID NO: 5684 - protein, 310 aa, Escherichia coli
MDNDKIDQHSDEIEVESEEKERGKKIEIDEDRLPSRAMAIHEHIRQDGEKELERDAMALLWSAIAAGLSMGASLLAKGIFHVELEGVPGSFLLENLGYTFGFIIVIMARQQLFTENTVTAVLPVMQKPTMSNVGLLMRLWGIVLLGNILGTGIAAWAFEYMPIFNEETRDAFVKIGMDVMKNTPSEMFANAIISGWLIATMVWMFPAAGAAKIVVIILMTWLIALGDTTHIVVGSVEILYLVFNGTLHWSDFIWPFALPTLAGNICGGTFIFALMSHAQIRNDMSNKRKAEARQKAERAENIKKNDKNPA

SEQ ID NO: 5685 - DNA, 1194 bp, Escherichia coli
gtggataaaataattttacccaccggatttttacccatgctcaccgttaagcagattgaagcagcaaagccgaaagaaaaaccataccgcctactcgatggtaatggcctgtacctttatgtccctgtatcagggaaaaaggtatggcagcttcgctacaagattgacggtaaggagaaaatcctgaccgtcggaaaatatccacttatgactttgcaggaggcaagagataaagcatggaccgcgaggaaagacatctcggttggcatcgatccggtaaaagcgaaaaaggcttcgtctaacaacaattcctttagtgcgatttacaaggaatggtacgagcacaagaagcaagtctggtcagtaggctatgcaactgaacttgcaaaaatgtttgatgacgacattttacctatcatcggcggccttgaaattcaggatattgagccgatgcaactgctggaagtaatccgcagatttgaagatcgcggtgcaatggagcgagccaacaaagcccgcagaagatgcggcgaggttttccgttacgctattgtcactggtagggctaaatataacccggcacctgaccttgctgacgccatgaagggataccgcaagaagaacttcccgtttcttcctgcagaccagatccctgcattcaacaaagcactggcaacattttcaggaagtatcgtatcgctcattgcgaccaaagttttacgctacacagccctaagaacgaaagagcttcgttccatgctatggaagaacgtcgattttgaaaacaggattatcaccatcgacgccagtgtgatgaagggacgcaaaattcatgtggtcccgatgtcagaccaggtggttgaacttctcactacgctaagctccatcaccaaaccagtatcagagtttgtttttgccgggcgcaacgataagaagaagccaatctgcgagaacgcggttctacttgtgatcaaacaaatcggctatgagggtctagaaagcggtcacggattcaggcatgaattcagcacgattatgaacgagcacgaatggcctgctgacgctattgaagtgcaactggcacatgccaacggcggatctgtgcgcggtatttacaaccatgctcagtatctcgataagcgcagagaaatgatgcagtggtgggcggattggcttgatgagaaggtagagtga

SEQ ID NO: 5686 - protein, 397 aa, Escherichia coli
MDKIILPTGFLPMLTVKQIEAAKPKEKPYRLLDGNGLYLYVPVSGKKVWQLRYKIDGKEKILTVGKYPLMTLQEARDKAWTARKDISVGIDPVKAKKASSNNNSFSAIYKEWYEHKKQVWSVGYATELAKMFDDDILPIIGGLEIQDIEPMQLLEVIRRFEDRGAMERANKARRRCGEVFRYAIVTGRAKYNPAPDLADAMKGYRKKNFPFLPADQIPAFNKALATFSGSIVSLIATKVLRYTALRTKELRSMLWKNVDFENRIITIDASVMKGRKIHVVPMSDQVVELLTTLSSITKPVSEFVFAGRNDKKKPICENAVLLVIKQIGYEGLESGHGFRHEFSTIMNEHEWPADAIEVQLAHANGGSVRGIYNHAQYLDKRREMMQWWADWLDEKVE

SEQ ID NO: 5687 - DNA, 156 bp, Escherichia coli
atgtattcttacgtaattattatcacccctaaatattacggtaagccatcgacactcaacatcatcttctataataagtttgttattgtttccattgaactgaactttattctctttgctatttacaagatctccacatacaaaaacattacctga

SEQ ID NO: 5688 - protein, 51 aa, Escherichia coli
MYSYVIIITPKYYGKPSTLNIIFYNKFVIVSIELNFILFAIYKISTYKNIT

SEQ ID NO: 5689 - DNA, 894 bp, Escherichia coli
atgtcgacgtcaggcgtgaggacggttcctgtacccgttgatttcacagatgatgttgccgtccagtcactgactgtccatgcaggtacatcaggacaagttcgcgcggaagtcaaacttgagggtaattacgccattattgcgaagaaagtaccgtctgatgatgttaccgctcagagattaatcgttagcggcggtgaaacaacgtcttcagcagatggtgcaatgataacgttgcatggttccagaagcagtactccacgtcgcgcggtatataacgcactcgaacatctttttgagaacggagatgttaaaccttatcttgataatgtaaatgctcttggtggtccgggaaacaggttctcgatagtttatcttggctccaatcctgtggttaccagtgacggaacattaaagacagagccggtctctcctgacgaaacattgctggatgcctggggtgacgtcaggtatatcgcttataaatggctgaacgctgtcgctataaagggggaagaaggggcgaggatacatcatggtgtaatcgcgcagcaacttcgtgatgttcttatttctcacggactcatggaagaagaaagcacaacatgccgctatgcctttctttgctatgacgattatcccgcagtatatgatgacgtcattactggccaaagggaaatgccgctgactgataatgacgggagcatcattgttgatgaggatgataatccagtgatggtaatggaagacatcattgagcgcgttgaaataacgccagcaggatctagatggggggtcagacctgatctcttattctatatcgaggcagcatggcagcgcagagaaatagaaagaataaaagctaggttagacttaatagaagggaagcactaa

SEQ ID NO: 5690 - protein, 297 aa, Escherichia coli
MSTSGVRTVPVPVDFTDDVAVQSLTVHAGTSGQVRAEVKLEGNYAIIAKKVPSDDVTAQRLIVSGGETTSSADGAMITLHGSRSSTPRRAVYNALEHLFENGDVKPYLDNVNALGGPGNRFSIVYLGSNPVVTSDGTLKTEPVSPDETLLDAWGDVRYIAYKWLNAVAIKGEEGARIHHGVIAQQLRDVLISHGLMEEESTTCRYAFLCYDDYPAVYDDVITGQREMPLTDNDGSIIVDEDDNPVMVMEDIIERVEITPAGSRWGVRPDLLFYIEAAWQRREIERIKARLDLIEGKH

SEQ ID NO: 5691 - DNA, 126 bp, Escherichia coli
atgttcttatttctcacggactcatggaagaagaaagcacaacatgccgctatgcctttctttgctatgacgattatcccgcagtatatgatgacgtcattactggccaaagggaaatgccgctga

SEQ ID NO: 5692 - protein, 41 aa, Escherichia coli
MFLFLTDSWKKKAQHAAMPFFAMTIIPQYMMTSLLAKGKCR

SEQ ID NO: 5693 - DNA, 2091 bp, Escherichia coli
atgacagacattacagccaatgtgatcgtatcgatgccttcgcaactcttcactatggcgcgttcttttaaagccgtagccaatggcaaaatttatatcggtaaaattgacactgatcctgtaaatacagaaaaccagattcaggtctatgtggagaatgaagacggttctcacgttcctgtttcgcaaccaataatcattaacgctgctggatatccggtatataacggacagattgccaaattcgttaccgtgcaaggccattctatggctgtttatgatgcgtatggtgcgcagcagttctattttcctaatgtgctgaagtatgatcctgatcagttacggcagcaattagaagacacagatggagcgaataaatacccaaaacttcagatagcaagatggagagacagttatgatgtaagaggttggggggctattggtgatggtgttcatgatgatacatcagctctatcagaattactttctgttgcaacaggtggtgaaaagatagatgggcgagggcttacttttaaagtatcaactcttccagatgtcagtcgatttaaaaatgctcgttttttatttgagagaataccgggtcagcctcttttttatgtttctgaagattttatccagggagagttatttaaaattacagatacaccgtggtacaacgcctggacgcaggataaaacgtttgtatatgacaatgtcatctatgcgccttttatggctggagaccgccatggtgtaaataacctccatgttgcatgggttcgctcaggagatgacgggaagacctggacaacgccggaatggcttacagatttacatgaaaactatcccacagttaactatcactgcatgagtatgggggttgtcagaaatcgcctttttgctgtaattgagacgcggaccgtgagcggaaataaactgcaggttgcagagttgtgggatcgcccaatgagtcgcagccttcgcgtttatggtggtataacgaaagcagcaaatcagcaagtcgcttatattcgcattactgatcacggattatttgctggtgattttgtcaacttctcaaactctggtgttacaggtgttaccgggaatatgacggtgactactgttattgataaaaatacttttacagttacgacgcaaaatacccaggatgtggatcagaataacgagggtagatactggagttttggtacatcatttcactcgtcaccatggagaaaaaccagtcttggaactattccttcttttgttgacggaagcactcctgttactgagattcacagttttgcgacgattagcgataacagttttgctgttggctaccataatggtgatattggtccacgcgagcttgggatactctatttctctgatgctttcggttctcctggtagctttgttcgcagacgcatacctgcagaatatgaggcgaatgcatctgagccatgtgtaaaatattatgatggcattctgtatctgacgaccagggggacattaagtactcaacccggtagttcattgcacagaagctctgatttaggtacatcatggaattctcttcgcttcccaaataatgttcatcactcaaaccttccttttgccaaagttggcgatgagctgattatttttggcagtgagcgcgcatttggtgagtgggaaggaggagaacctgataaccgttatgcaggaaattatccaagaacatttatgaccagagttaacgtcaatgagtggagtctggataatgtagagtgggttaatgttactgatcagatttatcagggcggaatagttaactctgcggttggtgttggttcagtttgtatcaaagacaactggctgtactacattttcggtggggaagactttctaaacccatggagcataggggataacaacagaaaatatccttatgttcacgatggtcacccggctgatttgtattgtttcagggtgaaaattaaacaggaagaatttgtttcaagggatttgtctacggagccactcctaacagaacgcttctacttttatgtcgacgtcaggcgtgaggacggttcctgtacccgttga

SEQ ID NO: 5694 - protein, 696 aa, Escherichia coli
MTDITANVIVSMPSQLFTMARSFKAVANGKIYIGKIDTDPVNTENQIQVYVENEDGSHVPVSQPIIINAAGYPVYNGQIAKFVTVQGHSMAVYDAYGAQQFYFPNVLKYDPDQLRQQLEDTDGANKYPKLQIARWRDSYDVRGWGAIGDGVHDDTSALSELLSVATGGEKIDGRGLTFKVSTLPDVSRFKNARFLFERIPGQPLFYVSEDFIQGELFKITDTPWYNAWTQDKTFVYDNVIYAPFMAGDRHGVNNLHVAWVRSGDDGKTWTTPEWLTDLHENYPTVNYHCMSMGVVRNRLFAVIETRTVSGNKLQVAELWDRPMSRSLRVYGGITKAANQQVAYIRITDHGLFAGDFVNFSNSGVTGVTGNMTVTTVIDKNTFTVTTQNTQDVDQNNEGRYWSFGTSFHSSPWRKTSLGTIPSFVDGSTPVTEIHSFATISDNSFAVGYHNGDIGPRELGILYFSDAFGSPGSFVRRRIPAEYEANASEPCVKYYDGILYLTTRGTLSTQPGSSLHRSSDLGTSWNSLRFPNNVHHSNLPFAKVGDELIIFGSERAFGEWEGGEPDNRYAGNYPRTFMTRVNVNEWSLDNVEWVNVTDQIYQGGIVNSAVGVGSVCIKDNWLYYIFGGEDFLNPWSIGDNNRKYPYVHDGHPADLYCFRVKIKQEEFVSRDLSTEPLLTERFYFYVDVRREDGSCTR

SEQ ID NO: 5695 - DNA, 924 bp, Escherichia coli
atgaaaagtatagcaacagcagtatctactatcaatgtaccattccacggcgcagagctttatgttgtcaatcacaacggcgaaccgtataccccaatgaaacctatcgttgagggaatggggctagactggaaatctcaacataagaagatttctcaacgattctcgaatggtatggtggaaatcaccataccttctgccggtggggtgcaagccatgatttgtatggctttacgaaaattggcagcttggttgaacagcatcagtcctaacaaagtccgccctgaaatccgcgacaaggtaatccagtatcaggaagagtgtgacgatgtgctctacgagtactggactaaaggccatgtagttaacccacgcaaagctaaaaaggcgttgcagggtaaaatcaccactgaacagcaggaagccattaaacaactcgtcatgagtcgcggtcagtctctgccaaaagaaaaacaggctaaggcgatgatcaccatgtggtcgtcactgaaatcccattttggatgttcgtacaaagaaatcagtgaggagcagtttaccgaagcactatcacttgcagctcgagttccacttgaaggtgagttcattggcaaacaagagaagaaaaccaacgagctttctgcaaaagaagtaaacagccttgtatggctatgggattatgccaaccgctcacaggcattattccgcgaactgtatcaggcgctaaaacaaattcaatcgaactattccggcagatgctacgactacggtcatgaattctcgtatgttatcggaatggcgagagatgttttaatcaaccatacacgagatgttgatattaatgagccagacggaccaacgaatctttccgcatggatgagacttaagaataaagaattacctccttcagtacataactactga

SEQ ID NO: 5696 - protein, 307 aa, Escherichia coli
MKSIATAVSTINVPFHGAELYVVNHNGEPYTPMKPIVEGMGLDWKSQHKKISQRFSNGMVEITIPSAGGVQAMICMALRKLAAWLNSISPNKVRPEIRDKVIQYQEECDDVLYEYWTKGHVVNPRKAKKALQGKITTEQQEAIKQLVMSRGQSLPKEKQAKAMITMWSSLKSHFGCSYKEISEEQFTEALSLAARVPLEGEFIGKQEKKTNELSAKEVNSLVWLWDYANRSQALFRELYQALKQIQSNYSGRCYDYGHEFSYVIGMARDVLINHTRDVDINEPDGPTNLSAWMRLKNKELPPSVHNY

SEQ ID NO: 5697 - DNA, 249 bp, Escherichia coli
atggctagagatgatccgcactttaacttccgtatgcctttggaagtaagagaaaaattgaaattaagagccgaggctaacggaaggtcaatgaactctgagttattacaaatcgttcaggatgcgctatcaaaaccatcaccgattgcaggttaccgtgacgaagcagaacgtatggctgatcagcaagcagaaattgttaagaagatggtgtttgaaaccctgaaaaaaatgtacgagaccagatag

SEQ ID NO: 5698 - protein, 82 aa, Escherichia coli
MARDDPHFNFRMPLEVREKLKLRAEANGRSMNSELLQIVQDALSKPSPIAGYRDEAERMADQQAEIVKKMVFETLKKMYETR

SEQ ID NO: 5699 - DNA, 2160 bp, Escherichia coli
atggctaaagcatggaaagatgttatcgcttctccacagtatcaggcgttaactgaagaacagaaagcacaggctcaagcgcaatattttgatgaggttgttgcccctaaggctggtgacaaatgggctgaagcaagagatcagttttatgcagcataccctccgcctcagcagcagaaagaagaaccatcattgatgcaacaagctggtgattggctcacaggtggtcaaagtgcagggcaaattgcagaacaggctggtcgtggtctggtaaacataccatttgacgtattgcagggtggcgcaagtctgattaatgcaatcagccaggggcttggcggccccaaggttttggatgatgtttatcgccctgccgagcgaccgacagacccttacgcgcaagccggtgaaacaattggtgggtatctcctgccaattggcacagcggcaaaagctgctggagcgacagcaaagctcgctggagatatcggttccgccggaaacatgattgcaggttctcttgctgatgctgcaaatcaggagggcgactttgcacaaaatgctgccattaacggtggtatcaatattggtgctcaaggcgttctttcaggtgtcgggcgcgttattgcgccaagggtttcacaggctcttggtggtgcagcactgaattctgctaatgatgtttctaggatggcaaagtcaggtgctgggcgtcagtcaattgccagtcaggccgctaatgtgtccgaagatgtagcaaaagcggctgagtctgctggaattgatataaacgcattaacaccaggaatgcgatctggaagtcgtggaattgcacaagccgaaggcgcattggcatcaacaccaggaattgttcaggacgcccatcaggcagcatttaacgaaatatcatcaaagttaagtcgaaaccttgatgaatttggggccgcatctggaacggcatcagaaaaaagtgcggctataaaacaaaggattcttcaaaatcttgatcagatgaaggatgccgagcgcgcggcatgggatgacgtgcggtcaacaatgccaaatcaaaaagcaagaatgctaaatggtaatgccgttattcaggcagagcgatctgccggcataccgcttactcctgaaatgaaacagtttgttcaggcaaacaatcaaggtggagtaacatttgacggcatgaaagcatggagagcgaaatttgctgatgcggagcaaaaatataagcgtagcggagaggcaaatgcggcaaggagagcaggggaaatacgccgggcaattactgatgatatgcgcacaatggcggaaaacggcggatttcttgatgactggcaaaaagctaatgatctgtctaaagcgaggttatcagcacaagagagtgcagagtctgttttcgggcgtgatttggcaacagatgcactgattacgaatggagtaaaatcccttcaatcatcgtcagctaaaggtcttaatggtcctgctggattccattctatgatccgcgcgctgccagaatcagagcgtgttcctgctatatcatcaatgttgcaagatgctatctcgcatggtgtacgtggtggtaaagctgatgcagcaggaattaaccatatcgcagagatactcactccacaaaatgtaaaagccattagccgatattcctcagagcttggaagaattgcagatgcatatggcactcttgcaagagcagcagtgaaacctcagcagtatattgaaagaacagggagaactgccaatgtactacgcgatctggatgccggtttatccaacgtcacatcaacagtgttaaatgcaattgccaattcaacatcaggtgccattgttggtggagcaggagggggcattgcaggcgctgccgcaggtgctttagttggcgccgggctaaaaggtgctgtatctaaaattgccaccacacgtagtggtcggtatgcgatagagaaagcagttcaggaagccacgaaagcagtaagagctggcggaagtaaagaagcattagcggcggcggaacgcagatttatggcaaataaagccgccgtaaaagcaatacgcgatgcagttggaaacgaagagttcaatcgcttagcgagggctggcattgtagcgtcgctaagcggaatggcacaggagtaa

SEQ ID NO: 5700 - protein, 719 aa, Escherichia coli
MAKAWKDVIASPQYQALTEEQKAQAQAQYFDEVVAPKAGDKWAEARDQFYAAYPPPQQQKEEPSLMQQAGDWLTGGQSAGQIAEQAGRGLVNIPFDVLQGGASLINAISQGLGGPKVLDDVYRPAERPTDPYAQAGETIGGYLLPIGTAAKAAGATAKLAGDIGSAGNMIAGSLADAANQEGDFAQNAAINGGINIGAQGVLSGVGRVIAPRVSQALGGAALNSANDVSRMAKSGAGRQSIASQAANVSEDVAKAAESAGIDINALTPGMRSGSRGIAQAEGALASTPGIVQDAHQAAFNEISSKLSRNLDEFGAASGTASEKSAAIKQRILQNLDQMKDAERAAWDDVRSTMPNQKARMLNGNAVIQAERSAGIPLTPEMKQFVQANNQGGVTFDGMKAWRAKFADAEQKYKRSGEANAARRAGEIRRAITDDMRTMAENGGFLDDWQKANDLSKARLSAQESAESVFGRDLATDALITNGVKSLQSSSAKGLNGPAGFHSMIRALPESERVPAISSMLQDAISHGVRGGKADAAGINHIAEILTPQNVKAISRYSSELGRIADAYGTLARAAVKPQQYIERTGRTANVLRDLDAGLSNVTSTVLNAIANSTSGAIVGGAGGGIAGAAAGALVGAGLKGAVSKIATTRSGRYAIEKAVQEATKAVRAGGSKEALAAAERRFMANKAAVKAIRDAVGNEEFNRLARAGIVASLSGMAQE

SEQ ID NO: 5701 - DNA, 129 bp, Escherichia coli
ttgcagcaagggaggctgaatcaatgggatatagttcatcaggttatgacacatatgttagtgagcgaaaatcaggaagcgacagcaataagtccggtttctcgtctttatggggtgattaatggctaa

SEQ ID NO: 5702 - protein, 42 aa, Escherichia coli
MQQGRLNQWDIVHQVMTHMLVSENQEATAISPVSRLYGVING

SEQ ID NO: 5703 - DNA, 1350 bp, Escherichia coli
atggctacgtggcaacagggtattaattctggtggttttctggctggaattggtgcgcaaaatgagaatgcgccaaaggcaagcgacattaacgcaacgcttggtctgatccgcgaaaacaatgaactggctcaatcaggtgcaaataacgttggtctgaccgcgttacgtggtctggctggagttgctgatatttataagcaggaccagcaacagaaagcgattaatgcgttcaataaggttcatgctgatgcatgggcttctggtgatccatcgggactatttaagtttgccaaggaaaatccagcgtttgttgcgcaggcacaacaggcattttccggtcttaatgagcagcaacgcaacgatatgggcgatttagccatgagggctaacgtcgctctttctcagggaccggaagcctacagtaaattcattactgacaacaaggacaggttaaatcgcgtgggggcgaatgctgattggatgattcagacaggtatccagaatccagagcagctatcacacatgctgactactatgtctctcggtgcgcttggaccagaaaaggcgtttgctgttcaggacaagatggttggtcgccagcaggagcagcaaagaattaacgaaaccattcgcaataatgacatgacgaatgcgagggctattagggggcaggatctttcctataaggctcaaatggcaagactgaatcacgacaagtatgtgtttaagcagtcacaggcggcccttgaaagagcaggacaacttcaggatatggatgttttgtctcttaactcacagatagcagcgacgggaattgatcctctaaccggtaaagctgcaacgtcagccagaatgtctcaggctaagagatggcttgatggcaacaataattacaacaatgcgttgattactggtgagcgagggatagagaaaatagattctttgcttggtaagaaggagcttgaaggtatcggtcgcttcgaaggaagaaatatagatggcttcacaagtgctgaagggcttgcaaaccgtaatgcgatagaagaattaaagtcgggtgcgtttgtccagaacgtgcagattatgcgaggtatggggagcctctccaatgctgaaggccaaaaactggaaaacctgatcgcgaaactcgatataacacagcctgaagaggtcgtcagaaaacagttatctgaaatccgatcgcaatattctgtatttcaaaaggttgcagcaagggaggctgaatcaatgggatatagttcatcaggttatgacacatatgttagtgagcgaaaatcaggaagcgacagcaataagtccggtttctcgtctttatggggtgattaa

SEQ ID NO: 5704 - protein, 449 aa, Escherichia coli
MATWQQGINSGGFLAGIGAQNENAPKASDINATLGLIRENNELAQSGANNVGLTALRGLAGVADIYKQDQQQKAINAFNKVHADAWASGDPSGLFKFAKENPAFVAQAQQAFSGLNEQQRNDMGDLAMRANVALSQGPEAYSKFITDNKDRLNRVGANADWMIQTGIQNPEQLSHMLTTMSLGALGPEKAFAVQDKMVGRQQEQQRINETIRNNDMTNARAIRGQDLSYKAQMARLNHDKYVFKQSQAALERAGQLQDMDVLSLNSQIAATGIDPLTGKAATSARMSQAKRWLDGNNNYNNALITGERGIEKIDSLLGKKELEGIGRFEGRNIDGFTSAEGLANRNAIEELKSGAFVQNVQIMRGMGSLSNAEGQKLENLIAKLDITQPEEVVRKQLSEIRSQYSVFQKVAAREAESMGYSSSGYDTYVSERKSGSDSNKSGFSSLWGD

SEQ ID NO: 5705 - DNA, 693 bp, Escherichia coli
atgttatatgcatttacgctgggcagaaaactgcgcggcgaggaaccttattaccctgaaaaaggcgggaaaggtggcagttctgataaaagcgcaaagtatgcagcagaagctcagaagtatgccgcagacctgcaaaatcagcagttcaacaccatcatgaacaacctgaagctgtttactcctctggctgggaagtatgtcggcagccttgagaacttatcgtctctggaagggcaaggtcaggcacttaaccagtattacaactctcagcagtataaagaccttgcaggtcaggctcgctatcagagtctggcggcagcggaagcaacaggtggattgggttccaccgcaaccagtaatcagttagcaacaatcgcaccaacgcttggtcagcaatggctatctggacaaatgaacaattacaacaacctggcaaatatcggtcttggcgctcttcaggggcaggcaaacgccgggcaaacatatgccaacaacatgagtcagatttcacagcaaagcgcggctcttgcagcggcaaacgccaaccgaccgtcagcattgcggcagggtgttagtggtgctgcatccggtgcgcttttgggtggtggcatagccagtgctctcgagctatcaactccgtggggtgctggtatcggtgctggtcttggtctgcttggctcgttgttttaa

SEQ ID NO: 5706 - protein, 230 aa, Escherichia coli
MLYAFTLGRKLRGEEPYYPEKGGKGGSSDKSAKYAAEAQKYAADLQNQQFNTIMNNLKLFTPLAGKYVGSLENLSSLEGQGQALNQYYNSQQYKDLAGQARYQSLAAAEATGGLGSTATSNQLATIAPTLGQQWLSGQMNNYNNLANIGLGALQGQANAGQTYANNMSQISQQSAALAAANANRPSALRQGVSGAASGALLGGGIASALELSTPWGAGIGAGLGLLGSLF

SEQ ID NO: 5707 - DNA, 456 bp, Escherichia coli
atgattacattcaaaccaacgcgaaacatcgacctgatcgaagcagtaggaaatcaccctgacatcatcgccgggagcaacaacggtgatggatacgactacaaacctgattgccgttactttgaggtgaacgtgcacggtcagtttggcggcattgtttactatcaggagattcagccgcttacattcgattgccacgccatgtacctgccagagattcgcggcttcagcaaggaaatagggctggcgttctggcgatacattctgaccaacaccaccgttcagtgcgtcacatcatttgctgcacgcaaattccgccacgggcagatgtactgcgcaatgattggccttaagcgtgtaggaaccatcaagaaatacttcaaaggcgtggatgacgtgacgttttacagcgccacacgcgaagaactaatcgacttcctgaatcacgggagatag

SEQ ID NO: 5708 - protein, 151 aa, Escherichia coli
MITFKPTRNIDLIEAVGNHPDIIAGSNNGDGYDYKPDCRYFEVNVHGQFGGIVYYQEIQPLTFDCHAMYLPEIRGFSKEIGLAFWRYILTNTTVQCVTSFAARKFRHGQMYCAMIGLKRVGTIKKYFKGVDDVTFYSATREELIDFLNHGR

SEQ ID NO: 5709 - DNA, 702 bp, Escherichia coli
atggctgattcgaatctcaacacccctgttattgtgcaggcgacgcggctcgatacatcaatccttccacgcaatatattcagccagtcttacctgctgtatgtcattaatcagggggctgatgtcggcgcaattgccgggaaagcaaatcaggctggtcagggcgcttacgatgctcaggtgaaaaacgatgaacaggatgtcgaactggctgaccacgatgcaagaatcaccgcaaacacaaaagcgataaatctccttgaggtcaggttaacaaccgccgaagggaagatagttgtactgcgtagcgatgttgattacttgctggatgaggttatcgatattcaggcgcatctggtcactgttgaccaaagactggatggcgtagaaagcgatatatctgacattaagagtgattacgtatcgaaaaccgtaacagaatcgcagtctcttgcgtcaccgctggatgtaaaaacatcatattcagttgatggaattcaggtcgttggagcaaggcagaccggatggacagcggccacaggcacaccacttcttggctcattcaacgctaaccagtcatacacggtcggcactacgtacacacaatccgaagtcgcagctatcgctacaggtttggagcaggcgcggcagcgtattctggcgcttgaaacagcacttagattacatgggctgattgactga

SEQ ID NO: 5710 - protein, 233 aa, Escherichia coli
MADSNLNTPVIVQATRLDTSILPRNIFSQSYLLYVINQGADVGAIAGKANQAGQGAYDAQVKNDEQDVELADHDARITANTKAINLLEVRLTTAEGKIVVLRSDVDYLLDEVIDIQAHLVTVDQRLDGVESDISDIKSDYVSKTVTESQSLASPLDVKTSYSVDGIQVVGARQTGWTAATGTPLLGSFNANQSYTVGTTYTQSEVAAIATGLEQARQRILALETALRLHGLID

SEQ ID NO: 5711 - DNA, 1419 bp, Escherichia coli
atgccgattcagcaacttccgcttatgaaaggtgtcggcaaagactttcgaaacgccgactatatcgactatctgccagtgaatatgttggctacgcccaaagaaatcctgaacagcagcggatatcttcgctcattcccgggcattgccaaacgttctgatgtgaatggtatatcgcgcggcgtcgagtacaacatggcgcagagtgctgtttatcgcgtgtgtggcggcaagctgtacaaaggagaaagcgaagtcggtgacgtcgccggaagtggtcgcgtatcaatggcgcatggtcgaacatcacaggctgtaggcgttaatggtcaactggtcgagtatcgttatgatggcacggttaaaaccgtctcaaactggcctacagacagtggattcacgcagtatgagttaggttcagttcgcgacattactcgcttacgtgggcgttatgcgtggtcaaaagacggaactgattcatggtttatcactgaccttgaagacgaatcgcaccctgaccgatacagtgcacaatatcgcgcagaatcgcagccggacggcatcatcggtatcgggacatggcgagacttcatcgtctgctttggttcatcgactattgaatatttctccctgactggcgcaaccaccgttggtgctgctttgtatgtcgcacagccatcactgatggtgcaaaaaggcatcgccggaacctattgcaaaacgccattcgctgattcctatgcgttcatcagcaatccggcaacaggtgcgccgtctgtatacatcatcggttccgggcaggtgtcaccaatcgccagcgcgagcattgagaaaattcttcgctcctacactgctgatgaactggctgatggtgtgatggagtctctgcgatttgatgcgcatgagctgctgattatccatcttccgcgccatgtcctcgtatacgacgcatcttcaagcgccaatgctccgcaatggtgtgtactgaaaacaggtctgtatgacgatgtgtaccgcgctatcgacttcatttacgaaggcaatcagataacgtgcggcgataagctggagtccgtgaccgggaaattgcaattcgacatcagcagccagtacgacaagcaacaggagcatctgctgtttactcctctgttcaaagcggataacgccagagttttcgaccttgaagttgaatcttcaactggcgttgcgcagtacgccgaccgcctttttctctctgcaaccactgacggcatcaattacggtcgtgagcagatgattgagcagaatgaaccgtttgtttacgacaaacgcgttttgtggaagcgagtcgggcgcatcaggaaaaatgtcggcttcaaattgcgcgttatcacgaagtcacctgtcactctgtctggctgccagataaggatcgagtaa

SEQ ID NO: 5712 - protein, 472 aa, Escherichia coli
MPIQQLPLMKGVGKDFRNADYIDYLPVNMLATPKEILNSSGYLRSFPGIAKRSDVNGISRGVEYNMAQSAVYRVCGGKLYKGESEVGDVAGSGRVSMAHGRTSQAVGVNGQLVEYRYDGTVKTVSNWPTDSGFTQYELGSVRDITRLRGRYAWSKDGTDSWFITDLEDESHPDRYSAQYRAESQPDGIIGIGTWRDFIVCFGSSTIEYFSLTGATTVGAALYVAQPSLMVQKGIAGTYCKTPFADSYAFISNPATGAPSVYIIGSGQVSPIASASIEKILRSYTADELADGVMESLRFDAHELLIIHLPRHVLVYDASSSANAPQWCVLKTGLYDDVYRAIDFIYEGNQITCGDKLESVTGKLQFDISSQYDKQQEHLLFTPLFKADNARVFDLEVESSTGVAQYADRLFLSATTDGINYGREQMIEQNEPFVYDKRVLWKRVGRIRKNVGFKLRVITKSPVTLSGCQIRIE

SEQ ID NO: 5713 - DNA, 462 bp, Escherichia coli
atggcgaaaacgaagggtgatctcgttctaaaggctttacgaaaagccgggctgtattccaatgccacgttgacagatgctgaccctcaggcaattgaagatgccattaatgacctcgaagacatgatggcagcatggcaggctaaaggtatcgagcttggatatcagtttgctgatacagaaaacggcatcatgccgttacctgacgatgattcaggtatccctgcatgggcaaatgatggcgtcgctttgaaactcgctgtgcaagtgtgcatggataacgtcattcagccgtcagacgctctccttaccgctgctgacagtgcatatcagacaatctgtatcgctttaaccaaaataccaccacttgagcggcgaaatgacatgcctcgcggtagtggtaacaaaagcgcgtttacgtggaatcggttttacatcgagaaagatgatccgagtacgtga

SEQ ID NO: 5714 - protein, 153 aa, Escherichia coli
MAKTKGDLVLKALRKAGLYSNATLTDADPQAIEDAINDLEDMMAAWQAKGIELGYQFADTENGIMPLPDDDSGIPAWANDGVALKLAVQVCMDNVIQPSDALLTAADSAYQTICIALTKIPPLERRNDMPRGSGNKSAFTWNRFYIEKDDPST

SEQ ID NO: 5715 - DNA, 225 bp, Escherichia coli
gtggggcttcggccccatttttattgggagaagacaatggcacgaacaatgctctataagcctggcaacatgatcacctgtggtcagtttgctgtcgattacgtcattgttgatgacgaagaagttaaatctcacctgaaaaaaggttgggtaaaaactcctgaagaaaccgcaacgaagcaaaaagtggctaaggcggaagaagatggcgaaaacgaagggtga

SEQ ID NO: 5716 - protein, 74 aa, Escherichia coli
MGLRPHFYWEKTMARTMLYKPGNMITCGQFAVDYVIVDDEEVKSHLKKGWVKTPEETATKQKVAKAEEDGENEG

SEQ ID NO: 5717 - DNA, 1254 bp, Escherichia coli
atggctaaccaattagcaaaagaccttgaaatcatgttcgaaaactacgttgaaggctttgaggccgcctgcgtagtttcccgtaacgctaaaaaattccgtcccggtgatacagcaatgcagcgagcaggtgatgttctgtatcgtccgcagcattaccacatgaatattgaggaaggcctcgacctcagcagcaaaacgccaacagcactggttcagcgccttgttccttcagtgttcaaggagccgaaaaacattctgtacactctggatgcgcgtgaaatgcgtgatccggaacataaaactgaagctggtcgcgccgcaggtatgcgccttgctgcacagattgactctgacctgatttccatggtcacgcagcgtgctactaacgtgatcacgatggctgactcaaccgcaggtacacagggccgtgatttgtggaactgtgcggcaggtattgatgccaccatgacggcgattggtgtacctcagggtatcaaccgtcgctctttctggaaccccttcaactacaaagaccttgctggcgagcttggtcaccgtgcctatgctcagggcgcaaccctgacagcatacgaaaaagcgcaaatccctccggttgcgtccttcgatagctacaagaccgatatttctggtcgattaccgaaaggaagcactgaatccttgacagtatcaggccaacctgaacacaaggttgaagcgaaagattcaaatggtatgccagttgataaccgacaggggactattacggtatctgcatctggcttgcaggttggtgatgcgttcaccattgccggtgtgaattccgtacaccagatcacaaaagataccaccggtcaaccgcaggtattccgtgttctggctgttagcggaactaccgtaacaatttctccaaagattctccctgttgaaaatactgatgttgcgagtcgtccatatgcaaacgtcgatgccaaaccggcagaatcagcagcaatcaccattctcaacaagaacgcagcacctgctaacctcttctgggctgatggttctgttgagctgatgtacggcaaactggcattcccgacaggtcagggtccacaggtaatgacagcaaccaccgagcagggcgctacgctgatcatgtcttatgccttcgaccacatcaaaggcgtaaccactgctcgtttcaccactctgtacggttgctctgtacttgttcctgaatatacgggcatcgttattgccgggcagtaa

SEQ ID NO: 5718 - protein, 417 aa, Escherichia coli
MANQLAKDLEIMFENYVEGFEAACVVSRNAKKFRPGDTAMQRAGDVLYRPQHYHMNIEEGLDLSSKTPTALVQRLVPSVFKEPKNILYTLDAREMRDPEHKTEAGRAAGMRLAAQIDSDLISMVTQRATNVITMADSTAGTQGRDLWNCAAGIDATMTAIGVPQGINRRSFWNPFNYKDLAGELGHRAYAQGATLTAYEKAQIPPVASFDSYKTDISGRLPKGSTESLTVSGQPEHKVEAKDSNGMPVDNRQGTITVSASGLQVGDAFTIAGVNSVHQITKDTTGQPQVFRVLAVSGTTVTISPKILPVENTDVASRPYANVDAKPAESAAITILNKNAAPANLFWADGSVELMYGKLAFPTGQGPQVMTATTEQGATLIMSYAFDHIKGVTTARFTTLYGCSVLVPEYTGIVIAGQ

SEQ ID NO: 5719 - DNA, 894 bp, Escherichia coli
atggaccagatggcagaaaacacaccagaagttgaaatcgaaaccgacgcgtcagagcagattcctgatgatgtcgaactggctgaaaaagtcgaaacagaagatggcagtgagtcctcaggcaatgatgcagaggaggctactgaaactgatgacgacgaatcagaacaggaattctactttggtgacgaaaagctggattcgccaaccagcgaagatggcgctgagcatggactggtaaaacacctgcgcaagacgattaaagagaaagaccgcgagctgaaagagctgatgcgtcagtctcagaaacccgtcgagcagcagccggtaatcactcaaccaccgcgaatgccaaaactggatgatgaggacatcggtttcgatgaagaaatctaccagcaacgcatggctaagtgggcagaggataatggcaagtaccagcaacaggagatggctcgcaagcagaaggagcaggagcttcaggctgcctatcaagagcgattatccaaatatcagcaacgtgttaaggctctcaaagttcctggctatcaggaagctgagcaggccgtactcgaggaaatccccatcgagacacaaaacgcgatcctgtttgagtcagagaagccggaaatcgttgttctggcgcttggtcgcaacgctgaactgcgcaagcaactggcagaagctaccaaccccgtagcaattggtcgtctgctggaacgtatcgaatcgaaggccagaatcatgccaaaagcaaaaaccacggcagccacaaccccgacggttaaggggagcaacggcgcagtaatcaacaacctcgacaaattgaaagccaaggcgctggaaactggtgactggacgccgtatttcgccgctaaaaaggcaaaaaaataa

SEQ ID NO: 5720 - protein, 297 aa, Escherichia coli
MDQMAENTPEVEIETDASEQIPDDVELAEKVETEDGSESSGNDAEEATETDDDESEQEFYFGDEKLDSPTSEDGAEHGLVKHLRKTIKEKDRELKELMRQSQKPVEQQPVITQPPRMPKLDDEDIGFDEEIYQQRMAKWAEDNGKYQQQEMARKQKEQELQAAYQERLSKYQQRVKALKVPGYQEAEQAVLEEIPIETQNAILFESEKPEIVVLALGRNAELRKQLAEATNPVAIGRLLERIESKARIMPKAKTTAATTPTVKGSNGAVINNLDKLKAKALETGDWTPYFAAKKAKK

SEQ ID NO: 5721 - DNA, 2184 bp, Escherichia coli
atgactgactggcatcgcaaggtgctgtgcaactttgataatgcctggtcagcaacgcaggatatgcgtgagcagattattgaggctcaacgtttcgtccgggtatccggcgcacagtgggaaggcagcacaaacgctggttactcatttgatgaaggcaggtttgagcattacccgcgctttgaactgaataagattgcccgtgaatgtgatcgcatcattggcgagtatcgacagaatcgcatcagcgttaaattcaggccgaaggatgacaaggcatcggaagcgttagccaaaaagatgaacggcaaattccgcgctgactatcaggaaacatcaggtggcgaagcgtgtgataacgcatttgatgatgctgtaacgggcggattcggttgtttccgcatgtgtgccgattacgaagatgaaatggacccaagtaacgagcagcgacgcatcagccttcttcctgtttacgacccagcgacatgcgtcttcttcgatcaggacagcaagcaatatgaccgttctgatgctatgtgggctatggaaatgttctccatgacgcctaaagcgttcgaggctgaataccctgattccatcgcggcaggcctttctcgtgatgagactggcactcaatatgactggtcaacgccagatgccatctatgttgggcgctactacgaagttcgcatagagaaggtgaagctcacggcatggcgcaaccctgttagcggagaaacggcaatctatgatgaagagcaaatcaaagatattgtcgacgagctgaccgatggtgcattcgaactgattggcgagcgaacggtgaagaaacgccgcgtttattgcggccttctgtctggcgctgaatggctggaagaaccgaagcgtattccgggcgaacatattcctctcatcccggtatatggacgtcgctcatttgttgataatcaggaacgaatcgaaggccacgcagcaaaagcgatggatgcacagcgtcttgagaacctgatggtttccatgattgcagataacgctactcaggctggcggtgatggcattcctgtagttgatgttgacatgattcctggtcctctcgctactcattgggcggagcgcaacaaaaagcgcccggcgttcctgccgatggtcagtctgaaaaacaaaaacggagatattactgcgcaggctcaggtcagcagttatacgcctccgacacaaatgcctccagctcttgccgggctattgcagtacaccggaacggctattcagcaaattacaggtgcgtcgcagcttgagaacatgccgagcaacgttgctaccgataccgttgatagcatctttaaccggatggatacgcagtcctatatctacatggacaacatggctaaatccatgcgtcgcgctggcgttgtgtggctttctatggctcgtgaagtctatggcagcgatacgccgatgcgtatcgttaatgaggacggcagcgatgacgtggcgctgatgactggtgaagtggttgaccgtcagacagggcaggttatcgcgcttaacgacctttcgcagggtaactatgaagtgactgtcgatgtcggtcagtcgttcgctactcgccgtgacgcaacggttaagtcgttactttccatgctggcacttatcccgcccggaacgccgaaacacgaccttgtatcgtcgatgatcctcgacaatatggacggcgaagggatggacgaccttaaagaatacaaccgcaatcagttgcttctgtctggagttatcaagccgagaacgccagaagaacagcagatggttgagcaggcgaaacaacaacaggccagtcagccagatccggctatggttgctgcgcaaggtcagcttcttgctggtcaggctgaattgcagaaagcgcagaacgagcaggcagccattcaggttaaagcattccaggcacagactgatgctcaggttgcagcggcaaatgttgtgaaaatcctcgcatctgccgatagccagcagaaatctgatatccgcgaggctctgaaactgctcggacagttccagcaacagcaaggagacaatgcccgtgctgatgcagagcttgtcctgaaaagtcaggcacagggccatgcgcagcgcatggacatcagcagcatcctgcaaaaatcaactcagcaacaaccacagcagtaa

SEQ ID NO: 5722 - protein, 727 aa, Escherichia coli
MTDWHRKVLCNFDNAWSATQDMREQIIEAQRFVRVSGAQWEGSTNAGYSFDEGRFEHYPRFELNKIARECDRIIGEYRQNRISVKFRPKDDKASEALAKKMNGKFRADYQETSGGEACDNAFDDAVTGGFGCFRMCADYEDEMDPSNEQRRISLLPVYDPATCVFFDQDSKQYDRSDAMWAMEMFSMTPKAFEAEYPDSIAAGLSRDETGTQYDWSTPDAIYVGRYYEVRIEKVKLTAWRNPVSGETAIYDEEQIKDIVDELTDGAFELIGERTVKKRRVYCGLLSGAEWLEEPKRIPGEHIPLIPVYGRRSFVDNQERIEGHAAKAMDAQRLENLMVSMIADNATQAGGDGIPVVDVDMIPGPLATHWAERNKKRPAFLPMVSLKNKNGDITAQAQVSSYTPPTQMPPALAGLLQYTGTAIQQITGASQLENMPSNVATDTVDSIFNRMDTQSYIYMDNMAKSMRRAGVVWLSMAREVYGSDTPMRIVNEDGSDDVALMTGEVVDRQTGQVIALNDLSQGNYEVTVDVGQSFATRRDATVKSLLSMLALIPPGTPKHDLVSSMILDNMDGEGMDDLKEYNRNQLLLSGVIKPRTPEEQQMVEQAKQQQASQPDPAMVAAQGQLLAGQAELQKAQNEQAAIQVKAFQAQTDAQVAAANVVKILASADSQQKSDIREALKLLGQFQQQQGDNARADAELVLKSQAQGHAQRMDISSILQKSTQQQPQQ

SEQ ID NO: 5723 - DNA, 1416 bp, Escherichia coli
atgacctcgattaatcctatctttgaaccgttcattgaggcgcatcgctacaaagtcgccaaaggcggtcgaggtagcggtaaatcatgggcaattgcgagactgcttgttgaagcggcgcgtcggcagccagtgcgtattctctgcgctcgtgaactgcaaaacagtatcagcgattcggtaatccggctgcttgaagacaccatagagcgtgaagggtatacggctgagtttgaaattcagcgttccatgattcgtcatctcgggacgaatgctgagttcatgttctacggcatcaaaaacaacccgacgaagattaaatcgctcgaaggcattgatatctgctgggtggaggaagcggaagcggtaacgaaggaatcatgggatatcctgataccaaccatccgcaagccattttccgaaatatgggtgagcttcaacccgaaaaacatcctcgacgatacctatcagcgattcgtagtaaaccctcccgatgatatttgtctgctgacggtgaactacaccgacaacccgcactttcctgaagttctccgtctggagatggaagagtgtaaacgcagaaacccgacactgtatcgtcacatctggcttggtgagccagtaagcgcaagtgatatggcaatcatcaaacgtgaatggcttgaagccgcaaccgatgcgcacaagaaactcggatggaaagcgaaaggcgctgttgtctctgcgcatgacccatcagatacagggccagatgctaaaggttatgcatcgcgtcacggttcggtagttaagcgcattgccgaaggtctgctgatggacatcaacgagggtgctgactgggctacttcgctggcgattgaagacggcgctgaccattacctgtgggatggcgatggtgtcggtgcagggctacgcagacagacaacggaagcattctccggcaagaaaattaccgccacgatgttcaagggcagcgaatcgccattcgatgaagatgctccgtatcaggccggagcatgggctgatgaagtcgtacagggtgacaacgttcgcactattggcgatgtattccgcaataagcgagcgcaattctattacgcgctggctgacaggctgtatctgacatatcgggcggttgtccacggtgagtatgcagaccccaacgacatgctgagcttcgacaaagaagcgataggcgagaagatgctggagaaactgtttgcagaactgacgcagattcagcgcaaattcaataataacgggaaactggagcttatgactaaggtcgaaatgaagcagaagctcggtatcccatctcctaacctggctgatgcgctgatgatgtgtatgcattgcccggagtcggctgcgcaacccgactattccagttactcaattccttgtggtgtaggttga

SEQ ID NO: 5724 - protein, 471 aa, Escherichia coli
MTSINPIFEPFIEAHRYKVAKGGRGSGKSWAIARLLVEAARRQPVRILCARELQNSISDSVIRLLEDTIEREGYTAEFEIQRSMIRHLGTNAEFMFYGIKNNPTKIKSLEGIDICWVEEAEAVTKESWDILIPTIRKPFSEIWVSFNPKNILDDTYQRFVVNPPDDICLLTVNYTDNPHFPEVLRLEMEECKRRNPTLYRHIWLGEPVSASDMAIIKREWLEAATDAHKKLGWKAKGAVVSAHDPSDTGPDAKGYASRHGSVVKRIAEGLLMDINEGADWATSLAIEDGADHYLWDGDGVGAGLRRQTTEAFSGKKITATMFKGSESPFDEDAPYQAGAWADEVVQGDNVRTIGDVFRNKRAQFYYALADRLYLTYRAVVHGEYADPNDMLSFDKEAIGEKMLEKLFAELTQIQRKFNNNGKLELMTKVEMKQKLGIPSPNLADALMMCMHCPESAAQPDYSSYSIPCGVG

SEQ ID NO: 5725 - DNA, 441 bp, Escherichia coli
atggcgcgcccaacaaagtatcaagaggcgtatgccgaacaggcacgcaaactgtgcttgctgggctacaccgatgcagagcttgctgatttcttcgaagtcagtgagtcaactattaacaagtggaagcttgattatcctgagttttcggagtccataaaaaagggtaaggccgtcgctgatgcagaagttagtgaccgtctttatcaacgcgctatgggcttcgtggctccagacatcgatattcgtgttattgaaaacagaattgtcgaaactcctcttgagaagtattacccgcctgatacaacagctgccatcttctggcttaagaaccgacagaaggataaatggcgcgacaaggttgatcacgagctaacaggcaaagacggcggcgcaatccagattgaaacatcaccgatgagtactctattcggaaaatga

SEQ ID NO: 5726 - protein, 146 aa, Escherichia coli
MARPTKYQEAYAEQARKLCLLGYTDAELADFFEVSESTINKWKLDYPEFSESIKKGKAVADAEVSDRLYQRAMGFVAPDIDIRVIENRIVETPLEKYYPPDTTAAIFWLKNRQKDKWRDKVDHELTGKDGGAIQIETSPMSTLFGK

SEQ ID NO: 5727 - DNA, 243 bp, Escherichia coli
atggcagagattattcccatgactgaagaacagaaattccagttagagatttacaagctggtcatgaaccagaacgcagccgcagaggaagcatttcagttcattggcactgacgaactgaagcttgagctattcaaaattcacttccagtcaggcggcgctaattcagatatcacgacccgcactatcgaagcggtgcgtaaatcgaaggaagcgttagacctgttcaccaccggagcataa

SEQ ID NO: 5728 - protein, 80 aa, Escherichia coli
MAEIIPMTEEQKFQLEIYKLVMNQNAAAEEAFQFIGTDELKLELFKIHFQSGGANSDITTRTIEAVRKSKEALDLFTTGA

SEQ ID NO: 5729 - DNA, 612 bp, Escherichia coli
atggtggcgaccatctcggggcggcttttctgtgcgaacaggctcatctttctaaaaggtaaagacgcaatgaactacccaaccgttgttaacgatatagatttcagagacctaatttttgtagcaaacaacgatccggttacagattcttttatggtggcaaaagcatttggaaagctgccgaagaacgtggttcgtgacattgaacgaaccatagaagcttgccctcctgagtttgatacaaagctcaactttgagctttgctataaaaacaatgagttacagaatggtaagccgcaaaaattctaccgtctccgcaaggatgggttgatgcttttggttatgtcctacaccaaaaaagaagcaatgcgtatcaaaattgcttacatcaacgcattcaactggatgtacgccatgcttcaggttggtcatcgtcaatttgaagaagagagaaatgccgtaatgctggagtacatgaaagagaaggatgttgccagcatgtcaggccgcctgcttaatcgctggggaaaaattaagaagcctcagctactggcgagaattgaacgccttgaacagcacgggcaaaccgtaatccccggactcaccaattaa

SEQ ID NO: 5730 - protein, 203 aa, Escherichia coli
MVATISGRLFCANRLIFLKGKDAMNYPTVVNDIDFRDLIFVANNDPVTDSFMVAKAFGKLPKNVVRDIERTIEACPPEFDTKLNFELCYKNNELQNGKPQKFYRLRKDGLMLLVMSYTKKEAMRIKIAYINAFNWMYAMLQVGHRQFEEERNAVMLEYMKEKDVASMSGRLLNRWGKIKKPQLLARIERLEQHGQTVIPGLTN

SEQ ID NO: 5731 - DNA, 438 bp, Escherichia coli
atgagcagagtcaccgcgattatctccgctctgattatttgcatcatcgtctgcctgtcatgggctgttaatcattaccgtgataatgcaatcgcctacaaagagcagcgcgataaagccacatccatcatcgctgatatgcggaagcgtcaacgtgatgtagcagaactcgacgcaagatacacaaaggagcttgctgatgctaacgcgactatcgaaagtctccgtgctgatgtttctgctgggcgtaagcgcctgcaagtcgccgccacctgtgcaaagtcaacgaccggagccagcagcatgggcgatggagaaaacccaagacttacagcagatgctgaactcaattattaccgtctccgaagtggaatcgacaggataaccgcgcaggttaactacctgcaggagtacatcaggacgcaatgccttcgatga

SEQ ID NO: 5732 - protein, 145 aa, Escherichia coli
MSRVTAIISALIICIIVCLSWAVNHYRDNAIAYKEQRDKATSIIADMRKRQRDVAELDARYTKELADANATIESLRADVSAGRKRLQVAATCAKSTTGASSMGDGENPRLTADAELNYYRLRSGIDRITAQVNYLQEYIRTQCLR

SEQ ID NO: 5733 - DNA, 477 bp, Escherichia coli
atggtggaaatcaataatcaacgtaaggcgttcctcgatatgctggcgtggtcagagggaactgataacggacggcagaaaaccagaaatcatggttatgacgtcattgtaggcggagagctatttactgattactccgatcaccctcgcaagcttgtcacgctaaacccaaaactcaaatcaacagccgccggacgctaccagcttctttcccgttggtgggatgcctaccgtaagcagcttggtctgaaagacttctctccgaaaagtcaggacgctgtggcattgcagcagattaaagagcgtggcgctttaccgatgattgaccgcggtgatattcgtcaggcaatcgaccgttgcagcaatatctgggcttcactgccgggcgctggttatggtcagttcgagcataaggctgacaacctgattgcaaaattcaaagaggctggcggaacggtcagagagattgaggtatga

SEQ ID NO: 5734 - protein, 158 aa, Escherichia coli
MVEINNQRKAFLDMLAWSEGTDNGRQKTRNHGYDVIVGGELFTDYSDHPRKLVTLNPKLKSTAAGRYQLLSRWWDAYRKQLGLKDFSPKSQDAVALQQIKERGALPMIDRGDIRQAIDRCSNIWASLPGAGYGQFEHKADNLIAKFKEAGGTVREIEV

SEQ ID NO: 5735 - DNA, 324 bp, Escherichia coli
atgaagatgccagaaaaacatgacctgttagccgccattctcgcggcaaaggaacaaggcatcggggcaatccttgcgtttgcaatggcgtaccttcgcggcagatataatggcggtgcgtttacaaaaacagtaatcgacgcaacgatgtgcgccattatcgcctggttcattcgtgaccttctcgacttcgccggactaagtagcaatctcgcttatataacgagcgtgttcatcggctacatcggtactgactcgattggttcgcttatcaaacgcttcgctgctaaaaaagccggagtagaagatggtggaaatcaataa

SEQ ID NO: 5736 - protein, 107 aa, Escherichia coli
MKMPEKHDLLAAILAAKEQGIGAILAFAMAYLRGRYNGGAFTKTVIDATMCAIIAWFIRDLLDFAGLSSNLAYITSVFIGYIGTDSIGSLIKRFAAKKAGVEDGGNQ

SEQ ID NO: 5737 - DNA, 177 bp, Escherichia coli
atgagcataagagaactaaacctcaccaaagagcagcacgagtggctgaatggctggcttgaactgtggggcgcatgggtttattcaggtcgtctggaaaagcgcatgagcagcgtaatagcgaagttcatgkagagcgtagagccgggaagaattatgaccaagsccaatgtgtaw

SEQ ID NO: 5738 - protein, 58 aa, Escherichia coli
  Xaa 45, 56: Xaa is any amino acid
MSIRELNLTKEQHEWLNGWLELWGAWVYSGRLEKRMSSVIAKFMXSVEPGRIMTKXNV

SEQ ID NO: 5739 - DNA, 189 bp, Escherichia coli
atgaacgccacaattcaaacgataccagagcttcttatccagacacgaggcaatcagaccgaagtggcgaggatgctttcctgcgcaagaggaacagtgctcaagtacaaccgagacagcaaaggcgagcgtcacgtaatagttaacggcgtcctgatggtcaaacaaggcaagaggggaagacgatga

SEQ ID NO: 5740 - protein, 62 aa, Escherichia coli
MNATIQTIPELLIQTRGNQTEVARMLSCARGTVLKYNRDSKGERHVIVNGVLMVKQGKRGRR

SEQ ID NO: 5741 - DNA, 363 bp, Escherichia coli
atgaacgaatatcagtttgtgcttccatacccgccgtcggtgaatacctactggcgaagacggggaagccaatattacataagcgataaaggccagaaataccgaaaagacgttcagcaaatcatccgccaactcaagttagacattttcaccaaatcacgactccgtatcaaagtcatcgcagacgttccagactcccgccgccgcgacctcgacaacatcctgaaaggtttactcgactcccttatccacgccggatttgcggaagacgacgagcaattcgatgacattcgcgtaattcgtggtgtgaaagtaccaggcggacggcttggaataaaaatcaccgaactggagaacgcatga

SEQ ID NO: 5742 - protein, 120 aa, Escherichia coli
MNEYQFVLPYPPSVNTYWRRRGSQYYISDKGQKYRKDVQQIIRQLKLDIFTKSRLRIKVIADVPDSRRRDLDNILKGLLDSLIHAGFAEDDEQFDDIRVIRGVKVPGGRLGIKITELENA

SEQ ID NO: 5743 - DNA, 291 bp, Escherichia coli
atggctaacctacgcaaagaagcgcgcggaagagaatgtcaggtacgtatttacggcgtatgcaatggcaaccctgaaactacagttctggcacattaccggatggctggaatttgcggaacgggaatgaagcctgacgacctgatcggtgcatgggcttgtagtgcgtgtcacgatgaaatcgaccgacgcacccataatctcgacaacaaagacgccagactttaccacctcgaaggcgtgatcagaacgcaggcgatactgctgagggaggggaagattaagtcatga

SEQ ID NO: 5744 - protein, 96 aa, Escherichia coli
MANLRKEARGRECQVRIYGVCNGNPETTVLAHYRMAGICGTGMKPDDLIGAWACSACHDEIDRRTHNLDNKDARLYHLEGVIRTQAILLREGKIKS

SEQ ID NO: 5745 - DNA, 723 bp, Escherichia coli
atgaatgagttaatgaatggcaatgccatcaaaatgacaagcattgaaattgctgagttggttggtaagcgtcatgacaatgtgaaacgtaccatcgaaacgctggctaaaaatggtgttatccggcttcctcaaattgaggtttccgaaagaatcaataacttagggttcaatgttcagtacgagcattacgtcttcgagggcgaacaaggtaagcgagacagtattgtcgttgttgcccagttgtcgccagagttcaccgctcgccttgttgaccgctggcgagagcttgaagaagctgcggttaatatccccaaaacgctaccggaagcgttgcgccttgctgccgatcttgctgagcagaaaatgcaactggaaaaccagctcgcaattgtcgcacctaaagttgagtttgccgatcgcgttggcgaggccagcggaattttgattggaaactttgcaaaggttgttggtattggtcaaaacaaactgtttgcgtggatgcgtgatcacaaaatccttattgcttcaggttcccggcgcaatgtgccaatgcaggaatatatggatcgcggctatttcacagtgaaagaaacagcggtcaacacaaatcacggaatacagatatcgttcaccacaaaaatcaccgggcgtggtcaacagtggctgaccagaaagctgctcgataacggaatgctgaaagtaacaggggaggctgcttaa

SEQ ID NO: 5746 - protein, 240 aa, Escherichia coli
MNELMNGNAIKMTSIEIAELVGKRHDNVKRTIETLAKNGVIRLPQIEVSERINNLGFNVQYEHYVFEGEQGKRDSIVVVAQLSPEFTARLVDRWRELEEAAVNIPKTLPEALRLAADLAEQKMQLENQLAIVAPKVEFADRVGEASGILIGNFAKVVGIGQNKLFAWMRDHKILIASGSRRNVPMQEYMDRGYFTVKETAVNTNHGIQISFTTKITGRGQQWLTRKLLDNGMLKVTGEAA

SEQ ID NO: 5747 - DNA, 177 bp, Escherichia coli
atgcttagcccatcccaatcccttcaatgccagaaagaaagcgtcgagcgagctttaacgtgcgctaactgcggtcagaagctgcatgtgctggaagttcacatgtgtgagcactgctgcgcagaactgatgagcgatccgaatagctcaatgtacgaggaagaagacgatgaatga

SEQ ID NO: 5748 - protein, 58 aa, Escherichia coli
MLSPSQSLQCQKESVERALTCANCGQKLHVLEVHMCEHCCAELMSDPNSSMYEEEDDE

SEQ ID NO: 5749 - DNA, 348 bp, Escherichia coli
atggattattcacagttaagtgattttgaaattaacaagcgagtatttaaagcgatagtgggggcaataccattaggttatccgcacaacgcagatggacggtctgtcggcaatgaatcaaatggtaattatcgatggtacgactactgcaataatcctgaagacgcagagccgattatcgtagagaacagaattggcattattccagcgccagaaaatggattatggaaggcagcgcatagaaaagttggcagtgatagcaccccatatcatatgactcaagatgaaaaccaactccgcgccgccatgattgtctttctcatgatgcaggacgccaataatgcttag

SEQ ID NO: 5750 - protein, 115 aa, Escherichia coli
MDYSQLSDFEINKRVFKAIVGAIPLGYPHNADGRSVGNESNGNYRWYDYCNNPEDAEPIIVENRIGIIPAPENGLWKAAHRKVGSDSTPYHMTQDENQLRAAMIVFLMMQDANNA

SEQ ID NO: 5751 - DNA, 177 bp, Escherichia coli
atgagacgacagcgacgaagtatcaccgacatcatctgcgaaaactgcaaataccttccaacgaaacgctccagaaataaacgcaagccaatcccaaaagaatctgacgtaaaaaccttcaactacacggctcacctgtgggatatccggtggctaagacatcgcgcgaggaaatga

SEQ ID NO: 5752 - protein, 58 aa, Escherichia coli
MRRQRRSITDIICENCKYLPTKRSRNKRKPIPKESDVKTFNYTAHLWDIRWLRHRARK

SEQ ID NO: 5753 - DNA, 441 bp, Escherichia coli
atgaaaaaactaacctttgaaattcgatctccagcacatcagcaaaacgctattcacgcagtacagcaaatccttccagacccaaccaaaccaatcgtagtaaccattcaggaacgcaaccgcagcttagaccagaatcgaaagctttgggcttgccttggtgacgtctctcgtcaggttgaatggcatggtcgctggctggatgcagaaagctggaagtgtgtgtttaccgcagcattaaagcagcaggatgttgttcctaaccttgccgggaatggctttgtggtaataggccagtcaaccagcaggatgcgtgtaaacgaatttgcggagctattagagcttatacaggcattcggtacagagcgtggcgttaagtggtcagacgaagcgcgactggctctcgaatggaaagcgcgatggggagacagggcggcatga

SEQ ID NO: 5754 - protein, 146 aa, Escherichia coli
MKKLTFEIRSPAHQQNAIHAVQQILPDPTKPIVVTIQERNRSLDQNRKLWACLGDVSRQVEWHGRWLDAESWKCVFTAALKQQDVVPNLAGNGFVVIGQSTSRMRVNEFAELLELIQAFGTERGVKWSDEARLALEWKARWGDRAA

SEQ ID NO: 5755 - DNA, 1377 bp, Escherichia coli
atgagacaggatatcgaagcgagcgttatcggtggcctgctgattggtggattaactccaaccgccagtgacgttcttgcaacgctggagccggaagcgttttcaattccgctctaccggaaagccttcgaggttattcgcaagcaggcgagaaacagaaacctaatcgacgcgctgatggttgccgaggcgtgcggagaggagcatttcaccgcaatcctgatgaccagcaaaaactgcccgagtgccgcaaacctgaagggatatgccggaatggtcgcggataactatcaccgccgtctggtgctggaaatcatggatgaaatgcgtgaaccaattcagagcggaaccatcgacgcatcgagtcaggcgatggatgagcttgtaaagcgtctttcagccatcagaaagccccgtgacgaggttaaacctgtacggttaggggaaatcattactgactacactgacacgcttgacaggcgtctgaggaacggagaagagtccgataccctgaagaccggaatcgaagaacttgatgccatcaccggagggatgaacgcagaagacctggtgataatcgctgctcgtcctggtatggggaaaaccgagctggcgctgaagattgccgaaggcgttgcaagccgcgttattcctggttctgacgtccggcgcggggtattgattttctcaatggaaatgagcgcattgcagattgcagagcgaagcattgccaacgccgggaggatgtcggttagcgtactgcgaaatcctgcatcgatggatgacgaaggctgggcgcgtgttgctaacggcatgagtcagcttgcagatttggatgtatgggtagtcgatgcctcgcggttatcggtcgaagaaatacgctcaatcgcagaacgacacaaacaggaaaatccaaacctgtcactcatcatggcggattatcttggcctgattgagaagccgaaagcagatcgcaacgacctcgcaattgcccacatctcaggaagccttaaggcgatggcgaaagacctgaaaacgcctgttatctccctaagtcagctttcacgcgatgttgagaagcgaccaaacaaacgcccgacaaacgcagatttgcgtgattcaggaagcattgaacaggacgcagactcaatcatcatgctctatcgggaagcggtatatgacgagaacagtagcgccgcgccatttgctgaaatcattgtgacgaaaaaccgttttggctcacttggtacggtttaccagcggttctgcaacggacactttgttgcatgtgaccaggatgaagccagacagatttgcacagcatcaaatgcgcctgctgcgcgtggcagacgatatgcacaaggggcggacgtatga

SEQ ID NO: 5756 - protein, 458 aa, Escherichia coli
MRQDIEASVIGGLLIGGLTPTASDVLATLEPEAFSIPLYRKAFEVIRKQARNRNLIDALMVAEACGEEHFTAILMTSKNCPSAANLKGYAGMVADNYHRRLVLEIMDEMREPIQSGTIDASSQAMDELVKRLSAIRKPRDEVKPVRLGEIITDYTDTLDRRLRNGEESDTLKTGIEELDAITGGMNAEDLVIIAARPGMGKTELALKIAEGVASRVIPGSDVRRGVLIFSMEMSALQIAERSIANAGRMSVSVLRNPASMDDEGWARVANGMSQLADLDVWVVDASRLSVEEIRSIAERHKQENPNLSLIMADYLGLIEKPKADRNDLAIAHISGSLKAMAKDLKTPVISLSQLSRDVEKRPNKRPTNADLRDSGSIEQDADSIIMLYREAVYDENSSAAPFAEIIVTKNRFGSLGTVYQRFCNGHFVACDQDEARQICTASNAPAARGRRYAQGADV

SEQ ID NO: 5757 - DNA, 888 bp, Escherichia coli
atggagaaccagaaaactggttacattccgttgtaccggagcattctgaaacagtcatgggcgaaagatgtttatcttcgcaccctgtgggaaaaccttctcctgaatgccgccagaaagccatacaaagcgaatttcaaaggtcatgaatggcatctgcaacccggtcaactggttgtgacagcagctgatttaggtcttcagttatgcgacagacatggcaagccagcaagccgtgatcaggttgagcggatgcttcaggtttttgtgaaagaggggatgatctccattgatggagagaagcaaaaaggccgtgtgataaccatcacaaattaccatgaatatgctcaaaaaatggacaatttacccgcacatgaagccgcacaaacaaccgcacatgatgccgcacatgatgaagccagcaatagcgcggctttcagcgtacatgccgcacatgaaagcgcacatgaagccgcacaaacaaccgcacatcatgaacaagaaggtattaacaagaatataaataatacccccctaccccccaatgggggaggcgatgggcaggttaaacctgaacgtcgcaaggcagaacgaatcgactacgaatccttcctgaacgcctacaacaccgaagtcggtgacagactgccacacgctgttgcggtcaacgagaaacgaaaacgccgcctgaagaaaatcatcccgcaactgaaaacgccaaacgtggacggtttcagagcgtatgtcagggcgtttgtgcatcaggccaagccgttttacttcggagacaacgacacgggctggacggctgattttgattacctgctgagagaagactcgttaacgggagttcgggaagggaagtttgcagacagggggattgcatga

SEQ ID NO: 5758 - protein, 295 aa, Escherichia coli
MENQKTGYIPLYRSILKQSWAKDVYLRTLWENLLLNAARKPYKANFKGHEWHLQPGQLVVTAADLGLQLCDRHGKPASRDQVERMLQVFVKEGMISIDGEKQKGRVITITNYHEYAQKMDNLPAHEAAQTTAHDAAHDEASNSAAFSVHAAHESAHEAAQTTAHHEQEGINKNINNTPLPPNGGGDGQVKPERRKAERIDYESFLNAYNTEVGDRLPHAVAVNEKRKRRLKKIIPQLKTPNVDGFRAYVRAFVHQAKPFYFGDNDTGWTADFDYLLREDSLTGVREGKFADRGIA

SEQ ID NO: 5759 - DNA, 294 bp, Escherichia coli
atggttcgtgcaaacaaacgcaacgaggctctaagaatcgagagtgcgttgcttaacaaaatcgcaatgcttggaactgagaagacagcggaagctgtgggcgttgataagtcgcagatcagcaggtggaagagggactggattccaaagttctcaatgctgcttgctgttcttgaatggggtgttgtcgacgacgacatggctcgattggcacgacaagttgcttcgattctcaccaataaaaaacgcccggcggcaaccgagcgttctgatcaaatacaaatagaattttaa

SEQ ID NO: 5760 - protein, 97 aa, Escherichia coli
MVRANKRNEALRIESALLNKIAMLGTEKTAEAVGVDKSQISRWKRDWIPKFSMLLAVLEWGVVDDDMARLARQVASILTNKKRPAATERSDQIQIEF

SEQ ID NO: 5761 - DNA, 105 bp, Escherichia coli
ttgctgcaattaaaagcaacaacccagccacttggaaaagtgcgctatggacaaaactccatgttagcaactgacgaacaacatcaggaatctgtgcctggctaa

SEQ ID NO: 5762 - protein, 34 aa, Escherichia coli
MLQLKATTQPLGKVRYGQNSMLATDEQHQESVPG

SEQ ID NO: 5763 - DNA, 447 bp, Escherichia coli
atgtcgctcgtaactaaacaggagccgacttgttctgattgttggaaatcttctttgccctccagtgtgagggcaattttttttgatggaggatatatgagtgaagtaacagatttagttgttattgaaaaagcaaatgcaatgactgtatttcagtctgccgaccagattgaagaaattctccaaaaggttgaacgtgaagttatgtcatttgtgcctgatatcacaacggcaaagggcagaaaggagatcgcttctctggcgtataaagttgcgcagacgaaaacatatctcgatggtcttggcaaagaccttgttgctgaactgaaggaaattccaaagctaattgatgccaaccgcaagacagtgcgcgatcgccttgatgaactgaaagccaaggcgcgccagcctcttactgattatgaggaagaatcaggcgcggattaa

SEQ ID NO: 5764 - protein, 148 aa, Escherichia coli
MSLVTKQEPTCSDCWKSSLPSSVRAIFFDGGYMSEVTDLVVIEKANAMTVFQSADQIEEILQKVEREVMSFVPDITTAKGRKEIASLAYKVAQTKTYLDGLGKDLVAELKEIPKLIDANRKTVRDRLDELKAKARQPLTDYEEESGAD

SEQ ID NO: 5765 - DNA, 645 bp, Escherichia coli
atgaggaagaatcaggcgcggattaaagccgaagaagaagctaaggcagcagctgaagctctcgcaaagcaaattgagtctgaccatgaaatagcgattttgatggatcgcgaatttgaccgccaaagagaagaggcaagactcaaagcggagcaggaaaagcgagagcatgaagaacgattaaaaagagaagctgaagagaaagccagagcagaagccgaagcaaaggcaaaagccgaaattgaagcagcagcaaggcgagaagcagaagctaaggccgcagcggaacgtgcagagcgtgaacgcattgaagccgagcaacgagcacagcgcgaagcaaaagaggcagcagaacgagctgaaagagaaaagcaggcagcaattgaagcagaacgcagaaaagcacaggaggaggctgaacgaatccgtcgcgaggctgaagcaaaagagcaagccagaatagcagaagaaaaaagaatcaaggacgaagaagagcgtagagcaaaggataaagctcaccggaaagaagtaaataacaaaatacttgctgaccttatcaaggttggcgcatcagaagatgttgctaaaaatatcataacagccatcgtaaaaggcgaagtattcgcaacaaaaataacctactaa

SEQ ID NO: 5766 - protein, 214 aa, Escherichia coli
MRKNQARIKAEEEAKAAAEALAKQIESDHEIAILMDREFDRQREEARLKAEQEKREHEERLKREAEEKARAEAEAKAKAEIEAAARREAEAKAAAERAERERIEAEQRAQREAKEAAERAEREKQAAIEAERRKAQEEAERIRREAEAKEQARIAEEKRIKDEEERRAKDKAHRKEVNNKILADLIKVGASEDVAKNIITAIVKGEVFATKITY

SEQ ID NO: 5767 - DNA, 153 bp, Escherichia coli
atgcgcaatgaaatagccatcaatcaccagatgcttcgtgctgcacagaacaaagcagtaatagccagatttattggtgattccaaaatgtggcttgaagcaaataaagcgatgaaatcagctatcaaccttccgtggtatcgcaggaaatga

SEQ ID NO: 5768 - protein, 50 aa, Escherichia coli
MRNEIAINHQMLRAAQNKAVIARFIGDSKMWLEANKAMKSAINLPWYRRK

SEQ ID NO: 5769 - DNA, 174 bp, Escherichia coli
gtggtatcgcaggaaatgagttttacagataactggtcagacgaagaattcattcgtcagattaaagaattaatcggtaacgaaggagatattcatgtcacttgcaaccacagtgaaggagagcaagttacagagacgcatgtacacgcagaaagctctctggtatcgccataa

SEQ ID NO: 5770 - protein, 57 aa, Escherichia coli
MVSQEMSFTDNWSDEEFIRQIKELIGNEGDIHVTCNHSEGEQVTETHVHAESSLVSP

SEQ ID NO: 5771 - DNA, 636 bp, Escherichia coli
ttgggccgtgtccattctgagagcaatcatatgagcaaagaattttacgcaagactggcagctattcaggagaatctgaacgcgccaaagaatcagtacaactcattcggcaaatataaatacagaagctgcgaagatattcttgaaggcgttaagccgttactgaacggtctgtttttatcaatcagcgatgaagttgtgttgattggtgatcggtattacgtgaaagccacggcaactattaccgatggcgaaaacagtcatacggcaaccgctcttgcacgagaggaagaaagcaagaaaggaatggattctgcacaagttacgggagctacaagctcttatgcacgcaagtattgcctcaatggtttgttcggcattgatgatgcgaaagatgcagatacagacgagcataaacatcagcagaacgcagcagcaaagcaatcaaaaccatcacttacacctgaacaggttctaaaagcattcactgacgcagcaatgcagaaaaacaccgtagaagagcttaaacaggcgttcgccaaagcgtggaagatgctcgaagggacgccggagcagcacaaagcgcaggacgtttacaacatcagacgagacgaattagaaggggcaactgcttaa

SEQ ID NO: 5772 - protein, 211 aa, Escherichia coli
MGRVHSESNHMSKEFYARLAAIQENLNAPKNQYNSFGKYKYRSCEDILEGVKPLLNGLFLSISDEVVLIGDRYYVKATATITDGENSHTATALAREEESKKGMDSAQVTGATSSYARKYCLNGLFGIDDAKDADTDEHKHQQNAAAKQSKPSLTPEQVLKAFTDAAMQKNTVEELKQAFAKAWKMLEGTPEQHKAQDVYNIRRDELEGATA

SEQ ID NO: 5773 - DNA, 297 bp, Escherichia coli
atgccagcgcctttgtatggtgcggatgacccgcgccgctgttccggcaattccgtatcggaggtgctggataaattcagaaaaaactacgatcgaataatgtctctaccgcaggaaacgaaagaggaaaaggaatttcgccactgtatatggcttgcagagaaagaagaacgcgagcgaatttaccagacatcaatccgaccattccgcaaagccacatatacccacttccctgaatatatcgacccgcgcctgcgtaattaccgctcacgctatggcgctatcagtaatgactga

SEQ ID NO: 5774 - protein, 98 aa, Escherichia coli
MPAPLYGADDPRRCSGNSVSEVLDKFRKNYDRIMSLPQETKEEKEFRHCIWLAEKEERERIYQTSIRPFRKATYTHFPEYIDPRLRNYRSRYGAISND

SEQ ID NO: 5775 - DNA, 798 bp, Escherichia coli
gtgccaatctcgatcattcccattgcaccaaccatcaggtggagtccagttttctatcagagcagccattttctttgctttcgccggagtagctgttgcggtatcgcagtaatgacgagtgtcaaccaacgtatccataccatcgatatcaagtacgcaaaaccatgtgtgattcggcatttcaacagatggtatttgttgcccacgtcgacgtttatcaataagacatacagtcactggttgcctcctttgcgaagctgggcagcaaagtcaactaaccactcagtcatttcaaccttccctaccaggtctgaaccagggtgcatacagcaatcactctgcgccgctttgaaatccttatactcatattcttgggccaccagattttttgcagcttctatagcagcatccaccccctgcgcccgcacttcagccagaaaagcatcggtggctggggtttcagtaacatcatcttcccattcgctaaactcctcacgacaaaagtcattaaattccttctcagattgcttaagtgaggtattttcagcagccatcttcgcgcatttagcctcaaggttatcaatcgtgattccagcagaactacactcccgcaacgccgtttccagttttgattcaagttcaccgaacttacggacaaggtattcagcgtttgtttcgttaacctttaaatcacttgggatgcatttacctttcagaaaaccatccatctcaattagtgacatttgtttcatttcttcccactccgccacatcgcattcagatatttgttgtcattaa

SEQ ID NO: 5776 - protein, 265 aa, Escherichia coli
MPISIIPIAPTIRWSPVFYQSSHFLCFRRSSCCGIAVMTSVNQRIHTIDIKYAKPCVIRHFNRWYLLPTSTFINKTYSHWLPPLRSWAAKSTNHSVISTFPTRSEPGCIQQSLCAALKSLYSYSWATRFFAASIAASTPCARTSARKASVAGVSVTSSSHSLNSSRQKSLNSFSDCLSEVFSAAIFAHLASRLSIVIPAELHSRNAVSSFDSSSPNLRTRYSAFVSLTFKSLGMHLPFRKPSISISDICFISSHSATSHSDICCH

SEQ ID NO: 5777 - DNA, 519 bp, Escherichia coli
atgaaacaaatgtcactaattgagatggatggttttctgaaaggtaaatgcatcccaagtgatttaaaggttaacgaaacaaacgctgaataccttgtccgtaagttcggtgaacttgaatcaaaactggaaacggcgttgcgggagtgtagttctgctggaatcacgattgataaccttgaggctaaatgcgcgaagatggctgctgaaaatacctcacttaagcaatctgagaaggaatttaatgacttttgtcgtgaggagtttagcgaatgggaagatgatgttactgaaaccccagccaccgatgcttttctggctgaagtgcgggcgcagggggtggatgctgctatagaagctgcaaaaaatctggtggcccaagaatatgagtataaggatttcaaagcggcgcagagtgattgctgtatgcaccctggttcagacctggtagggaaggttgaaatgactgagtggttagttgactttgctgcccagcttcgcaaaggaggcaaccagtga

SEQ ID NO: 5778 - protein, 172 aa, Escherichia coli
MKQMSLIEMDGFLKGKCIPSDLKVNETNAEYLVRKFGELESKLETALRECSSAGITIDNLEAKCAKMAAENTSLKQSEKEFNDFCREEFSEWEDDVTETPATDAFLAEVRAQGVDAAIEAAKNLVAQEYEYKDFKAAQSDCCMHPGSDLVGKVEMTEWLVDFAAQLRKGGNQ

SEQ ID NO: 5779 - DNA, 573 bp, Escherichia coli
atgaccaaaattaactatcaggcactgcgtgaggcggcagaacgtgcaattccggcaatggaacgcctgttaatgttgccagttgatgatgatttgttaagtgaacaggaacttaaggattacggtgtggatattgatgcgctcaacgccttcaaatttctgaccggaccagaaaccgtgctggcgctgctggatgaacgggaaagaaaccagcaatacatcaaacgccgcgaccaggagaacgaggaaattgcgctaacggtagggaagctgcgcgttgagctggaagctgcagagaagcgcattgcagaactggaagccgaacctgtaagccaaacttacaagttgaacgagctgtcgggcaactatccggtaactccggatggttggataagctgtagtgagcgaatgcccgctcaagatgattggattttaatttattcaaagcacggcgagtatatggcaggacaggtacaaggggaatacgtggagttgagcgacggcactttatcgtggttagggaacgccttgtactggatgcctctaccggaaccgccgcaggaggttaattga

SEQ ID NO: 5780 - protein, 190 aa, Escherichia coli
MTKINYQALREAAERAIPAMERLLMLPVDDDLLSEQELKDYGVDIDALNAFKFLTGPETVLALLDERERNQQYIKRRDQENEEIALTVGKLRVELEAAEKRIAELEAEPVSQTYKLNELSGNYPVTPDGWISCSERMPAQDDWILIYSKHGEYMAGQVQGEYVELSDGTLSWLGNALYWMPLPEPPQEVN

SEQ ID NO: 5781 - DNA, 285 bp, Escherichia coli
gtggctaacctgcaacttgccgttaaaggtgaatacttcgatgccatgattcgcggagagaaaacggaagagtatcgcctgtgtaatgactactggaataagcgaattatgttccgcgagtatgaccgcctgattatcacaaagggatatccgaagcgcgacgattccagccgcagaattgacgtcccgtatgacggatatgaaatcaagacaatcacacatccgcacttcggcgataaaccggtaaaggtgttcgctataaaggtgaatatcgacaatgaatga

SEQ ID NO: 5782 - protein, 94 aa, Escherichia coli
MANLQLAVKGEYFDAMIRGEKTEEYRLCNDYWNKRIMFREYDRLIITKGYPKRDDSSRRIDVPYDGYEIKTITHPHFGDKPVKVFAIKVNIDNE

SEQ ID NO: 5783 - DNA, 201 bp, Escherichia coli
atgcaacacgaactacaacctgattcactggttgatttgaaattcatcatggccgatactggcttcggtaaaaccttcatctatgaccggattaagtccggcgacctgccaaaagccaaagttatccacgggcgagcaagatggttatatcgtgaccattgtgaattcaaaaataagctcttaagccgcgccaatgggtaa

SEQ ID NO: 5784 - protein, 66 aa, Escherichia coli
MQHELQPDSLVDLKFIMADTGFGKTFIYDRIKSGDLPKAKVIHGRARWLYRDHCEFKNKLLSRANG

SEQ ID NO: 5785 - DNA, 936 bp, Escherichia coli
atggaaccccttcgtgaaataagaaatcgactgcttaacggctggcaactatcaaaactgcatacttttgaagtggctgccaggcatcagtccttcgcccttgcggcagaggaattgtcgctgagccccagtgcggtaagtcaccgtatcaatcagctggaagaagaattaggtattcagttgtttgttcgttcccatcgcaaagtggaattaacgcacgaggggaaacgtgtttattgggcgctaaaatcgtcgctggataccctgaatcaggaaattctggatatcaaaaatcaggagttatcgggaacgttaacgttgtattcccggccctctatcgcccaatgctggttggtgcccgcattaggtgactttacacgccgatatccgtctatttcgctcaccgtgctcactggtaatgacaatgtcaatttgcaacgtgccggaatcgatttggcgatctactttgatgatgcgccgtcagcgcaattggctcatcactttctgatggatgaagaaatcctgccagtttgcagcccggagtacgctcatagacatgatttaaccaacacggtaattaacctgcgtcactgtacgttgctccatgacagacaggcatggagcaacgactccggtacggatgaatggcatagttgggcgcaacattatgcggttaatttgccgacatcttctggaattggctttgatcgctctgatttagccgttatcgccgcgatgaatcatattggggtggcgatgggaaggaaacgtctggtacaaaaaaggcttgccagtggtgagctcgtcgcgccgtttggcgatatgacggtgaaatgccatcagcattattacatcactacattaccgggcaggcagtggccaaaaattgaggcatttattacttggttaagagaacaggtaaaaaccacttcataa

SEQ ID NO: 5786 - protein, 311 aa, Escherichia coli
MEPLREIRNRLLNGWQLSKLHTFEVAARHQSFALAAEELSLSPSAVSHRINQLEEELGIQLFVRSHRKVELTHEGKRVYWALKSSLDTLNQEILDIKNQELSGTLTLYSRPSIAQCWLVPALGDFTRRYPSISLTVLTGNDNVNLQRAGIDLAIYFDDAPSAQLAHHFLMDEEILPVCSPEYAHRHDLTNTVINLRHCTLLHDRQAWSNDSGTDEWHSWAQHYAVNLPTSSGIGFDRSDLAVIAAMNHIGVAMGRKRLVQKRLASGELVAPFGDMTVKCHQHYYITTLPGRQWPKIEAFITWLREQVKTTS

SEQ ID NO: 5787 - DNA, 1338 bp, Escherichia coli
atgcactctcaaatctgggttgtgagcacgctgcttatcagcatcgtgttaattgtactgaccatcgtgaagttcaaattccacccgtttctggcgctgttgctggccagcttcttcgtgggaacgatgatgggcatggggccactggatatggtaaatgctattgaaagtggaattggcggaacgctggggttcctcgctgcggttatcggccttggcacgatactgggaaaaatgatggaagtatccggggccgcagaaagaattggtctgacacttcaacgctgccggtggctttcagctgatgtcattatggtgctggttggcctgatttgcggcatcacgctgtttgttgaagtgggcgtcgtgctattgattcctctggctttttcaattgccaaaaaaaccaatacctcattgttaaagctggccattccgctgtgtaccgcattgatggcagtgcactgcgtggttcccccacatccggctgctttatatgttgccaataagctgggcgcagatatcggttcggtgatcgtctacggtttgctggttgggctgatggcatcactgatcggtggcccacttttccttaaatttctggggcaacgactgccctttaaacctgtacccacagagtttgccgatctcaaagttcgcgatgaaaaaacactaccgtcattaggcgcaacgttattcaccatactgctacccattgcgctgatgttggttaaaacgattgccgaattgaatatggcgcgtgagagtggtttgtataccttgcttgagtttattggcaaccctatcactgccatgtttatcgccgtatttgtcgcctattatgtgttgggtatacgtcagcatatgagcatggggacgatgctcacacatacggaaaatggtttcggttctattgctaatattttgctgattatcggggccggaggcgcattcaacgccattttaaaaagcagcagtctcgctgatacgctggcagttattctctccaatatgcatatgcacccgattcttctggcctggttggtggcacttattctgcatgctgcagtgggctccgctacggtggcaatgatgggggcaacggcaattgttgcacccatgctgccgctgtatcccgacatcagcccggaaattattgcaattgccatcggttcaggtgcgattggctgcacgatcgttacggactcgcttttctggctggtgaagcaatattgcggtgctacgctcaatgaaacatttaaatactatacgacagcgacatttatcgcttcagtcatcgctctggcgggcacattcctgctgtcatttatcatctaa

SEQ ID NO: 5788 - protein, 445 aa, Escherichia coli
MHSQIWVVSTLLISIVLIVLTIVKFKFHPFLALLLASFFVGTMMGMGPLDMVNAIESGIGGTLGFLAAVIGLGTILGKMMEVSGAAERIGLTLQRCRWLSADVIMVLVGLICGITLFVEVGVVLLIPLAFSIAKKTNTSLLKLAIPLCTALMAVHCVVPPHPAALYVANKLGADIGSVIVYGLLVGLMASLIGGPLFLKFLGQRLPFKPVPTEFADLKVRDEKTLPSLGATLFTILLPIALMLVKTIAELNMARESGLYTLLEFIGNPITAMFIAVFVAYYVLGIRQHMSMGTMLTHTENGFGSIANILLIIGAGGAFNAILKSSSLADTLAVILSNMHMHPILLAWLVALILHAAVGSATVAMMGATAIVAPMLPLYPDISPEIIAIAIGSGAIGCTIVTDSLFWLVKQYCGATLNETFKYYTTATFIASVIALAGTFLLSFII

SEQ ID NO: 5789 - DNA, 1329 bp, Escherichia coli
atggaaaacgctaaaatgaattcgctcatcgcccagtatccgttggtagaggatctggttgctcttaaagaaaccacctggtttaatcctggcacgacctcattggcagaaggtttaccttatgttggcctgaccgaacaggatgttcaggacgcccatgcgcgcctgtctcgttttgcgccgtatctggcaaaagcatttcctgaaacggctgccgcgggggggattattgaatcagaactggttgctattcctgctatgcaaaaacggctggaaaaggaatatcaccagccgatcgccgggcaattgctactaaaaaaagacagccatttgccgatttccggctccataaaagcacgtggcgggatttatgaagtcctggcccatgctgaaaaactggctctggaagcgggtttgctgacacttgaggatgattacagcaaactgctttccccggagtttaaacagttctttagccaatacagtattgctgtgggatcaaccggaaatctggggttatcaattggtattatgagcgcccgcatcggctttaaagtaacggtgcatatgtctgctgatgcccgcgcctggaaaaaagcgaaactgcgcagtcatggcgttactgtcgtggaatacgagcaagattatggtgttgctgtcgaggaaggacgtaaagcagcgcagtctgacccgaactgtttctttattgatgacgagaattcccgcacgttgttccttggatattccgtcgcaggccagcgtcttaaggcacaatttgctcagcaaggtcgcatcgtcaatgctgataaccctctgtttgtctatctgccgtgtggtgttggcggtggtcctggtggcgtcgcattcggacttaaactggcgtttggcgatcatgttcactgcttttttgccgaaccaacgcactccccgtgtatgttattaggcgtccataccggattacacgatcagatttctgttcaggatattggcatcgacaaccttaccgctgccgatggccttgcggttggtcgcgcatcgggctttgtcgggcgggcaatggagcgtctgctggatggcttctatacccttagcgatcaaaccatgtatgacatgcttagctggttggcgcaggaagaaggtattcgtcttgaaccatcggcactggcgggtatggccgggcctcagcgcgtgtgcgcatcagtaagttaccaacagatgcacggtttcagcgcagaacaactgcgtaatgccactcatctggtgtgggcgacgggaggtggaatggtgccggaagaagagatgaatcaatatctggcaaaaggccgttaa

SEQ ID NO: 5790 - protein, 442 aa, Escherichia coli
MENAKMNSLIAQYPLVEDLVALKETTWFNPGTTSLAEGLPYVGLTEQDVQDAHARLSRFAPYLAKAFPETAAAGGIIESELVAIPAMQKRLEKEYHQPIAGQLLLKKDSHLPISGSIKARGGIYEVLAHAEKLALEAGLLTLEDDYSKLLSPEFKQFFSQYSIAVGSTGNLGLSIGIMSARIGFKVTVHMSADARAWKKAKLRSHGVTVVEYEQDYGVAVEEGRKAAQSDPNCFFIDDENSRTLFLGYSVAGQRLKAQFAQQGRIVNADNPLFVYLPCGVGGGPGGVAFGLKLAFGDHVHCFFAEPTHSPCMLLGVHTGLHDQISVQDIGIDNLTAADGLAVGRASGFVGRAMERLLDGFYTLSDQTMYDMLSWLAQEEGIRLEPSALAGMAGPQRVCASVSYQQMHGFSAEQLRNATHLVWATGGGMVPEEEMNQYLAKGR

SEQ ID NO: 5791 - DNA, 1185 bp, Escherichia coli
atggcggggccgttaattccactgtcacagagtttattattaaggaattatccaccagaaaaaagaacatttgctctggcattatggtcaatgaccgtgattatcgctccgatatgtgggccgatattgggcggctatatttgcgataactttagctggggttggatatttttaatcaatgtccctatggggattatcgtcctgacattatgcttaaccttacttaaaggacgagaaactgagacttcaccggtcaaaatgaatctaccaggactgaccctgttagtgctcggtgttggtggcttgcaaattatgcttgataaagggcgcgatctggattggttcaactcgagtacaataatactactaacagtagtatcagttatttctctgatctctttagtcatttgggagtcgacctcagagaatccgattcttgacctcagtttgtttaagtcccgtaatttcaccattggtattgtgagtatcacatgcgcgtatttattttactctggagcgatagttcttatgccgcagttactccaggaaacgatggggtataatgcgatatgggccggacttgcctatgcgcccatcggtatcatgccgctattaatatcacctttgataggacgttatggcaacaaaattgatatgcggttgttggtgacatttagttttttgatgtatgcggtttgctattactggcgttctgtgacatttatgccaacgattgattttacaggcatcattttgccacagttttttcagggattcgccgttgcctgtttctttttacccttaacaacgatttcgttttcaggcttgccagataataaatttgccaatgcctcgagtatgagtaatttttttcgcaccttgtcaggatcagttggtacgtcgttgacaatgacactgtggggacgccgcgaatcgttacaccatagtcagttgacagcaaccatcgatcaatttaaccccgtgtttaattcatcgtcacaaattatggataaatactatggttcgctttcaggagttcttaatgaaattaataatgaaataactcagcagtcactttctatttctgcaaatgagattttccgtatggcggctattgcttttatcttacttacggttttggtttggtttgcgaaaccgccgtttacagcgaaaggcgttgggtga

SEQ ID NO: 5792 - protein, 394 aa, Escherichia coli
MAGPLIPLSQSLLLRNYPPEKRTFALALWSMTVIIAPICGPILGGYICDNFSWGWIFLINVPMGIIVLTLCLTLLKGRETETSPVKMNLPGLTLLVLGVGGLQIMLDKGRDLDWFNSSTIILLTVVSVISLISLVIWESTSENPILDLSLFKSRNFTIGIVSITCAYLFYSGAIVLMPQLLQETMGYNAIWAGLAYAPIGIMPLLISPLIGRYGNKIDMRLLVTFSFLMYAVCYYWRSVTFMPTIDFTGIILPQFFQGFAVACFFLPLTTISFSGLPDNKFANASSMSNFFRTLSGSVGTSLTMTLWGRRESLHHSQLTATIDQFNPVFNSSSQIMDKYYGSLSGVLNEINNEITQQSLSISANEIFRMAAIAFILLTVLVWFAKPPFTAKGVG

SEQ ID NO: 5793 - DNA, 1164 bp, Escherichia coli
gtggaacaggttaattcaaataaaaaacattctgacagaagaaagtattttgctttgttagcggtagttttatttattgcgttttcaggtgcctatgcctattggtcaatggaattaaaagacatgattagtacagatgacgcctatgtcacgggaaatgcagatccaatttctgcacaagtctcaggcagtgtcactgtcgttaatcataaagatacgaactacgttcgacaaggtgacattttagtttcactggataaaactgatgccactatcgcactcaataaagctaaaaataatctggcaaatattgttcggcaaacgaataaactatacttacaggataaacaatacagtgccgaagtcgcttcagcacgtattcagtatcaacaatctttagaagattataaccgtcgtgtgcctttagcgaagcaaggggttatttcaaaagaagcgctggagcataccaaagatacgttaataagtagcaaagcggcattgaatgctgctatccaggcttataaagcgaataaagctttagtaatgaacacaccattaaaccgtcagccacaagtcattgaagctgcagatgcaaccaaagaagcctggttggcgcttaaacgtacggatattaagagtccggttaccggttatattgcccaaagaagtgttcaggtcggcgaaacagtgagtcccggacaatcgttaatggctgtcgtaccggcgcgtcaaatgtgggttaatgccaactttaaagaaacacaactcacggatgtacggattggtcaatcggtcaatattatcagcgatctttatggtgaaaatgttgtgtttcatggtcgggtgacagggatcaatatgggaaccggcaatgcgttctccttattacctgcacaaaatgcgacagggaactggatcaaaatcgttcagcgtgtaccggttgaagtttctctggatccaaaagaactcatggaacaccctttgcgcattggtttatcgatgactgctactattgatacgaagaatgaagacattgccgagatgcccgatctggcttcaaccgtgacgtccatgcctgcttataccagtaaggctttagttatcgataccagtccgatagaaaaagaaattagcaacattatttcgcataatggacaactttaa

SEQ ID NO: 5794 - protein, 387 aa, Escherichia coli
MEQVNSNKKHSDRRKYFALLAVVLFIAFSGAYAYWSMELKDMISTDDAYVTGNADPISAQVSGSVTVVNHKDTNYVRQGDILVSLDKTDATIALNKAKNNLANIVRQTNKLYLQDKQYSAEVASARIQYQQSLEDYNRRVPLAKQGVISKEALEHTKDTLISSKAALNAAIQAYKANKALVMNTPLNRQPQVIEAADATKEAWLALKRTDIKSPVTGYIAQRSVQVGETVSPGQSLMAVVPARQMWVNANFKETQLTDVRIGQSVNIISDLYGENVVFHGRVTGINMGTGNAFSLLPAQNATGNWIKIVQRVPVEVSLDPKELMEHPLRIGLSMTATIDTKNEDIAEMPDLASTVTSMPAYTSKALVIDTSPIEKEISNIISHNGQL

SEQ ID NO: 5795 - DNA, 339 bp, Escherichia coli
ttggtcgataaactacacattaatgaagacagcgaaaaaaaggttactgaaagtaaaaataaccttaattcgcctattctttgtgccagcctgccggtaacagggatcgcaatggcatttgctacgccaaacgaggtgataacccaggtgccttcgtctgttgatgctcccagaaagccagatattgtcggtattgcgacgttagaaatagtggaatccaacatttgcataaacgtcgctaatgacaatgcaatagtgacgcaccataacgtcccaccggttaatggtgcaggagttgatttagtgattgccattaaagttgtccattatgcgaaataa

SEQ ID NO: 5796 - protein, 112 aa, Escherichia coli
MVDKLHINEDSEKKVTESKNNLNSPILCASLPVTGIAMAFATPNEVITQVPSSVDAPRKPDIVGIATLEIVESNICINVANDNAIVTHHNVPPVNGAGVDLVIAIKVVHYAK

SEQ ID NO: 5797 - DNA, 615 bp, Escherichia coli
atgaacgcaataattattgatgaccatcctcttgctatcgcagcaattcgtaatttattgatcaaaaacgatattgaaatcttagcagagttgactgaaggcggaagcgccgttcagcgggtggaaacacttaagcctgatatcgtcatcattgatgtcgatatccccggagttaacggtatccaggtgttagaaacgctgagaaagcgccaatatagcggaattattattattgtctccgctaaaaatgaccatttttacgggaaacattgtgctgatgctggcgctaatggtttcgtgagtaaaaaagaaggcatgaacaatatcattgcggctattgaagctgcaaaaaatggctactgctatttccccttctctctcaaccggtttgttggaagtttaacgtccgaccagcaaaaactcgactccttatcgaaacaagaaattagtgtcatgcggtatattcttgatggcaaggataataatgacattgctgaaaaaatgttcatcagcaacaaaactgtcagcacttataaaagtcgcttgatggaaaaattagaatgcaaatcactgatggatctttacacattcgcacaacgtaacaaaatcggctaa

SEQ ID NO: 5798 - protein, 204 aa, Escherichia coli
MNAIIIDDHPLAIAAIRNLLIKNDIEILAELTEGGSAVQRVETLKPDIVIIDVDIPGVNGIQVLETLRKRQYSGIIIIVSAKNDHFYGKHCADAGANGFVSKKEGMNNIIAAIEAAKNGYCYFPFSLNRFVGSLTSDQQKLDSLSKQEISVMRYILDGKDNNDIAEKMFISNKTVSTYKSRLMEKLECKSLMDLYTFAQRNKIG

SEQ ID NO: 5799 - DNA, 3594 bp, Escherichia coli
atgaagtttttaccctatatttttcttctctgttgtggtctttggtcgaccataagcttcgcagacggagattacatcgaatatcgtggcatcagtagtaacaaccgtgtcacacttgatccactacgtctgagcaacaaggaattacgttggctcgcgagcaaaaaaaatcttgtgattgcagtacacaagtcccaaacagctacgttgttgcataccgattcgcagcaacggattcgtggtattaatgctgattatttaaatcttttaaaaagagcgttaaatatcaaattaacactccgggaatacgcagatcatcaaaaagcaatggacgcgctggaagacggtgaagttgatatagtgttatcacatttagttgcttcgccgcctcttaatgatgacattgctgcaactaatcctctgataattacctttccggcgctggtcactacccttcacgattcaatgcgaccgcttacctcatcaaaaccagtaaatattgctcgagtagcaaattatcccccagacgaggtaattcatcaatcatttccaaaagcaacaattatctcttttacaaatttatatcaggcattagcatccgtctcagccggacagaatgattactttattggtagtaacatcattaccagcagtatgatttcccgttattttactcactccttaaatgtagtgaagtattataactcaccgcgtcaatataactttttattaaccagaaaagattcaatcgttcttaatgaagtactcaatcgatttgttgatgctttaacaaatgaagttcgctatgaagtatcacaaaattggcttgatacaggaaacctggcctttctgaacaaaccattagaactcactgaacatgaaaaacagtggattaagcagcatcccgatttaaaggtgctggaaaatccttactcgccaccctattctatgacagatgaaactggctcagttcggggcgtgatgggtgatattcttaatattattaccttgcaaacaggtttaaatttttctccgatcaccgtttcacataatattcatgctgggacacagcttaaccccggtggatgggatatattgcccgccgctatttatagtgaagatcgagaaaataatgtttcatttgctgaagtcttcataacaacgccttacgtttttgtcatgcaaaaagcgcctgacagtgaacaaacattaaaaaaaggaatgaaagttgccattccatattattatgagcttcattcgcaattaaaagagatgtatccggaggtagagtggataaaagtcgataacgccagcgctgcatttcacaaggtcaaggaaggtgaacttgatgctctggtcgcgacacagttaaattcgcgttacatgatcgaccattactatcctaatgaactttatcattttcttattcccggcgttcagaatgcatcactttcgttcgcttttcctcgcggagaaccggaacttaaggatattattaataaagcactgaatgcaattcccccaagcgaagttctgcgcctgaccgaaaaatggattaaaatgcccaatgtgaccattgacacatgggacctctatagcgagcagttttatattgttacgacattatccgttttattagttggcagtagccttttatggggattctacctgttacgctcagttcgtcgtcgtaaagttattcagggtgatttagaaaaccaaatatcattccggaaagcactctcggactccttaccgaatccaacttatgttgtaaactggcaaggtaatgtcattagtcataatagtgcatttgaacattatttcactgatgattactacaaaaatgcaatgttgccattagaaaacagtgaatccccctttaaagatgttttttctaatacgcatgaagtcacagcagaaacgaaagaaaaccgaacaatatacacacaggtatttgaaattgataatggcatcgagaaaagatgcattaatcactggcataccttatgtaatctgccagcaagcgaacatgctgtttatatttgtggttggcaagatattaccgagacgcgtgatttaattcatgcactcgaagtagagagaaataaagcgatcaatgcaactgtcgcaaaaagccagtttctggcaacaatgagtcacgaaataagaacaccaataagctccattatgggcttcctggaacttctgtcgggttctggtcttagcaaggaacaacgggtggaggcgatttcacttgcctacgccaccggacaatcactcctcggcttaattggtgaaatccttgatgtcgacaaaattgaatcgggtaactatcaacttcaaccacaatgggtcgatatccctactttagtccagaacacttgtcactctttcgctgcgattgctgcaagcaaatcgatcgcattaagttgcagcagtacgcttcctgaacgctacctggttaagatcgaccctcaggcgtttaagcaggtcttatctaatttactgagtaatgctctcaaatttactaccgagggggcagtaaaaattacgacctccctgggtcacattgatgacaaccacgctgttatcaaaatgacgattatggattctggaagtggattatcgcaggaagaacaacaacaactgtttaaacgctatagccaaacaagtgcaggtcgtcagcaaacaggttctggtttaggcttaatgatctgcaaagaattaattaaaaacatgcagggcgatttgtcattagaaagtcatccaggcataggaacgatatttacgatcacaatcccggtagaaattacccaacaagtggcggctgtcgaggcaaaagcagaacaacctataacactacctgaaaagttgagcatattaatcgcggatgatcatccgaccaacaggctattactcaaacgccagctaaatctattaggatatgatgttgatgaagccactgatggtgtgcaagcgctacacaaagtcagtatgcaacattatgatctgcttattactgacgttaatatgccgaatatggatggttttgagttgactcgcaaactccgtgagcaaaattcttccttacccatctgggggcttacagccaacgcacaggctaacgaacgtgaaaaagggttaaattgcggcatgaacttatgtttgttcaaaccgttgactctggatgtactgaaaacacatttaagtcagttacaccaggttgcgcatattgcacctcagtatcgccaccttgatatcgaggccctgaagaataatacggcgaatgatctacaactgatgcaggagattctcatgactttccagcatgaaacgcataaagatctacccgctgcgtttcatgcactagaagctggcgataacagaactttccatcagtgtattcatcgcatccacggtgcggctaacatcctgaatttgcaaaagttgattaatattagccaccagttagaaataacacctgtttcagatgacagtaagcctgaaattcttcagttgctgaactctgtaaaagaacacattgcagagctggaccaggagattactgttttctgtcagcaaaatgactaa

SEQ ID NO: 5800 - protein, 1197 aa, Escherichia coli
MKFLPYIFLLCCGLWSTISFADGDYIEYRGISSNNRVTLDPLRLSNKELRWLASKKNLVIAVHKSQTATLLHTDSQQRIRGINADYLNLLKRALNIKLTLREYADHQKAMDALEDGEVDIVLSHLVASPPLNDDIAATNPLIITFPALVTTLHDSMRPLTSSKPVNIARVANYPPDEVIHQSFPKATIISFTNLYQALASVSAGQNDYFIGSNIITSSMISRYFTHSLNVVKYYNSPRQYNFLLTRKDSIVLNEVLNRFVDALTNEVRYEVSQNWLDTGNLAFLNKPLELTEHEKQWIKQHPDLKVLENPYSPPYSMTDETGSVRGVMGDILNIITLQTGLNFSPITVSHNIHAGTQLNPGGWDILPAAIYSEDRENNVSFAEVFITTPYVFVMQKAPDSEQTLKKGMKVAIPYYYELHSQLKEMYPEVEWIKVDNASAAFHKVKEGELDALVATQLNSRYMIDHYYPNELYHFLIPGVQNASLSFAFPRGEPELKDIINKALNAIPPSEVLRLTEKWIKMPNVTIDTWDLYSEQFYIVTTLSVLLVGSSLLWGFYLLRSVRRRKVIQGDLENQISFRKALSDSLPNPTYVVNWQGNVISHNSAFEHYFTDDYYKNAMLPLENSESPFKDVFSNTHEVTAETKENRTIYTQVFEIDNGIEKRCINHWHTLCNLPASEHAVYICGWQDITETRDLIHALEVERNKAINATVAKSQFLATMSHEIRTPISSIMGFLELLSGSGLSKEQRVEAISLAYATGQSLLGLIGEILDVDKIESGNYQLQPQWVDIPTLVQNTCHSFAAIAASKSIALSCSSTLPERYLVKIDPQAFKQVLSNLLSNALKFTTEGAVKITTSLGHIDDNHAVIKMTIMDSGSGLSQEEQQQLFKRYSQTSAGRQQTGSGLGLMICKELIKNMQGDLSLESHPGIGTIFTITIPVEITQQVAAVEAKAEQPITLPEKLSILIADDHPTNRLLLKRQLNLLGYDVDEATDGVQALHKVSMQHYDLLITDVNMPNMDGFELTRKLREQNSSLPIWGLTANAQANEREKGLNCGMNLCLFKPLTLDVLKTHLSQLHQVAHIAPQYRHLDIEALKNNTANDLQLMQEILMTFQHETHKDLPAAFHALEAGDNRTFHQCIHRIHGAANILNLQKLINISHQLEITPVSDDSKPEILQLLNSVKEHIAELDQEITVFCQQND

SEQ ID NO: 5801 - DNA, 1185 bp, Escherichia coli
gtgtcttttcaccttcggcttttttcaaggcataagcaaatgacaaataatgaatgcaaagggccgtttgaaggcttattagttatcgatatgacgcatgtccttaatgggcctttcggaactcaacttctttgtaatatgggtgcaagggtaattaaagttgagccgccgggtcatggtgatgatacccgcacatttggtccctatgtggatggacagtcactctattacagttttattaattatggcaaagagagtgtggttcttgatttaaagaatgatcacgataaaagtatatttataaatatgcttaaacaagcggatgtattagctgagaattttcgcccaggtacaatggaaaaactggggttttcatgggaaacgctacaagaaatcaacccgcgccttatatatgcttcatcgtcaggtttcggacataccggtccgctaaaagatgctcctgcctacgataccatcattcaggcaatgagcgggataatgatggaaacaggataccctgatgctccgccagtgcgcgttggtacctctcttgcggatctctgtggcggtgtttatttattcagtggaatagtgagtgcactttatggccgcgaaaagagccagagaggggcgcatgtcgatatagcgatgtttgatgccactctgagttttctggagcatggactgatggcatatatcgcgactgggaagtcaccacaacgcctgggaaatcgccatccctacatggcaccttttgatgttttcgatactcaggataagccgattacgatttgttgtggtaatgacaagcttttttctgtgttatgccaggcactggagcttacagaactggttaatgatccccgatttagcagcaatattttacgcgtacaaaaccaggctattcttaaacaatatattgagcggacgttaaaaacgcaggcagctgaagtttggttagccagaatacatgaagttggtgtgcccgtcgcgccgttattaagtgtggctgaggccattaatttaccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataa

SEQ ID NO: 5802 - protein, 394 aa, Escherichia coli
MSFHLRLFSRHKQMTNNECKGPFEGLLVIDMTHVLNGPFGTQLLCNMGARVIKVEPPGHGDDTRTFGPYVDGQSLYYSFINYGKESVVLDLKNDHDKSIFINMLKQADVLAENFRPGTMEKLGFSWETLQEINPRLIYASSSGFGHTGPLKDAPAYDTIIQAMSGIMMETGYPDAPPVRVGTSLADLCGGVYLFSGIVSALYGREKSQRGAHVDIAMFDATLSFLEHGLMAYIATGKSPQRLGNRHPYMAPFDVFDTQDKPITICCGNDKLFSVLCQALELTELVNDPRFSSNILRVQNQAILKQYIERTLKTQAAEVWLARIHEVGVPVAPLLSVAEAINLPQTQARNMLIEAGGIMMPGNPIKISGCADPHVMPGAATLDQHGEQIRQEFSS

SEQ ID NO: 5803 - DNA, 945 bp, Escherichia coli
atgctaacattttttattggcgatttattgcctattatcgtaatcatgctgttgggttattttagcggcagacgagaaactttttcagaagatcaagctcgggcatttaataaactggtattaaactacgctcttcctgcggccctatttgtttctattacccgggcaaacagggaaatgatttttgcggacactcgcctgacccttgtatcacttgtggttattgtcggatgtttctttttctcctggtttggttgctacaaattttttaaacgtacccatgcagaagcagcagtatgtgcattaattgcaggctcacctaccatcggattcctggggtttgcagttctcgaccctatttatggtgattccgtatcaacaggtttagtggtagcaattatttctattattgttaacgcaattactattcctattggtctgtatttgctgaatccttcctcaggagcggatggtaagaagaatagtaatctgagcgcattaatttctgcggcaaaggagccagtagtatgggcacctgttctggcaacgatcctggtgctggttggggtaaaaattccggcagcatgggacccaacctttaatctgattgcgaaggctaactcaggggtagcggtattcgctgcggggttgactctggctgcacataaattcgagttcagtgccgaaattgcttataacactttcctgaagctgattctgatgccactggcgctgcttctcgtaggtatggcatgtcatttgaatagcgaacatttgcagatgatggtactggcaggcgcattaccgccggcattctccggaatcattattgccagccggtttaatgtctacacccgcactggtacagcgtcattggctgtgagcgtactgggttttgtcgtcacggctcctttgtggatttatgtcagtcgactggtttcataa

SEQ ID NO: 5804 - protein, 314 aa, Escherichia coli
MLTFFIGDLLPIIVIMLLGYFSGRRETFSEDQARAFNKLVLNYALPAALFVSITRANREMIFADTRLTLVSLVVIVGCFFFSWFGCYKFFKRTHAEAAVCALIAGSPTIGFLGFAVLDPIYGDSVSTGLVVAIISIIVNAITIPIGLYLLNPSSGADGKKNSNLSALISAAKEPVVWAPVLATILVLVGVKIPAAWDPTFNLIAKANSGVAVFAAGLTLAAHKFEFSAEIAYNTFLKLILMPLALLLVGMACHLNSEHLQMMVLAGALPPAFSGIIIASRFNVYTRTGTASLAVSVLGFVVTAPLWIYVSRLVS

SEQ ID NO: 5805 - DNA, 1695 bp, Escherichia coli
atgtcagatcaacttcaaatgacagatggtatgcatatcatcgttgaagcattaaaacagaataatattgacactatttatggtgttgtaggtattcctgtgacggatatggcgcgccatgcccaggcggaaggcattcgttatattggttttcgtcatgagcagtcggcaggctatgccgctgcagcaagcggttttcttacccaaaaaccagggatctgcctgacagtgtctgcgccaggattcctcaacggtttgaccgcattggccaatgcaacggtaaatggttttccgatgatcatgattagcggctccagcgaccgcgcgatcgtcgatctccagcaaggtgattatgaagagctggaccaaatgaatgcggcaaaaccgtatgccaaagcagcatttcgcgttaatcagccgcaggatcttggcattgcattggcacgcgctatccgggtctcagtatcgggtcgtcctggcggtgtttatcttgatttgccagcaaatgtcctggccgcgacgatggaaaaagacgaagcgttaaccacgattgttaaagttgaaaatccgtcgccagcattattgccatgcccgaagtcagtcactagcgcaatttcgcttttagcaaaagctgaacgaccattaattatccttggcaaaggcgcggcgtattcacaatctgatgaacagcttcgtgaatttattgaaagtgcccagattccattcctgccaatgtctatggcgaaagggatcctcgaagatacgcatccactttctgcggcagctgcgcgttcgtttgccctggcaaatgctgacgttgtcatgcttgttggtgcacgactgaattggttactggcacacggtaaaaaaggatgggcggcagatacacagtttattcaactggatattgaaccgcaggaaattgacagcaaccgccccattgctgtgccagtcgttggcgatattgcatccagtatgcaaggtatgctggcagaattgaaacaaaacacatttacgactccactggtgtggcgcgatattttaaatatccacaagcagcaaaatgcacaaaaaatgcatgaaaagttaagtacagatacccaaccattaaattactttaatgcattgagtgccgtgcgcgatgttttgcgcgagaaccaggatatttatttagttaatgaaggggcaaataccctggataatgcacgaaatattattgatatgtataaaccacgtcgtcgtctggattgtggcacctggggtgtcatgggcatcggtatgggctatgccatcggtgctagcgtgacctctggttctccggttgtcgctattgaaggtgatagtgcttttggtttcagtgggatggagattgaaacgatttgtcgatataacctgccggtgacgatcgttatttttaataatggcggcatctacagaggagacggtgttgatctcagcggcgctggtgcaccatcgccaacggatctgttgcaccatgcaaggtatgacaaattaatggatgcgtttcgtggccttggctataacgtcaccacgacagatgaacttcgtcatgctttaaccaccggaattcagtcgcgcaaaccgaccattattaatgtggtcatcgacccagcagcaggaactgaaagtggccatattaccaaacttaacccaaaacaagtcgctggtaattaa

SEQ ID NO: 5806 - protein, 564 aa, Escherichia coli
MSDQLQMTDGMHIIVEALKQNNIDTIYGVVGIPVTDMARHAQAEGIRYIGFRHEQSAGYAAAASGFLTQKPGICLTVSAPGFLNGLTALANATVNGFPMIMISGSSDRAIVDLQQGDYEELDQMNAAKPYAKAAFRVNQPQDLGIALARAIRVSVSGRPGGVYLDLPANVLAATMEKDEALTTIVKVENPSPALLPCPKSVTSAISLLAKAERPLIILGKGAAYSQSDEQLREFIESAQIPFLPMSMAKGILEDTHPLSAAAARSFALANADVVMLVGARLNWLLAHGKKGWAADTQFIQLDIEPQEIDSNRPIAVPVVGDIASSMQGMLAELKQNTFTTPLVWRDILNIHKQQNAQKMHEKLSTDTQPLNYFNALSAVRDVLRENQDIYLVNEGANTLDNARNIIDMYKPRRRLDCGTWGVMGIGMGYAIGASVTSGSPVVAIEGDSAFGFSGMEIETICRYNLPVTIVIFNNGGIYRGDGVDLSGAGAPSPTDLLHHARYDKLMDAFRGLGYNVTTTDELRHALTTGIQSRKPTIINVVIDPAAGTESGHITKLNPKQVAGN

SEQ ID NO: 5807 - DNA, 1251 bp, Escherichia coli
atgtcaactccacttcaaggaattaaagttctcgatttcaccggtgtgcaatctggcccatcttgtactcaaatgctggcctggtttggcgctgacgtcattaaaattgaacgtcccggcgttggtgacgtaacgcgccaccagctgcgagatattcctgatatcgatgcgctttacttcaccatgcttaacagtaacaaacgttctattgaattaaataccaaaacagcggaaggcaaagaggtaatggaaaagctgatccgcgaagctgatatcttagtcgagaactttcatccaggggccattgatcatatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatctactacaggtttttgggacggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtgttgaacctttgccgcgtgaaattacgcgaccagcagcgtctcgataaattgggttatctggaagaatacccgcagtatccgaatggcacatttggtgatgcagttccccgcggtggtaatgcgggtgggggcggtcagcctggctggatcctgaaatgtaaaggctgggaaaccgatcctaacgcctatatttatttcactattcaggagcaaaattgggaaaacacctgtaaagccatcggcaaaccagaatggattaccgatccggcatacagtacagcccatgcccgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgtcgaagtggaacaaccgttgcgtggaaaatatctgacagttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctga

SEQ ID NO: 5808 - protein, 416 aa, Escherichia coli
MSTPLQGIKVLDFTGVQSGPSCTQMLAWFGADVIKIERPGVGDVTRHQLRDIPDIDALYFTMLNSNKRSIELNTKTAEGKEVMEKLIREADILVENFHPGAIDHMGFTWEHIQEINPRLIFGSIKGFDECSPYVNVKAYENVAQAAGGAASTTGFWDGPPLVSAAALGDSNTGMHLLIGLLAALLHREKTGRGQRVTMSMQDAVLNLCRVKLRDQQRLDKLGYLEEYPQYPNGTFGDAVPRGGNAGGGGQPGWILKCKGWETDPNAYIYFTIQEQNWENTCKAIGKPEWITDPAYSTAHARQPHIFDIFAEIEKYTVTIDKHEAVAYLTQFDIPCAPVLSMKEISLDPSLRQSGSVVEVEQPLRGKYLTVGCPMKFSAFTPDIKAAPLLGEHTAAVLQELGYSDDEIAAMKQNHAI

SEQ ID NO: 5809 - DNA, 636 bp, Escherichia coli
atgaaacgtttaattatggctacgatggtcacagcaattctggcatcttcaactgtatgggctgctgataatgcaccggtagcggcacaacagcaaactcagcaagttcagcaaacccagaaaacggcagcggcagcagagcgtatctctgaacaaggtttatatgcgatgcgtgacgtgcaggtagcgcgcctggctctgtttcatggcgatccggaaaaggcaaaagaactgaccaatgaagcttccgctttgctgtcagatgatagtaccgaatgggcaaagttcgctaagccaggtaaaaagaccaacgtcaatgatgaccaatatattgtcattaatgcatctgtcggaatttctgagagttatgtagcaacccccgaaaaagaagccgcgataaaaattgccaacgaaaaaatggcgaaaggggataaaaagggtgcaatggaagagcttcgcctggccggtgttggtgtaatggaaaaccaatatttgatgccgcttaaacagactcgtaatgcacttgctgatgcgcagaaactgcttgataaaaagcaatactacgaggcaaacctggcgcttaaaggtgcggaagatggaatcatcgttgatagcgaagcactgtttgtgaactaa

SEQ ID NO: 5810 - protein, 211 aa, Escherichia coli
MKRLIMATMVTAILASSTVWAADNAPVAAQQQTQQVQQTQKTAAAAERISEQGLYAMRDVQVARLALFHGDPEKAKELTNEASALLSDDSTEWAKFAKPGKKTNVNDDQYIVINASVGISESYVATPEKEAAIKIANEKMAKGDKKGAMEELRLAGVGVMENQYLMPLKQTRNALADAQKLLDKKQYYEANLALKGAEDGIIVDSEALFVN

SEQ ID NO: 5811 - DNA, 243 bp, Escherichia coli
atgatttatttatggatgtttctcgccctgtgtattgtctgcgtaagcggatacatcggtcaggtactgaacatgatatcggcggtctcttctttcttcggcatggtgatcctcgctgcactcatttactacttcaccatgtggttaactggcggtaatgaactagtgacggggatatttatgtttcttgccccggcttgtggcttgatgattcgctttatggtggggtatggcaggcgatag

SEQ ID NO: 5812 - protein, 80 aa, Escherichia coli
MIYLWMFLALCIVCVSGYIGQVLNMISAVSSFFGMVILAALIYYFTMWLTGGNELVTGIFMFLAPACGLMIRFMVGYGRR

SEQ ID NO: 5813 - DNA, 921 bp, Escherichia coli
atgtttccaaaatgcaaattttcccgcgagtttctgcatcctcgctactggctcacgtggtttgggcttggtgtactctggctttgggtacagcttccttatcctgttctctgctttctcggcacgcgtatcggcacaatggcgcgaccattcctgaaacgtcgtgaatctatcgcccgtaaaaacctggaactttgtttcccgcagcattctgcgaaagagcgcgagaagatgattgccgaaaactttcgttcactcggcatggcgctggtagaaaccggcatggcgtggttctggcccgacagtcgcgtacgtaaatggtttgatgtggaagggctggataaccttaaacgcgcacaaatgcaaaatcgcggcgtaatggttgtcggcgtccattttatgtcgctggaactgggcggtcgggtgatgggactttgccaaccaatgatggccacctatcgcccgcataataatcagctgatggaatgggtgcagacccgtggtcgcatgcgctctaacaaagcgatgatcggcagaaataatctgcgcggtattgtcagtgcactgaagaaaggtgaagcggtatggtttgctcccgatcaggattatggtcgtaaaggcagctccttcgcgccgttctttgcggtggaaaatgtcgccacaaccaatggcacctatgtcctctctcgtctctctggcgcagccatgttgaccgtaacgatggtaagaaaagcggattacagcggatatcgtttgtacatcaccccagagatggaaggctacccgacagatgaaaatcaagccgctgcctatatgaacaagattatcgagaaagagatcatgcgcgcaccggagcagtacctctggatccaccgtcgctttaaaacgcgcccggtgggtgaatcgtcgttatacatttaa

SEQ ID NO: 5814 - protein, 306 aa, Escherichia coli
MFPKCKFSREFLHPRYWLTWFGLGVLWLWVQLPYPVLCFLGTRIGTMARPFLKRRESIARKNLELCFPQHSAKEREKMIAENFRSLGMALVETGMAWFWPDSRVRKWFDVEGLDNLKRAQMQNRGVMVVGVHFMSLELGGRVMGLCQPMMATYRPHNNQLMEWVQTRGRMRSNKAMIGRNNLRGIVSALKKGEAVWFAPDQDYGRKGSSFAPFFAVENVATTNGTYVLSRLSGAAMLTVTMVRKADYSGYRLYITPEMEGYPTDENQAAAYMNKIIEKEIMRAPEQYLWIHRRFKTRPVGESSLYI

SEQ ID NO: 5815 - DNA, 1239 bp, Escherichia coli
atggctgacactcgccctgaacgtcgctttacgcgtattgatcgtctcccgccctacgtttttaacattaccgctgaactgaaaatggctgcgcgtcggcgcggcgaagatattatcgatttcagtatgggtaacccggacggtgcgactccgccgcatatcgtcgaaaaattatgtacggtggcccagcgcccggacacgcatggttactccacttcacgcggcattccgcggttacgtcgcgccatttcccgctggtatcaggatcgctacgacgttgaaatcgacccggaatcagaagccatcgtcactattggttcgaaagagggcctggcgcatctgatgctggcgacactggatcacggtgacacagtgctggtgccgaatccaagttaccccattcatatttacggcgcggtgattgccggggcgcaggtacgctcagtgccgctggtggaaggtgtcgatttcttcaacgaactggaacgcgccattcgcgaaagttatccgaaaccgaagatgatgatcctcggcttcccgtcgaacccaaccgcgcaatgcgtggagctggagttcttcgaaaaggttgtggcgctggcgaaacgctacgatgtgctggtggtccacgacctggcctatgcggacatcgtctacgatggctggaaagcgccgtcaatcatgcaggtgccaggtgcacgcgacgtggcggtcgagttctttacgctgtcgaaaagctacaacatggcgggctggcgtatcggctttatggtcggtaacaaaacgctggtcagcgcgttggcacgtattaaaagctatcacgattacggcacctttacgccgttgcaggtggcggctattgcggcgctggagggcgatcaacagtgcgtgcgcgatattgccgaacagtacaaacgccgccgtgatgtgctggtgaaagggctgcatgaagcgggctggatggtcgaaatgccgaaggcttcgatgtatgtctgggcgaaaatcccggaaccgtatgctgccatgggctcgctggaatttgccaagaaattgcttaacgaagcgaaggtctgtgtctctccagggattggctttggcgactacggcgatacgcatgtgcgctttgcactgattgaaaaccgcgaccgtattcgtcaggcgattcgtgggattaaagcgatgttccgtgccgacggtttactacctgccagcagcaaacatattcacgaaaacgcggaataa

SEQ ID NO: 5816 - protein, 412 aa, Escherichia coli
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 5817 - DNA, 1698 bp, Escherichia coli
gtgcacgaaatattcaacatgctgctggcggtcttcgatcgggccgcgttaatgcttatctgcctgttttttctcatccgtatccgcctgtttcgcgaactgttgcacaagtcggcacactcaccgaaagagctgctcgccgttaccgccattttctcgctgttcgccctgttcagcacctggtccggcgttcccgtagaaggctcgctggtgaacgtacgtattatcgcggtgatgtcaggcggaattctgtttggcccgtgggtgggcatcattaccggcgtgattgcgggtattcaccgttatttaattgacatcggcggcgtaacggcgatcccctgctttatcaccagcattctggcgggttgtatatcgggctggatcaacctgaaaatccccaaagcacagcgctggcgcgtcggtattctcggcggcatgttgtgtgaaacgttgaccatgattctggtgattgtctgggcaccaactaccgcattggggatcgatatcgtctctaaaatcgggattccaatgatcctcggtagcgtctgtatcggctttattgtgctgctggtgcaaagcgttgagggcgaaaaagaggccagcgccgcgcggcaggccaagctggcgctggatatcgccaacaaaacgctaccgctgtttcgccatgtcaatagcgagtcattacgcaaagtttgtgaaattattcgcgatgatattcacgccgatgcggtggcgatgactaatactgatcatgtgctggcctatgtcggcgtgggtgaacacaactatcagaatggcgatgacttcattagcccgactacccgacaggcgatgaattacggaaaaatcatcattaaaaacaatgatgaagcccaccgcacaccagagattcattccatgctggtgatcccattgtgggagaaaggcgttgtgaccggaacgctgaaaatttactactgccacgcgcatcagataacctcgtcattacaggaaatggcggtcggtctgtcacaaatcatctccacgcaactggaggtttcgcgcgctgagcagctgcgtgaaatggcaaataaggcagagcttcgcgccctgcaaagcaaaattaatccccattttctgtttaacgctttgaacgctatttcatcgtcaatccgtctgaatccggatactgctcgccagctgatctttaatttgtcgcgctatctgcgctataacattgaattaaaagacgatgagcaaatcgatatcaaaaaagagctgtatcaaattaaagactatattgccattgagcaggcccgctttggcgacaagctgacggttatctatgatattgatgaagaggtgaattgctgcattcccagcctgctgatccagccgttggtggaaaacgccattgtccacggtatccagccttgcaaaggtaaaggcgttgtcaccatcagcgttgcagagtgcggtaatcgggtacgcattgcggtgcgagataccgggcacggcatcgatccaaaggtgattgagcgggtcgaagcgaacgaaatgccgggcaataaaattggcctgctgaatgtccatcatcgcgtgaagttattgtatggcgaggggctgcatatccgccgcctggaaccaggaacggaaattgcgttttacattcctaaccaacgcaccccagtcgcctcacaggctaccttattgctttga

SEQ ID NO: 5818 - protein, 565 aa, Escherichia coli
MHEIFNMLLAVFDRAALMLICLFFLIRIRLFRELLHKSAHSPKELLAVTAIFSLFALFSTWSGVPVEGSLVNVRIIAVMSGGILFGPWVGIITGVIAGIHRYLIDIGGVTAIPCFITSILAGCISGWINLKIPKAQRWRVGILGGMLCETLTMILVIVWAPTTALGIDIVSKIGIPMILGSVCIGFIVLLVQSVEGEKEASAARQAKLALDIANKTLPLFRHVNSESLRKVCEIIRDDIHADAVAMTNTDHVLAYVGVGEHNYQNGDDFISPTTRQAMNYGKIIIKNNDEAHRTPEIHSMLVIPLWEKGVVTGTLKIYYCHAHQITSSLQEMAVGLSQIISTQLEVSRAEQLREMANKAELRALQSKINPHFLFNALNAISSSIRLNPDTARQLIFNLSRYLRYNIELKDDEQIDIKKELYQIKDYIAIEQARFGDKLTVIYDIDEEVNCCIPSLLIQPLVENAIVHGIQPCKGKGVVTISVAECGNRVRIAVRDTGHGIDPKVIERVEANEMPGNKIGLLNVHHRVKLLYGEGLHIRRLEPGTEIAFYIPNQRTPVASQATLLL

SEQ ID NO: 5819 - DNA, 738 bp, Escherichia coli
gtgaaagtcatcattgttgaagacgaattcctggcacaacaggaactgagctggctaattaaagagcacagccagatggagattgtcggcacctttgacgacggtctggacgtgttgaagtttttgcagcataaccgcgtcgacgccatttttctggatatcaatattccgtcgctggacggtgtgttgctggcgcaaaacatcagccagttcgcccataaaccgtttattgtattcatcaccgcgtggaaagaacatgcggtggaagcatttgaactggaagcgtttgactacattctcaaaccgtatcaggagtcacgcattaccgggatgctgcaaaaactggaagcagcctggcaacaacagcagaccagcagtacgacacctgccgcgacggtaacgcgtgagaatgacaccattaatctggtgaaagatgagcgaatcatcgtcacgccaattaacgatatctattacgccgaagcgcacgagaaaatgacctttgtctatacgcggcgtgaatcctacgtaatgccgatgaacattaccgagttttgcagcaagctgccgccgtcgcattttttccgctgccatcgctcattttgtgtcaatctgaacaaaatacgcgaaatcgaaccgtggtttaataacacctacattctgcggctgaaagatctggattttgaagtgccggtcagccgtagcaaagttaaagaattccgccagttaatgcatctgtaa

SEQ ID NO: 5820 - protein, 245 aa, Escherichia coli
MKVIIVEDEFLAQQELSWLIKEHSQMEIVGTFDDGLDVLKFLQHNRVDAIFLDINIPSLDGVLLAQNISQFAHKPFIVFITAWKEHAVEAFELEAFDYILKPYQESRITGMLQKLEAAWQQQQTSSTTPAATVTRENDTINLVKDERIIVTPINDIYYAEAHEKMTFVYTRRESYVMPMNITEFCSKLPPSHFFRCHRSFCVNLNKIREIEPWFNNTYILRLKDLDFEVPVSRSKVKEFRQLMHL

SEQ ID NO: 5821 - DNA, 858 bp, Escherichia coli
atgaaagcaccaggcttgcccgccgatcaacaatttttcgccgatctgttcagcggcctggtgcttaacccgcaactccttgggcgcgtctggtttgccagccaccccgcctcattgccagtgggcagtttatgtattgattttccccgtctggatatcgtgctacgcggcgaatacggcaatctgctggaagcaaagcagcaacgtatggtggaaggagaaatgctgtttattccggcacgcgcggctaatttaccggtcaacaacaaaccggtgatgctgttaagcctggtgttcgcaccgacctggcttggcttatcattttacgatagccgcaccacgtcgttgttacatcctgctcgccagatccaacttcccagcctgcaacgcggcgaaggtgaagcgatgcttaccgccctcacccatcttagccgttcgccgctggagcagaatatcattcagccactggtgttaagtttgctgcatctttgccgtaacgtggtgaatatgccgccgggcaattcgcagccgcgcggcgattttctctatcacagcatttgtaactgggttcaggataattatgcccagccgctcacccgcgagagcgtggctcagttttttaatatcacgcccaatcatctgtcaaaactgtttgctcagcatggaacaatgcgttttatcgagtatgttcgctgggtacgaatggcaaaggcaaggatgattttgcagaaatatcatctgtcgattcatgatgtggcacagcgttgcggttttccggacagcgactatttttgtcgcgttttccggcgtcagtttggcctgacgccgggagagtacagcgcccgttttcagggctaa

SEQ ID NO: 5822 - protein, 285 aa, Escherichia coli
MKAPGLPADQQFFADLFSGLVLNPQLLGRVWFASHPASLPVGSLCIDFPRLDIVLRGEYGNLLEAKQQRMVEGEMLFIPARAANLPVNNKPVMLLSLVFAPTWLGLSFYDSRTTSLLHPARQIQLPSLQRGEGEAMLTALTHLSRSPLEQNIIQPLVLSLLHLCRNVVNMPPGNSQPRGDFLYHSICNWVQDNYAQPLTRESVAQFFNITPNHLSKLFAQHGTMRFIEYVRWVRMAKARMILQKYHLSIHDVAQRCGFPDSDYFCRVFRRQFGLTPGEYSARFQG

SEQ ID NO: 5823 - DNA, 2496 bp, Escherichia coli
atgttaacgattcaatttctctgtcctttgcctaacggtctacatgctcgtccggcgtgggaacttaaagagcagtgcagccagtggcaaagcgaaatcacttttattaaccatcgccagaacgcaaaggccgatgcgaaaagctcgctggcgctgattggcactggcactttatttaatgacagttgcagcctgaacattagcggtagcgatgaagagcaggcgcggcgagtgctggaagagtatatccaggtgcgctttatcgacagcgatagcgtccagccgacgctggcagaactgacggcgcatccgctgccgagttcattaagccgcctgaacccggatttactgtacggcaacgtgctggcaagcggcgttggcgtgggtacactgaccctgttacagagcgacagcctcgacagttatcgggtgatccctgcgagtgcgcaagattccaccctactggagcacagtctggcaacgcttgccgagcaactgaaccagcaattgcgtgagcgtgacggcgaaagcaaaactatcctcagcgcccatttgtcgctgattcaggatgatgaatttgcaggcaatatccgtcacctgatggcagaacagcatcaggggctgggggcggcgatcatcagcaatatggagcagatttgtgccaaactttctgcttctgccagcgattatctgcgcgagcgggtcagcgacattcgcgatatcagcgaacagttgctgcatatcacctggccggaactaaaaccgcgcaataatctggtgcttgaaaaaccgaccattctggtggctgaagatttaaccccaagccagtttttgagcctcgatttaaaaaatcttgcgggcatgattctggagaaaaccgggcgcacctcgcataccctgattctggcccgcgcttcggcgatcccggtactgagcggcctgccgctggatgcgattgcccgttatgccgggcaacctgcagtgcttgatgcccagtgcggcgtactggcaattaatcccaacgatgcggtgagcggttattaccaggtggcgcagacgctggcggataaacgccaaaaacaacaggcgcaagctgccgcgcagctggcctattcccgtgataaaaagcgtattgatattgcggcgaatattggcacagctctggaagccccaggcgcgtttgccaacggcgcggaaggcgttgggctgtttcgtaccgaaatgctctatatggatcgcgacagcgcgccggacgagcaggaacagtttgaagcgtaccagcaggtgctactggcggcgggcgacaagccgattatcttccgcatgatggacatcggtggcgataaaagcattccttacctcaacattccccaggaagagaacccgttcctcggctatcgcgcggtacgtatttacccggaatttgctggcctgttccgtactcaattgcgggcgattttgcgcgctgccagtttcggcaacgcccagttgatgatcccaatggtccacagtctcgatcagatcttatgggtgaagggtgagatccaaaaagcgatcgttgagcttaagcgcgatggcctgcgtcatgcagagacgattacgctgggtatcatggtggaagtgccgtcggtgtgctacatcatcgaccacttctgcgatgaggtcgatttcttcagtatcggctccaacgatatgacccagtatctgtatgcggtcgatcgtaataacccgcgcgtatcgccgctgtataacccgattacgccatcgttcctgcgcatgttgcagcagattgttaccgctgcgcatcagcgcggcaaatgggtaggtatttgcggtgaactgggcggtgaaagtcgttatctgccgctactgctagggctgggcctggatgagctaagcatgagtagcccgcgtattccggcagtgaaaagccagcttcgtcaactggatagcgaggcgtgtcgggaactggcgcgtcaggcgtgcgagtgccgcagcgcgcaggaaattgaagcgttacttaccgcgtttgcgccggaagaagacgttcgcccactgctggcactagagaatatctttgttgatcagtcctttagtaataaagagcaggcgatccagttcctgtgcggtaacctcggtgttaacgggcgtactgaacatccgttcgagctggaagaagatgtctggcagcgggaagagattgttactactggcgttggttttggcgtggcgatcccgcacaccaaatcacagtggatccgtcattccagtatcagcattgcccggttggtgaaaccggttgactggcagtcagaaatgggcgaagtcgaactggtgatcatgctgacgctgggcgctaacgaagggatgaatcatgtgaaagtcttctcgcagctggcgcgcaaactggtgaataaaaacttccgccagtcgttgtttgccgcgcaagatgcgcaaagcatcctgacgctgctggaaacggaattaaccttctga

SEQ ID NO: 5824 - protein, 831 aa, Escherichia coli
MLTIQFLCPLPNGLHARPAWELKEQCSQWQSEITFINHRQNAKADAKSSLALIGTGTLFNDSCSLNISGSDEEQARRVLEEYIQVRFIDSDSVQPTLAELTAHPLPSSLSRLNPDLLYGNVLASGVGVGTLTLLQSDSLDSYRVIPASAQDSTLLEHSLATLAEQLNQQLRERDGESKTILSAHLSLIQDDEFAGNIRHLMAEQHQGLGAAIISNMEQICAKLSASASDYLRERVSDIRDISEQLLHITWPELKPRNNLVLEKPTILVAEDLTPSQFLSLDLKNLAGMILEKTGRTSHTLILARASAIPVLSGLPLDAIARYAGQPAVLDAQCGVLAINPNDAVSGYYQVAQTLADKRQKQQAQAAAQLAYSRDKKRIDIAANIGTALEAPGAFANGAEGVGLFRTEMLYMDRDSAPDEQEQFEAYQQVLLAAGDKPIIFRMMDIGGDKSIPYLNIPQEENPFLGYRAVRIYPEFAGLFRTQLRAILRAASFGNAQLMIPMVHSLDQILWVKGEIQKAIVELKRDGLRHAETITLGIMVEVPSVCYIIDHFCDEVDFFSIGSNDMTQYLYAVDRNNPRVSPLYNPITPSFLRMLQQIVTAAHQRGKWVGICGELGGESRYLPLLLGLGLDELSMSSPRIPAVKSQLRQLDSEACRELARQACECRSAQEIEALLTAFAPEEDVRPLLALENIFVDQSFSNKEQAIQFLCGNLGVNGRTEHPFELEEDVWQREEIVTTGVGFGVAIPHTKSQWIRHSSISIARLVKPVDWQSEMGEVELVIMLTLGANEGMNHVKVFSQLARKLVNKNFRQSLFAAQDAQSILTLLETELTF

SEQ ID NO: 5825 - DNA, 1038 bp, Escherichia coli
atggatttatcgctattaaaagcgttgagcgaggcagatgcgatcgcctcctcggaacaggaagtgcggcagatcctgctggaagaagcggatcgcctgcaaaaagaagtgcgatttgatggtctgggatcggtgctgatccgactcaatgagtcgacaggtccgaaggtgatgatctgtgcgcatatggacgaagtgggatttatggtgcgcagcatctcccgcgaaggggcgatcgatgtgttgccggttggcaatgtacgcatggctgcccgccagcttcagtcggtgcgtatcactacccgtgaagagtgcaaaattccaggcctgcttgacggcgatcggcaggggaatgacgtcagcgccatgcgcgtggacattggcgcgcgctcctgtgacgaagtgatgcaggcaggaattcgtccaggcgatcgcgttaccttcgataccacttttcaggttctccctcaccagcgggtgatggggaaagcctttgatgaccgcctcggttgctatctgctggtgacgttactgcgtgagctgcacgacgccgaactgcctgcggaagtgtggctggtggcaagttccagcgaagaggtgggattacgcggcgggcaaactgccacccgcgcggtgtcgccggatgtcgccattgtgcttgataccgcctgctgggcgaaaaactttgattatggcgcagctaaccatcgccagattggtaacgggccgatgctggtgttaagcgacaagtcactgattgcgccgccaaaacttatcgcctggatcgaaaccgtggcggcagaaattggcgtaccgttgcagtcagatatgttcagcaatggcggcacggacggtggggcggtgcacttaaccggcactggcgtacccacagtggtgatggggccagcaacccgccacggacattgcgccgcatcgattgccgactgccgcgacattttgcagatgcagcaacttttatctgcccttattcaacgttttacgcgtgagacggttgttcaactgacggatttcagatga

SEQ ID NO: 5826 - protein, 345 aa, Escherichia coli
MDLSLLKALSEADAIASSEQEVRQILLEEADRLQKEVRFDGLGSVLIRLNESTGPKVMICAHMDEVGFMVRSISREGAIDVLPVGNVRMAARQLQSVRITTREECKIPGLLDGDRQGNDVSAMRVDIGARSCDEVMQAGIRPGDRVTFDTTFQVLPHQRVMGKAFDDRLGCYLLVTLLRELHDAELPAEVWLVASSSEEVGLRGGQTATRAVSPDVAIVLDTACWAKNFDYGAANHRQIGNGPMLVLSDKSLIAPPKLIAWIETVAAEIGVPLQSDMFSNGGTDGGAVHLTGTGVPTVVMGPATRHGHCAASIADCRDILQMQQLLSALIQRFTRETVVQLTDFR

SEQ ID NO: 5827 - DNA, 1086 bp, Escherichia coli
atgacattactcgcttcgctgcgtgactggcttaaggcacaacaactggatgcggtgcttctctcctcacggcagaacaaacagccgcatctggggatctccaccggatcaggttatgtggtgattagccgtgaaagtgcgcacattctggtggattcgcgctattacgcggatgtagaagcccgcacgcaaggttaccagctgcatttgctcgacgcgatgcacacgcttgccaccatcgtcagacaaatcattgccgatgagcagttgcaaacgctcggttttgaaggccagcaggtgagttgggaaaccgcgcaccgctggcagtccgaactcaatgcgaaactggtgagcgccacgccggatgtgctgcggcaaatcaaaacgccagaagaggtggagaaaatccgccttgcctgcgggattgccgatcgtggcgcagagcatattcgccgctttattcaggcgggaatgagcgaatgcgagatagccgctgaactggagtggtttatgcgccggcagggcgcagaaaaagcctcttttgacaccattgtcgccagcggctggcgtggggcgctgccgcacggcaaagccagcgacaagattgttacagcgggcgagtttgtcactctcgatttcggtgcgctctatcagggctactgctctgatatgacgcgcaccttgctggtgaatggcgaaggggtgagcgccgaatctcacccgctgtttaacgtctatcaaattgtcctgcaggcacagctcgcagcaatctccgcgattcgccccggcgtgcgctgccagcaggttgacgatgccgcgcgccgggtgattacagaagccggttatggcgactatttcggccataacaccggtcatgctatcggcattgaagtccatgaagatccgcgtttttcaccgcgggacaccacgacgctacagccaggtatgttactgaccgtggagccagggatttatttgccagggcaagggggcgtgcgcatcgaagatgttgtgctggttaccccgcaaggcgcagaggtgctctacgccatgccgaaaacagtgttgctcacgggagaggcataa

SEQ ID NO: 5828 - protein, 361 aa, Escherichia coli
MTLLASLRDWLKAQQLDAVLLSSRQNKQPHLGISTGSGYVVISRESAHILVDSRYYADVEARTQGYQLHLLDAMHTLATIVRQIIADEQLQTLGFEGQQVSWETAHRWQSELNAKLVSATPDVLRQIKTPEEVEKIRLACGIADRGAEHIRRFIQAGMSECEIAAELEWFMRRQGAEKASFDTIVASGWRGALPHGKASDKIVTAGEFVTLDFGALYQGYCSDMTRTLLVNGEGVSAESHPLFNVYQIVLQAQLAAISAIRPGVRCQQVDDAARRVITEAGYGDYFGHNTGHAIGIEVHEDPRFSPRDTTTLQPGMLLTVEPGIYLPGQGGVRIEDVVLVTPQGAEVLYAMPKTVLLTGEA

SEQ ID NO: 5829 - DNA, 1248 bp, Escherichia coli
atggccattaaaaaacgcagtgcaaccgttgtgcatggcgcatccggtgcggcagcggcagttaagaatccgcaggcctctaaatccagcttctggggtgaactcccgcagcatgtgatgtcagggatttcacgcatggtgccgaccttaattatgggcggtgtgatcctcgctttcagtcagctgattgcttatagctggcttaaaattcctgctgatatcggcatcatggatgctcttaatagcgggaaattctctggtttcgacctctccttacttaaatttgcctggctgtcgcaatccttcggcggcgtgttgtttggttttgccattccgatgtttgctgcttttgtggcgaactctatcggtggcaaactggcgttcccggctggttttatcggcggcttgatgtctacccagccgacgcaactgctgaacttcgatcccagcattatgcaatgggcgacctcttcgccggtgccgtccaccttcattggtgcgctgattatttctatcgttgccggttaccttgtgaaatggatgaaccagaaaatccagttaccggatttcctgttagcgttcaaaaccacatttttgctaccgattctttccgccatttttgtcatgctggcgatgtactacgtcatcaccccctttggtggctggatcaacggcggtatccgtaccgtgctgaccgctgcaggtgagaagggcgcgctgatgtacgcaatggggatcgccgcggcgacagcaatcgaccttggtggcccgatcaacaaagcggcaggtttcgttgccttcagctttaccactgaccacgtattaccggtcactgcacgttctatcgctatcgttattccgccgattggtctgggtctggcgaccattatcgatcgtcgcttaactggcaaacgcttgttcaacgcccagctttatccgcagggtaagaccgcgatgttccttgcctttatggggatcagtgagggtgcgattccgtttgcactggaaagccctatcaccgccattccgtcgtatatggttggcgcgattgtcggctcaaccgccgcagtctggctgggcgcagtgcaatggttcccggagtccgctatctgggcatggccgctggtcactaacctcggcgtctacatggcggggatcgcgctgggggcagtcataactgcgctgatggtggtgttcctgcgtctgatgatgttccgtaaaggcaaattgttaatcgatagcctgtaa

SEQ ID NO: 5830 - protein, 415 aa, Escherichia coli
MAIKKRSATVVHGASGAAAAVKNPQASKSSFWGELPQHVMSGISRMVPTLIMGGVILAFSQLIAYSWLKIPADIGIMDALNSGKFSGFDLSLLKFAWLSQSFGGVLFGFAIPMFAAFVANSIGGKLAFPAGFIGGLMSTQPTQLLNFDPSIMQWATSSPVPSTFIGALIISIVAGYLVKWMNQKIQLPDFLLAFKTTFLLPILSAIFVMLAMYYVITPFGGWINGGIRTVLTAAGEKGALMYAMGIAAATAIDLGGPINKAAGFVAFSFTTDHVLPVTARSIAIVIPPIGLGLATIIDRRLTGKRLFNAQLYPQGKTAMFLAFMGISEGAIPFALESPITAIPSYMVGAIVGSTAAVWLGAVQWFPESAIWAWPLVTNLGVYMAGIALGAVITALMVVFLRLMMFRKGKLLIDSL

SEQ ID NO: 5831 - DNA, 378 bp, Escherichia coli
ttgcacgttcataattccactcgtcaactatcactgaacgaggaattaacgatgagtaagaaactgattgccttatgtgcctgcccaatgggcctggctcacacttttatggccgctcaggcgctggaagaagcggcggtagaagccggttatgaagtgaaaattgaaacccagggcgcggacggtatccagaatcgcctgacggcgcaggatatcgccgaagcgaccatcatcatccactccgtggcagttaccccggaagataacgaacgtttcgaatcacgcgacgtttatgaaatcactttgcaggacgcaattaaaaacgctgcgggaatcatcaaagaaatcgaagagatgattgcctctgaacaacagtaa

SEQ ID NO: 5832 - protein, 125 aa, Escherichia coli
MHVHNSTRQLSLNEELTMSKKLIALCACPMGLAHTFMAAQALEEAAVEAGYEVKIETQGADGIQNRLTAQDIAEATIIIHSVAVTPEDNERFESRDVYEITLQDAIKNAAGIIKEIEEMIASEQQ

SEQ ID NO: 5833 - DNA, 966 bp, Escherichia coli
atgacaaagtatgcattagtcggtgatgtgggcggcaccaacgcacgtcttgctctgtgtgatattgccagtggtgaaatctcgcaggctaagacctattcagggcttgattaccccagcctcgaagcggtcattcgcgtttatcttgaagaacataaggtcgaggtgaaagacggctgtattgccatcgcttgcccaattaccggtgactgggtggcaatgaccaaccatacctgggcgttctcaattgccgaaatgaaaaagaatctcggttttagccatctggaaattattaacgattttactgctgtatcgatggcgatcccgatgctgaaaaaagagcatctgattcagtttggtggcgcagaaccggtagaaggtaagcctattgcggtttacggtgccggaacagggcttggggttgcgcatctggtccatgtcgataagcgttgggtaagcttgccaggagaaggcggtcacgttgattttgcgccgaatagtgaagaagagggcattatcctcgaaatattgcgtgcggaaattggtcatgtttcggcggaacgcgtgctttctggccctggactggtgaatttgtatcgcgcaattgttaaagccgacaaccgcctgccagaaaatctcaagccaaaagatattaccgaacgcgcgctggctgacagctgcaccgattgccgccgcgcgttgtcgctgttttgcgtcattatgggccgttttggcggcaatctggcgctcaatctcgggacatttggcggcgtgtttattgcgggtggtatcgtgccgcgcttccttgagttcttcaaagcctctggtttccgcgccgcatttgaagataaagggcgctttaaagaatatgtccatgatattccggtgtatctcatcgtccatgacaatccgggccttctcggttccggtgcacatttacgccagaccttaggtcacattctctaa

SEQ ID NO: 5834 - protein, 321 aa, Escherichia coli
MTKYALVGDVGGTNARLALCDIASGEISQAKTYSGLDYPSLEAVIRVYLEEHKVEVKDGCIAIACPITGDWVAMTNHTWAFSIAEMKKNLGFSHLEIINDFTAVSMAIPMLKKEHLIQFGGAEPVEGKPIAVYGAGTGLGVAHLVHVDKRWVSLPGEGGHVDFAPNSEEEGIILEILRAEIGHVSAERVLSGPGLVNLYRAIVKADNRLPENLKPKDITERALADSCTDCRRALSLFCVIMGRFGGNLALNLGTFGGVFIAGGIVPRFLEFFKASGFRAAFEDKGRFKEYVHDIPVYLIVHDNPGLLGSGAHLRQTLGHIL

SEQ ID NO: 5835 - DNA, 1257 bp, Escherichia coli
atgctccatccgcgagccagaaccatgttgttattatcgctccccgccgtggcaattgggattgcgtccagtcttattctgattatggtgatgaaaatcgcctcggtattacagaatttgctctggcaacgactgccgggaactctggggatagcccaggattcacctctctggatcatcggtgtattaacgctaacgggtattgcggtggggttggttatccgtttcagccagggtcatgccggaccagaccccgcctgtgaaccgcttatcggcgcaccggttccgccctctgcgctaccaggacttatcgtagcattaattctcggtcttgctggcggcgtcagcctggggccggaacatccgatcatgaccgtcaatatcgcccttgccgtcgccattggcgctcgtctgttaccgcgcgtcaaccgaatggagtggactattttagcctctgccggaactatcggcgcgctgtttggcacacctgttgcggcggcattgatattttcgcaaaccttaaatggcagtaatgaagttccgctatgggatcgtctctttgcgccgttaatggcggcagcagctggtgcacttactaccggattatttttccatcctcatttttcactgcccattgcgcattacggacagatggaaatgaccgatattctcagcggtgcaattgtcgcggcgattgccatcgcagcagggatggtcgccgtatggtgcttaccacggttgcacgcgatgatgcatcaaatgaaaaatccggtgttcgtgctgggtattggcggacttattctcggtattctgggggttattggtggaccggtttcgctgtttaaagggctggatgagatgcagcagatggtggcaaatcaggctttcagcaccagcgattactttttgctggcggtgataaaacttgccgccctggtcgttgctgccgccagtggctttcgcggtgggcgaatcttcccggcagtgtttgtcggcgtggcattagggttgatgcttcatgagcacgttcccgccgttccagcggcaataaccgtttcctgcgctatactcggcatcgtgctggtggtaacacgcgatggctggttaagtctttttatggcggcagtcgttgtacccaataccacattgctaccgctgctctgtatcgtcatgctcccggcatggctgttattagcaggtaagccgatgatgatggtcaatcgtcagaagcaacagccaccccacgataacgtttag

SEQ ID NO: 5836 - protein, 418 aa, Escherichia coli
MLHPRARTMLLLSLPAVAIGIASSLILIMVMKIASVLQNLLWQRLPGTLGIAQDSPLWIIGVLTLTGIAVGLVIRFSQGHAGPDPACEPLIGAPVPPSALPGLIVALILGLAGGVSLGPEHPIMTVNIALAVAIGARLLPRVNRMEWTILASAGTIGALFGTPVAAALIFSQTLNGSNEVPLWDRLFAPLMAAAAGALTTGLFFHPHFSLPIAHYGQMEMTDILSGAIVAAIAIAAGMVAVWCLPRLHAMMHQMKNPVFVLGIGGLILGILGVIGGPVSLFKGLDEMQQMVANQAFSTSDYFLLAVIKLAALVVAAASGFRGGRIFPAVFVGVALGLMLHEHVPAVPAAITVSCAILGIVLVVTRDGWLSLFMAAVVVPNTTLLPLLCIVMLPAWLLLAGKPMMMVNRQKQQPPHDNV

SEQ ID NO: 5837 - DNA, 327 bp, Escherichia coli
atgttcaggtcactgtttctggcggccgccctgatggcatttaccccgcttgcggcaaacgcaagtgaaatcaccctactgccatcaatcaaattacaaattggcgatcgcgatcattacggtaattactgggacggtggtcactggcgcgaccgtgactactggcaccgcaattatgaatggcgtaaaaaccgctggtggcgtcatgataatggctaccatcgtggctgggataagcgtaaagcgtatgagcgtggctatcgtgaaggctggcgcgatcgtgacgatcatcgtggaaaaggccgcggacatggacaccgccattaa

SEQ ID NO: 5838 - protein, 108 aa, Escherichia coli
MFRSLFLAAALMAFTPLAANASEITLLPSIKLQIGDRDHYGNYWDGGHWRDRDYWHRNYEWRKNRWWRHDNGYHRGWDKRKAYERGYREGWRDRDDHRGKGRGHGHRH

SEQ ID NO: 5839 - DNA, 1239 bp, Escherichia coli
atgacgaactatcgcgttgagagtagcagcggacgggcggcgcgcaagatgaggctcgcattaatgggacctgcgttcattgcggcgattggttatatcgatcccggtaactttgcgaccaatattcaggcgggtgccagcttcggctatcagttattgtgggttgtcgtttgggctaacctgatggcgatgctgattcaaatcctctcggccaaactggggattgccaccggtaaaaatctggcggagcagattcgcgatcactacccgcgtcccgtcgtgtggttctattgggttcaggcagaaattattgcgatggcaaccgacctggcggaatttattggtgcggcgatcggttttaaactcattcttggtgtttcgttgttgcagggcgcggtgctgacagggatcgcgactttccttattttaatgctgcaacgtcgcgggcaaaaaccgctggagaaagtgattggcgggttactgttgtttgttgccgcggcttacattgtcgagttgattttctcccagcctaacctggcgcagctgggtaaaggaatggtgatcccgagtttacctacttcggaggcggtcttcctggcagcgggcgtgttaggggcgacgattatgccgcatgtgatttatttgcactcttcgctcactcagcatttacatggcggttcgcgtcaacaacgttattccgccaccaaatgggatgtggctatcgccatgacgattgccggttttgtcaatctggcgatgatggctacagctgcggcggcgttccacttttctggtcatactggtgttgccgatcttgatgaggcttatctgacgctgcaaccgctgttaagccatgctgcggcaacggtctttggattaagcctggttgctgccggactgtcttcaacggtggtggggacgctggcggggcaggtagtgatgcagggcttcattcgctttcatatcccgctgtgggtgcgtcgtacagtcaccatgctgccgtcatttatcgtcattctgatgggattagatccgacacggattctggttatgagtcaggtgctgttaagttttggtatcgccctggcgctggttccactgttgattttcaccagtgacagcaagttgatgggcgatctggtgaacagtaaacgcgtaaaacagacaggctgggtgattgtggtgctggtagtggcgctgaatatctggttactggtaggaacggcactgggattgtag

SEQ ID NO: 5840 - protein, 412 aa, Escherichia coli
MTNYRVESSSGRAARKMRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLAMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKRVKQTGWVIVVLVVALNIWLLVGTALGL

SEQ ID NO: 5841 - DNA, 285 bp, Escherichia coli
  n 258, 259, 260, 261, 262: n is any nucleotide
atggaccgcgtccttcattttgtactggcacttgccgttgttgcgattctcgcactgctggtaagcagcgaccgcaaaaaaattcgtatccgttatgttattcaactgcttgttatcgaagtgttactggcgtggttcttcctgaactccgacgttggtctgggcttcgtgaaaggcttctccgaaatgttcgaaaaactgctcggatttgccaacgaagggactaacttcgtctttggtagcatgaatgatcaaggnnnnncattccattcattaattaattaa

SEQ ID NO: 5842 - protein, 94 aa, Escherichia coli
  Xaa 87, 88: Xaa is any amino acid
MDRVLHFVLALAVVAILALLVSSDRKKIRIRYVIQLLVIEVLLAWFFLNSDVGLGFVKGFSEMFEKLLGFANEGTNFVFGSMNDQGXXFHSLIN

SEQ ID NO: 5843 - DNA, 708 bp, Escherichia coli
atgtacaccatggcagcaacggcgatgtccaccgtgtcgatgtccatcgttggtgcatacatgaccatgctggagccgaaatacgtcgttgcggcgctggtactgaacatgttcagcacctttatcgtgctgtcgctgatcaacccttaccgtgttgatgccagtgaagaaaatattcagatgtccaacctgcacgaaggtcagagcttcttcgaaatgctgggtgaatacattctggcaggtttcaaggttgccattatcgttgccgcgatgctgatcggctttatcgccctgatcaccgcgctgaacgcactgtttgccaccgtgactggctggtttggctacagcatctccttccagggcatcctgggctacatcttctatccgattgcatgggtgatgggtgttccttccagtgaagcactgcaagtgggcagtatcatggcgaccaaactggtttccaacgagttcgttgcgatgatggatctgcagaaaattgcttccacgctctctccgcgtgcggaaggcatcatctctgtgttcctggtttccttcgctaacttctcttcaatcgggattatcgcgggtgcggttaaaggcctgaatgaagagcaaggtaacgtggtttctcgcttcggtctgaaactggtttacggctctaccctggtgagtgtgctgtctgcgtcaatcgcagcactggtgctgtaa

SEQ ID NO: 5844 - protein, 235 aa, Escherichia coli
MYTMAATAMSTVSMSIVGAYMTMLEPKYVVAALVLNMFSTFIVLSLINPYRVDASEENIQMSNLHEGQSFFEMLGEYILAGFKVAIIVAAMLIGFIALITALNALFATVTGWFGYSISFQGILGYIFYPIAWVMGVPSSEALQVGSIMATKLVSNEFVAMMDLQKIASTLSPRAEGIISVFLVSFANFSSIGIIAGAVKGLNEEQGNVVSRFGLKLVYGSTLVSVLSASIAALVL

SEQ ID NO: 5845 - DNA, 2190 bp, Escherichia coli
atgtttgtggagcataacctgataaaaaatatcaagatattcacactagcgtttacgctcaccgtggtacttattcagctatcccgtttaatttcgccacttgctgttatccattccaattatatctttctggcgtggatgccactgtgcgtaatgctgtcaatcttgtttatctttggctggcgtggtgtcgttcccattttatgcgggatgttttgcaccaatctgtggaacctgcatctctcttttttacagaccgccgtcatgatcggcagccaggcgtttgcagtcctgtgtgcctgtgcaatattacgctggcaattggggacgcgttggcgttatggattgaccagccgatacgtctggcaacgtctgttctggcttggtttggtggcgccgattggcatcaaatgcagcatgtatcttgtgggaaatttctttgattttccgctaaagatatctacctttttcggcgatgcggatgccattttcacggtcgttgatttgctaagccttttcaccgcagtgctgatttacaacatgcttttttactatctcacccgcatgattgtaagtccccactttgcacagatattgtggcgtagggatatcgctccgtcgttgagcaaagagaaacgcgcatttaccttaagctggctggcagctcttagcgtgctgctacttctgatgtgcacaccgtatgaaaatgactttattgccggttacctggtacctgttttctttatcatctttaccctcggtgtcggtaagattcgctatccgtttttaaatctcacctgggctgtttcaacgctttgccttctgaattacaaccagaactttttgcaaggggtactaaccgaatattcgctggcatttattctcgcagtactgatttcctttagtgtttgcctgctctatatggtgcgtatttatcatcgtagtgaatggcttaaccgccgctggcatttgcaggcgctgaccgatccgttaacgcttctacccaactttcgtgcgttggagcaagcgccggagcaagaggcgggcaagagtttttgctgcctgcgcattgataatcttgagtttatgagtcgtcattacggcttaataatgcgcgttcactgtatccgctcaatttaccgtacgctgctgccgttgatgcaggaaaacgaaaagttgtatcaattgccgggtagtgaactgctgttagtgctgagcgggccggaaacggaagggcgactccagcatatggttaacatcctgaatagtcggcaaattcactggaacaataccgggctggatatgggctatggtgctgcctgggggcgttttgatggaaatcaggaaaccctgcaacccttgttggggcagttaagctggctggcggagcaatcctgcgcacatcatcatgtgctggcgctggatagcagagaggagatggtttccgggcaaaccactaaacaggtgctattgctgaataccattcgcacggcgttagatcagggtgatttgctgctctacgcccagccaattcgcaacaaagagggtgaaggttatgatgagatcctcgcgcgactgaagtatgacggcggcattatgaccccggataagtttctgccccttattgctcagtttaaccttagcgcgcgttttgatttgcaagtgctggaatccttgttgaagtggctggcaacacacccttgcgacaaaaaaggtccacgcttttcagtcaatttaatgccgctcacgctgctgcaaaagaatattgccgggcggattattcgtctgtttaagcgttattacatctccccgcaggcggtcattcttgagatcaccgaggagcaggcgttttctaacgcagaaagcagcatgtacaacatcgagcagctgcataagtttggtttccggattgcgattgatgactttggcaccggatatgccaactacgaacggttaaagcgtttgcaggctgatatcatcaaaattgatggcgtctttgtgaaagatatcgtcacgaacacgctggatgcgatgattgtgagatcaattaccgatctggcgaaagcgaagtcattgagtgtggtcgcggagtttgtcgagacgccacagcagcaggcgctattgcataaacttggggtgcaatatctgcaaggatatttaattggtcgtccgcagccattagctgattaa

SEQ ID NO: 5846 - protein, 729 aa, Escherichia coli
MFVEHNLIKNIKIFTLAFTLTVVLIQLSRLISPLAVIHSNYIFLAWMPLCVMLSILFIFGWRGVVPILCGMFCTNLWNLHLSFLQTAVMIGSQAFAVLCACAILRWQLGTRWRYGLTSRYVWQRLFWLGLVAPIGIKCSMYLVGNFFDFPLKISTFFGDADAIFTVVDLLSLFTAVLIYNMLFYYLTRMIVSPHFAQILWRRDIAPSLSKEKRAFTLSWLAALSVLLLLMCTPYENDFIAGYLVPVFFIIFTLGVGKIRYPFLNLTWAVSTLCLLNYNQNFLQGVLTEYSLAFILAVLISFSVCLLYMVRIYHRSEWLNRRWHLQALTDPLTLLPNFRALEQAPEQEAGKSFCCLRIDNLEFMSRHYGLIMRVHCIRSIYRTLLPLMQENEKLYQLPGSELLLVLSGPETEGRLQHMVNILNSRQIHWNNTGLDMGYGAAWGRFDGNQETLQPLLGQLSWLAEQSCAHHHVLALDSREEMVSGQTTKQVLLLNTIRTALDQGDLLLYAQPIRNKEGEGYDEILARLKYDGGIMTPDKFLPLIAQFNLSARFDLQVLESLLKWLATHPCDKKGPRFSVNLMPLTLLQKNIAGRIIRLFKRYYISPQAVILEITEEQAFSNAESSMYNIEQLHKFGFRIAIDDFGTGYANYERLKRLQADIIKIDGVFVKDIVTNTLDAMIVRSITDLAKAKSLSVVAEFVETPQQQALLHKLGVQYLQGYLIGRPQPLAD

SEQ ID NO: 5847 - DNA, 345 bp, Escherichia coli
atgacgccagatgaacttgccagactgaccggctatagccgccagaccattaataaatgggtacgcaaggaaggctggacaacgtcaccaaaaccaggcgtccagggtggcaaagctcgactggttcacgtcaatgaacaggttcgtgaatatattcgcaatgctgaacgtccagaaggtcagggagaagcgccagccctttctggtgatgcgccgcttgaagtgttgctggtgacactggcgaaagagatgacgccagttgaacaaaaacagtttacatccttgcttctgcgggaagggattatcggattgttacaacgcttagggattcgcgatagcaaataa

SEQ ID NO: 5848 - protein, 114 aa, Escherichia coli
MTPDELARLTGYSRQTINKWVRKEGWTTSPKPGVQGGKARLVHVNEQVREYIRNAERPEGQGEAPALSGDAPLEVLLVTLAKEMTPVEQKQFTSLLLREGIIGLLQRLGIRDSK

SEQ ID NO: 5849 - DNA, 393 bp, Escherichia coli
atgaaaagattacgcaataaaatgaccaccgaagaactggctgaatgcctcggcgtggctaaacaaactgttaaccgttggatcagagaaaaaggctggaaaacggaaaaatttcccggcgtgaaaggcggtcgtgccagacttattctggtcgatacgcaagtttgcgagtttattcagaacacgccagccttccataacacaccgatgcttctggaagccgaagaaccccttgccgaatacgcaccgggtattcgcactcctgcttatcggcaaatcatcagcgcaatagacaacatgactcacagtgagcaagaaaaagttgcgcaatttttgtcacgcgaaggaattcgtaattttcttgctcgtctcgacatagatgaatcagcataa

SEQ ID NO: 5850 - protein, 130 aa, Escherichia coli
MKRLRNKMTTEELAECLGVAKQTVNRWIREKGWKTEKFPGVKGGRARLILVDTQVCEFIQNTPAFHNTPMLLEAEEPLAEYAPGIRTPAYRQIISAIDNMTHSEQEKVAQFLSREGIRNFLARLDIDESA

SEQ ID NO: 5851 - DNA, 1416 bp, Escherichia coli
atgaaaatcaaaactcgcttcgcgccaagcccaacaggctatctgcacgttggcggcgcgcgtactgctctttactcctggctttttgcacgtaaccacggcggtgagtttgtgctgcgtattgaagacaccgatcttgagcgttccacgccggaagctatcgaagccattatggatggcatgaactggctgagcctggagtgggatgaaggtccgtactaccagaccaaacgttttgatcgctacaacgcggtgatcgatcagatgctggaagagggcacagcttataaatgctattgctctaaagagcgcctggaagcgctgcgcgaagagcaaatggcgaaaggtgagaagccgcgttatgacggtcgctgccgccacagtcatgagcatcacgctgatgatgagccgtgtgtcgtacgttttgctaacccgcaggaaggttctgttgtttttgacgatcagatccgtggtccgatcgagttcagcaaccaggagctggatgatctgattatccgccgtaccgatggttccccaacctataacttctgtgtggttgtcgatgactgggatatggaaatcacccacgttatccgtggcgaagaccatatcaacaacacaccgcgccagattaacattcttaaggctctgaaagcgccggtaccggtttacgcgcacgtttctatgatcaacggcgatgacggtaaaaaactgtccaaacgtcacggggcggtcagcgtaatgcagtatcgtgatgatggttatctgccagaagcactgctgaactatctggtgcgtctgggctggtcccacggcgatcaggaaatcttcactcgtgaagagatgattaaatacttcactctgaatgccgtcagcaaatctgccagtgcgttcaacaccgacaagctgctgtggctgaaccatcactacattaacgcgttgccgccggagtatgttgctactcacttacagtggcacattgagcaggaaaatatcgatacccgtaacggcccgcagctggctgatctggtgaaactgctgggcgaacgctgcaagacgctgaaagagatggcacagagctgccgttatttctacgaagattttgctgagttcgatgccgacgccgcgaaaaaacatctgcgtccggtagcgcgtcagccgctggaagtagttcgtgacaaactgactgcgattactgactggaccgctgaaaacgttcatcacgctattcaggcgacggcggatgagctggaagtgggtatgggtaaagttggtatgccgctgcgtgtcgccgtaaccggtgcggggcagtctccggcgctggatgttaccgttcacgcaatcggtaagacccgcagtatcgagcgtatcaacaaagcgctggcttttattgctgaacgcgaaaatcagcactaa

SEQ ID NO: 5852 - protein, 471 aa, Escherichia coli
MKIKTRFAPSPTGYLHVGGARTALYSWLFARNHGGEFVLRIEDTDLERSTPEAIEAIMDGMNWLSLEWDEGPYYQTKRFDRYNAVIDQMLEEGTAYKCYCSKERLEALREEQMAKGEKPRYDGRCRHSHEHHADDEPCVVRFANPQEGSVVFDDQIRGPIEFSNQELDDLIIRRTDGSPTYNFCVVVDDWDMEITHVIRGEDHINNTPRQINILKALKAPVPVYAHVSMINGDDGKKLSKRHGAVSVMQYRDDGYLPEALLNYLVRLGWSHGDQEIFTREEMIKYFTLNAVSKSASAFNTDKLLWLNHHYINALPPEYVATHLQWHIEQENIDTRNGPQLADLVKLLGERCKTLKEMAQSCRYFYEDFAEFDADAAKKHLRPVARQPLEVVRDKLTAITDWTAENVHHAIQATADELEVGMGKVGMPLRVAVTGAGQSPALDVTVHAIGKTRSIERINKALAFIAERENQH

SEQ ID NO: 5853 - DNA, 753 bp, Escherichia coli
  n 731, 732, 733, 734, 735: n is any nucleotide
atggaacgcgtatatagaacagatcttaagttgctccgttattttcttgccgtagcggaagagttgcattttggtcgcgcagcagcgcgtttaaatatgtctcagcctccgctcagtattcatattaaagagctggaaaatcaactcggcacgcagctttttattcgccattcgcgcagcgtcgtactgacacacgcgggcaaaatcttgatggaagaatcgcgtcgattgctggtgaatgcaaataatgtattggctcgggttgaacaaataggtcggggagaagcagggcggattgaactcggggttgtgggaacggcaatgtggggacggatgcgcccggttatgcggcgattccttagagaaaatcctaacgttgaagttctgtttcgcgaaaagatgcctgcgatgcaaatggccttgctggaacgccgcgaacttgatgccgggatctggcgaatggcgacagaaccaccgactggttttaccagcttacggttgcatgaatcggcgtttctggtggcgatgcctgaagagcatcatctctcatcattttccaccgtcccgctggaagcgctacgtgacgagtatttcgttacaatgccgcccgtgtacactgactgggattttttgcagcgagtttgccagcaggtgggattttcaccggttgttattcgcgaagttaatgaaccgcaaacggtactcgccatggtcagtatgggtattggtannnnncattcattcattaattaa

SEQ ID NO: 5854 - protein, 250 aa, Escherichia coli
  Xaa 244, 245: Xaa is any amino acid
MERVYRTDLKLLRYFLAVAEELHFGRAAARLNMSQPPLSIHIKELENQLGTQLFIRHSRSVVLTHAGKILMEESRRLLVNANNVLARVEQIGRGEAGRIELGVVGTAMWGRMRPVMRRFLRENPNVEVLFREKMPAMQMALLERRELDAGIWRMATEPPTGFTSLRLHESAFLVAMPEEHHLSSFSTVPLEALRDEYFVTMPPVYTDWDFLQRVCQQVGFSPVVIREVNEPQTVLAMVSMGIGXXHSFIN

SEQ ID NO: 5855 - DNA, 159 bp, Escherichia coli
gtgaaagatattttattttcttctggcgttggttttggcattggtgctttgtttacaatcgtgcgattacctattcctgttccaaatgtattgccgggtatattatccatcgtgtttatgtatgtcggatatctggtggtgaaatactttatgccatga

SEQ ID NO: 5856 - protein, 52 aa, Escherichia coli
MKDILFSSGVGFGIGALFTIVRLPIPVPNVLPGILSIVFMYVGYLVVKYFMP

SEQ ID NO: 5857 - DNA, 1257 bp, Escherichia coli
atgagcatcgctttgcgcttaaaggtaatgtcctttttgcaatattttatctgggggagctggctggttaccctcggttcttacatgattaatacccttcatttcaccggcgctaatgttggcatggtttacagttccaaagggatcgccgcgattattatgccgggtataatggggatcatcgcagacaaatggctgcgtgcggaacgtgcatacatgctgtgtcacctggtgtgtgcgggcgtacttttttatgcggcatccgtaactgatccggatatgatgttttgggtgatgttagtcaatgcgatggcgtttatgccgactattgcgttatcgaacagcgtctcttattcctgtcttgcccaggcagggcttgacccggtgaccgctttcccgcccattcgcgtttttggtacggtggggttcattgtcgccatgtgggcagtaagcctgctgcatctggaattgagtagtctgcaactgtatatcgcgtccggtgcgtcattgctgctgtcggcttatgcgttgactttgccgaagattccggttgcggagaaaaaagcgactacatcgcttgccagcaagctgggtctggatgccttcgtgctgtttaaaaatccacgcatggctatctttttcctcttcgccatgatgctgggcgcggtgctgcaaattaccaacgtttttggcaacccattcctgcatgatttcgcccgtaatcctgagtttgctgatagcttcgtggtgaaatacccgtccattttactgtcagtttcacagatggctgaagtcggtttcattctgacgataccgttctttttgaagcgtttcggtattaaaaccgtcatgctgatgagtatggtggcgtggacgctgcgctttggcttctttgcctatggcgatccatcaccaaccgggtttattttgctgttgctgtcgatgattgtttacggttgtgcattcgatttcttcaatatttctggttcggtctttgtcgaacaggaagttgattccagcattcgtgccagcgcccagggcctttttatgacgatggtaaatggcgtcggcgcatgggttggctcgattctgagcggtatggcagtggattacttctcggtggatggcgtaaaagattggcataccatttggctgatgtttgcagggtatgctcttttcctcgcagtgatatttttctttgggtttaaatataaccatgaccctgaaaagataacgcatcgttcagttacacattaa

SEQ ID NO: 5858 - protein, 418 aa, Escherichia coli
MSIALRLKVMSFLQYFIWGSWLVTLGSYMINTLHFTGANVGMVYSSKGIAAIIMPGIMGIIADKWLRAERAYMLCHLVCAGVLFYAASVTDPDMMFWVMLVNAMAFMPTIALSNSVSYSCLAQAGLDPVTAFPPIRVFGTVGFIVAMWAVSLLHLELSSLQLYIASGASLLLSAYALTLPKIPVAEKKATTSLASKLGLDAFVLFKNPRMAIFFLFAMMLGAVLQITNVFGNPFLHDFARNPEFADSFVVKYPSILLSVSQMAEVGFILTIPFFLKRFGIKTVMLMSMVAWTLRFGFFAYGDPSPTGFILLLLSMIVYGCAFDFFNISGSVFVEQEVDSSIRASAQGLFMTMVNGVGAWVGSILSGMAVDYFSVDGVKDWHTIWLMFAGYALFLAVIFFFGFKYNHDPEKITHRSVTH

SEQ ID NO: 5859 - DNA, 834 bp, Escherichia coli
atgtatcaggctcagttttctcataacccactgtattgcgtagatattatcaagacttataaacctgatttcacgccacgagtggcctttattttaggttccgggctgggcgcgctagccgatcagattgagaacgcggtcgcaatttcctacgaaaagctgcctgggttcccggtaagtaccgtacacggtcatgcgggtgagctggtgctggggtatctccagggggtgccagtggcgtgcatgaaaggtcgtggacatttctacgaaggtcgtgggatgaccatcatgacggatgcaatccgtacctttaagttgctgggctgcgagttgctgttctgcaccaatgcggctggctcactgcgtcctgaagtgggggccggcagtctggtcgcattgaaagatcacatcaacaccatgccgggaacgccgatggtgggtcttaatgatgaacgttttggtgagcgcttcttctcgctggcgaatgcctacgatgcggaataccgcgcactgttacaaaaagtggcgaaagaagaggggttccctctgacggagggcgtgttcgtctcgtatccggggccgaatttcgagactgcggcggaaattcgcatgatgcaaattattggtggggatgttgttggtatgtctgtggtgcctgaggttatttcagctcgccattgcgaacttaaagtcgttgcggtctctgcgattaccaacatggcggaaggtctgagtgacgtgaagctttctcatgcccaaacgctggcagcagcggaactctcaaagcaaaactttattaatcttatttgcggctttctgcgcaaaattgcctga

SEQ ID NO: 5860 - protein, 277 aa, Escherichia coli
MYQAQFSHNPLYCVDIIKTYKPDFTPRVAFILGSGLGALADQIENAVAISYEKLPGFPVSTVHGHAGELVLGYLQGVPVACMKGRGHFYEGRGMTIMTDAIRTFKLLGCELLFCTNAAGSLRPEVGAGSLVALKDHINTMPGTPMVGLNDERFGERFFSLANAYDAEYRALLQKVAKEEGFPLTEGVFVSYPGPNFETAAEIRMMQIIGGDVVGMSVVPEVISARHCELKVVAVSAITNMAEGLSDVKLSHAQTLAAAELSKQNFINLICGFLRKIA

SEQ ID NO: 5861 - DNA, 105 bp, Escherichia coli
ttgattaaaagcggcatattgttaatgcaagggaaagaagagtaccaatacagttttttcagcctattaatagtgaaaaaatataaatatatcgatatcgaataa

SEQ ID NO: 5862 - protein, 34 aa, Escherichia coli
MIKSGILLMQGKEEYQYSFFSLLIVKKYKYIDIE

SEQ ID NO: 5863 - DNA, 765 bp, Escherichia coli
atgaaaaaacatctttttactctgacactctcttctgtattggcgataccagcagtatcccatgcagaatttaaaggcggttttgctgatataggtattcattatcttgactggactagcagaaccactgagaaatcgtcgaccaaatcacacaaagatgattttggatatctggaactggaaggcggcgctaactttagttggggagaaatgtacgggttcttcgactgggaaaacttttataatgatcgtcatgataaaccgggtagcgagcagcgttatacatttaaaaataccaaccgtatttacctgggtgacaccggatttaatctctacttgcatgcgtatggcacctacggttctgcgaatcgtgtgaatttccatgacgatatgttcctttacgggatcggctacaatttcaccggcagcggttggtggttcaaaccgttctttgcaaaacgctatacagaccaaacctattataccggcgataacggttatgtcgccggttgggttgcaggttacagctttatgctgggcagtgagaaattcaccctcaccaactggaacgagtacgagtttgatcgtgatgccacctacgcggcaggtaatggcggcaaagaaggtctgaacggtgccgtcgcactttggtggaatgcaacttcacacatcaccacagggattcagtatcgttatgcggatgacaaactgggcgaagatttttaccaggatgcgataatctactccatcaaatttaatttctga

SEQ ID NO: 5864 - protein, 254 aa, Escherichia coli
MKKHLFTLTLSSVLAIPAVSHAEFKGGFADIGIHYLDWTSRTTEKSSTKSHKDDFGYLELEGGANFSWGEMYGFFDWENFYNDRHDKPGSEQRYTFKNTNRIYLGDTGFNLYLHAYGTYGSANRVNFHDDMFLYGIGYNFTGSGWWFKPFFAKRYTDQTYYTGDNGYVAGWVAGYSFMLGSEKFTLTNWNEYEFDRDATYAAGNGGKEGLNGAVALWWNATSHITTGIQYRYADDKLGEDFYQDAIIYSIKFNF

SEQ ID NO: 5865 - DNA, 816 bp, Escherichia coli
gtgaaggagctggaaaatcatactggtgttcgcctgctggacagaaccacgcgtgaagtggtgcttacagatgcagggcagcagttggctttgcgtcttgagcgactgctggatgaacttaacagcacgttgcgcgataccgggcgtatggggcaacaactgagcggaaaagttcgggtcgctgccagccagaccatttccgcgcatcttattccgcaatgcattgctgaaagccatcgctgctatccagatattcagtttgtcctgcacgatcgtccgcagcagtgggtgatggaaagtattcgccagggagatgtcgattttggcatcgtcatcgatccaggcccagtgggcgatctgcaatgtgaagcgattctttccgagcctttctttctgctttgccatcgcgatagcgctttggccgtggaagattatgtaccctggcaggcattacagggagcgaaattggtgttgcaggattacgcgtcaggcagccgaccgctgattgacgcagcgctggcgcgcaacggtattcaggcgaatattgtgcaggagattggtcatccggcgacgctgttcccgatggtagccgcaggcatcggcatcagtattcttcccgcactggcgctaccattgcctgaaggtagcccactggtggtaaagcgcattacgccagtggttgaacgccagttgatgctggtgcgcaggaagaaccgttcactttccaccgccgctgaagcgttatgggacgtggtacgagaccagggcaatgcgctaatggctgggcgggaaggggatccgttgtatcagatataa

SEQ ID NO: 5866 - protein, 271 aa, Escherichia coli
MKELENHTGVRLLDRTTREVVLTDAGQQLALRLERLLDELNSTLRDTGRMGQQLSGKVRVAASQTISAHLIPQCIAESHRCYPDIQFVLHDRPQQWVMESIRQGDVDFGIVIDPGPVGDLQCEAILSEPFFLLCHRDSALAVEDYVPWQALQGAKLVLQDYASGSRPLIDAALARNGIQANIVQEIGHPATLFPMVAAGIGISILPALALPLPEGSPLVVKRITPVVERQLMLVRRKNRSLSTAAEALWDVVRDQGNALMAGREGDPLYQI

SEQ ID NO: 5867 - DNA, 999 bp, Escherichia coli
atgaaactttttcgtatcctcgatcctttcaccttaaccctgatcacggtggtgttgctggcctctttctttccggccagaggcgatttcgtccccttctttgaaaatctgaccactgcagcgattgctctgctgttctttatgcacggcgcgaagttgtcgcgtgaggcgattattgctggcggtggtcactggcgactgcatttgtgggtaatgtgcagcaccttcgtgctgtttccgattctgggcgtgctgtttgcctggtggaaaccggtaaatgtcgacccgatgctctactccggttttctctacttgtgcattctccccgcgaccgtgcagtctgcaatcgccttcacgtcaatggcgggcggtaacgtcgcggcggcggtttgttctgcgtcagcatccagcctgctggggattttcctttcaccattgctggttggtctggtgatgaatgttcacggtgcagggggcagccttgagcaggtcggtaaaattatgctgcaactgttgctgccatttgtgttggggcatctttcccggccttggattggtgactgggtgtcgcgtaataaaaaatggattgcgaaaactgaccagacgtccattctgttggtggtttatacggcattcagcgaagccgtcgttaacggtatctggcacaaagttggctggggatcattgctgtttatcgtggtggtcagttgcgttcttctggctatcgtgattgtagttaacgtctttatggcacgccgactgggcttcaataaggcagatgaaattactatcgtcttttgtggttcgaaaaagagtctggcaaatggcatcccgatggcaaacattctgttccccacatcggtgatcggtatgatggtgctgcccctgatgattttccatcagatccaattgatggtctgtgcggtgctggcgcgtcgatacaaacgccagaccgaacagttacaggcgcagcaggaaagcagcgccgataaagcttaa

SEQ ID NO: 5868 - protein, 332 aa, Escherichia coli
MKLFRILDPFTLTLITVVLLASFFPARGDFVPFFENLTTAAIALLFFMHGAKLSREAIIAGGGHWRLHLWVMCSTFVLFPILGVLFAWWKPVNVDPMLYSGFLYLCILPATVQSAIAFTSMAGGNVAAAVCSASASSLLGIFLSPLLVGLVMNVHGAGGSLEQVGKIMLQLLLPFVLGHLSRPWIGDWVSRNKKWIAKTDQTSILLVVYTAFSEAVVNGIWHKVGWGSLLFIVVVSCVLLAIVIVVNVFMARRLGFNKADEITIVFCGSKKSLANGIPMANILFPTSVIGMMVLPLMIFHQIQLMVCAVLARRYKRQTEQLQAQQESSADKA

SEQ ID NO: 5869 - DNA, 219 bp, Escherichia coli
atggaaaaagagcagctgattgaaatagccaatacgataatgccgtttggcaagtacaaagggcgtcgcttaatcgacctgccggaggagtatctgctgtggtttgcccgcaaagatgagttcccggcagggaagctcggtgagctaatgcaaatcacgctgctgattaaaaccgaggggctgacgcaactggtccagcccctgaagcgtccgctttaa

SEQ ID NO: 5870 - protein, 72 aa, Escherichia coli
MEKEQLIEIANTIMPFGKYKGRRLIDLPEEYLLWFARKDEFPAGKLGELMQITLLIKTEGLTQLVQPLKRPL

SEQ ID NO: 5871 - DNA, 2016 bp, Escherichia coli
atggaatcaatcgaacaacaactgacagaactgcgaacgacgcttcgccatcatgaatatctttatcatgtgatggatgcgccggaaattcccgacgctgaatacgacaggctgatgcgcgaactgcgcgagctggaaaccaaacatccagaactgattacgcctgattcgcctacccaacgtgtaggtgctgcgccgctggcggctttcagccagatccgccatgaagtgccaatgctgtcgctggataacgtttttgatgaagaaagctttcttgccttcaacaaacgagtgcaggaccgtctgaaaagcaacgagaaagtcacctggtgctgtgagctgaagctggatggtcttgccgtcagtattctgtatgaaaatggcgttttagtcagtgccgcaactcgtggcgatggcaccaccggggaagatatcacgtctaatgtgcgtactattcgcgccattccgctgaagctacacggtgagaatatcccggcgcgtctggaagtgcgtggtgaagtgttcctgccgcaggcggggttcgaaaagattaacgaagatgcgcgacgcacgggcgggaaagtgtttgctaacccacgtaatgcggcagctggttcactgcgtcagcttgatccgcgtattacagcgaagcgaccgctcactttcttctgctacggcgttggtgttctggaaggcggtgaattgccggatacccatttgggacgcttaatgcaatttaaagcgtggggattacctgtcagcgatcgggtaacgctttgtgaatcggcggaagaagtgctggcgttctaccacaaagtagaagaagaccgtccgacgctgggctttgatatcgacggcgtggtgattaaggtcaactcactggcacagcaggagcagcttggctttgtcgcgcgtgccccgcgctgggcggtagcgtttaaattcccggcgcaggaacagatgacctttgtgcgtgacgtcgagtttcaggttgggcgtactggcgcgattacgcctgttgcgcgtctggaacctgtccatgttgctggcgtgttggtgagtaacgctacactgcataatgctgacgaaatcgaacgtcttggtttacgcattggcgataaagtggtgattcgccgcgctggcgacgtgatcccgcaggtggttaacgtcgtgctttctgaacgcccggaagatacccgtgaggttgtattcccgacgcattgtccggtatgtggttctgacgtcgagcgtgtggaaggtgaagcggttgcccgctgtaccggtggcctgatttgcggtgcgcagcgtaaagagtctctgaaacactttgtttcccgccgtgcgatggatgttgacggaatgggcgacaaaatcatcgatcaactggttgaaaaagaatatgtccacactccggcggatctgttcaaactcaccgcaggcaaactgaccggactggagcgtatggggccgaaatcggcacaaaacgtggttaacgcgctggaaaaagcgaaagaaaccacctttgcccgcttcctctatgcacttggcgtccgtgaagtcggcgaggctaccgcagcaggtctggcggcatatttcggcacgctggaagcgctggaagccgcgtcgattgaagagctgcaaaaggtgcctgatgttggaattgtcgttgcctcccacgttcacaacttctttgccgaagaaagcaaccgcaatgtcatcagcgagctgttggcggaaggtgttcactggcctgagccgatcgttatcaatgcggaagagattgacagtccgtttgctggtaaaaccgtggtgcttacgggcagcttaagccagatgtcgcgtgatgacgctaaagctcgactggtcgaactgggggcgaaagtcgcgggcagcgtgtcgaagaaaaccgatctggtgatagcgggtgaagctgcaggatctaaactggcgaaggcgcaggaactgggcattgaagtcatcgacgaaacggaaatgctgcgtttgctgggtagctga

SEQ ID NO: 5872 - protein, 671 aa, Escherichia coli
MESIEQQLTELRTTLRHHEYLYHVMDAPEIPDAEYDRLMRELRELETKHPELITPDSPTQRVGAAPLAAFSQIRHEVPMLSLDNVFDEESFLAFNKRVQDRLKSNEKVTWCCELKLDGLAVSILYENGVLVSAATRGDGTTGEDITSNVRTIRAIPLKLHGENIPARLEVRGEVFLPQAGFEKINEDARRTGGKVFANPRNAAAGSLRQLDPRITAKRPLTFFCYGVGVLEGGELPDTHLGRLMQFKAWGLPVSDRVTLCESAEEVLAFYHKVEEDRPTLGFDIDGVVIKVNSLAQQEQLGFVARAPRWAVAFKFPAQEQMTFVRDVEFQVGRTGAITPVARLEPVHVAGVLVSNATLHNADEIERLGLRIGDKVVIRRAGDVIPQVVNVVLSERPEDTREVVFPTHCPVCGSDVERVEGEAVARCTGGLICGAQRKESLKHFVSRRAMDVDGMGDKIIDQLVEKEYVHTPADLFKLTAGKLTGLERMGPKSAQNVVNALEKAKETTFARFLYALGVREVGEATAAGLAAYFGTLEALEAASIEELQKVPDVGIVVASHVHNFFAEESNRNVISELLAEGVHWPEPIVINAEEIDSPFAGKTVVLTGSLSQMSRDDAKARLVELGAKVAGSVSKKTDLVIAGEAAGSKLAKAQELGIEVIDETEMLRLLGS

SEQ ID NO: 5873 - DNA, 1038 bp, Escherichia coli
ttgccgtggtggcaaggtgttagaacaacagagaatataatgatgcaggatttgcgtctgatattaatcattgttggcgcgatcgccataatcgctttactggtacatggtttctggaccagccgtaaagaacgatcttctatgttccgcgatcggccattaaaacgaatgaagtcaaaacgtgacgacgattcttatgacgaggatgtcgaagatgatgagggcgttggtgaggttcgagttcaccgcgtgaatcatgccccggctaacgcccaggagcatgaggctgctcgtccgtcgccgcaacaccagtaccaaccgccttatgcgtctgcgcagccgcgtcaaccggtccagcagccgcctgaagctcaggtaccgccgcaacatgctccgcgtccagcgcagccggtgcagcaacccgtgcagcagcctgcctatcagccgcagcctgaacagccgttgcagcagccagtttcgccacaggtcgcatcagcgccgcagccagtgcattcagcaccgcaaccggcacaacaggctttccagcctgcagagcctgtagcggcaccacagcctgagcctgtagcggaaccggctccagttatggataaaccgaagcgcaaagaagcggtgattatcatgaacgtcgcggcgcatcacggtagcgagctaaacggtgaactgcttcttaacagcattcaacaagcgggcttcatttttggcgatatgaatatttaccatcgtcatcttagcccggatggcagcggcccggcgttatttagcctggcgaatatggtgaaaccgggaacctttgatcctgaaatgaaggatttcactactccgggtgtcactatctttatgcaggtaccgtcttacggtgacgagctgcagaacttcaagctgatgctgcaatctgcgcagcatattgccgatgaagtgggcggtgtagtgcttgacgatcagcgccgtatgatgactccgcagaaattgcgcgagtaccaggacatcatccgcgaagtcaaagacgccaacgcctga

SEQ ID NO: 5874 - protein, 345 aa, Escherichia coli
MPWWQGVRTTENIMMQDLRLILIIVGAIAIIALLVHGFWTSRKERSSMFRDRPLKRMKSKRDDDSYDEDVEDDEGVGEVRVHRVNHAPANAQEHEAARPSPQHQYQPPYASAQPRQPVQQPPEAQVPPQHAPRPAQPVQQPVQQPAYQPQPEQPLQQPVSPQVASAPQPVHSAPQPAQQAFQPAEPVAAPQPEPVAEPAPVMDKPKRKEAVIIMNVAAHHGSELNGELLLNSIQQAGFIFGDMNIYHRHLSPDGSGPALFSLANMVKPGTFDPEMKDFTTPGVTIFMQVPSYGDELQNFKLMLQSAQHIADEVGGVVLDDQRRMMTPQKLREYQDIIREVKDANA

SEQ ID NO: 5875 - DNA, 762 bp, Escherichia coli
atggtttcatcattcacatctgccccacgcagcggtttttactattttgcgcaaggctggaagctcgtctcgcaacctgggattcggcgtttcgttattttaccgctgctggtcaatattttgttgatggggggcgcattctggtggctctttacgcaactcgatgtctggatcccgacgctcatgagttatgttccggactggttacaatggctgagctatctgttgtggcccctggctgtcatctctgtgctgttagtgtttggctatttcttctcaacgattgctaactggattgctgctccgttcaacggtttattggctgaacaactggaagcaagactgactggcgctacaccgccagataccggaattttcggtatcatgaaagatgtgccgcgaatcatgaaacgcgaatggcaaaaatttgcctggtatctgccgcgcgcaattgtattgctaattctttacttcatccctggcattgggcaaaccgtcgcgccggtactgtggttcctgtttagcgcctggatgttagccatccagtattgtgattaccccttcgataaccacaaagtgccgtttaaagagatgcgcaccgccctgcgcacacgcaaaatcaccaatatgcagtttggtgctttaaccagcctgtttacgatgatcccgctgcttaatctgttcattatgcccgttgccgtttgtggcgcgacggcgatgtgggtcgattgctatcgcgataaacacgccatgtggcggtaa

SEQ ID NO: 5876 - protein, 253 aa, Escherichia coli
MVSSFTSAPRSGFYYFAQGWKLVSQPGIRRFVILPLLVNILLMGGAFWWLFTQLDVWIPTLMSYVPDWLQWLSYLLWPLAVISVLLVFGYFFSTIANWIAAPFNGLLAEQLEARLTGATPPDTGIFGIMKDVPRIMKREWQKFAWYLPRAIVLLILYFIPGIGQTVAPVLWFLFSAWMLAIQYCDYPFDNHKVPFKEMRTALRTRKITNMQFGALTSLFTMIPLLNLFIMPVAVCGATAMWVDCYRDKHAMWR

SEQ ID NO: 5877 - DNA, 864 bp, Escherichia coli
atgagtaagatttttgaagataactcgctgactatcggtcacacgccgctggttcgcctgaatcgcatcggtaacggacgcattctggcgaaggtggaatctcgtaaccccagcttcagcgttaagtgccgtatcggtgccaacatgatttgggatgccgaaaagcgcggcgtgctgaaaccaggcgttgaactggttgaaccaaccagcggtaataccgggattgcactggcctatgtagctgccgctcgcggttacaaacttaccctgaccatgccagaaaccatgagtattgaacgccgcaaactgctgaaagcgttaggtgcaaacctggtgctgaccgaaggtgctaaaggcatgaaaggtgcaatccaaaaagcagaagaaattgtcgccagcaatccagagaaatacctgctgctgcaacaattcagcaatccggcaaaccctgaaattcatgaaaaaaccaccggtccggagatctgggaagataccgacggtcaggttgatgtatttattgctggcgttgggactggcggtacgctgactggcgtcagccgctacattaaaggcaccaaaggcaagaccgatcttatctctgtcgccgttgagccaaccgattctccagttatcgcccaggcgctggcaggtgaagagattaaacctggtccgcataaaattcagggtattggcgctggttttatcccggctaaccttgatctcaagctggtcgacaaagtcattggcatcaccaatgaagaagccatttctaccgcacgtcgtctgatggaagaagaaggcattcttgctggtatctcttctggagcagctgttgctgcggcgttgaaactacaagaaagatga

SEQ ID NO: 5878 - protein, 287 aa, Escherichia coli
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQALAGEEIKPGPHKIQGIGAGFIPANLDLKLVDKVIGITNEEAISTARRLMEEEGILAGISSGAAVAAALKLQER

SEQ ID NO: 5879 - DNA, 258 bp, Escherichia coli
atgttccagcaagaagttaccattaccgctccgaacggtctgcacacccgccctgctgcccagtttgtaaaagaagctaagggcttcacttctgaaattactgtgacttccaacggcaaaagcgccagcgcgaaaagcctgtttaaactgcagactctgggcctgactcaaggtaccgttgtgactatctccgcagaaggcgaagacgagcagaaagcggttgaacatctggttaaactgatggcggaactcgagtaa

SEQ ID NO: 5880 - protein, 85 aa, Escherichia coli
MFQQEVTITAPNGLHTRPAAQFVKEAKGFTSEITVTSNGKSASAKSLFKLQTLGLTQGTVVTISAEGEDEQKAVEHLVKLMAELE

SEQ ID NO: 5881 - DNA, 1728 bp, Escherichia coli
atgatttcaggcattttagcatccccgggtatcgctttcggtaaagctctgcttctgaaagaagacgaaattgtcattgaccggaaaaaaatttctgccgaccaggttgatcaggaagttgaacgttttctgagcggtcgtgccaaggcatcagcccagctggaaacgatcaaaacgaaagctggtgaaacgttcggtgaagaaaaagaagccatctttgaagggcatattatgctgctcgaagatgaggagctggagcaggaaatcatagccctgattaaagataagcacatgacagctgacgcagctgctcatgaagttatcgaaggtcaggcttctgccctggaagagctggatgatgaatacctgaaagaacgtgcggctgacgtacgtgatatcggtaagcgcctgctgcgcaacatcctgggcctgaagattatcgacctgagcgccattcaggatgaagtcattctggttgccgctgacctgacgccgtccgaaaccgcacagctgaacctgaagaaggtgctgggtttcatcaccgacgcgggtggccgtacttcccacacctctatcatggcgcgttctctggaactgcctgctatcgtgggtaccggtagcgtcacctctcaggtgaaaaatgacgactatctgattctggatgccgtaaataatcaggtttacgtcaatccaaccaacgaagttattgataaaatgcgcgctgttcaggagcaagtggcttctgaaaaagcagagcttgctaaactgaaagatctgccagctattacgctggacggtcaccaggtagaagtgtgcgctaacattggtacggttcgtgacgttgaaggtgcagagcgtaacggcgctgaaggcgttggtctgtatcgtactgagttcctgttcatggaccgcgacacgctgcccactgaagaagaacagtttgctgcttacaaagcagtggctgaagcgtgtggctctcaggcggttatcgttcgtaccatggacatcggcggcgacaaagagctgccatacatgaacttcccgaaagaagagaacccgttcctcggctggcgcgctatccgtatcgcgatggatcgtaaagagatcctgcgcgatcagctccgcgctatcctgcgtgcctctgctttcggtaaattgcgcatcatgttcccgatgatcatctctgttgaagaagtgcgtgcactgcgcaaagagatcgaaatctacaaacaggaactgcgcgacgaaggtaaagcgtttgacgagtcaattgaaatcggcgtaatggtggaaacaccggctgccgcaacaattgcacgtcatttagccaaagaagttgatttctttagtatcggcaccaatgatttaacgcagtacactctggcagttgaccgtggtaatgatatgatttcacacctttaccagccaatgtcaccgtccgtgctgaacttgatcaagcaagttattgatgcttctcatgctgaaggcaaatggactggcatgtgtggtgagcttgctggcgatgaacgtgctacacttctgttgctggggatgggtctggacgaattctctatgagcgccatttctatcccgcgcattaagaagattatccgtaacacgaacttcgaagatgcgaaggtgttagcagagcaggctcttgctcaaccgacaacggacgagttaatgacgctggttaacaagttcattgaagaaaaaacaatctgctaa

SEQ ID NO: 5882 - protein, 575 aa, Escherichia coli
MISGILASPGIAFGKALLLKEDEIVIDRKKISADQVDQEVERFLSGRAKASAQLETIKTKAGETFGEEKEAIFEGHIMLLEDEELEQEIIALIKDKHMTADAAAHEVIEGQASALEELDDEYLKERAADVRDIGKRLLRNILGLKIIDLSAIQDEVILVAADLTPSETAQLNLKKVLGFITDAGGRTSHTSIMARSLELPAIVGTGSVTSQVKNDDYLILDAVNNQVYVNPTNEVIDKMRAVQEQVASEKAELAKLKDLPAITLDGHQVEVCANIGTVRDVEGAERNGAEGVGLYRTEFLFMDRDTLPTEEEQFAAYKAVAEACGSQAVIVRTMDIGGDKELPYMNFPKEENPFLGWRAIRIAMDRKEILRDQLRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 5883 - DNA, 510 bp, Escherichia coli
atgggtttgttcgataaactgaaatctctggtttccgacgacaagaaggataccggaactattgagatcattgctccgctctctggcgagatcgtcaatatcgaagacgtgccggatgtcgtttttgcggaaaaaatcgttggtgatggcattgctatcaaaccaacgggtaacaaaatggtcgcgcctgtagacggcaccattggtaaaatctttgaaaccaaccatgcgttctctatcgaatctgatagcggcgttgagctgttcgtccacttcggtatcgacaccgttgaactgaaaggcgaaggcttcaagcgtattgctgaagaaggtcagcgcgtgaaagttggtgatactgtcattgaatttgatctgccgctgctggaagagaaagccaagtcaaccctgactccggttgttatctccaacatggacgaaatcaaagaactgatcaaactgtccggtagcgtaaccgtgggtgaaaccccggttatccgcatcaagaagtaa

SEQ ID NO: 5884 - protein, 169 aa, Escherichia coli [sequence omitted]

SEQ ID NO: 5885 - DNA, 852 bp, Escherichia coli
atgagtagtttgttgttgtttaacgataagagcagggcactgcaggcggatatcgttgccgtgcagtcgcaggtagtgtacggcagcgtaggcaacagcattgcggtgcctgctatcaaacagaacggcctgaatgtctttgccgtgccgacggtattgctgagcaatacgccgcattatgacactttctacggtggtgcgattccggatgaatggtttagcggttatttgcgtgcgcttcaggagcgtgatgcgctgcgccaacttcgtgctgtaaccacgggctatatgggaacggcatcgcaaatcaaaatccttgccgagtggctgactgcgctacgcaaagaccatcctgacctattgatcatggtcgatccggtgattggcgatattgatagcggaatttatgtcaaacctgaccttcccgaggcgtatcgacaatatttactgccgctggcacagggaattacccccaatatctttgagctggaaatcctgaccggtaaagattgccgcgatctcgacagtgccattgctgccgcaaaaagtctgctttcagacacattaaagtgggtggtgattaccagcgcctccggcaatgaagaaaatcaggagatgcaggtggtggtggtcagtgccgacagcgtgaatgtcatttcccattcccgggttaaaactgacctgaaagggactggcgacctgttttgtgctcagcttatcagtggtttgctgaaagggaaggcgttaaccgatgcggtacaccgcgcggggttgcgcgtactggaagtgatgcgctatacccagcagcatgagagcgatgaattgattttgccgcctctggctgaagcataa

SEQ ID NO: 5886 - protein, 283 aa, Escherichia coli
MSSLLLFNDKSRALQADIVAVQSQVVYGSVGNSIAVPAIKQNGLNVFAVPTVLLSNTPHYDTFYGGAIPDEWFSGYLRALQERDALRQLRAVTTGYMGTASQIKILAEWLTALRKDHPDLLIMVDPVIGDIDSGIYVKPDLPEAYRQYLLPLAQGITPNIFELEILTGKDCRDLDSAIAAAKSLLSDTLKWVVITSASGNEENQEMQVVVVSADSVNVISHSRVKTDLKGTGDLFCAQLISGLLKGKALTDAVHRAGLRVLEVMRYTQQHESDELILPPLAEA

SEQ ID NO: 5887 - DNA, 369 bp, Escherichia coli
gtgaagaaaatcgtttgtctggtcgttacgctgctaatgacactccccgcttatgcgaagttaacggcccatgaagaagcccgtatcaacgccatgctggagggattagcacagaaaaaggatttgatatttgtgcgcaacggtgatgaacatacctgcgatgaagcggtttctcatctgcgcctgaagctgggcaatacccgtaatcgcattgatacagccgagcagtttattgacaaggtggcctcgtcgtcatcgattaccgggaagccgtatatcgtgaagatgcccggtaagagcgatgagaacgcacagccttttttacatgcgttaattgcgcagacggataaaacggtgcctgcgcaataa

SEQ ID NO: 5888 - protein, 122 aa, Escherichia coli
MKKIVCLVVTLLMTLPAYAKLTAHEEARINAMLEGLAQKKDLIFVRNGDEHTCDEAVSHLRLKLGNTRNRIDTAEQFIDKVASSSSITGKPYIVKMPGKSDENAQPFLHALIAQTDKTVPAQ

SEQ ID NO: 5889 - DNA, 912 bp, Escherichia coli
gtgagtacattagaacaaacaataggcaatacgcctctggtgaagttgcagcgaatggcgccggataacggcagtgaagtgtggttaaaactggaaggcaataacccggcgggatcggtaaaagaccgtgcggcgctttcgatgattgtcgaggcggaaaagcgcggcgagattaaaccgggtgatgtgctgatcgaagccaccagtggtaacaccggcattgcgctggcaatgattgcggcgcttaaaggctatcgcatgaaattgctgatgcccgacaacatgagccaggaacgccgtgcggcgatgcgtgcctacggtgcagaactgattctggtcaccaaagaacagggcatggaaggcgcacgcgatctggcgcttgaaatggcgaatcgcggcgaaggaaagttgctcgatcagttcaataatcccgataacccttacgcccattacaccactaccgggccagaaatctggcagcaaactggcgggcgtattacccattttgtctccagcatgggaacaaccggcactatcaccggcgtgtcacgctttatgcgcgaacaatccaaaccggtgaccattgttggcctgcagccggaagaaggcagcagtattcccggcattcgccgctggcctgcggaatatctgccggggattttcaatgcttctctggtggatgaggtgctggatattcatcagcgcgatgcggaaaacaccatgcgcgaactggcagtgcgggaagggattttctgcggcgtaagctccggcggcgcggttgccggagcactgcgggtggcaaaagctaaccctggcgcggtggtggtggcgatcatctgcgatcgtggcgatcgctacctttctaccggggtgtttggggaagagcattttagccagggggcggggatttaa

SEQ ID NO: 5890 - protein, 303 aa, Escherichia coli
MSTLEQTIGNTPLVKLQRMAPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPAEYLPGIFNASLVDEVLDIHQRDAENTMRELAVREGIFCGVSSGGAVAGALRVAKANPGAVVVAIICDRGDRYLSTGVFGEEHFSQGAGI

SEQ ID NO: 5891 - DNA, 1098 bp, Escherichia coli
atgagcattgagattgccaatattaagaagtcgtttggtcgcacccaggtgctgaacgatatctcactggatattccttctggtcagatggtcgcgttgctggggccgtccggttccggaaaaaccacgctgctgcgcattattgccgggctggagcatcaaaccagcgggcatattcgctttcacggtaccgacgtgagccgtctgcacgcgcgggaccgtaaagtcggtttcgtgttccagcattacgcgctgtttcgccatatgacggtgtttgacaatatcgcttttggcctgacggtgttgccacggcgtgaacgcccgaatgcggcggcgatcaaagcgaaagtgacaaaattgctggagatggtgcagctcgcgcatctggcggatcgttatccggcgcagctttccggcggccagaaacagcgtgtggcgcttgcacgcgcgctggctgtggaaccgcaaattttgctgcttgatgaaccgtttggcgcgctggatgcgcaggtgcgtaaagagctgcgtcgctggctgcgtcaactgcatgaagaactgaaattcaccagcgtgttcgtgacccacgaccaggaagaggcgaccgaagtagccgatcgtgtagtggtgatgagtcagggcaatattgaacaagctgacgcaccggatcaggtatggcgtgaaccggcgactcgttttgtgctggagtttatgggcgaggtaaaccgcctgcagggaaccattcgcggcgggcagttccacgttggcgcacatcgctggccgctgggatacacccccgcgtatcaggggccggtggatctcttcctgcgcccgtgggaagtggatatcagccgccgtaccagcctcgattcgccgctacccgtacaggtactggaagccagcccgaaaggtcactacacccaattagtggtgcagccgctggggtggtacaacgaaccgctgacggtcgtgatgcatggcgacgatgccccgcagcgtggcgatcgtttatacgttggtctgcaacatgcgcggctgtataacggcgatgagcgtattgaaacccgcgatgaggaacttgctctcgcacaaagcgcctga

SEQ ID NO: 5892 - protein, 365 aa, Escherichia coli
MSIEIANIKKSFGRTQVLNDISLDIPSGQMVALLGPSGSGKTTLLRIIAGLEHQTSGHIRFHGTDVSRLHARDRKVGFVFQHYALFRHMTVFDNIAFGLTVLPRRERPNAAAIKAKVTKLLEMVQLAHLADRYPAQLSGGQKQRVALARALAVEPQILLLDEPFGALDAQVRKELRRWLRQLHEELKFTSVFVTHDQEEATEVADRVVVMSQGNIEQADAPDQVWREPATRFVLEFMGEVNRLQGTIRGGQFHVGAHRWPLGYTPAYQGPVDLFLRPWEVDISRRTSLDSPLPVQVLEASPKGHYTQLVVQPLGWYNEPLTVVMHGDDAPQRGDRLYVGLQHARLYNGDERIETRDEELALAQSA

SEQ ID NO: 5893 - DNA, 876 bp, Escherichia coli
atggcggaagtgacacaattgaagcgttatgacgcgcgcccgattaactggggcaaatggtttctgattggcatcgggatgctggtatcggcgttcatcctgctggtaccgatgatttatatcttcgtacaggcgttcagcaaaggactgatgccggtgttacaaaatctggccgatccggacatgctgcacgccatctggctgacggtgatgatcgcgctgattgccgtaccggtaaacctggtgttcggtattctgctggcctggctggtgacgcgctttaacttccccggacgccagctattgctgacgctgctggacattccgtttgccgtgtcgccggtggttgctggtctggtgtatctgctgttctacggctctaacggcccgctgggcggctggctggatgaacataatctgcaaattatgttctcctggccgggtatggtgctggtcaccatcttcgtgacgtgtccgtttgtggtgcgcgaactggtaccggtaatgttaagtcagggcagccaggaagacgaagcggcgattttgcttggcgcgtccggctggcagatgttccgtcgcgtcacgctgccgaacatccgctgggcgctgctttacggcgtggtgctgaccaacgcccgcgcgattggcgagtttggcgcggtgtcggtggtttctggctcgattcgcggcgaaacactttcgctgccattacagattgaattgctggagcaggactacaacaccgttggctcctttaccgccgcggcgctgttgacgctgatggcgattatcaccctgtttttaaagagtatgttgcagtggcgcctggagaaccaggaaaaacgcgcgcagcaggaggaacatcatgagcattga

SEQ ID NO: 5894 - protein, 291 aa, Escherichia coli
MAEVTQLKRYDARPINWGKWFLIGIGMLVSAFILLVPMIYIFVQAFSKGLMPVLQNLADPDMLHAIWLTVMIALIAVPVNLVFGILLAWLVTRFNFPGRQLLLTLLDIPFAVSPVVAGLVYLLFYGSNGPLGGWLDEHNLQIMFSWPGMVLVTIFVTCPFVVRELVPVMLSQGSQEDEAAILLGASGWQMFRRVTLPNIRWALLYGVVLTNARAIGEFGAVSVVSGSIRGETLSLPLQIELLEQDYNTVGSFTAAALLTLMAIITLFLKSMLQWRLENQEKRAQQEEHHEH

SEQ ID NO: 5895 - DNA, 834 bp, Escherichia coli
atgtttgccgtttcttcaagacgcgtgctgccgggctttaccttaagcctcggcaccagtctgctgtttgtgtgcctgattttgctgctgccgctctccgcgctggtgatgcaactggcccagatgagctgggcgcagtactgggaggtgatcaccaacccgcaggtggtcgcagcctataaagtgacgctgctgtcggcgtttgtggcatcgatttttaacggcgttttcggtctgctgatggcgtggatcttaacccgctatcgctttccgggtcgcacgctgcttgatgcgctgatggatttaccctttgcgctgccaacggcagtcgccggtttaacgctggcctcgctcttttccgtgaacggtttttacggtgaatggctggcgaagtttgatatcaaagtcacctatacctggctggggattgcggtggcgatggcctttaccagcattccgtttgtggtgcgcaccgtgcagccggtgctggaagagttaggcccggaatatgaagaggcggcagaaacgctcggcgcaacacgctggcagagttttcgcaaagtggtgctgccggaactatctccggcgctggtggcgggtgtggcgctgtcatttacccgcagcctcggtgagtttggcgcggtgatttttatcgccgggaatatcgcctggaaaacagaagtgacgtcgctgatgatctttgttcgcttacaggagtttgattacccggcggcgagcgcgattgcctcggtgatcctcgcggcatcgctgctgttgctgttctcaattaacactctgcaaagtcgctttggtcggcgtgtggtaggtcattaa

SEQ ID NO: 5896 - protein, 277 aa, Escherichia coli
MFAVSSRRVLPGFTLSLGTSLLFVCLILLLPLSALVMQLAQMSWAQYWEVITNPQVVAAYKVTLLSAFVASIFNGVFGLLMAWILTRYRFPGRTLLDALMDLPFALPTAVAGLTLASLFSVNGFYGEWLAKFDIKVTYTWLGIAVAMAFTSIPFVVRTVQPVLEELGPEYEEAAETLGATRWQSFRKVVLPELSPALVAGVALSFTRSLGEFGAVIFIAGNIAWKTEVTSLMIFVRLQEFDYPAASAIASVILAASLLLLFSINTLQSRFGRRVVGH

SEQ ID NO: 5897 - DNA, 1017 bp, Escherichia coli
atggccgttaacttactgaaaaagaactcactcgtgctggttgcttctctgctactggcgggccatgtacaggcaacggaactgctgaacagttcttatgacgtctcccgcgagctgtttgccgccctgaacccgccgtttgagcaacaatgggcaaaagataacggtggcgacaaactgacgattaaacaatctcatgccggatcatcaaaacaggcgctggcaattttgcagggtttaaaagccgacgttgtcacttataaccaggtgaccgacgtacaaatcctgcacgataaaggcaagctgatcccagcggactggcagtcgcgcctgccgaataatagctcgccgttctactccaccatgggcttcctggtgcgtaagggcaacccgaagaatatccacgactggaacgacctggtacgctctgacgtgaagctgattttcccgaacccgaaaacgtcgggtaacgcgcgttatacctaccttgcggcatggggcgcagcggacaaagccgacggtggtgataaagccaaaaccgaacagtttatgacccagttcctgaaaaacgttgaagtgttcgatactggcggtcgtggcgcgaccaccacttttgccgagcgcggcctgggcgatgtgctgatcagcttcgagtcggaagtgaacaacatccgtaaacagtatgaagcgcagggctttgaagtggtgattccgaaaaccaacattctggcggaattcccggtggcgtgggtcgataaaaatgtgcaggccaacggcacggaaaaagcggcaaaagcctacctgaactggctctacagcccgcaggcgcaaaccatcatcaccgactattactaccgcgtaaataacccggaagtcatggacaaactgaaagataaattcccgcagaccgagctgttccgcgtggaagacaaatttggctcctggacggaagtgatgaaaacccacttcaccagcggcggcgagttagacaagctgttagcggcggggcgtaagtaa

SEQ ID NO: 5898 - protein, 338 aa, Escherichia coli
MAVNLLKKNSLVLVASLLLAGHVQATELLNSSYDVSRELFAALNPPFEQQWAKDNGGDKLTIKQSHAGSSKQALAILQGLKADVVTYNQVTDVQILHDKGKLIPADWQSRLPNNSSPFYSTMGFLVRKGNPKNIHDWNDLVRSDVKLIFPNPKTSGNARYTYLAAWGAADKADGGDKAKTEQFMTQFLKNVEVFDTGGRGATTTFAERGLGDVLISFESEVNNIRKQYEAQGFEVVIPKTNILAEFPVAWVDKNVQANGTEKAAKAYLNWLYSPQAQTIITDYYYRVNNPEVMDKLKDKFPQTELFRVEDKFGSWTEVMKTHFTSGGELDKLLAAGRK

SEQ ID NO: 5899 - DNA, 792 bp, Escherichia coli
atgggtaaactcacgggcaagacagcactgattacgggcgcattgcagggaattggcgaaggaattgccagaacttttgcgcgtcatggcgcaaacctaatcttgctggatatctcccctgagatcgaaaagctggcggacgaactgtgtggccgtggtcatcgctgtacggcggttgtcgccgatgtgcgtgacccggcgtcggtagccgcagctattaagcgcgctaaggaaaaagaagggcgcattgatattctggtgaataacgcaggcgtttgtcgtctgggcagtttccttgatatgagcgatgaagatcgcgatttccatattgatatcaatataaaaggcgtatggaacgtcacgaaggcggtgctgccggagatgattgcccgcaaagatggccggattgtgatgatgtcttcagtcactggcgatatggtggcagacccgggcgaaacggcgtacgccttaacgaaagcggcgattgttggcctgactaaatcgctggcggtggagtacgcgcagtctggtattcgcgttaacgccatctgccctggatacgttcgcacgccaatggcggaaagcattgcccgccagtcgaacccggaagatccagaatcggtgctgactgaaatggcgaaagcaatcccgatgcgtcgcctcgccgatccgctggaagtcggcgaactggcggccttcctcgcatcggatgaatccagctatttaaccggtacacagaatgtgattgatggcggcagcacactgccggagacggttagcgtcggcatctga

SEQ ID NO: 5900 - protein, 263 aa, Escherichia coli
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDEDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 5901 - DNA, 897 bp, Escherichia coli
atgcaacttgaaaagatgattaccgaaggctcgaacgccgcctcggctgaaattgaccgcgtatcaacgctggaaatgtgccggattatcaacgatgaagataaaaccgtaccactcgccgttgagcgcgtactgccggatatcgccgcggcgatcgatgttatccacacccaggtaagcggcggcggccgtctgatttatctcggtgcgggaacatccggtcgtctggggattctggatgccagcgaatgtccgccgacctacggcgtgaaaccgggcctggtagttggtttgattgctggcggcgaatatgccattcagcacgcggtggaaggcgcagaagatagccgggaaggtggtgttaatgatctgaaaaatattaatttaaccgcgcaggatgtggtggttggtattgcggccagcggacgcacgccttatgtgattgccgggctggaatacgcgcgccaactcggctgccgtacagtgggcatttcctgtaatccggggagtgccgtttcatccaccgcagagtttgctattacgccggtagttggtgccgaagttgttaccggttcttcgcgaatgaaagcaggcacggcgcagaaactggtgctcaacatgctctccaccgggctgatgattaaatccggcaaagtgttcggcaacctgatggtcgatgtggtcgccaccaacgaaaaactgcatgtgcgccaggtcaatatcgtcaaaaacgctaccggatgtaatgccgaacaagcggaagcggcgttaattgcttgcgagcgcaactgtaaaacggccattgtgatggtactgaaaaatctcgatgccgatgaagctaaaaaatgcctggatcaacacggcggttttattcgcaaggctctggaaaaggaataa

SEQ ID NO: 5902 - protein, 298 aa, Escherichia coli
MQLEKMITEGSNAASAEIDRVSTLEMCRIINDEDKTVPLAVERVLPDIAAAIDVIHTQVSGGGRLIYLGAGTSGRLGILDASECPPTYGVKPGLVVGLIAGGEYAIQHAVEGAEDSREGGVNDLKNINLTAQDVVVGIAASGRTPYVIAGLEYARQLGCRTVGISCNPGSAVSSTAEFAITPVVGAEVVTGSSRMKAGTAQKLVLNMLSTGLMIKSGKVFGNLMVDVVATNEKLHVRQVNIVKNATGCNAEQAEAALIACERNCKTAIVMVLKNLDADEAKKCLDQHGGFIRKALEKE

SEQ ID NO: 5903 - DNA, 1425 bp, Escherichia coli
atggctaaagagatcagcagtgaacttctgaacaccattcttacccgggtcggcggaccgggaaatatcgccagttgtggtaactgtatgacgcgcctgcgtctgggtgtacatgacagttcattggttgatcccgatatcaaaacgctggaaggcgtgaagggcgtcattttgaccagcgatcaggtgcaggtggtttttgggccaggcaaagcgcatcgtgccgcaaaagccatgagcgagctgctgggcgaggcaccggtacaggatgccgcagaaatcgccgcccagaataaacgccagttaaaagccagacaaacttccggcgtgcaacaatttctcgccaaattcgccaccatcttcacgccgctgatccccggttttattgccgccggtctgctgctggggatagcgacgttaattgccacggtgatgcacgttacggcagatgctcagggcacgctacccgatgcgctgaattttatgaaggtgttcagcaaaggcctgttcaccttcctggtaattctggtgggctataacgcggcccaggcatttggtggcacgggcgtaaatggcgcaattatcgctgcgctctttttgcttggttataacccaactgcaaccacgggttactacgccggatttcacgatttctttggtctgcccatcgatccgcgcggcaatattatcggcgtgttgatcgccgcgtgggcctgcgcccgcatcgaaggcatggtgcgccgctttatgcccgacgatctcgacatgctgctgacctcgttaatcaccctgctgatcaccgctacgcttgcgtacctgatcattatgccgctgggcggctggctgtttgaaggcatgtcgtggctgtttatgcacctgaacagtaatccgctcggttgtgcggttttagccgggctgttcctgatcgccgtggtatttggcgtgcatcagggctttattcctgtttatctggcgttaatggacagccagggattcaacagcttatttcccatcctttcaatggcaggcgcaggccaggtgggcgcggcgctggcgctctactggcgggcgcaaccgcacagtgcattacgcagtcaggtccgcggggcgattattcccggtctgcttggcgttggcgaaccgctgatttacggtgtcaccctgccccgcatgaaaccgtttgttaccgcctgtttaggcggcgcggcgggcggtttgtttatcggcctgatagcctggtggggtctgccgatgggcttaaacagcgccttcgggccgtctggtctggtggcgctgccgctgatgacttccgcgcaaggcatccttccggcaatggcggtttacgctggcggtattctggtggcatgggttagtgggtttattttcaccacactctttggctgccgtaacgtcaatctggactga

SEQ ID NO: 5904 - protein, 474 aa, Escherichia coli
MAKEISSELLNTILTRVGGPGNIASCGNCMTRLRLGVHDSSLVDPDIKTLEGVKGVILTSDQVQVVFGPGKAHRAAKAMSELLGEAPVQDAAEIAAQNKRQLKARQTSGVQQFLAKFATIFTPLIPGFIAAGLLLGIATLIATVMHVTADAQGTLPDALNFMKVFSKGLFTFLVILVGYNAAQAFGGTGVNGAIIAALFLLGYNPTATTGYYAGFHDFFGLPIDPRGNIIGVLIAAWACARIEGMVRRFMPDDLDMLLTSLITLLITATLAYLIIMPLGGWLFEGMSWLFMHLNSNPLGCAVLAGLFLIAVVFGVHQGFIPVYLALMDSQGFNSLFPILSMAGAGQVGAALALYWRAQPHSALRSQVRGAIIPGLLGVGEPLIYGVTLPRMKPFVTACLGGAAGGLFIGLIAWWGLPMGLNSAFGPSGLVALPLMTSAQGILPAMAVYAGGILVAWVSGFIFTTLFGCRNVNLD

SEQ ID NO: 5905 - DNA, 900 bp, Escherichia coli
atgtctcaggttcagagtggcattttgccagaacattgccgcgcggcgatttggatcgaagccaacgtgaaaggggaagttgacgccctgcgtgcggccagtaaaacatttgccgacaaactggcaacttttgaagcgaaattcccggacgcgcatcttggtgcggtggttgcctttggtaacaatacctggcgcgctctgagcggcggcgttggggccgaagagctgaaagattttccgggctacggtaaaggtcttgcaccgacgacccagttcgatgtgttgatccacattctttctctgcgtcacgacgtgaacttctctgtcgctcaggcggcgatggaagcctttggtgactgcattgaagtgaaagaagagatccacggcttccgttgggttgaagagcgtgacctgagcggctttgttgacggtacagaaaacccggcgggtgaagagacgcgccgcgaagtggctgttatcaaagacggcgtggatgcgggcggcagctatgtgtttgtgcagcgttgggagcacaacctgaaacagctcaatcggatgagcgttcacgatcaagagatgatgatcgggcgcaccaaagaggccaacgaagagattgacggcgacgaacgtccggaaacctctcacctgacccgcgttgatctgaaagaagatggcaaagggctgaagattgttcgtcagagcctgccgtacggcaccgccagtggcactcacggtctgtacttctgcgcctactgcgcgcgtctgcataacattgagcagcaactgctgagcatgtttggcgatactgatggtaagcgtgatgcgatgttgcgtttcaccaaaccggtcactggcggctattacttcgcaccgtcgctggacaagctgatggcgctgtaa

SEQ ID NO: 5906 - protein, 299 aa, Escherichia coli
MSQVQSGILPEHCRAAIWIEANVKGEVDALRAASKTFADKLATFEAKFPDAHLGAVVAFGNNTWRALSGGVGAEELKDFPGYGKGLAPTTQFDVLIHILSLRHDVNFSVAQAAMEAFGDCIEVKEEIHGFRWVEERDLSGFVDGTENPAGEETRREVAVIKDGVDAGGSYVFVQRWEHNLKQLNRMSVHDQEMMIGRTKEANEEIDGDERPETSHLTRVDLKEDGKGLKIVRQSLPYGTASGTHGLYFCAYCARLHNIEQQLLSMFGDTDGKRDAMLRFTKPVTGGYYFAPSLDKLMAL

SEQ ID NO: 5907 - DNA, 576 bp, Escherichia coli
atgaaatcgctgcgtttaatgttatgcgctatgccgttgatgctgaccggctgttccacgatgtcgtcagttaactggtcggccgctaacccgtggaactggtttggatcatccaccaaagtgagcgagcagggcgtgggtgaattaacggcgtccacaccactgcaagaacaagccattgctgatgcgcttgatggcgattatcgcctgcgcagcggaatgaaaaccgcgaacggcaacgtggtgcgcttttttgaagtgatgaaaggcgacaacgtggcgatggtgattaacggtgatcaaggcacgatcagccgcattgatgtgctggatagcgatattcctgctgacaccggtgttaaaatcggtacaccgtttagtgacctttacagcaaagcatttggcaattgccaaaaggccgacagtgatgataatcgtgccgtcgaatgtaaagccgaaggcagtcaacatattagctaccagttcagcggggaatggagtggtcctgaagggttaatgccttcggacgataccctgaaaaactggaaagtcagtaaaattatctggcggcgttaa

SEQ ID NO: 5908 - protein, 191 aa, Escherichia coli
MKSLRLMLCAMPLMLTGCSTMSSVNWSAANPWNWFGSSTKVSEQGVGELTASTPLQEQAIADALDGDYRLRSGMKTANGNVVRFFEVMKGDNVAMVINGDQGTISRIDVLDSDIPADTGVKIGTPFSDLYSKAFGNCQKADSDDNRAVECKAEGSQHISYQFSGEWSGPEGLMPSDDTLKNWKVSKIIWRR

SEQ ID NO: 5909 - DNA, 456 bp, Escherichia coli
ttgaagatgaagagtactgagttttatcctgtccattatgatgcgcacggtcgcctgcgtttacccttgctcttctggcttgtgctattgcttcaggcgcgaacctgggtgctgtttgtcattgccggagcgtcgcgcgagcagggtactgcgctgctaaatctgttttatcccgatcacgataatttctggctggggttgattcccggtattccggcggtgctggcatttttgctgagtggtcggcgggcttcatttccccgtatctggcatgtgctctattttctgttgctgttggcgcaagtggttttactttgttggcaaccgtggctgtggctgaacggtgaatccgttagcggtatcggtctggcactggtagtggcggatatcgtggcgttaatctggctgctgaccaatcgacgtttacgcgcttgttttaatgaagaaaaagaataa

SEQ ID NO: 5910 - protein, 151 aa, Escherichia coli
MKMKSTEFYPVHYDAHGRLRLPLLFWLVLLLQARTWVLFVIAGASREQGTALLNLFYPDHDNFWLGLIPGIPAVLAFLLSGRRASFPRIWHVLYFLLLLAQVVLLCWQPWLWLNGESVSGIGLALVVADIVALIWLLTNRRLRACFNEEKE

SEQ ID NO: 5911 - DNA, 537 bp, Escherichia coli
ttgacaactccccattatgccactttttcaaccgattttcgtcagatattggctaattcgaccgttcacgccataatcagccttttaacccgcaaaaaggtaacgaataccatggagatacgcgtatttcgccaggaagatttcgaagaggtcatcaccctttgggagcgttgcgacttgctgcgtccgtggaacgatccggaaatggacatcgagcgtaagatgaaccatgacgtcagtttgtttctggtcgctgaggtgaacggtgaagtggtcggaacggtgatgggcggttatgacgggcatcgcgggtctgcttattatcttggcgtgcatcccgagtttcgtgggcgtgggattgctaatgcgttgcttaatcggttggagaaaaagctgattgctcgcggctgtccgaaaattcagatcaacgtgccggaagataacgacatggtgctcggaatgtatgaacgcctgggatatgaacacgccgacgtgctgagtctgggtaagcgtttgattgaagatgaagagtactga

SEQ ID NO: 5912 - protein, 178 aa, Escherichia coli
MTTPHYATFSTDFRQILANSTVHAIISLLTRKKVTNTMEIRVFRQEDFEEVITLWERCDLLRPWNDPEMDIERKMNHDVSLFLVAEVNGEVVGTVMGGYDGHRGSAYYLGVHPEFRGRGIANALLNRLEKKLIARGCPKIQINVPEDNDMVLGMYERLGYEHADVLSLGKRLIEDEEY

SEQ ID NO: 5913 - DNA, 870 bp, Escherichia coli
atgagcacttttaaaccactaaaaacactcacttcgcgccgccaggtgctgaaagccggtttggctgccctgacgttgtcaggaatgtcgcaagccatcgccaaagaagaaccgttaaaaaccagtaacggacacagcaagccgaaagcaaaaaaaagcggcggcagacgtgtcgttgttctcgatccaggccacggcgggattgataccggagcgatcggacgcaacggttcgaaagaaaaacatgtggtgctggcaattgccaagaatgtccgttccatattgcgtaatcatggcattgatgcgcgtttaacgcgttctggcgatacgtttatcccactgtacgatcgcgttgaaatcgcccataaacacggcgcagacctgtttatgtcaattcacgccgacggttttaccaacccgaaagctgccggtgcttcggtatttgccctctctaaccgtggggcaagtagcgcaatggcgaaatacctgtctgaacgcgaaaaccgcgccgatgaagttgccggtaaaaaagcgactgacaaggatcacctattgcagcaagtgctgtttgatctggtgcaaaccgatactattaaaaacagcctgacgctcggctcgcatattctgaaaaagattaagccggtgcataaactgcacagccgcaataccgaacaagccgcgtttgtggtgttgaaatcgccgtcggttccgtcggtgctggtggaaacctcgtttatcaccaacccggaagaagagcggctgttaggcactgcagcgtttcgccagaaaatcgccacagcgattgccgaaggcgtgatcagttatttccactggtttgacaaccagaaagcacactcgagaaagcggtaa

SEQ ID NO: 5914 - protein, 289 aa, Escherichia coli
MSTFKPLKTLTSRRQVLKAGLAALTLSGMSQAIAKEEPLKTSNGHSKPKAKKSGGRRVVVLDPGHGGIDTGAIGRNGSKEKHVVLAIAKNVRSILRNHGIDARLTRSGDTFIPLYDRVEIAHKHGADLFMSIHADGFTNPKAAGASVFALSNRGASSAMAKYLSERENRADEVAGKKATDKDHLLQQVLFDLVQTDTIKNSLTLGSHILKKIKPVHKLHSRNTEQAAFVVLKSPSVPSVLVETSFITNPEEERLLGTAAFRQKIATAIAEGVISYFHWFDNQKAHSRKR

SEQ ID NO: 5915 - DNA, 900 bp, Escherichia coli
atgaaacccgacgcacaccaggttaaacagtttctgctcaaccttcaggatacgatttgtcagcagttgagcgccgtcgatggcgcagaatttgtcgaagatagctggcagcgcgaagctggcggcggcgggcgtagtcgggttttgcgtaatggtggtgttttcgaacaggcaggcgtcaacttttcacatgtccacggtgaggcgatgcctgcttccgccaccgctcatcgtccggaacttgccgggcgcagtttcgaggcgatgggcgtttcactggtagtgcatccgcataatccgtatgtccccaccagccacgcgaatgtgcgcttttttattgccgaaaagccgggtgcagagcccgtctggtggtttggcggcggcttcgatttaacccctttctatggttttgaagaagacgccattcactggcaccgcaccgcccgtgacctgtgcctgccatttggcgaagacgtttatccgcgttacaaaaagtggtgcgacgaatacttctacctcaaacatcgtaacgaacagcgcggcattggcgggctgttctttgatgatctgaacacgccagatttcgaccactgttttgcctttatgcaggcggtaggcaaaggctacaccgacgcttatttaccaattgtagagcgacgaaaagcgatggcctacggcgagcgcgagcgcaattttcagctctaccgtcgcggtcgttatgtcgagttcaatctggtctgggatcgcggcacgctgtttggcctgcaaactggcgggcgcaccgagtcgatcctgatgtcaatgccgccactggtacgctgggagtatgattatcagccaaaagatggcagcccggaagcggctttaagtgagtttattaaggtcagggattgggtgtaa

SEQ ID NO: 5916 - protein, 299 aa, Escherichia coli
MKPDAHQVKQFLLNLQDTICQQLSAVDGAEFVEDSWQREAGGGGRSRVLRNGGVFEQAGVNFSHVHGEAMPASATAHRPELAGRSFEAMGVSLVVHPHNPYVPTSHANVRFFIAEKPGAEPVWWFGGGFDLTPFYGFEEDAIHWHRTARDLCLPFGEDVYPRYKKWCDEYFYLKHRNEQRGIGGLFFDDLNTPDFDHCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 5917 - DNA, 1053 bp, Escherichia coli
atgaaaaagacccgtacagccaatttgcaccatctttatcatgaacccttacccgaaaacctgaagctcacgccgaaggtcgaagtggataatgttcatcaacgacagacaacggacgtctatgaacatgctttgacaattaccgcctggcagcagatttacgatcaactgcatccgggcaagtttcatggtgaatttacggaaattctactcgatgatattcaggtttttcgtgaatacactggtctggcgctgcgtcagtcgtgcctggtctggccgaactcgttctggtttggcattccggcgacgcgcggtgagcagggatttatcggttcgcaatgtctgggaagcgcagaaattgcgacgcgccctggtggaaccgagtttgaattaagtacgccggacgattacacgatccttggcgtagtgctttctgaagatgtcatcactcgtcaggctaactttttgcataatccggatcgggtattacatatgctgcgtagccagtcggcgctggaagtgaaagagcagcataaagccgctctgtggggctttgtccaacaggcgctggcgacgttttgcgaaaacccggaaaatctccatcagcctgcagtgcgaaaagtgctgggggataatttgctaatggcgatgggggcgatgctggaagaagcgcagccaatggtgacggcggaaagcatcagtcatcagagttaccgtcgattgctttcccgcgcccgtgaatatgtgctggaaaacatgtccgaaccggtgacggtgctggacttgtgtaatcaactgcatgtcagccgccgcacgctacaaaacgcgtttcacgccattttgggcattggtccgaacgcgtggctgaaacgtattcgcctgaacgccgtgcgccgcgaactcataagtccgtggtcacaaagcacaacggtaaaagacgccgccatgcagtggggattctggcatcttgggcaatttgccacggattatcagcaactgtttgccgagaagccgtcactgacgctgcatcagcggatgcgagagtgggggtga

SEQ ID NO: 5918 - protein, 350 aa, Escherichia coli
MKKTRTANLHHLYHEPLPENLKLTPKVEVDNVHQRQTTDVYEHALTITAWQQIYDQLHPGKFHGEFTEILLDDIQVFREYTGLALRQSCLVWPNSFWFGIPATRGEQGFIGSQCLGSAEIATRPGGTEFELSTPDDYTILGVVLSEDVITRQANFLHNPDRVLHMLRSQSALEVKEQHKAALWGFVQQALATFCENPENLHQPAVRKVLGDNLLMAMGAMLEEAQPMVTAESISHQSYRRLLSRAREYVLENMSEPVTVLDLCNQLHVSRRTLQNAFHAILGIGPNAWLKRIRLNAVRRELISPWSQSTTVKDAAMQWGFWHLGQFATDYQQLFAEKPSLTLHQRMREWG

SEQ ID NO: 5919 - DNA, 501 bp, Escherichia coli
atgatcaatgcactgggattgctggaagtggacggcatggtcgccgcgatagatgcagctgatgccatgctcaaagcagctaacgttcgtctgctcagtcacgaagtgcttgaccctggtcgcctaacgctggtggtggaaggcgatctggcggcgtgtcgtgcggcgctggacgcaggttgtgctgccgcgatgcgtaccgggcgtgtcatcagccgtaaggagatcggtcggccagacgatgacacccagtggctggttactggctttaaccgccagccgaagcaacccgtaaaggaacccgacgcgccagttatcgtcgcggaatctgctgacgagttgttggcgctgttaacatcagtacgtcagggaatgacggcaggagaagtggctgcccactttggctggccgctggaaaaagccagaaatgcgctcgaacagctcttttctgccgggacgttacgtaaacgcagtagtcgttaccgtctcaagccccattaa

SEQ ID NO: 5920 - protein, 166 aa, Escherichia coli
MINALGLLEVDGMVAAIDAADAMLKAANVRLLSHEVLDPGRLTLVVEGDLAACRAALDAGCAAAMRTGRVISRKEIGRPDDDTQWLVTGFNRQPKQPVKEPDAPVIVAESADELLALLTSVRQGMTAGEVAAHFGWPLEKARNALEQLFSAGTLRKRSSRYRLKPH

SEQ ID NO: 5921 - DNA, 660 bp, Escherichia coli
atgccagctttagatttgattcgaccgtcggtaaccgccatgcgggtgattgcctccgttaacgccgaatttgcacgtgaactgaaattgccgccgcatattcgtagcctcgggctgatttctgctgattcagatgacgtcacctacattgcggctgacgaagcgaccaagcaggcgatggtcgaagtggtatatggtcgctcgctgtatgcgggcgctgcacacggcccgtcaccgactgccggtgaggtgctgattatgcttggtggaccaaacccggcggaagtgcgtgctggtctggatgcgatggttgcgaatattgaaaatggcgctgctttccagtgggcaaacgacgcagaaaacacagccttcctggcacatgtagtttcgcgtaccggttcttatctctcatcaaccgccgggatcacgcttggcgatccgatggcgtatctggtggcaccgccgctggaagcgacctacggcattgatgcagcgttgaaatctgccgacgtgcagttggtgacctatgtcccgccaccgtctgaaaccaactactcggcagcatttttaaccggtagccaggccgcgtgtaaagcagcctgtaacgcctttaccgatgcagtgctggaaatcgcgcgtaatccaatccagcgtgcgtaa

SEQ ID NO: 5922 - protein, 219 aa, Escherichia coli
MPALDLIRPSVTAMRVIASVNAEFARELKLPPHIRSLGLISADSDDVTYIAADEATKQAMVEVVYGRSLYAGAAHGPSPTAGEVLIMLGGPNPAEVRAGLDAMVANIENGAAFQWANDAENTAFLAHVVSRTGSYLSSTAGITLGDPMAYLVAPPLEATYGIDAALKSADVQLVTYVPPPSETNYSAAFLTGSQAACKAACNAFTDAVLEIARNPIQRA

SEQ ID NO: 5923 - DNA, 888 bp, Escherichia coli
atggatcaaaaacagattgaagaaattgtacgcagcgtgatggcgtcaatgggacaagcggcccccgcgccgtcagaagcaaagtgcgccaccaccaactgtgcggcaccggtgacctcggaaagctgcgcgctggatttaggttctgcggaagcaaaagcgtggattggtgttgaaaacccgcatcgcgcagacgtattaacagaactgcgtcgcagcaccgtggcccgcgtttgtaccggtcgtgccggtccgcgtccgcgcacccaggcgttgctgcgtttcctggccgatcactctcgttcgaaagataccgttctgaaagaagtaccggaagagtgggtgaaagcgcagggcttgctggaagtccgctccgaaatcagcgacaaaaatctctacctgactcgtccggatatgggccgccgcctgtgtgcagaagctgttgaagcgctgaaagcacagtgtgttgctaatccggacgtgcaggtcgttatttctgatggcctgtcaactgatgcgatcaccgtgaactacgaagagatcctgccgccgctgatggcgggcctgaagcaagccgggctgaaagtcggtacgccattctttgtacgttatggtcgcgtgaagattgaagatcagatcggtgagatcctaggcgcgaaagtagtgatcctgctggtgggcgaacgtccggggttggggcagtcagaaagcctctcctgctacgccgtttactcgccgcgtatggcgaccaccgttgaggccgatcgcacctgtatatctaatattcaccagggcggcacgccgccggttgaagccgcagccgtcattgtggatttggcgaaacgtatgctggagcagaaagcatccggcatcaacatgacccgataa

SEQ ID NO: 5924 - protein, 295 aa, Escherichia coli
MDQKQIEEIVRSVMASMGQAAPAPSEAKCATTNCAAPVTSESCALDLGSAEAKAWIGVENPHRADVLTELRRSTVARVCTGRAGPRPRTQALLRFLADHSRSKDTVLKEVPEEWVKAQGLLEVRSEISDKNLYLTRPDMGRRLCAEAVEALKAQCVANPDVQVVISDGLSTDAITVNYEEILPPLMAGLKQAGLKVGTPFFVRYGRVKIEDQIGEILGAKVVILLVGERPGLGQSESLSCYAVYSPRMATTVEADRTCISNIHQGGTPPVEAAAVIVDLAKRMLEQKASGINMTR

SEQ ID NO: 5925 - DNA, 1362 bp, Escherichia coli
atgaaactaaagaccacattgttcggcaatgtatatcagtttaaggatgtaaaagaggtgctggctaaagccaacgaactgcgttcgggggatgtgctggcgggcgttgctgcggcaagctcacaggagcgcgtggcggcaaagcaggtgttgtcggaaatgaccgtagcggacatccgcaataatccggtgattgcctatgaagatgactgcgtgacgcggctgattcaggacgacgttaacgaaacggcctacaaccagattaaaaactggagcatcagcgaactgcgtgagtatgtgctgagcgatgaaaccagcgtggacgacattgcctttacccgcaaagggctgacctcggaagtggtggcggcggtagcgaagatttgctccaacgcggacctgatctacggcgcgaagaaaatgccggtgatcaaaaaggccaataccaccattggtattccgggcacctttagcgcccgtttgcagccgaatgatacccgtgacgacgtgcaaagtatcgccgcgcaaatctacgaagggctttccttcggggtgggcgatgcggtgatcggcgttaacccggtgactgacgacgtggaaaacttaagccgcgtgttggataccatctatggcgtgatcgacaaattcaacatcccaactcagggctgcgtactggcgcacgtcaccacccagatcgaagcgatccgtcgtggcgcaccaggcgggctgattttccagagtatctgcggcagcgaaaaagggctgaaagagtttggcgtagagctggcgatgctcgctgaagcacgcgcagtgggcgcggagttcaaccgtatcgccggggaaaactgtctctacttcgaaaccggacaaggctcggcgctatccgctggcgctaacttcggcgcagaccaggtgacgatggaagcgcgtaactatgggctggcgcgtcattacgatccgtttatcgtcaacaccgtggtcggttttattgggccggagtatctctacaacgaccgccagattatccgcgcaggcttagaagatcactttatgggtaagctgagcggcatctctatgggctgtgactgctgctacaccaaccacgctgacgctgaccagaacctcaacgaaaacctgatgatcctgctcgccaccgcaggctgcaactacatcatggggatgccgctgggcgatgacatcatgctcaactatcagaccaccgcattccacgacacagccactgtgcgtcagttactcaacctgcgcccgtcaccggagtttgaacgctggctggaaagcatgggcattatggcaaacggtcgcctgaccaaacgggcgggcgatccgtcactgttcttctga

SEQ ID NO: 5926 - protein, 453 aa, Escherichia coli
MKLKTTLFGNVYQFKDVKEVLAKANELRSGDVLAGVAAASSQERVAAKQVLSEMTVADIRNNPVIAYEDDCVTRLIQDDVNETAYNQIKNWSISELREYVLSDETSVDDIAFTRKGLTSEVVAAVAKICSNADLIYGAKKMPVIKKANTTIGIPGTFSARLQPNDTRDDVQSIAAQIYEGLSFGVGDAVIGVNPVTDDVENLSRVLDTIYGVIDKFNIPTQGCVLAHVTTQIEAIRRGAPGGLIFQSICGSEKGLKEFGVELAMLAEARAVGAEFNRIAGENCLYFETGQGSALSAGANFGADQVTMEARNYGLARHYDPFIVNTVVGFIGPEYLYNDRQIIRAGLEDHFMGKLSGISMGCDCCYTNHADADQNLNENLMILLATAGCNYIMGMPLGDDIMLNYQTTAFHDTATVRQLLNLRPSPEFERWLESMGIMANGRLTKRAGDPSLFF

SEQ ID NO: 5927 - DNA, 1404 bp, Escherichia coli
gtgaacactcgccagctactgagcgtcggtatcgatatcggcaccaccaccacccaggtgatcttctcccacctggagctggttaaccgtgcggcggtgtcgcaggtgccgcgctacgaattcatcaaacgcgaaattagctggcaaagcccggtgttttttacccctgtcgataaacagggtggtttaaaagaagcggaactgaaaaccttaatcctcgagcaatatcaggctgcgggcattgcgccggaaagcgttgattctggtgccatcattatcaccggtgaaagcgcaaaaacccgcaacgctcgcccggcggtgatggcgctctcccggtcgctgggcgattttgtcgtcgccagcgccgggccgcatcttgaatccgtgatcgccggacacggtgccggggcgcaaaccctttctgaacaacggctgtgtcgggtcctgaatatcgatatcgggggtggcaccgcgaactacgccctgttcgatgccggaaaaatcagcggcactgcctgcctcaacgtcggcggtcgcctgctggaaaccgacagccaggggcgcgtggtttacgctcataaaccggggcagatgattgtggatgagtgcttcggtgccggtactgacgcccgttcgctgaccggcgcgcagctggtgcaggttactcgccggatggcagagctgattgtcgaagtgattgacggaacgctctcgccgctcgcgcaggcattgatgcaaaccggtttgctgcccgcaggtgttacgcccgaaatcattacgctttctggcggcgtgggcgaatgttatcgccaccagcccgccgacccgttctgttttgccgatataggcccgcttctggcaacggcgctgcatgaccatccgcgtctgcgtgagatgaacgtgcagtttccggcgcaaaccgtgcgcgccacggtgattggcgcgggtgctcataccctttcgctctctggcagcacaatctggctggagggcgtacaactgccgctgcgcaatttgccggtggcgatcccgattgatgaaacggatctggtcagtgcctggcaacaggcgctgattcaactggatctttgccccaaaactgacgcgtatgtgctggcgcttcccgcctcgctgcctgtgcgttacgccgcggtactgacggtcatcaacgcgctggtcgatttcgtcgcgcgttttccgaatccgcatcccctgctggtggtggccgggcaggactttggtaaagctctgggcatgttgttgcgcccacagctacaacaactcccgttggcagtcattgacgaagtgattgtccgcgcgggggactatatcgacattggtacgcctctttttggcggatcggttgtgccggtgacggtgaaatcactcgcatttccttcctga

SEQ ID NO: 5928 - protein, 467 aa, Escherichia coli
MNTRQLLSVGIDIGTTTTQVIFSHLELVNRAAVSQVPRYEFIKREISWQSPVFFTPVDKQGGLKEAELKTLILEQYQAAGIAPESVDSGAIIITGESAKTRNARPAVMALSRSLGDFVVASAGPHLESVIAGHGAGAQTLSEQRLCRVLNIDIGGGTANYALFDAGKISGTACLNVGGRLLETDSQGRVVYAHKPGQMIVDECFGAGTDARSLTGAQLVQVTRRMAELIVEVIDGTLSPLAQALMQTGLLPAGVTPEIITLSGGVGECYRHQPADPFCFADIGPLLATALHDHPRLREMNVQFPAQTVRATVIGAGAHTLSLSGSTIWLEGVQLPLRNLPVAIPIDETDLVSAWQQALIQLDLCPKTDAYVLALPASLPVRYAAVLTVINALVDFVARFPNPHPLLVVAGQDFGKALGMLLRPQLQQLPLAVIDEVIVRAGDYIDIGTPLFGGSVVPVTVKSLAFPS

SEQ ID NO: 5929 - DNA, 1227 bp, Escherichia coli
atgggaattaacgaaatcatcatgtacatcatgatgttctttatgctgatagctgccgtagacaggatcctgtcgcagttcggcggttctgctcgtttcctcggtaagttcggtaaaagtatcgaaggatccggcggtcagttcgaagaaggctttatggcaatgggcgctctgggcctggcgatggtcggtatgaccgcactggcaccggtactggcccacgttctcggaccggtgattatcccggtttacgaaatgctcggcgcaaacccgtcaatgttcgccggaacactgctggcgtgcgatatgggcggcttcttcctcgccaaagagctggcgggcggtgacgtagcagcgtggctatactctgggttaattctcgggtcgatgatggggccaacgattgtgttttccattccagtggcgctcggcattatcaaaccttctgaccgtcgttatctggcgctcggcgtgctggcgggcatagtgaccattccgattggctgtatcgctggtggtctggtagcgatgtactccggtgtgcagatcaacggccagcctgttgaattcacctttgcgctgatcctgatgaacatgatcccggtacttatcgttgcggtgctggtggcgctgggactgaaattcatcccggaaaaaatgatcaacggcttccagatcttcgccaaattcctcgttgcattgatcaccctcggtcttgccgctgcggtagtgaaattcctccttggctgggaactgatcccgggtcttgatcctatctttatggcccctggcgataaacccggtgaagtgatgcgcgccattgaagttatcggctcgatctcctgcgttctgttaggggcgtatccgatggtactgctgctgactcgctggtttgaaaaaccgctgatgagtgtcggtaacgtgctgaatatgaacaatatcgcggcagccggcatggtggcaacgcttgccaacaacattccgatgtttggcatgatgaagcagatggatacccgcggcaaagtcatcaactgcgccttcgccgtttccgctgctttcgccctgggcgaccatttaggcttcgccgctgccaacatgaacgccatgatcttcccgatgattgtcggcaaattgatcggcggcgtaacggcaattggcgtggcgatgatgctggtgccaaaagaagacgcgaccgcggctaaaactgaagcggaggcgcaatcgtga

SEQ ID NO: 5930 - protein, 408 aa, Escherichia coli
MGINEIIMYIMMFFMLIAAVDRILSQFGGSARFLGKFGKSIEGSGGQFEEGFMAMGALGLAMVGMTALAPVLAHVLGPVIIPVYEMLGANPSMFAGTLLACDMGGFFLAKELAGGDVAAWLYSGLILGSMMGPTIVFSIPVALGIIKPSDRRYLALGVLAGIVTIPIGCIAGGLVAMYSGVQINGQPVEFTFALILMNMIPVLIVAVLVALGLKFIPEKMINGFQIFAKFLVALITLGLAAAVVKFLLGWELIPGLDPIFMAPGDKPGEVMRAIEVIGSISCVLLGAYPMVLLLTRWFEKPLMSVGNVLNMNNIAAAGMVATLANNIPMFGMMKQMDTRGKVINCAFAVSAAFALGDHLGFAAANMNAMIFPMIVGKLIGGVTAIGVAMMLVPKEDATAAKTEAEAQS

SEQ ID NO: 5931 - DNA, 1188 bp, Escherichia coli
atgcaaagtgaattgcaaacggcgctttttcaggcgttcgataccctgaatctgcaacgggtaaaaacatttagcgttccaccggtgacgctttgcggtccgggcgcggtgagcagttgcgggcagcaagcgcaaacgcgtgggttgaaacatctgttcgtgatggcagacagctttttgcatcaggcagggatgaccgccgggctgacacgtagcctggccgttaaaggtatcgccatgacgctctggccatgtccggtgggcgaaccgtgcatcaccgacgtgtgtgcagccgtggcgcagttgcgtgaatcaggttgtgacggggtgatcgcgtttggcggcggctcggtgctggatgcggcgaaagccgttgcgttgctggtgacgaaccccgatagcacgctggcagaaatgtcagaaaccagcgtcctgcaaccgcgcctgccgttgattgccattccaacgaccgccggaaccggctctgaaacgactaacgtgacggtgattatcgatgcggtaagcgggcgcaaacaggtgttagcccatgcctcgctgatgccggatgtggcgattctcgacgctgcgctgaccgaaggcgtgccgtcgcatgtcacggcgatgactggcattgatgcgttaacccatgccattgaagcgtacagcgcgctgaacgctacaccgtttaccgacagcctggcgattggtgccattgcgatgattggcaaatcactgccgaaagcggtgggctacggccatgaccttgccgcgcgcgagagcatgttgctggcttcatgtatggcgggaatggcgttttccagcgccgggcttgggttatgccacgcgatggcgcatcagccaggggcggcgctgcatattccgcacggtctggcgaacgccatgttgttgccaacggtgatggaatttaaccggatggtttgtcgtgatcggtttagtcagattggtcgggcgctgcgaactaaaaaatccgacgatcgtgacgctattaacgcggtaagtgagctgattgctgaagttgggattggtaaacgactgggcgatgttggtgcgacatctgcgcattacggcgcatgggcgcaggccgcgctggaagatatttgtctgcgcagtaacccgcgtaccgccagcctggagcagattgtcggcctgtacgcagcggcgcaataa

SEQ ID NO: 5932 - protein, 395 aa, Escherichia coli
MQSELQTALFQAFDTLNLQRVKTFSVPPVTLCGPGAVSSCGQQAQTRGLKHLFVMADSFLHQAGMTAGLTRSLAVKGIAMTLWPCPVGEPCITDVCAAVAQLRESGCDGVIAFGGGSVLDAAKAVALLVTNPDSTLAEMSETSVLQPRLPLIAIPTTAGTGSETTNVTVIIDAVSGRKQVLAHASLMPDVAILDAALTEGVPSHVTAMTGIDALTHAIEAYSALNATPFTDSLAIGAIAMIGKSLPKAVGYGHDLAARESMLLASCMAGMAFSSAGLGLCHAMAHQPGAALHIPHGLANAMLLPTVMEFNRMVCRDRFSQIGRALRTKKSDDRDAINAVSELIAEVGIGKRLGDVGATSAHYGAWAQAALEDICLRSNPRTASLEQIVGLYAAAQ

SEQ ID NO: 5933 - DNA, 837 bp, Escherichia coli
atggcgcacgatgaacaatggctcaccccacgtctgcaaacggcggcaacgctgtgtaaccagacgcctgccgcgacggaatctccgctgtggctgggggtggatctgggcacttgcgatgtggtgtcgatggttgtcgaccgcgacggtcagccggtggcggtatgcctcgactgggccgatgtggtccgcgacggcatcgtctgggatttcttcggtgcggtcaccattgttcgtcgccatctcgacacccttgagcagcaattcggtcgccgttttagccatgcggcgacctcatttcctcctggtacggacccgcgtatttccatcaacgtgctggagtctgctggactggaagtgagccatgtgctggatgagccaaccgcagtcgcggatctgctgcaactggacaacgccggtgtagtggatatcggcggtggcactactggtattgccatcgtgaaaaagggcaaggtgacgtactcggcggatgaagccaccggcggacatcacatctctctgactctcgccggaaatcgccgtatttcgctggaagaggcagagcagtacaaacgcggtcacggtgacgagatttggcccgcggtgaaaccggtgtacgaaaaaatggcggacattgtggcccggcatattgaagggcagggcattacggatttatggctggcgggcggttcctgtatgcaaccgggcgtagctgcgctgttttgcaaacaatttccggcgttacaggtgcatttaccgcagcacagtttgtttatgaccccgctggcaatcgccagtagtgggcgagagaaagcggaggggatctatgcaaagtga

SEQ ID NO: 5934 - protein, 278 aa, Escherichia coli
MAHDEQWLTPRLQTAATLCNQTPAATESPLWLGVDLGTCDVVSMVVDRDGQPVAVCLDWADVVRDGIVWDFFGAVTIVRRHLDTLEQQFGRRFSHAATSFPPGTDPRISINVLESAGLEVSHVLDEPTAVADLLQLDNAGVVDIGGGTTGIAIVKKGKVTYSADEATGGHHISLTLAGNRRISLEEAEQYKRGHGDEIWPAVKPVYEKMADIVARHIEGQGITDLWLAGGSCMQPGVAALFCKQFPALQVHLPQHSLFMTPLAIASSGREKAEGIYAK

SEQ ID NO: 5935 - DNA, 1404 bp, Escherichia coli
atgaatcaacaggatattgaacaggtggtgaaagcggtactgctgaaaatgcaaagcagtgacacgccgcccgccgccgttcatgagatgggcgttttcgcgtccctggatgacgccgttgcggcagccaaagtcgcccagcaagggttaaaaagcgtggcaatgcgccagttagccattgctgccattcgtgaagcaggcgaaaaacacgccagagatttagcggaacttgccgtcagtgaaaccggcatggggcgcgttgaagataaatttgccaaaaacgtcgctcaggcgcgcggcacaccaggcgttgagtgcctctctccgcaagtgctgactggcgacaacggcctgaccctaattgaaaacgcaccctggggcgtggtggcttcggtgacgccttccactaacccggcggcaaccgtaattaacaacgccatcagcctgattgccgcgggcaacagcgtcatttttgccccgcatccggcggcgaaaaaagtctcccagcgggcgatcacgctgctcaaccaggcgattgttgccgcaggcgggccggaaaacttactggttaccgtagcaaatccggatatcgaaaccgcgcaacgcttgttcaagtttccgggtatcggcctgctggtggtgaccggcggcgaagcggtagtggaagcggcgtgcaaacacaccaataaacgtctgattgccgcaggcgctggcaacccgccggtagtggtggatgaaaccgccgacctcgcccgtgctgctcagtccatcgtcaaaggcgcgtctttcgataacaacatcatttgtgccgacgaaaaggtactgattgttgttgatagcgtagccgatgaactgatgcgtctgatggaaggccagcatgcggtgaaactgaccgcagagcaggcgcagcaactgcaaccggtgttgctgaaaaatatcgacgagcgcggaaaaggcaccgtcagccgtgactgggttggtcgcgatgcggcgaaaatcgcggcggcaatcggccttaaagttccggaacaaacgcgactgctgtttgtagaaaccaccgcagaacatccgtttgccgtgaccgaactgatgatgccggtgctgcccgtcgtgcgcgtcgccaacgtggcggatgccattgcgctggcggtgaaactggaaggcggttgccaccacacggcggcaatgcactcgcgcaatatcgaaaacatgaaccagatggcgaacgccattgataccagcattttcgttaagaacggaccgtgtattgccgggctggggctgggcggggaaggctggaccacgatgaccatcaccacgccaaccggtgaaggggtaaccagcgcgcggacgtttgtccgtctgcgtcgctgtgtattagtcgatgcgtttcgcattgtttaa

SEQ ID NO: 5936 - protein, 467 aa, Escherichia coli
MNQQDIEQVVKAVLLKMQSSDTPPAAVHEMGVFASLDDAVAAAKVAQQGLKSVAMRQLAIAAIREAGEKHARDLAELAVSETGMGRVEDKFAKNVAQARGTPGVECLSPQVLTGDNGLTLIENAPWGVVASVTPSTNPAATVINNAISLIAAGNSVIFAPHPAAKKVSQRAITLLNQAIVAAGGPENLLVTVANPDIETAQRLFKFPGIGLLVVTGGEAVVEAACKHTNKRLIAAGAGNPPVVVDETADLARAAQSIVKGASFDNNIICADEKVLIVVDSVADELMRLMEGQHAVKLTAEQAQQLQPVLLKNIDERGKGTVSRDWVGRDAAKIAAAIGLKVPEQTRLLFVETTAEHPFAVTELMMPVLPVVRVANVADAIALAVKLEGGCHHTAAMHSRNIENMNQMANAIDTSIFVKNGPCIAGLGLGGEGWTTMTITTPTGEGVTSARTFVRLRRCVLVDAFRIV

SEQ ID NO: 5937 - DNA, 288 bp, Escherichia coli
atgaaactggcagtcgtcactggacaaattgtttgtaccgtacgccatcacggactggcgcatgacaaattgctgatggtggaaatgattgatccacaaggtaatcctgacgggcaatgcgccgtcgccatcgacaatattggcgcgggaaccggggagtgggtgttactggtgagtggcagttccgcccgccaggcgcataaaagcgaaacgtcaccggtcgatctgtgcgtgattggcatcgtcgatgaggtggtgtctggcggtcaggtcattttccacaaataa

SEQ ID NO: 5938 - protein, 95 aa, Escherichia coli
MKLAVVTGQIVCTVRHHGLAHDKLLMVEMIDPQGNPDGQCAVAIDNIGAGTGEWVLLVSGSSARQAHKSETSPVDLCVIGIVDEVVSGGQVIFHK

SEQ ID NO: 5939 - DNA, 336 bp, Escherichia coli
atgaacggtcccgttctggaccctgataaagaggaaagcacaatggaagcattaggaatgatcgaaacccggggcctggttgcactgatagaggcttctgacgcgatggttaaagctgcgcgcgtcaagctggttggtgttaagcagattggcggcggcctgtgtactgccatggttcgtggtgatgttgcagcctgtaaagccgcgaccgatgcaggtgccgcagcggcacagcgtatcggcgagctggtatctgtacacgttatcccgcgtccgcacggcgacctggaagaagtcttcccgatcggcctgaaaggcgatagcagcaacctgtaa

SEQ ID NO: 5940 - protein, 111 aa, Escherichia coli
MNGPVLDPDKEESTMEALGMIETRGLVALIEASDAMVKAARVKLVGVKQIGGGLCTAMVRGDVAACKAATDAGAAAAQRIGELVSVHVIPRPHGDLEEVFPIGLKGDSSNL

SEQ ID NO: 5941 - DNA, 1017 bp, Escherichia coli
atgattattaaacgttgtcgtgaactggcgttgcgagcgcccgccagagtagtttttccggatgcgttagatcaacgtgtgctgaaagctgcgcaatatttacatcaacaaggtctggcaacgcccattctggtcgccaatccgtttgaacttcgtcagtttgcgctcagtcacggcgtggcgatggacgggctacaggtgatagatccgcatggcaacctcgcaatgcgggaagaatttgctcatcgctggctggcccgcgcgggcgaaaaaacgccgccggatgcgctggaaaaacttaccgatccgctgatgttcgccgccgcaatggtcagcgccggtaaagcggatgtctgtatcgcgggcaacctctcttccacggcgaatgtgctgcgtgccggattacgcattatcggcttgcagccaggctgtaaaacgctctcatccattttcctgatgctgccacagtacagcggtccggcgttgggctttgccgattgcagcgtggtgccgcagccgacggcggcacaactggcggatatcgcgcttgccagcgccgaaacctggcgcgccatcaccggagaagaaccgcgcgtggcgatgctgtcgttttccagtaacggtagtgcccgtcacccctgcgttgccaacgtccagcaggcgacagaaatcgtccgtgagcgcgcaccaaagctggttgtcgatggcgagttgcagtttgacgccgccttcgtgccggaagtggcggcgcaaaaagcgcctgccagcccgttacagggcaaagctaatgtgatggtttttccgtcgctggaagtcggaaatattggctacaaaatcgcacaacgacttggcggatatcgtgccgtcgggccattgatacaaggacttgccgcgccgatgcacgatctctctcgtggttgtagcgtgcaggaaattatcgaactggcgctggtggcagctgtgccgcgtcagacagaagtgaaccgcgaaagcagtttacaaacactggttgaatga

SEQ ID NO: 5942 - protein, 338 aa, Escherichia coli
MIIKRCRELALRAPARVVFPDALDQRVLKAAQYLHQQGLATPILVANPFELRQFALSHGVAMDGLQVIDPHGNLAMREEFAHRWLARAGEKTPPDALEKLTDPLMFAAAMVSAGKADVCIAGNLSSTANVLRAGLRIIGLQPGCKTLSSIFLMLPQYSGPALGFADCSVVPQPTAAQLADIALASAETWRAITGEEPRVAMLSFSSNGSARHPCVANVQQATEIVRERAPKLVVDGELQFDAAFVPEVAAQKAPASPLQGKANVMVFPSLEVGNIGYKIAQRLGGYRAVGPLIQGLAAPMHDLSRGCSVQEIIELALVAAVPRQTEVNRESSLQTLVE

SEQ ID NO: 5943 - DNA, 804 bp, Escherichia coli
atgaaagatttcatcaccgaagcatggctaagagcgaaccatacgctcagcgaaggcgcagagatccatctccctgcggacagtcgcctgacgccctctgcccgggagttactggaaagccgccatctgcgcatcaagtttattgacgagcagggccgcctgtttgttgacgatgaacagcagcagccgcagcccgttcacgggctgaccagtagcgatgaacatccgcaggcgtgctgcgaactgtgccgccagccggtagcaaaaaagccggatacgctgactcacctgtcggcggaaaaaatggtcgccaaaagcgatccgcgcctggcttttcgcgctgttctcgacagcaccattgcgctggcagtgtggctgcaaattgaactggcggaaccgtggcagccgtggctggcggatatccgttcgcgtcttggcaacattatgcgtgccgatgcgctgggggaaccgctggcctgccaggcgattgtcgggctttctgacgaagatctgcatcggctttctcaccagccgctgcgttatctcgaccacgatcatctggtgccggaagccagccacgggcgcgatgcggcgttgctgaatctgctacgcaccaaagtgcgggaaaccgaaaccgtagcggcgcaggtctttatcacccgcagctttgaagtattacgcccggacattttgcaggcgctgaaccgcctttccagcacggtctacgtgatgatgatcctgagcgtaacgaagcagccgctaacggtgaagcagatccaacaacgactgggggaaacgcaatga

SEQ ID NO: 5944 - protein, 267 aa, Escherichia coli
MKDFITEAWLRANHTLSEGAEIHLPADSRLTPSARELLESRHLRIKFIDEQGRLFVDDEQQQPQPVHGLTSSDEHPQACCELCRQPVAKKPDTLTHLSAEKMVAKSDPRLAFRAVLDSTIALAVWLQIELAEPWQPWLADIRSRLGNIMRADALGEPLACQAIVGLSDEDLHRLSHQPLRYLDHDHLVPEASHGRDAALLNLLRTKVRETETVAAQVFITRSFEVLRPDILQALNRLSSTVYVMMILSVTKQPLTVKQIQQRLGETQ

SEQ ID NO: 5945 - DNA, 702 bp, Escherichia coli
gtgaaaaaactcatcacagcgaatgatattcgtgaagcacacgcgcgcggcgaactggcaatgtccgtggttctgcgcgccagcattattaccccggaagctcgtgaaatggctgatctgttgggttttaccatcaccgaatgtgatgaatcgatcccggtaacggcgtctgttcccgccagcgcatcagccgataaaaccgaaagccagcgcatccgtgaaaccattatcgcccaactgccggaaggtcagtttaccgaaagcctggtcgcgcagctgatggaaaaagtgatgaaggaaaaacagtcgctggaacagggtgcactgcagccgagctttaaatcggtgaccggcaaaggcggcatcaaagttattgatggcagcagcgtcaagtttggtcgtttcgacggcgcacaaccgcactgcgtaggcttgactgatctcgtgaccggagacgacggcagcagtatggccgctggtttcatgcagtgggagaacgccttctttccgtggaccctgaactacgacgaaatcgacatggtgctggaaggggagctgcatgttcgccacgaaggcgaaactatgatcgccaaagcgggcgatgtgatgtttatcccgaaaggctccagtatcgaatttggtacgacatccagcgtgaaattcctgtatgtcgcctggccggctaactggcaatccctatga

SEQ ID NO: 5946 - protein, 233 aa, Escherichia coli
MKKLITANDIREAHARGELAMSVVLRASIITPEAREMADLLGFTITECDESIPVTASVPASASADKTESQRIRETIIAQLPEGQFTESLVAQLMEKVMKEKQSLEQGALQPSFKSVTGKGGIKVIDGSSVKFGRFDGAQPHCVGLTDLVTGDDGSSMAAGFMQWENAFFPWTLNYDEIDMVLEGELHVRHEGETMIAKAGDVMFIPKGSSIEFGTTSSVKFLYVAWPANWQSL

SEQ ID NO: 5947 - DNA, 480 bp, Escherichia coli
atgaaacgaattgcgtttgtgggtaccgtcggggcaggaaaaacaacgttatttaatgcgttgcaggggaattataccctcgcaagaaaaacacaggccgtggaatttaatgataatggcgatattgatacgccgggtgaatattttagccatccccgctggtatcacgccttaattaccacgctacaggatgtggacatgctgatctatgtccacggcgcgaatgacccggaaagtcggttgcctgccgggttgctggatattggcgtcagcaaacggcaaatcgccgtcatcagtaaaacggacatgccagatgctgacgtcgccgcaacgcgaaagttattgcttgagacgggcttcgaagagccgattttcgagctaaacagccacgacccgcaaagcgtgcagcaactggtggattatctggcatctctcaccaaacaggaggaagcaggtgaaaaaactcatcacagcgaatga

SEQ ID NO: 5948 - protein, 159 aa, Escherichia coli
MKRIAFVGTVGAGKTTLFNALQGNYTLARKTQAVEFNDNGDIDTPGEYFSHPRWYHALITTLQDVDMLIYVHGANDPESRLPAGLLDIGVSKRQIAVISKTDMPDADVAATRKLLLETGFEEPIFELNSHDPQSVQQLVDYLASLTKQEEAGEKTHHSE

SEQ ID NO: 5949 - DNA, 408 bp, Escherichia coli
ttgccgaattttgttatttactctgacgaaaaattgtcacgatacacgaaagtttttcacaggcggcgactcatggataaagaacgcatcattcaggaatttgtgcccggtaaacaggtcacactggcgcatctcatcgcgcatcccggcgaggaactggcgaagaaaatcggcgttccggatgcgggcgcaatcggcattatgacgctaactcccggagaaacggcgatgatcgccggtgatttagcgttgaaagccgccggtgtgcatatcggttttctcgaccgttttagcggcgcgctggtgatttatggttcggtgggcgcagtagaagaagcgttatcacaaaccgtcagtggtttaggacgcttattaaattatacgctttgtgaaatgaccaaaagttaa

SEQ ID NO: 5950 - protein, 135 aa, Escherichia coli
MPNFVIYSDEKLSRYTKVFHRRRLMDKERIIQEFVPGKQVTLAHLIAHPGEELAKKIGVPDAGAIGIMTLTPGETAMIAGDLALKAAGVHIGFLDRFSGALVIYGSVGAVEEALSQTVSGLGRLLNYTLCEMTKS

SEQ ID NO: 5951 - DNA, 2280 bp, Escherichia coli
atggatgaccagttaaaacaaagtgcacttgatttccatgaatttccagttccagggaaaatccaggtttctccaaccaagcctctggcaacgcagcgcgatctggcgctggcctactcaccaggcgttgccgcaccttgtcttgaaatcgaaaaagacccgttaaaagcctacaaatataccgcgcgcggtaacctggtagcggtgatctctaacggtacggcggtgctggggttaggcaacattggcgcgctggcaggcaaaccggtgatggaaggcaagggcgttctgtttaagaaattcgccgggattgatgtatttgacattgaagttgatgaactcgacccggacaaatttattgaagtcgtcgctgcgctcgaaccgaccttcggcggcatcaacctcgaagacattaaagcgccagaatgtttctatattgaacagaaactgcgcgagcggatgaatattccggtattccacgacgatcagcacggcacggcaattatcagcactgccgccatcctcaacggcttgcgcgtggtggagaaaaacatctccgacgtgcggatggtggtttctggcgcgggtgccgcagcaatcgcctgtatgaacctgctggtagcgctgggtctgcaaaaacataacatcgtggtttgcgattcaaaaggcgttatctatcagggccgtgagccaaacatggcggaaaccaaagctgcatacgcggtggtggatgacggtaaacgtaccctcgatgatgtgattgaaggcgcggatattttcctcggctgttccggcccgaaagtgctgacccaggaaatggtgaagaaaatggcccgtgcgccaatgatcctggcgctggcgaacccggaaccggaaattctgccgccgctggcgaaagaagtgcgtccggatgccatcatctgtaccggccgttccgactacccgaaccaggtgaacaacgtcctttgcttcccgtttatcttccgtggcgcgctggacgttggcgcaaccgccatcaacgaagagatgaaactggcggcggtacgcgcgattgcagaactggcccatgcggaacagagtgaagtggtggcttcagcgtatggcgatcaggatctgagctttggtccggaatacatcattccaaaaccgtttgatccgcgcttgatcgttaagatcgctcctgcggtggcgaaagcggcgatggagtcgggcgtggcgacgcgtccgattgctgatttcgacgtctacatcgacaagctgacagagttcgtttacaaaactaacctgtttatgaagccgattttctcccaggctcgcaaagcgccgaagcgcgtagttctgccggaaggggaagaggcgcgcgttctgcatgccactcaggaactggtaacgctgggactggcgaaaccgatccttattggtcgtccgaacgtgatcgaaatgcgcattcagaaactgggcttgcagatcaagtcgggcgttgattttgagatcgtcaataacgaatccgatccgcgctttaaagagtactggaccgaatacttccagatcatgaagcgtcgcggtgtcactcaggagcaggcgcagcgtgcgctgatcagtaacccgacagtgatcggcgcgatcatggttcagcgtggcgaagccgatgcaatgatttgcggtacggtgggcgattatcatgaacactttagcgtggtgaaaaatgtctttggttatcgcgatggcgttcacaccgcaggtgcaatgaacgcgctgctgttgccgagtggtaacacctttattgccgatacctacgtcaatgatgagcctgatgcagaagagctggcggagatcaccttgatggcggcagaaactgttcgtcgttttggtattgaaccgcgtgtggctctgttgtcgcactccaactttggttcttctgactgcccgtcgtcgagcaaaatgcgtcaggcgctggaactggtcagggaacgtgcgccagaactgatgattgatggtgaaatgcacggcgatgcagcgctggtggaagcgattcgcaacgaccgtatgccggacagccctttgaaaggttccgctaatattctggtgatgccgaacatggaagctgcccgcattagttacaacttactgcgcgtttccagctcggaaggtgtgactgtcggtccggtgctgatgggcgtggcgaaaccggttcacgtgttaacgccgatcgcatcggtacgtcgtatcgtcaacatggtggcgctggccgtggttgaagcgcaaacccaaccgctgtaa

SEQ ID NO: 5952 - protein, 759 aa, Escherichia coli
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNGLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQIKSGVDFEIVNNESDPRFKEYWTEYFQIMKRRGVTQEQAQRALISNPTVIGAIMVQRGEADAMICGTVGDYHEHFSVVKNVFGYRDGVHTAGAMNALLLPSGNTFIADTYVNDEPDAEELAEITLMAAETVRRFGIEPRVALLSHSNFGSSDCPSSSKMRQALELVRERAPELMIDGEMHGDAALVEAIRNDRMPDSPLKGSANILVMPNMEAARISYNLLRVSSSEGVTVGPVLMGVAKPVHVLTPIASVRRIVNMVALAVVEAQTQPL

SEQ ID NO: 5953 - DNA, 951 bp, Escherichia coli
atgaacgagttagacggcatcaaacagttcaccactgtcgtggcagacagcggcgatattgagtccattcgccattatcatccccaggatgccaccaccaatccttcgctgttactcaaggctgccggattatcacaatatgagcatttaatagacgatgctatcgcctggggtaaaaaaaatggcaagacccaggaacaacaggtggtcgcagcgtgtgacaaactggcggtcaatttcggtgctgaaattctcaaaatcgtacccggtcgcgtgtcaacagaagttgatgcacgcctctcttttgataaagaaaagagtattgagaaggcgcgccatctagtggacttgtatcagcaacaaggcgttgagaaatcgcgcattctgatcaagctggcttcgacctgggaaggaattcgcgcggcagaagagctggaaaaagaaggtatcaactgcaacctgacgctgctgttttcttttgcacaggcgcgggcctgtgcagaagcaggcgtttttctgatttcgccgtttgtcgggcgtatttatgactggtatcaggcacgcaagccgatggacccgtatgtggtggaagaagatccaggcgttaaatcagtacgcaatatctacgactactataagcaacaccactatgaaaccattgtgatgggcgcgagcttccgtcgcaccgaacaaatcctcgccttaaccggctgcgaccgactgactatcgcaccgaatttgctgaaggagctacaggaaaaagtttcgccagtggtacgtaaattaatcccaccttctcagacgttcccacgcccagctcccgtgagcgaagcggagttccgttgggagcacaatcaggatgcgatggcggtagaaaaactgtctgaaggcattcgtctgttcgccgttgatcaacgcaaactggaagatcttcttgccgccaaactataa

SEQ ID NO: 5954 - protein, 316 aa, Escherichia coli
MNELDGIKQFTTVVADSGDIESIRHYHPQDATTNPSLLLKAAGLSQYEHLIDDAIAWGKKNGKTQEQQVVAACDKLAVNFGAEILKIVPGRVSTEVDARLSFDKEKSIEKARHLVDLYQQQGVEKSRILIKLASTWEGIRAAEELEKEGINCNLTLLFSFAQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPVSEAEFRWEHNQDAMAVEKLSEGIRLFAVDQRKLEDLLAAKL

SEQ ID NO: 5955 - DNA, 2004 bp, Escherichia coli
atgtcccgaaaagaccttgccaatgcgattcgcgcactcagtatggatgcggtacaaaaagccaattctggtcatcccggcgcgccgatgggcatggctgatattgccgaagtgctgtggaacgattttcttaaacataaccccaccgacccaacctggtatgaccgtgaccgctttattctttccaacggtcacgcgtcgatgctgctctacagtttgctgcatctgaccggttacgacctgccactggaagaactgaagaacttccgtcagttgcattcgaaaacccctggtcacccggaaatcggctatacgccaggtgttgaaaccaccaccggtcctcttggacaaggtttggcgaacgccgtcgggctggcgatagcagagcgtacgctggcggcgcagtttaatcagccggatcatgaaattgtcgatcacttcacctatgtgtttatgggcgacggctgcctgatggaaggtatctctcacgaagtctgttcgctggcgggcacgctggggctgggcaagctgattggtttttacgatcacaacggtatttccatcgacggtgaaaccgaaggctggtttaccgacgatacggcaaaacgttttgaagcctatcactggcatgtgatccatgaaatcgacggccacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccactgggggaagaagaagtggcgctggcacggcaaaaactgggctggcaccatccgccatttgagatccctaaagagatttatcacgcctggaatgcccgcgaaaaaggcgaaaaagcgcagcagcgctggaatgagaagtttgccgcctataaaaaggctcatccgcaactggcagaagagtttacccgtcggatgagcggcggtttgccgaaggactgggagaaaacgactcagaaatatatcaatgagttgcaggcgaatccggcgaaaatcgctacccgtaaggcttcgcaaaatacgcttaacgcttacgggccgatgctgcctgagttgctcggcggttcggcggatctggctcccagcaacctgaccatctggaaaggttctgtgtcgctgaaggaagatccggcgggcaactacattcactacggggtgcgtgaatttggtatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggtctgggcgaagatggtccgacgcaccaggctgttgagcaactggctagtctgcgcttaacgccaaatttcagcacctggcgaccgtgcgatcaggtggaagcggcggttggctggaagctggcggttgagcgccacaacggaccgacagcactgatcctctcaaggcagaatctggcacaggtagaacgaacaccggatcaggttaaagagattgctcgtggcggttatgtgctgaaagacagcggcggtaagccagatattattctgattgccaccggttcagagatggaaatcaccctgcaagcggcagagaaattagcgggagaaggtcgcaatgttcgcgtggtttccctgccctcgaccgatattttcgatgcccaggatgaggaatatcgcgagtcggtactgccttcaaatgtttctgcccgcgtggcagtagaagcgggtattgccgattactggtacaaatatgttggtctgaaaggggcaattgtcgggatgacaggttatggggaatcagctccggcggataagctgttcccgttctttggctttaccgccgagaatattgtggcaaaagcgcataaggtactgggagtgaaaggtgcctga

SEQ ID NO: 5956 - protein, 667 aa, Escherichia coli
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWNAREKGEKAQQRWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEEYRESVLPSNVSARVAVEAGIADYWYKYVGLKGAIVGMTGYGESAPADKLFPFFGFTAENIVAKAHKVLGVKGA

SEQ ID NO: 5957 - DNA, 888 bp, Escherichia coli
gtgatgaccctgagccgcagcgccggggcgcataccgatgccgttttacgtattgagcgcggcgggttgaagtcgccggatgcgtcagaaggggagatagcgccacggatgctgttagatggtgagccgttggcgttaagtggtgacaagtggcggatttcaccatggttattagtaaccgatgatacggcaaccatcaccgcgtttttgcagatgattcaggaagggagggcgatcaccttacgcgacggcaatcagactatttctctgagtggcttaaaagcggcgttgttgtttattgatgcccagcaaaagcgcgttggcagtgagaccgcgtggataaagaaaggggacgaaccgccgctcagcgtaccgccagcgcctgcgctgaaagaggtcgcggtggttaacccaacgccgacgccactctcactcgaagaacgtaacgatttgctggattatggaaactggcggatgaatggtctgcgctgttcgcttgatccgttacgtcgtgaggtgaatgtcactgcgctgaccgatgataaagcgctgatgatgattagctgtgaggcaggggcctataacaccattgatttggcatggattgtgtcgcgtaaaaagccgctggcctcgcgcccggtacggttgcgtttgccgttcaacaacggtcaggagaccaatgaactggaactgatgaacgcaacattcgatgaaaaatcgcgtgaactggtgaccttagcaaaagggcgcggattaagcgattgtggcattcaggcgcgctggcgctttgacggtcagcgttttcgcctggtgcgttacgccgcagaacccacctgcgataactggcatgggccagacgcctggcccacgttgtggatcacccgttaa

SEQ ID NO: 5958 - protein, 295 aa, Escherichia coli
MMTLSRSAGAHTDAVLRIERGGLKSPDASEGEIAPRMLLDGEPLALSGDKWRISPWLLVTDDTATITAFLQMIQEGRAITLRDGNQTISLSGLKAALLFIDAQQKRVGSETAWIKKGDEPPLSVPPAPALKEVAVVNPTPTPLSLEERNDLLDYGNWRMNGLRCSLDPLRREVNVTALTDDKALMMISCEAGAYNTIDLAWIVSRKKPLASRPVRLRLPFNNGQETNELELMNATFDEKSRELVTLAKGRGLSDCGIQARWRFDGQRFRLVRYAAEPTCDNWHGPDAWPTLWITR

SEQ ID NO: 5959 - DNA, 132 bp, Escherichia coli
ttgaacttctggggtcgtaccgtccatgcgatatcgcattttccttctcttttttttcgctttgttgccgatgtctttggtgtgggcggcaccagcgcaacgggcgttttccgactggcaggtcacctgtaa

SEQ ID NO: 5960 - protein, 43 aa, Escherichia coli
MNFWGRTVHAISHFPSLFFRFVADVFGVGGTSATGVFRLAGHL

SEQ ID NO: 5961 - DNA, 576 bp, Escherichia coli
atgacgcaacaaatcaccctcgttaaagacaaaattctctccgataactattttaccctgcacaacattacttacgatctcacgcgcaaagatggcgaagttatccgccataaacgtgaagtttacgatcgcggtaatggtgcgacgatcctcctgtacaacgcgaagaaaaagaccgtggttctgattcgccagttccgcgtcgctacctgggttaatggcaatgaaagcgggcaactgattgaaacctgcgccgggctgctggataacgacgaaccggaagtgtgcattcgcaaagaagcgattgaagagacgggctatgaagttggcgaagtccgcaaattatttgaactgtatatgtcgccaggcggtgtgactgagctaatccacttttttatcgccgaatacagtgacagccagcgcgctaacgccggtggtggtgtcgaagatgaagatattgaagtgcttgagctgccgttcagccaggcgctggagatgattaaaaccggcgagatacgtgacggtaagacggtgttattgcttaactatttgcaaatgtcacatttaatggactga

SEQ ID NO: 5962 - protein, 191 aa, Escherichia coli
MTQQITLVKDKILSDNYFTLHNITYDLTRKDGEVIRHKREVYDRGNGATILLYNAKKKTVVLIRQFRVATWVNGNESGQLIETCAGLLDNDEPEVCIRKEAIEETGYEVGEVRKLFELYMSPGGVTELIHFFIAEYSDSQRANAGGGVEDEDIEVLELPFSQALEMIKTGEIRDGKTVLLLNYLQMSHLMD

SEQ ID NO: 5963 - DNA, 1980 bp, Escherichia coli
atgaatcgttttattatggccaacagtcagcaatgtctgggttgtcatgcttgtgaaatcgcctgtgtcatggctcacaatgacgagcaacatgtcctgagccaacaccattttcatccccgaattacggttatcaaacatcagcagcaacgtagtgcagtgacctgtcaccattgtgaagatgcgccctgcgcccgtagctgccctaatggcgcaatcagccacgttgatgacagcattcaggtcaatcagcaaaagtgtattggctgtaaatcctgcgtggtggcctgtccatttggtacgatgcaaatcgttctgacacccgttgcggcaggaaaagtaaaagccacggcgcataaatgcgacctttgtgcagggcgcgaaaacggtcctgcctgtgtcgaaaattgcccggcggacgcgctgcaactggtcactgacgccgcactctccggcatggcgaaatcccgccgcttgcgcaccgcacgtcaggaacaacaaccgtggcatgccagtaccgcggcgcaagaaatgccggtaatgagtaaagtcgagcaaatgcaggcaacgcccgcgcgtggcgagccagataaactggcgattgaagcgcgcaaaaccggttttgatgaaatttatctgccattccgtgccgatcaggcacaacgggaagcctcgcgctgccttaagtgcggcgagcacagcgtttgtgaatggacctgcccgctgcataaccatataccgcagtggattgaactggtgaaagccggaaacatcgacgccgccgtcgagctttctcaccagaccaacaccctgccggaaattaccggacgcgtttgcccgcaagaccgtttgtgtgaaggtgcctgtactattcgcgatgagcacggcgcagtaactatcggtaacattgaacgctacatttcagatcaggcgttggcgaaaggttggcgtcctgacttaagccatgtcaccaaagtggacaagcgggtggcgattatcggtgcgggtccggcagggctggcctgtgcagatgttctcacccgcaatggcgtagaggtgacggtgtacgatcgccatccagaaatcggtggcttgctcactttcggcattccttctttcaaactggataaatccctgctggcacgccgtcgggaaatcttcagcgcgatggggattcacttcgaactcaattgtgaagtgggtaaagatgtctctttgaattcgcttttggaacaatacgacgcggtcttcgttggcgtaggcacttaccgttccatgaaagcgggtttacccaatgaagatgcgccgggcgtttatgacgcgctgccgttcctcatcgccaatactaaacaggtgatgggactcgaagagctaccggaagagccgtttatcaatactgccggacttaacgtcgtggtactgggcggcggcgacaccgcgatggactgtgtgcgtactgcgctgcgccacggcgcgagtaacgtcacctgcgcttatcgtcgtgatgaagctaacatgccaggctcgaagaaagaggtgaagaacgcccgtgaagagggggccaacttcgaatttaacgtccagccggtggcgcttgaactgaatgaacaaggtcacgtctgcgggattcgtttcctgcgcacgcgtcttggcgagccggatgcccaggggcgtcggcgtccagtgccggtggaaggcagtgaatttgtcatgccagccgatgcggtgattatggcgtttggcttcaatccgcacgggatgccgtggctggagtcgcacggtgtaacggtagacaaatggggccgcatcatcgcggatgtggaaagccagtaccgttaccagaccacgaatccgaaaatcttcgccggtggtgacgccgtgtgtggtgcggatctggtggttaccgcaatggcagaaggacgtcatgcggcacaggggatcattgactggctgggcgtaaaatcagtcaaatctcactga

SEQ ID NO: 5964 - protein, 659 aa, Escherichia coli
MNRFIMANSQQCLGCHACEIACVMAHNDEQHVLSQHHFHPRITVIKHQQQRSAVTCHHCEDAPCARSCPNGAISHVDDSIQVNQQKCIGCKSCVVACPFGTMQIVLTPVAAGKVKATAHKCDLCAGRENGPACVENCPADALQLVTDAALSGMAKSRRLRTARQEQQPWHASTAAQEMPVMSKVEQMQATPARGEPDKLAIEARKTGFDEIYLPFRADQAQREASRCLKCGEHSVCEWTCPLHNHIPQWIELVKAGNIDAAVELSHQTNTLPEITGRVCPQDRLCEGACTIRDEHGAVTIGNIERYISDQALAKGWRPDLSHVTKVDKRVAIIGAGPAGLACADVLTRNGVEVTVYDRHPEIGGLLTFGIPSFKLDKSLLARRREIFSAMGIHFELNCEVGKDVSLNSLLEQYDAVFVGVGTYRSMKAGLPNEDAPGVYDALPFLIANTKQVMGLEELPEEPFINTAGLNVVVLGGGDTAMDCVRTALRHGASNVTCAYRRDEANMPGSKKEVKNAREEGANFEFNVQPVALELNEQGHVCGIRFLRTRLGEPDAQGRRRPVPVEGSEFVMPADAVIMAFGFNPHGMPWLESHGVTVDKWGRIIADVESQYRYQTTNPKIFAGGDAVCGADLVVTAMAEGRHAAQGIIDWLGVKSVKSH

SEQ ID NO: 5965 - DNA, 1701 bp, Escherichia coli
gtgattgttaaacgacccgtctcggccagtctggcccgggcctttttttacattgtgctgctgtcgattctttccacgggtatcgctctgctaacgctggcgagcagtttacgcgacgctgaggctatcaatattgccggatcgctgcgtatgcagagttaccgcctgggctacgacttgcaaagtggcagtccacaactcaatgcacatcgccagttatttcagcaggcactgcattcaccggtattaaccaatctcaacgtctggtatgtgccagaggcagtaaaaacccgctatgcgcatctgaatgccaactggctggagatgaataatcggctcagcaagggcgacttgccgtggtatcaggccaatattaataattatgttaatcagatagacctgttcgtgctggctttacagcactacgctgaacgcaaaatgctgctggtggtggcaatttccctggctggcggcatcggtattttcacgctggtcttttttactttgcgccgcatacgccatcaggtggttgccccgctgaatcagctggttaccgccagtcagcgtattgaacacgggcagttcgactcgccgccgctggataccagcctgccgaatgagcttggcctgcttgcaaaaacctttaaccagatgtcgagcgagctgcataaattgtaccgttcgctggaggcgtcagtagaagaaaagacccgcgatctccacgaggccaagcgtcgtctggaggtgttgtatcagtgttcgcaggcgctaaacaccagccagattgatgtgcattgtttccgccatattttgcagattgttcgcgacaatgaagcggctgaatatctggagttaaatgtcggtgacaactggcggattagcgaagggcagccaaacccggaattgccgatgcagattttaccggtgacaatgcaagagacggtttacggcgaactgcactggcaaaatagtcacgtttcatcatcagaaccgctgcttaacagcgtttcgtcgatgctgggacgcggtttgtactttaatcaggcgcagaagcattttcagcagttattgttgatggaagaacgtgcgaccatcgcccgcgaattgcacgactcgctggctcaggtactttcttacttacgtatccagttgacgttactgaagcgttcgataccggaagataatgccaccgcacaaagtatcatggccgatttttcccaggcgttgaatgatgcttatcggcagttacgcgagctgttgactactttccgcctgacgctgcagcaggcggatctcccctccgcgttgagggaaatgctggatacgttacaaaatcaaaccagcgccaaactgaccctcgactgccgtctgccaaccctggcgctggatgcgcaaatgcaggtgcatttgttgcaaattattcgcgaagcggtgctgaatgcgatgaagcacgccaacgccagcgaaatcgccgttagctgcgtcaccgcgccggatggcaatcacacagtctatattcgcgacaacgggattggcatcggtgaaccgaaagaacccgaaggccattatggtctgaatatcatgcgcgaacgcgcggaaagattgggtgggacgctgactttttcacaaccttccggcggcggcacgttagtgagtattagctttcgctctgcggagggtgaggaaagtcagctgatgtaa

SEQ ID NO: 5966 - protein, 566 aa, Escherichia coli
MIVKRPVSASLARAFFYIVLLSILSTGIALLTLASSLRDAEAINIAGSLRMQSYRLGYDLQSGSPQLNAHRQLFQQALHSPVLTNLNVWYVPEAVKTRYAHLNANWLEMNNRLSKGDLPWYQANINNYVNQIDLFVLALQHYAERKMLLVVAISLAGGIGIFTLVFFTLRRIRHQVVAPLNQLVTASQRIEHGQFDSPPLDTSLPNELGLLAKTFNQMSSELHKLYRSLEASVEEKTRDLHEAKRRLEVLYQCSQALNTSQIDVHCFRHILQIVRDNEAAEYLELNVGDNWRISEGQPNPELPMQILPVTMQETVYGELHWQNSHVSSSEPLLNSVSSMLGRGLYFNQAQKHFQQLLLMEERATIARELHDSLAQVLSYLRIQLTLLKRSIPEDNATAQSIMADFSQALNDAYRQLRELLTTFRLTLQQADLPSALREMLDTLQNQTSAKLTLDCRLPTLALDAQMQVHLLQIIREAVLNAMKHANASEIAVSCVTAPDGNHTVYIRDNGIGIGEPKEPEGHYGLNIMRERAERLGGTLTFSQPSGGGTLVSISFRSAEGEESQLM

SEQ ID NO: 5967 - DNA, 3114 bp, Escherichia coli
atggcgaatttctttattgatcgccccatttttgcctgggtgctggcaatcctgttgtgtctgacaggtaccctggcgattttttcattgcccgttgaacaataccccgatctcgcgccaccgaatgtgcgagtgaccgctaactatcccggcgcatcggcccagacgctggaaaacaccgtgacccaggttatcgagcaaaatatgaccggcctcgataatctgatgtatatgtcatctcagagcagcggcaccggtcaggcatctgtcacgttaagttttaaagcaggcaccgatccggacgaagccgtgcagcaagtacaaaaccagctgcaatcagccatgcgaaagttaccgcaggcggtgcaaaatcagggcgtgacggtgcgtaaaaccggcgataccaacattctgaccattgccttcgtctctaccgatggttcgatggataaacaggatattgccgattatgttgccagtaatattcaggacccgttaagccgcgtgaatggcgtcggggatatcgatgcctatggttcgcaatattccatgcgtatctggctggacccggcgaaactcaacagtttccagatgacggctaaagatgtcaccgatgccattgaatcacagaacgcgcagattgcggttgggcaacttggtggtacgccttccgtcgataagcaggcgctcaacgccaccattaacgcccagtcactgctgcaaacaccagaacagttccgcgatatcaccttgcgggtgaatcaggacggctcagaggtaaggctgggcgatgtcgccaccgtcgaaatgggggcggagaaatacgattatcttagccgcttcaatggtaagccagcctccgggctgggggtaaaactggcctccggcgcgaacgaaatggcgacagcggagctggtgctcaatcgtctcgacgagctggcgcagtattttccacacggactggaatacaaggtggcgtatgaaaccacctcttttgtaaaagcctccattgaagacgtggtgaaaacgctgctggaagctatcgccctggttttcctcgttatgtatctgttcctgcaaaacttccgcgccacgctgatacccactatcgccgtgccggtggtgttgatgggaaccttctcggtgctttatgccttcggctatagcgtcaacaccttaaccatgttcgcgatggtgctggctatcggcctgttggtagatgacgccatcgtggtggtggaaaacgtcgaacgtattatgagtgaggaaggactcactcctcgcgaagccacacgtaaatcgatggggcaaatccagggcgcactggtcgggattgcgatggtgctttcggcggtatttgtgccaatggccttcttcggcggcaccaccggtgccatctatcgccagttctctattaccattgttgcggcgatggtgctgtcagtactggtagcgatgatcctcactcctgctctgtgtgccacgctacttaagccactgaaaaaaggtgagcatcacgggcaaaaaggcttttttgcctggtttaaccagatgtttaaccgcaacgccgaacgctacgaaaaaggggtggcgaaaattctccaccgtagcctgcgctggattgtgatttatgtcctgctgcttggcggcatggtgttcctgttcctgcgtttgccgacgtcgttcttaccgctggaagaccgtggcatgtttactacttcggtacagttgcccagcggttcaacccagcaacagaccctgaaagtcgttgagcaaatcgagaaatattacttcacccatgaaaaagacaacatcatgtcggtgtttgccaccgtgggttctggccctgggggtaacgggcaaaacgtggcgcgaatgtttatccgcctgaaagactggagcgaacgcgacagtaagaccggcacctcgtttgccattatcgagcgtgcaacgaaggcgtttaacaagattaaagaagctcgcgttatcgccagcagcccgccagcaattagcggtcttggtagttctgcgggttttgatatggagttgcaggaccacgctggagcgggtcacgatgcgctgatggcagcacgaaaccagttgctggcgctggcagcggaaaacccggagctaacccgtgtgcgccataacggcctcgacgacagtccgcagttgcagattgatatcgaccagcgtaaagctcaggcgctgggcgttgctatcgacgatattaacgacacactgcaaaccgcctggggttcgagctatgtgaatgactttatggatcgcggtcgcgtgaagaaagtctatgtgcaggcagctgcgccgtatcgcatgctgccagatgacatcaatctctggtatgtccgaaataaagatggcggcatggtgcccttctctgctttcgcgacctcacgctgggagacaggctcgccgcgtctggaacgctataacggttattctgcggttgagattgttggggaagccgcaccgggggtcagtaccggtacggcgatggatattatggaatcgttagtgaagcagctgccaaacggctttggtctggagtggacggcgatgtcgtatcaggagcggctttccggcgcgcaggctccggcgctgtacgccatttccttgctggtggtattcctgtgtctggcggcattgtatgaaagctggtcggtgccgttctcggtaatgctggtcgtgccactgggggttatcggcgcgctgctggcaacctggatgcgcgggctggaaaacgatgtttacttccaggtgggcctgttaacggtcattggtttatcggcgaaaaacgccatcctgatcgtcgaatttgctaacgagatgaaccaaaaaggccacgacctgtttgaagcgacgctccacgcctgccgtcagcgtttacgcccgattctgatgacctcgctggcatttatcttcggcgtattgccaatggcaaccagcacaggtgccggttccggtggtcagcatgcggtgggtactggcgtaatgggcgggatgatttcggccactattctggctatttacttcgtgccgctgttctttgtgctggtgcgccgccgcttcccgctgaagccgcgcccggaataa

SEQ ID NO: 5968 - protein, 1037 aa, Escherichia coli
MANFFIDRPIFAWVLAILLCLTGTLAIFSLPVEQYPDLAPPNVRVTANYPGASAQTLENTVTQVIEQNMTGLDNLMYMSSQSSGTGQASVTLSFKAGTDPDEAVQQVQNQLQSAMRKLPQAVQNQGVTVRKTGDTNILTIAFVSTDGSMDKQDIADYVASNIQDPLSRVNGVGDIDAYGSQYSMRIWLDPAKLNSFQMTAKDVTDAIESQNAQIAVGQLGGTPSVDKQALNATINAQSLLQTPEQFRDITLRVNQDGSEVRLGDVATVEMGAEKYDYLSRFNGKPASGLGVKLASGANEMATAELVLNRLDELAQYFPHGLEYKVAYETTSFVKASIEDVVKTLLEAIALVFLVMYLFLQNFRATLIPTIAVPVVLMGTFSVLYAFGYSVNTLTMFAMVLAIGLLVDDAIVVVENVERIMSEEGLTPREATRKSMGQIQGALVGIAMVLSAVFVPMAFFGGTTGAIYRQFSITIVAAMVLSVLVAMILTPALCATLLKPLKKGEHHGQKGFFAWFNQMFNRNAERYEKGVAKILHRSLRWIVIYVLLLGGMVFLFLRLPTSFLPLEDRGMFTTSVQLPSGSTQQQTLKVVEQIEKYYFTHEKDNIMSVFATVGSGPGGNGQNVARMFIRLKDWSERDSKTGTSFAIIERATKAFNKIKEARVIASSPPAISGLGSSAGFDMELQDHAGAGHDALMAARNQLLALAAENPELTRVRHNGLDDSPQLQIDIDQRKAQALGVAIDDINDTLQTAWGSSYVNDFMDRGRVKKVYVQAAAPYRMLPDDINLWYVRNKDGGMVPFSAFATSRWETGSPRLERYNGYSAVEIVGEAAPGVSTGTAMDIMESLVKQLPNGFGLEWTAMSYQERLSGAQAPALYAISLLVVFLCLAALYESWSVPFSVMLVVPLGVIGALLATWMRGLENDVYFQVGLLTVIGLSAKNAILIVEFANEMNQKGHDLFEATLHACRQRLRPILMTSLAFIFGVLPMATSTGAGSGGQHAVGTGVMGGMISATILAIYFVPLFFVLVRRRFPLKPRPE

SEQ ID NO: 5969 - DNA, 357 bp, Escherichia coli
atggttacactttacggcatcaaaaattgtgacaccattaaaaaggctcgccgttggctggaagccaataacatcgactatcgttttcatgattaccgcgtcgatggattggacaacgaattattgaacggttttatcaacgaattaggctgggaagcgttactcaacacccgtggtacaacctggcgtaaactggacgaaaccacccgcaataaaatcaccgatgcggcctctgcggcgacattaatgactgaaatgcctgcaattatcaaacgtccattgctctgcgcgcctggtaagcctatgctgctgggtttcagtgaatccagttatcagcaatttttccatgaggtgtag

SEQ ID NO: 5970 - protein, 118 aa, Escherichia coli
MVTLYGIKNCDTIKKARRWLEANNIDYRFHDYRVDGLDNELLNGFINELGWEALLNTRGTTWRKLDETTRNKITDAASAATLMTEMPAIIKRPLLCAPGKPMLLGFSESSYQQFFHEV

SEQ ID NO: 5971 - DNA, 1128 bp, Escherichia coli
atgtcgtgcccggttattgagctgacacaacagcttattcgccgcccttccctgagtcctgatgacgcaggatgccaggctttgttgattgaacgtttgcaggcgatcggttttaccgttgaacgcatggactttgccgatacgcagaatttttgggcatggcgtgggcagggtgaaacgttagcctttgccgggcataccgacgtggtgccgcctggcgacgccgaccgttggatcaatccgccgtttgaaccaaccattcgtgacggcatgttattcgggcgcggtgcggcagatatgaaaggctcgctggcggcgatggtggtagctgcagaacgttttgtcgcacaacatcccaaccatacggggcgactggcatttctgatcacctctgatgaagaagccagtgcacacaatggtacggtaaaagtcgtcgaagcgttaatggcacgtaatgagcgtctcgattactgcctggttggcgaaccgtcgagtatcgaagtggtaggtgatgtggtgaaaaatggtcgtcgcggatcgttaacctgcaaccttaccattcatggcgttcaggggcatgttgcctacccacatctggctgacaatccggtacatcgcgcagcacctttcattaatgaattagtggctattgagtgggatcagggtaatgaattcttcccggcgaccagtatgcagattgccaatattcaggcgggaacgggcagtaacaacgttattccaggtgaactgtttgtgcagtttaacttccgctttagcaccgaactgacggatgagatgatcaaagcgcaggtgcttgccctgcttgaaaaacatcaactgcgctatacggtggattggtggctttccgggcagccatttttgaccgcgcgcggtaaactggtggatgcggtcgttaacgcggttgagcactataatgaaattaaaccgcagctactgaccacaggcggaacgtccgacgggcgctttattgcccgcatgggggcgcaggtggtggaactcgggccggtcaatgccacgattcataaaattaatgaatgtgtgaacgctgccgacctgcagctacttgcccgtatgtatcaacgtatcatggaacagctcgtcgcctga

SEQ ID NO: 5972 - protein, 375 aa, Escherichia coli
MSCPVIELTQQLIRRPSLSPDDAGCQALLIERLQAIGFTVERMDFADTQNFWAWRGQGETLAFAGHTDVVPPGDADRWINPPFEPTIRDGMLFGRGAADMKGSLAAMVVAAERFVAQHPNHTGRLAFLITSDEEASAHNGTVKVVEALMARNERLDYCLVGEPSSIEVVGDVVKNGRRGSLTCNLTIHGVQGHVAYPHLADNPVHRAAPFINELVAIEWDQGNEFFPATSMQIANIQAGTGSNNVIPGELFVQFNFRFSTELTDEMIKAQVLALLEKHQLRYTVDWWLSGQPFLTARGKLVDAVVNAVEHYNEIKPQLLTTGGTSDGRFIARMGAQVVELGPVNATIHKINECVNAADLQLLARMYQRIMEQLVA

SEQ ID NO: 5973 - DNA, 225 bp, Escherichia coli
gtggttctgcaagaggaaataagcatggactggctggctaaatattggtggattctggtgattgtctttttggtaggcgtcctgctgaacgtgattaaagatctcaagcgcgtcgaccataagaaatttctcgccaacaagccggagcttcccccgcatcgtgatttcaacgataagtgggacgatgacgacgactggccgaaaaaggatcaaccgaagaagtaa

SEQ ID NO: 5974 - protein, 74 aa, Escherichia coli
MVLQEEISMDWLAKYWWILVIVFLVGVLLNVIKDLKRVDHKKFLANKPELPPHRDFNDKWDDDDDWPKKDQPKK

SEQ ID NO: 5975 - DNA, 699 bp, Escherichia coli
atgaaacatgaccattttgttgttcaaagcccggataaaccagcacaacggttgttactgcttttccacggtgtcggggataacccggtggcaatgggggaaataggtagctggtttgcgccgctgtttcctgatgcgctggtggtgagtgtcggtggcgcggagccgagcggtaatccggcggggcgtcagtggttttcggtgcagggtattacggaagataatcgccaggcgcgtgtgaatgccatcatgccgacgtttattgagacggtgcgctactggcagaaacaaagcggagtaggggctaatgccacggcgctaatcggtttctcacaaggcgcgattatggcgctggagagcattaaagccgaaccgggccttgcttcgcgcgtcattgccttcaacggacgctacgcgagcctgccggaaaccgcgtctacagccacaacaattcacttgattcatggcggtgaagatccggttatcgatctggcgcatgcggttgcggcgcaggaagcgttaatcagtgccggtggcgatgtgacgctggatatcgtggaggatttaggccatgcgatcgacaatcgcagtatgcaattagccctggatcacttgcgttataccattccgaaacattatttcgacgaagcgctaagtggcggtaagcctggcgatgatgatgtgattgaaatgatgtaa

SEQ ID NO: 5976 - protein, 232 aa, Escherichia coli
MKHDHFVVQSPDKPAQRLLLLFHGVGDNPVAMGEIGSWFAPLFPDALVVSVGGAEPSGNPAGRQWFSVQGITEDNRQARVNAIMPTFIETVRYWQKQSGVGANATALIGFSQGAIMALESIKAEPGLASRVIAFNGRYASLPETASTATTIHLIHGGEDPVIDLAHAVAAQEALISAGGDVTLDIVEDLGHAIDNRSMQLALDHLRYTIPKHYFDEALSGGKPGDDDVIEMM

SEQ ID NO: 5977 - DNA, 2016 bp, Escherichia coli
atggctgaactgactgcgcttcacacattaacagcgcaaatgaaacgtgaagggatccgccgcttgctggtgttgagcggggaagagcgttggtgttttgatcatgcgcttaagttgcgtgatgccttacctggcgactggctgtggatttcgccgcagccagatgctgaaaaccactgttctccctcggcactacaaactttacttgggcgcgagttccggcatgcggtattcgacgcccgccaaggctttgatgccgctgcctttgcggcacttagcggaacgttgaaagcgggaagctggctggtgttgttactccctgtatgggatgagtgggaaaaccaacctgatgccgactcgctgcgctggagtgattgccctgaccctattgcgacgccgcattttgtccagcatttcaaacgcgtacttacggcgaataacgacgctatcctctggcggcaaaaccagccgttctcgttggcgcattttactccccgtactgactggcaccccgctaccggcgcaccacaaccagaacaacagcaactcttacagcagctactgaccatgccgccgggcgtggcagcggtaactgctgcgcgtgggcgcggtaagtcggcgttggcagggcaactcatttctcgtattgcgggcagtgcgattgtcaccgcgcccgcaaaagcggcaacggatgtactggcacaatttgcgggtgagaagtttcgctttattgcaccggatgccttgttagccagcgatgagcaagccgactggctggtggtcgatgaagccgcagctatacctgcgccgttgttgtatcaactggtatcgcgttttcctcgaacgttgttaaccactacggtgcagggctacgaaggcaccggacgtggttttttgctgaaattttgcgctcgctttccgcatttacaccgttttgaactacaacagccgatccgttgggcgcagggatgcccgctggaaaaaatggttagtgaggcactggtgtttgacgatgaaaacttcacccatacaccacaaggcaatatcgttatttccgcatttgaacagacgttatggcgaagcgagccagaaacgccgttaaaggtttatcaattattgtctggtgcgcactaccggacttcgccgctggatttacgccgcatgatggatgcaccaggtcaacattttttacaggcggctggcgaaaacgagattgccggggcgctgtggctggtggatgagggcggattatctcaagaactcagtcaggcggtatgggcaggttttcgtcgcccgcggggtaatctggtggcccagtcgctggcggcgcacggcagcaatccactggcggcgacattgcgcggaaggcgggtcagccgaatagcagttcatccggctcgtcagcgggaaggcacaggtcagcaactgattgctggtgctttgcaatatattcatgacctcgactatctttcggtgagttttggttacaccgaggagttatggcgtttctggcaacgctgcggttttgtgctggtgcgaatgggtaatcatcgtgaagccagcagcggttgctatacggcgatggcgctgttaccgatgagtgatgcgggtaaacaactggctgaacgtgagcattaccgtttacgtcgcgatgcgcaagctctcgcgcagtggaatggcgaaatgcttcctgttgatccactaaacgatgccgtcctttctgacgacgactggcttgaactggccggttttgctttcactcatcgtccgctattaacatcgttaggttgcttattgcgtttgctacaaaccagcgaactggcattaccggcgctgcgtgggcgtttacagaaaaacgccagtgacgcgcagttatgtaccacacttaaactttcaggccgtaagctgttactggttcgccagcgggaagaggccgcgcaggcgctattcgcacttgatgatgttcgcactgagcgtctgcgcgatcgcataacgcaatggcaattttttcactga

SEQ ID NO: 5978 - protein, 671 aa, Escherichia coli
MAELTALHTLTAQMKREGIRRLLVLSGEERWCFDHALKLRDALPGDWLWISPQPDAENHCSPSALQTLLGREFRHAVFDARQGFDAAAFAALSGTLKAGSWLVLLLPVWDEWENQPDADSLRWSDCPDPIATPHFVQHFKRVLTANNDAILWRQNQPFSLAHFTPRTDWHPATGAPQPEQQQLLQQLLTMPPGVAAVTAARGRGKSALAGQLISRIAGSAIVTAPAKAATDVLAQFAGEKFRFIAPDALLASDEQADWLVVDEAAAIPAPLLYQLVSRFPRTLLTTTVQGYEGTGRGFLLKFCARFPHLHRFELQQPIRWAQGCPLEKMVSEALVFDDENFTHTPQGNIVISAFEQTLWRSEPETPLKVYQLLSGAHYRTSPLDLRRMMDAPGQHFLQAAGENEIAGALWLVDEGGLSQELSQAVWAGFRRPRGNLVAQSLAAHGSNPLAATLRGRRVSRIAVHPARQREGTGQQLIAGALQYIHDLDYLSVSFGYTEELWRFWQRCGFVLVRMGNHREASSGCYTAMALLPMSDAGKQLAEREHYRLRRDAQALAQWNGEMLPVDPLNDAVLSDDDWLELAGFAFTHRPLLTSLGCLLRLLQTSELALPALRGRLQKNASDAQLCTTLKLSGRKLLLVRQREEAAQALFALDDVRTERLRDRITQWQFFH

SEQ ID NO: 5979 - DNA, 864 bp, Escherichia coli
atgcgttggcaagggcgacgtgaaagtgacaatgttgaagacaggcgcaacagctctggtggtccgtctatgggcggtcccggttttcgcctgccaagcggtaaaggcgggctgattttactgatagtcgtgctggttgcaggctactatggcgttgatttaaccgggttgatgaccggacagccggtttcccaacagcaatcaacgcggtcaattagccctaatgaagacgaagccgcaaaattcacctcggtgattctggcaaccacggaagacacctggggacagcaattcgagaagatgggtaaaacctatcagcaaccgaagctggtcatgtaccgtggaatgacgcgtaccggctgcggggcgggccagtccataatggggccattctattgcccggcggatggcacagtttatatcgatctctccttctatgatgacatgaaagacaaacttggcgcggatggcgattttgcccaggggtacgttatcgctcatgaagtcggtcatcatgtgcagaaactgttaggcatcgagccgaaagttcgtcaactgcaacaaaacgcgacgcaggcggaagtaaaccgcttatctgtgcgtatggaactccaggccgactgttttgccggtgtctgggggcatagtatgcagcagcaaggtgttctggaaaccggcgatctggaagaggcgctaaacgcggcgcaggccatcggcgatgaccgtttacaacagcaaagtcaggggcgagtagtaccagacagtttcactcatggcacttctcagcaacgctacagctggtttaaacgtggtttcgacagcggcgatccggcacaatgcaatacttttggtaaaagcatttaa

SEQ ID NO: 5980 - protein, 287 aa, Escherichia coli
MRWQGRRESDNVEDRRNSSGGPSMGGPGFRLPSGKGGLILLIVVLVAGYYGVDLTGLMTGQPVSQQQSTRSISPNEDEAAKFTSVILATTEDTWGQQFEKMGKTYQQPKLVMYRGMTRTGCGAGQSIMGPFYCPADGTVYIDLSFYDDMKDKLGADGDFAQGYVIAHEVGHHVQKLLGIEPKVRQLQQNATQAEVNRLSVRMELQADCFAGVWGHSMQQQGVLETGDLEEALNAAQAIGDDRLQQQSQGRVVPDSFTHGTSQQRYSWFKRGFDSGDPAQCNTFGKSI

SEQ ID NO: 5981 - DNA, 714 bp, Escherichia coli
atgcaaaagcaagctgagttgtatcgtggtaaagcgaaaaccgtatacagcacggaaaacccggacctgttggtgctcgaattccgcaatgatacgtcagcaggggatggcgcgcgcattgagcagtttgatcgcaaaggtatggtgaacaacaagttcaactacttcattatgagcaaactggctgaagcgggtatcccgactcaaatggagcgtctgctctccgataccgaatgtctggtgaaaaagctggatatggtgccggttgagtgtgtcgtgcgtaaccgtgctgctggctctctggtgaaacgtcttggaatcgaagaaggtattgagctgaacccgccactgttcgatctgttcctgaaaaacgacgccatgcacgatccgatggtcaacgaatcttactgcgaaacctttggctgggtgagcaaagagaacctggcgcgtatgaaagagctgacctacaaagcgaacgacgtgctgaaaaaactgttcgatgatgctggtctcattctggtcgacttcaagctggagtttggcctgtacaaaggtgaagtggtactgggcgatgagttctccccggacggcagccgcctgtgggacaaagaaacgctggagaaaatggacaaagaccgtttccgacagagcctcggtggcctgatcgaagcctatgaagccgttgcccgccgcctgggtgtacagctggactga

SEQ ID NO: 5982 - protein, 237 aa, Escherichia coli [sequence omitted]

SEQ ID NO: 5983 - DNA, 1035 bp, Escherichia coli
atggcttactctgttcaaaagtcgcgcctggcaaaggttgcgggtgtttcgcttgttttattactcgctgcctgtagttctgactcacgctataagcgtcaggtcagtggtgatgaagcctacctggaagcggcaccgcttgcggagcttcatgccccggctggaatgatcttgccggtgacctccggcgattatgcaatcccggtgaccaacggtagtggtgccgtcggtaaggcgctggacattcgtccaccagcccagccgctggcactggtttctggcgcgcgtacccagttcacgggcgataccgcttcattgctggtggaaaatggtcgtggcaatactctgtggccgcaggtggttagcgtgctgcaggcgaaaaactacaccatcacccaacgtgatgatgctggtcagacactgaccaccgattgggtacaatggaaccgtctggatgaagacgagcagtatcgtggtcgttatcaaatctctgttaagccgcagggttatcagcaggcggttacggttaaactgctgaacctggaacaggcgggcaaaccggttgcagacgcggcgtccatgcagcgttacagcacggagatgatgaacgttatttccgccggtctggataaatctgccactgacgccgcgaacgctgcgcaaaatcgtgcctccaccactatggacgtacaaagtgcagctgatgacaccggtttaccaatgctggtcgtacgcgggccgttcaatgtggtttggcaacgtctgccagctgcgctggaaaaagtgggcatgaaagtgactgacagcacccgttcgcagggcaacatggccgtaacttataagccgctgtctgacagcgaatggcacgaactgggcgcgagcgatccaggtctggcatccggtgactataaactgcaggttggcgatttagataaccgcagcagcctacagttcatcgatccgaaaggtcatactctgactcagagtcagaacgacgcgctggtagctgtcttccaggctgcgtttagcaagtaa

SEQ ID NO: 5984 - protein, 344 aa, Escherichia coli
MAYSVQKSRLAKVAGVSLVLLLAACSSDSRYKRQVSGDEAYLEAAPLAELHAPAGMILPVTSGDYAIPVTNGSGAVGKALDIRPPAQPLALVSGARTQFTGDTASLLVENGRGNTLWPQVVSVLQAKNYTITQRDDAGQTLTTDWVQWNRLDEDEQYRGRYQISVKPQGYQQAVTVKLLNLEQAGKPVADAASMQRYSTEMMNVISAGLDKSATDAANAAQNRASTTMDVQSAADDTGLPMLVVRGPFNVVWQRLPAALEKVGMKVTDSTRSQGNMAVTYKPLSDSEWHELGASDPGLASGDYKLQVGDLDNRSSLQFIDPKGHTLTQSQNDALVAVFQAAFSK

SEQ ID NO: 5985 - DNA, 879 bp, Escherichia coli
atgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggagctggctgacgggcgcattccggtgattgccgggaccggtgctaacgctactgcggaagccattagcctgacgcagcgcttcaatgacagcggtatcgtcggctgcctgacggtaaccccttactacaatcgtccgtcgcaagaaggtttgtatcagcatttcaaagccatcgctgaacatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattaggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggtcgtgagacggtcagagcggcgcttaagcatgccggtttgctgtaa

SEQ ID NO: 5986 - protein, 292 aa, Escherichia coli
MFTGSIVAIVTPMDEKGNVCRASLKKLIDYHVASGTSAIVSVGTTGESATLNHDEHADVVMMTLELADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 5987 - DNA, 639 bp, Escherichia coli
ttgttgtatgcatgttttttttatgctttccttaagaacaactcaccccttgaaggaataaccagtttgacactgtcatcgcaacattatctggtgatcactgcgttgggtgccgatcgccctggaatagtgaacaccatcacccgtcatgtcagtagttgcggctgtaatattgaagacagtcgcctggcgatgctgggagaagagttcacgtttatcatgctgctttccggttcatggaatgccattactctgattgaatcaacgttaccgttgaaaggtgccgagctggatcttttaatcgtgatgaagcgcacgacggcgcgtccgcgtccgccaatgccagcatctgtctgggttcaggtcgatgtggcagactccccgcatttaattgaacgcttcacagcacttttcgacgcgcatcatatgaacattgcggagctggtgtcgcgcacgcaacctgctgaaaatgaaagggctgcgcagttgcatattcagataactgcccacagccccgcatctgcggacgcagcaaatattgagcaagcgttcaaagccctatgtacagaactcaatgcacaaggcagtattaacgtcgtcaattattcccaacatgatgaacaggatggagttaagtaa

SEQ ID NO: 5988 - protein, 212 aa, Escherichia coli
MLYACFFYAFLKNNSPLEGITSLTLSSQHYLVITALGADRPGIVNTITRHVSSCGCNIEDSRLAMLGEEFTFIMLLSGSWNAITLIESTLPLKGAELDLLIVMKRTTARPRPPMPASVWVQVDVADSPHLIERFTALFDAHHMNIAELVSRTQPAENERAAQLHIQITAHSPASADAANIEQAFKALCTELNAQGSINVVNYSQHDEQDGVK

SEQ ID NO: 5989 - DNA, 471 bp, Escherichia coli
atgaatccactgaaagccggtgatatcgcaccgaaatttagcttgccggatcaagacggagaacaagttaatttgaccgacttccagggacagcgtgttctggtttatttctacccgaaagccatgacccccggctgtaccgtacaggcctgcggcttacgcgataacatggatgagttgaaaaaagcgggcgttgatgtgctgggtatcagcaccgataaacccgaaaaactctcccgttttgcggaaaaagagctgcttaactttacgctcctgtctgatgaggaccaccaggtgtgcgaacaattcggcgtctggggtgaaaagtccttcatgggcaaaacctacgatggtattcatcgcatcagcttcctgattgacgctgatggcaaaatcgaacatgtctttgacgatttcaaaaccagcaatcaccacgacgttgtgctgaactggctgaaagaacacgcctga

SEQ ID NO: 5990 - protein, 156 aa, Escherichia coli
MNPLKAGDIAPKFSLPDQDGEQVNLTDFQGQRVLVYFYPKAMTPGCTVQACGLRDNMDELKKAGVDVLGISTDKPEKLSRFAEKELLNFTLLSDEDHQVCEQFGVWGEKSFMGKTYDGIHRISFLIDADGKIEHVFDDFKTSNHHDVVLNWLKEHA

SEQ ID NO: 5991 - DNA, 1062 bp, Escherichia coli
atgctcgaaatgttgatgcaatggtatcgccgccgttttagcgacccggaagcgattgccttgctggttattttggttgctggttttggcattatctttttctttagcggcctactcgcgccgttgctggtggctattgtgctggcctatttactggaatggccgactgtccgcctgcagtctattggctgttcccgcccttgggcgacatctatcgtgctgatcctgtttgtgggcatcctgctactgatggcgttcgtggtactgcctatcgcttggcagcagggcatctacttaatccgcgatatgccggggatgctcaataagctttctgactttgccgccacgttgccgcgccgctatccggcgttaatggatgcgggcattattgatgcaatggctgaaaatatgcgcagtcggatgctgaccatgggcgattcggtggtgaaaatttccctcgcctcgttggttggtttgctgaccattgccgtctatctggtgctggtgccattgatggtcttcttcctgctgaaagacaaagagcagatgctgaacgccgttcgccgggtgctgccgcgcaaccgtggactggcaggacaggtgtggaaggagatgaatcaacaaatcaccaactatatccgcggcaaagtgctggagatgatcgtggtagggatcgccacctggctggggttcttgctctttgggctgaactattcgctgctgctggcggtgctggtcggcttctcggtacttattccgtacattggcgcatttgtggtgaccattccggtggttggcgtggcgctattccagtttggtgctggcacggaattctggagctgcttcgcggtgtatctgattattcaggcgctggacggcaacctgttagtaccggtgttgttctccgaagcggttaacctgcatcctctggtgattattttatcggtggtgatcttcggtggtttgtggggattctggggcgtattcttcgctattccattggcgacgctgatcaaagccgtgattcacgcctggcctgatgggcaaatcgcgcaagactga

SEQ ID NO: 5992 - protein, 353 aa, Escherichia coli
MLEMLMQWYRRRFSDPEAIALLVILVAGFGIIFFFSGLLAPLLVAIVLAYLLEWPTVRLQSIGCSRPWATSIVLILFVGILLLMAFVVLPIAWQQGIYLIRDMPGMLNKLSDFAATLPRRYPALMDAGIIDAMAENMRSRMLTMGDSVVKISLASLVGLLTIAVYLVLVPLMVFFLLKDKEQMLNAVRRVLPRNRGLAGQVWKEMNQQITNYIRGKVLEMIVVGIATWLGFLLFGLNYSLLLAVLVGFSVLIPYIGAFVVTIPVVGVALFQFGAGTEFWSCFAVYLIIQALDGNLLVPVLFSEAVNLHPLVIILSVVIFGGLWGFWGVFFAIPLATLIKAVIHAWPDGQIAQD

SEQ ID NO: 5993 - DNA, 1464 bp, Escherichia coli
atgttcaggcagttgaaaaaaaacctggttgcaaccctcattgctgctatgaccattggtcaggtagccccggcgtttgccgacagcgcagacaccttgccggatatgggaacctccgcaggaagcacactttccattggtcaggaaatgcagatgggcgactattatgtccgccagttacgcggcagcgcgccgttaattaatgatccgctgttaacgcaatacattaattcgctaggaatgcgtctggtttcgcatgccaattcggttaagacaccgtttcatttctttctgatcaacaacgatgaaattaacgcctttgctttctttggcggcaacgtggtgctgcactctgccctgttccgttattccgataacgaaagtcaactggcttcagttatggcgcacgaaatctcccacgtcacccaacgtcacctggcgcgagcgatggaagatcagcagcgcagcgcgccgctgacctgggtcggcgcgttaggttctattttactggcgatggccagtccgcaggcggggatggcggcgctgaccggtacactggcgggaacgcgccaggggatgatcagtttcacccagcaaaatgaacaggaagcggaccgcattggtattcaggtgctgcaacgctcgggattcgatccgcaggcgatgccgaccttcctcgaaaaattactcgatcaggcgcgttactcttcgcgcccaccagaaattctgctcactcacccactaccggaaagccgtctggctgatgcccgtaaccgtgccaatcagatgcgcccgatagtggtgcaatcgtcagaagatttctatctggcaaaagtgcgcacactggggatgtacaattcagggcgtaaccaactcaccagtgatttgctggatgaatgggcgaaaggaaacgttcgtcagcaacgagcggcgcaatatggtcgtgctttacaggcgatggaagccaataaatacgacgaggcgcgtaaaacgctgcaaccgttactggcggcagaacctggcaacgcatggtatctcgatctggctaccgatatcgatcttgggcaaaacaaagccaatgacgctatcaatcgcctgaaaaatgcccgcgatttgcgcaccaatccggtgttgcagctcaacctggcgaacgcttatctgcaaggggggcaaccacaggaagcggccaatattctgaatcgctacacttttaacaataaagatgacagcaacggctgggatttactggcacaggcggaagccgcactaaataaccgcgatcaggaactggctgcgcgagcagaaggttatgcgctcgccgggcgactcgatcaggctatttccttgttgagtagcgccagttcgcaggtgaaattaggcagcctgcaacaagcgcgttacgatgcgcgcatcgaccagttgcgccagctgcaggaacgctttaagccttataccaagatgtaa

SEQ ID NO: 5994 - protein, 487 aa, Escherichia coli
MFRQLKKNLVATLIAAMTIGQVAPAFADSADTLPDMGTSAGSTLSIGQEMQMGDYYVRQLRGSAPLINDPLLTQYINSLGMRLVSHANSVKTPFHFFLINNDEINAFAFFGGNVVLHSALFRYSDNESQLASVMAHEISHVTQRHLARAMEDQQRSAPLTWVGALGSILLAMASPQAGMAALTGTLAGTRQGMISFTQQNEQEADRIGIQVLQRSGFDPQAMPTFLEKLLDQARYSSRPPEILLTHPLPESRLADARNRANQMRPIVVQSSEDFYLAKVRTLGMYNSGRNQLTSDLLDEWAKGNVRQQRAAQYGRALQAMEANKYDEARKTLQPLLAAEPGNAWYLDLATDIDLGQNKANDAINRLKNARDLRTNPVLQLNLANAYLQGGQPQEAANILNRYTFNNKDDSNGWDLLAQAEAALNNRDQELAARAEGYALAGRLDQAISLLSSASSQVKLGSLQQARYDARIDQLRQLQERFKPYTKM

SEQ ID NO: 5995 - DNA, 360 bp, Escherichia coli
atgaccaaacaggtaaaaatctaccataacccacgctgttcaaagagccgggaaacgctgaacctgctgaaagaaaacggcgtggagccagaagtggtgctctaccttgagacacccgccgatgcggcaacgctgcgtgatttgctgaaaatgctggggatgaatagcgctcgtgaattgatgcgccaaaaagaggatctttataaagaactgaacctggctgacagttcgcttagcgaagaggtgctgattcaggcgatggtagagaatccgaagctaatggaacgcccgattgtggtcgcgaatggcaaagcgcggattggtcgtccaccggagcaggtactggaaatcgtgggttaa

SEQ ID NO: 5996 - protein, 119 aa, Escherichia coli
MTKQVKIYHNPRCSKSRETLNLLKENGVEPEVVLYLETPADAATLRDLLKMLGMNSARELMRQKEDLYKELNLADSSLSEEVLIQAMVENPKLMERPIVVANGKARIGRPPEQVLEIVG

SEQ ID NO: 5997 - DNA, 747 bp, Escherichia coli
gtggtaaacttctcgcgattttgtgaaatcctggttgaggtatctctgaacacaccggcacagctctctttgccactttatcttcctgacgacgaaacctttgcaagtttctggccgggggataactcctctttactggccgcgctgcaaaacgtgctgcgtcaggaacatagcggttacatctatctctgggcacgcgaaggcgcggggcgcagccatctgctgcacgcggcttgcgcggaattgtcacagcgtggcgatgcggtgggctatgtcccgctggataaacgcacctggtttgttccggaagtgctcgacggtatggagcatttgtcgctggtctgtattgacaacattgagtgtattgccggcgatgagttgtgggagatggcgattttcgatctctacaatcgaattctggaatcgggcaaaacacggttgttgatcaccggcgatcgtccaccgcggcagttgaatctgggattaccggatctcgcgtcgcgtctcgactgggggcagatctacaaattgcagccactttctgatgaagataagttgcaggcgctacagttacgcgcgcgtttgcgtggttttgaactgccggaagatgtggggcgtttcttgctgaagcggctcgacagagaaatgcgcacgttgtttatgacgctggatcagctggatcgtgcgtcgattaccgcgcaacgcaagctgaccattccgtttgtgaaagaaattctgaagttgtag

SEQ ID NO: 5998 - protein, 248 aa, Escherichia coli
MVNFSRFCEILVEVSLNTPAQLSLPLYLPDDETFASFWPGDNSSLLAALQNVLRQEHSGYIYLWAREGAGRSHLLHAACAELSQRGDAVGYVPLDKRTWFVPEVLDGMEHLSLVCIDNIECIAGDELWEMAIFDLYNRILESGKTRLLITGDRPPRQLNLGLPDLASRLDWGQIYKLQPLSDEDKLQALQLRARLRGFELPEDVGRFLLKRLDREMRTLFMTLDQLDRASITAQRKLTIPFVKEILKL

SEQ ID NO: 5999 - DNA, 1290 bp, Escherichia coli
atgacgcgccgtgctatcggggtgagtgaaagaccgccacttttacagacaatcccgcttagtttgcaacatttgttcgccatgtttggtgcaaccgtcctggtgcccgtcttatttcatattaacccggcgactgtactgttatttaacggtataggaacactgctgtatctcttcatctgtaaagggaaaattccggcttatcttggttccagctttgcctttatttcaccggtattgttactgttgccgttggggtatgaagtcgcgctgggcggctttattatgtgcggcgtgctgttctgcctggtttcttttatcgtgaagaaagcggggaccggctggctggacgtgctgtttccacctgcggcaatgggcgcaatcgttgccgtcatcggtctggagctggcgggcgtagctgccggtatggcgggtttactcccggctgaagggcaaacgccagactccaaaaccatcatcatctctattaccaccctggcggtcacggttttaggttccgtgctgtttcgtggtttcctggcaattatcccgattttaattggcgtgctggtggggtacgcgctctctttcgcaatgggaattgtcgataccacgccgattattaatgctcactggtttgcgctgccgaccctctatacgccgcgcttcgagtggtttgccattctgactattctgccagcggcgttagtggttattgccgaacacgtagggcacctggtcgtaacggctaatatcgtcaaaaaagatctgctgcgcgatccaggtctgcaccgttcgatgtttgctaacggcttgtcgaccgtgatctccggtttctttggttccacaccaaacaccacttacggagaaaacattggcgtgatggcgatcacccgtgtttacagtacctgggttatcggcggtgcggcgattttcgctatcctgctttcctgcgtcggtaaactggctgctgctatccagatgattccattgccggtgatgggcggcgtttcgctgctgctttacggggtcatcggtgcttccggtattcgtgtgttgatcgaatcgaaagtggattacaacaaagcacagaacctgatcctgacttccgttattttgatcatcggcgtcagtggcgcgaaggtaaacattggcgcggcggagctgaaaggtatggcgctggcgaccatcgtcggtatcggcttaagtttgatcttcaaactgattagtatgctgcgccctgaagaagtggtgctggacgcagaagacgcggatataacagacaaataa

SEQ ID NO: 6000 - protein, 429 aa, Escherichia coli
MTRRAIGVSERPPLLQTIPLSLQHLFAMFGATVLVPVLFHINPATVLLFNGIGTLLYLFICKGKIPAYLGSSFAFISPVLLLLPLGYEVALGGFIMCGVLFCLVSFIVKKAGTGWLDVLFPPAAMGAIVAVIGLELAGVAAGMAGLLPAEGQTPDSKTIIISITTLAVTVLGSVLFRGFLAIIPILIGVLVGYALSFAMGIVDTTPIINAHWFALPTLYTPRFEWFAILTILPAALVVIAEHVGHLVVTANIVKKDLLRDPGLHRSMFANGLSTVISGFFGSTPNTTYGENIGVMAITRVYSTWVIGGAAIFAILLSCVGKLAAAIQMIPLPVMGGVSLLLYGVIGASGIRVLIESKVDYNKAQNLILTSVILIIGVSGAKVNIGAAELKGMALATIVGIGLSLIFKLISMLRPEEVVLDAEDADITDK

SEQ ID NO: 6001 - DNA, 627 bp, Escherichia coli
atgaagatcgtggaagtcaaacacccactcgtcaaacacaagctgggactgatgcgtgagcaagatatcagcaccaagcgctttcgcgaactcgcttccgaagtgggtagcctgctgacttacgaagcgaccgccgacctcgaaacggaaaaagtcactatcgaaggctggaacggcccggtagaaatcgaccagatcaaaggtaagaaaattaccgttgtgccaattctgcgtgcgggtcttgggatgatggacggtgtgctggaaaacgttccgagtgcgcgcatcagtgtcgtcggtatgtaccgtaatgaagaaacgctggagccggtaccgtacttccagaaactggtttctaacatcgatgagcgtatggcgctgatcgttgacccaatgctggcaaccggtggttccgttatcgcgaccatcgacctgctgaaaaaagcgggctgcagcagcatcaaagttctggtgctggtagctgcaccagaaggtatcgctgcgctggaaaaagcgcacccggacgtcgaactgtatactgcatcgattgaccagggactgaacgagcacggatacattattccgggcctcggcgatgccggtgacaaaatctttggtacgaaataa

SEQ ID NO: 6002 - protein, 208 aa, Escherichia coli
MKIVEVKHPLVKHKLGLMREQDISTKRFRELASEVGSLLTYEATADLETEKVTIEGWNGPVEIDQIKGKKITVVPILRAGLGMMDGVLENVPSARISVVGMYRNEETLEPVPYFQKLVSNIDERMALIVDPMLATGGSVIATIDLLKKAGCSSIKVLVLVAAPEGIAALEKAHPDVELYTASIDQGLNEHGYIIPGLGDAGDKIFGTK

SEQ ID NO: 6003 - DNA, 1038 bp, Escherichia coli
gtgaccgataaaacctctcttagctacaaagatgccggtgttgatattgacgcgggtaatgctctggttggaagaatcaaaggcgtagtgaagaaaacgcgtcgtccggaagtgatgggcggtctgggcggcttcggtgcgctgtgtgcattgccgcaaaaatatcgtgaacctgtgctggtttccggcactgacggcgtaggtaccaagctgcgtctggcgatggacttaaaacgtcacgacaccattggtattgatctggtcgccatgtgcgttaatgacctggtggtgcaaggtgcggaaccgctgtttttcctcgactattacgcaactggaaaactggatgttaataccgcttcagcggtgatcagcggcatcgcggaaggttgtctgcaatcgggctgttcactggtgggtggcgaaacggcagaaatgccggggatgtatcacggtgaagattacgatgtcgctggtttctgcgttggcgtggtagaaaaatcagaaatcattgacggatctaaagtcagcgacggcgatgtgctgattgcactcggctccagcggcccgcactcgaatggctattcgctggtgcgcaaaattcttgaagtcagcggttgtgatccgcaaaccaccgaacttgatggtaagccattagccgatcatctgctggcaccgacccgcatttacgtgaagtcagtgctggagttgattgaaaaggtcgatgtgcatgccattgcgcacctgaccggcggcggcttctgggaaaacattccgcgcgtattgccagataatacccaggcagtgattgatgaatcttcctggcagtggccggaagtgttcaactggctgcaaacggcaggtaatgttgagcgccatgaaatgtatcgcaccttcaactgcggcgtcggtatgattattgccctgcctgctccggaagtggacaaagctctcgccctgctcaatgccaacggtgaaaacgcgtggaaaatcggtatcatcaaaacctctgattccgaacaacgcgtggttatcgaataa

SEQ ID NO: 6004 - protein, 345 aa, Escherichia coli
MTDKTSLSYKDAGVDIDAGNALVGRIKGVVKKTRRPEVMGGLGGFGALCALPQKYREPVLVSGTDGVGTKLRLAMDLKRHDTIGIDLVAMCVNDLVVQGAEPLFFLDYYATGKLDVNTASAVISGIAEGCLQSGCSLVGGETAEMPGMYHGEDYDVAGFCVGVVEKSEIIDGSKVSDGDVLIALGSSGPHSNGYSLVRKILEVSGCDPQTTELDGKPLADHLLAPTRIYVKSVLELIEKVDVHAIAHLTGGGFWENIPRVLPDNTQAVIDESSWQWPEVFNWLQTAGNVERHEMYRTFNCGVGMIIALPAPEVDKALALLNANGENAWKIGIIKTSDSEQRVVIE

SEQ ID NO: 6005 - DNA, 639 bp, Escherichia coli
atgaatattgtggtgcttatttccggcaacggaagtaatttgcaggcaattattgacgcctgcaaaaccaacaaaattaaaggcaccgtacgggcagttttcagcaataaggctgacgcgttcggccttgaacgcgcccgccaggcgggtattgcaacgcatacgctcatcaccagcgcgtttgacagtcgtgaagcctatgaccgggagttgattcatgaaatcgacatgtacgcacccgatgtggtcgtgctggctggttttatgcgcattctcagcccggcgtttgtctcccactatgccgggcgtttgctgaacattcacccttctctgctgccgaaatatcccggattacacacccatcgtcaggcgctggaaaatggcgatgaggagcacggtacatcggtgcatttcgtcaccgatgaactggacggtggcccggttattttacaggcgaaagtcccggtatttgctggtgatacggaagatgacatcaccgcccgcgtgcaaacccaggaacacgctatttatccactggtgattagctggtttgccgatggtcgtctgaaaatgcacgaaaacgccgcgtggctggatggtcaacgtctgccgccgcagggctacgctgccgacgagtaa

SEQ ID NO: 6006 - protein, 212 aa, Escherichia coli
MNIVVLISGNGSNLQAIIDACKTNKIKGTVRAVFSNKADAFGLERARQAGIATHTLITSAFDSREAYDRELIHEIDMYAPDVVVLAGFMRILSPAFVSHYAGRLLNIHPSLLPKYPGLHTHRQALENGDEEHGTSVHFVTDELDGGPVILQAKVPVFAGDTEDDITARVQTQEHAIYPLVISWFADGRLKMHENAAWLDGQRLPPQGYAADE

SEQ ID NO: 6007 - DNA, 2067 bp, Escherichia coli
atgggtcaggaaaagctatacatcgaaaaagagctcagttggttatcgttcaatgaacgcgtgcttcaggaagcggcggacaaatctaacccgctgattgaaaggatgcgtttcctggggatctattccaataaccttgatgagttctataaagtccgcttcgctgaactgaagcgacgcatcattattagcgaagaacaaggctccaactctcattcccgccatttactgggcaaaattcagtcccgggtgctgaaagccgatcaggaattcgacggcctctacaacgagctgttgctggagatggcgcgcaaccagatcttcctgattaatgaacgccagctctccgtcaatcaacaaaactggctgcgtcattattttaagcagtatctgcgtcagcacattacgccgattttaatcaatcctgacactgacttagtgcagttcctgaaagatgattacacctatctggcggtggaaattatccgtggcgataccatccgttacgcgctgctggagatcccatcagataaagtgccgcgctttgtgaatttaccgccagaagcgccgcgtcgacgcaagccgatgattcttctggataacattctgcgttactgccttgatgatattttcaaaggcttctttgattatgacgcactgaatgcctattcaatgaagatgacccgcgatgccgaatacgatttagtgcatgagatggaagccagtctgatggagttgatgtcttccagtctcaagcagcgtttaactgcagagccggtgcgttttgtttatcagcgcgatatgcccaatgctctggttgaagtgttacgcgaaaaactgactatttcccgctacgactccatcgtccccggcggtcgttatcataattttaaagactttattaatttccccaatgtcggcaaagccaatctggtgaacaaaccactgccgcgtttacgccatatttggtttgataaagcccagttccgcaatggttttgatgccattcgcgaacgcgatgtgttgctctattatccttatcacacctttgagcacgtgctggaactgctacgtcaggcgtcgttcgacccgagcgtgctggcgataaaaatcaatatctaccgcgtagcgaaagattcacgcatcatcgactcgatgatccacgccgcacacaacggtaagaaagtcaccgtggtggttgagttacaggcgcgtttcgacgaagaagccaacattcactgggcgaagcgcctgaccgaagcaggcgtgcacgttatcttctctgcgccggggctgaaaattcacgccaaactgttcctgatttcacgtaaagaaaacggtgaagtggtgcgttacgcacacatcgggaccgggaactttaacgaaaaaaccgcgcgtctttatactgactattcgttgctgaccgccgatgcgcgcatcactaacgaagtacggcgggtgttcaactttattgaaaacccataccgtccggtgacatttgattatttaatggtgtcgccgcaaaactctcgccgtctgttgtatgaaatggtggaccgcgagatcgccaacgcgcagcaagggctgcccagtggtatcaccctgaagctaaataaccttgtcgataaaggcctggttgatcgtctgtatgcagcctccagttccggcgtaccggttaatctgctggtgcgcggaatgtgttctctgatccccaatctggaaggcattagcgacaacattcgtgccatcagtattgttgaccgttaccttgaacatgaccgggtttatatttttgaaaatggcggcgataaaaaggtctacctttcttccgccgactggatgacgcgcaatattgattatcgtattgaagtggcaacgccgctgctcgatccgcgcctgaagcagcgggtgctggacatcatcgacatattgttcagcgatacggtcaaagcacgttatatcgataaagaactcagtaatcgctacgttccccgcggcaatcgccgcaaagtacgggcgcagttggcgatttacgactacatcaaatcactcgaacaatctgaataa

SEQ ID NO: 6008 - protein, 688 aa, Escherichia coli
MGQEKLYIEKELSWLSFNERVLQEAADKSNPLIERMRFLGIYSNNLDEFYKVRFAELKRRIIISEEQGSNSHSRHLLGKIQSRVLKADQEFDGLYNELLLEMARNQIFLINERQLSVNQQNWLRHYFKQYLRQHITPILINPDTDLVQFLKDDYTYLAVEIIRGDTIRYALLEIPSDKVPRFVNLPPEAPRRRKPMILLDNILRYCLDDIFKGFFDYDALNAYSMKMTRDAEYDLVHEMEASLMELMSSSLKQRLTAEPVRFVYQRDMPNALVEVLREKLTISRYDSIVPGGRYHNFKDFINFPNVGKANLVNKPLPRLRHIWFDKAQFRNGFDAIRERDVLLYYPYHTFEHVLELLRQASFDPSVLAIKINIYRVAKDSRIIDSMIHAAHNGKKVTVVVELQARFDEEANIHWAKRLTEAGVHVIFSAPGLKIHAKLFLISRKENGEVVRYAHIGTGNFNEKTARLYTDYSLLTADARITNEVRRVFNFIENPYRPVTFDYLMVSPQNSRRLLYEMVDREIANAQQGLPSGITLKLNNLVDKGLVDRLYAASSSGVPVNLLVRGMCSLIPNLEGISDNIRAISIVDRYLEHDRVYIFENGGDKKVYLSSADWMTRNIDYRIEVATPLLDPRLKQRVLDIIDILFSDTVKARYIDKELSNRYVPRGNRRKVRAQLAIYDYIKSLEQSE

SEQ ID NO: 6009 - DNA, 1470 bp, Escherichia coli
atggtcatagcccgtgtggtagatggtgccatgcagattattggccgcctgaaacagcgggtgcatctggcggacggcctggggccagataatatgttgagtgaagaggcaatgacgcgcggtttgaactgtctgtcgctatttgccgaaaggctacaggggttttctcctgctagcgtctgtatagttggtacccatacgctgcgtcaggcgctgaacgccactgactttctgaaacgcgcggaaaaagtcattccctacccgatcgaaattatttccggtaatgaagaagcccgtctgatttttatgggcgtggaacatacccaaccggaaaaaggtcgcaaactggttattgatattggcggcggttctacagaactggtgattggtgaaaatttcgaaccgattctcgttgaaagccgccggatgggttgtgtcagctttgcccagctttatttccctggcggggtcatcaataaagagaattttcagcgcgctcgcatggcggcagcacaaaaactggaaacgttaacctggcaatttcgaattcagggctggaacgtggcaatgggcgcttccggtaccataaaagccgcccatgaagtgttaatggaaatgggcgagaaagacgggataattaccccggaacgtctggaaaaactggtaaaagaagttttacggcaccgtaatttcgcatcgctgagtttaccaggtctttccgaagagcggaaaacagtcttcgttcctggactggcgattttatgcggtgtgtttgatgctttagccatccgtgaactgcgcctttctgacggggcgttacgcgaaggcgtactgtatgaaatggaaggacgtttccgtcatcaggatgtgcgtagtcgcactgccagcagcctcgccaaccagtatcacatcgacagcgaacaggcccgacgggtgctggataccactatgcaaatgtacgaacagtggcgggaacagcaaccgaagctggcgcatccacaactggaggcgctactgcgatgggccgccatgctgcatgaggtcgggttgaatatcaaccacagcggtttgcatcgccactccgcttatattctgcaaaacagcgacttgccgggttttaatcaggaacagcagctgatgatggcgacactggtgcgctatcaccgtaaagcgattaaactcgacgatctgccgcgctttaccttgtttaagaagaaacagttcctgccactgattcagctattgcgccttggcgtattactcaataatcaacgtcaggcaactaccacaccgccaacattgacgctgattactgatgacagtcactggacactgcgtttcccgcatgactggtttagtcagaatgcgctggtactgcttgatctggaaaaggagcaagaatactgggaaggcgtggctggctggcggttgaaaattgaagaagaaagtacaccagaaatcgccgcttaa

SEQ ID NO: 6010 - protein, 489 aa, Escherichia coli
MVIARVVDGAMQIIGRLKQRVHLADGLGPDNMLSEEAMTRGLNCLSLFAERLQGFSPASVCIVGTHTLRQALNATDFLKRAEKVIPYPIEIISGNEEARLIFMGVEHTQPEKGRKLVIDIGGGSTELVIGENFEPILVESRRMGCVSFAQLYFPGGVINKENFQRARMAAAQKLETLTWQFRIQGWNVAMGASGTIKAAHEVLMEMGEKDGIITPERLEKLVKEVLRHRNFASLSLPGLSEERKTVFVPGLAILCGVFDALAIRELRLSDGALREGVLYEMEGRFRHQDVRSRTASSLANQYHIDSEQARRVLDTTMQMYEQWREQQPKLAHPQLEALLRWAAMLHEVGLNINHSGLHRHSAYILQNSDLPGFNQEQQLMMATLVRYHRKAIKLDDLPRFTLFKKKQFLPLIQLLRLGVLLNNQRQATTTPPTLTLITDDSHWTLRFPHDWFSQNALVLLDLEKEQEYWEGVAGWRLKIEEESTPEIAA

SEQ ID NO: 6011 - DNA, 2244 bp, Escherichia coli
atgaaactgaatgcaacttatataaaaatacgtgataaatggtgggggcttccgctgttcctgccttctttaatcttgcccattttcgcccacattaatactttcgcgcatatttcttccggtgaagtttttctcttttatctgccactggcattgatgatcagcatgatgatgtttttcagctgggcggcattgccagggatcgccttagggatttttgtccgcaaatatgcagagctgggtttttacgaaacgctctcattaacggctaattttattatcattatcattctctgttggggcggttacagggtttttaccccccggcgtaacaacgtttcacatggtgatagccgtttaatttcccagcgactattctggcagattgtgtttcctgcaacgctgtttctgatacttttccagtttgctgcgtttgtagggttactggcgagcagagaaaatctggtcggcgtcatgccctttaacctcgggaccttaatcaattatcaggccttgctggtgggtaatctgattggtgtcccgctgtgctacttcatcattcgggtggtgcgaaatccgttttatttacgtagctattattcgcaattaaaacagcaggttgatgccaaagttaccaaaaaagagttcgcaatctggctactggcattaggtgctttactattgctgttatgcatgccgttaaatgaaaaaagcacgatttttagcaccaattacaccttgtcattattgctgcccctgatgatgtggggagcgatgcgctatggttataagctgatttcattgctctgggcggtcgtgttgatgatcagcatccacagctatcaaaattacattcccatttatcctggctataccacgcagctgaccataacctcctccagttatctggtattctcttttattgtcaattatatggctgtactggcaacccgtcagcgagcggtagtcagacgcattcagcggcttgcgtatgtggacccggtggttcatctgccaaatgttcgcgccctgaatcgcgcgttacgtgatgccccctggtctgcgctttgttatttacgcatccctggcatggaaatgctggttaagaattatggcatcatgctgcggattcaatacaagcaaaaactttctcactggctgtcaccattgctggaaccgggtgaagatgtttatcagctttcgggtaacgatctcgcgctgcggctgaatacagaatcgcaccaggagcgcattaccgcactggatagccatctcaagcaatttcgtttcttttgggatggaatgccgatgcaaccgcagattggcgtcagttactgctatgtgcgctcgccagtgaatcatatctacctgctgctgggagagctaaatacagtggccgaactttccatcgtgaccaacgccccggaaaatatgcagcgtcgcggagcaatgtatttgcaacgcgaattgaaagataaagtcgcgatgatgaatcggctacagcgggcgctggaacacaaccattttttcctgatggcccagccgattaccggtatgcgtggtgatgtttaccatgaaattcttctgcgcatgaagggtgagaatgatgagctgatcagccccgatagcttcttaccggtcgcgcacgaatttggtttatcgtcgagtatcgacatgtgggtcattgagcatacgctgcaatttatggctgaaaacagagcgaagatgcccgctcaccgttttgctattaatctgtctccaacctcggtatgtcaggctcgttttcctgttgaagtcagtcagctgctggctaaatatcagattgaagcgtggcaacttatttttgaagtcaccgaaagtaatgctctgaccaatgttaagcaggcgcaaatcaccttgcagcatcttcaggaattaggctgccagattgcgattgatgatttcggcaccggctacgccagctatgcgcggcttaaaaatgtgaatgccgatctgcttaaaattgacggcagttttatccgcaatattgtatcaaatagtctggattatcagatagtggcgtcgatttgccacctggcgcgaatgaagaaaatgcgggtagtggcagagtacgttgaaaacgaagagatccgcgaggcggtgctctctttggggatcgattatatgcagggttatcttattggtaagccgcaaccgttaattgatacgctgaatgaaatcgaacccattcgcgaaagtgcctga

SEQ ID NO: 6012 - protein, 747 aa, Escherichia coli
MKLNATYIKIRDKWWGLPLFLPSLILPIFAHINTFAHISSGEVFLFYLPLALMISMMMFFSWAALPGIALGIFVRKYAELGFYETLSLTANFIIIIILCWGGYRVFTPRRNNVSHGDSRLISQRLFWQIVFPATLFLILFQFAAFVGLLASRENLVGVMPFNLGTLINYQALLVGNLIGVPLCYFIIRVVRNPFYLRSYYSQLKQQVDAKVTKKEFAIWLLALGALLLLLCMPLNEKSTIFSTNYTLSLLLPLMMWGAMRYGYKLISLLWAVVLMISIHSYQNYIPIYPGYTTQLTITSSSYLVFSFIVNYMAVLATRQRAVVRRIQRLAYVDPVVHLPNVRALNRALRDAPWSALCYLRIPGMEMLVKNYGIMLRIQYKQKLSHWLSPLLEPGEDVYQLSGNDLALRLNTESHQERITALDSHLKQFRFFWDGMPMQPQIGVSYCYVRSPVNHIYLLLGELNTVAELSIVTNAPENMQRRGAMYLQRELKDKVAMMNRLQRALEHNHFFLMAQPITGMRGDVYHEILLRMKGENDELISPDSFLPVAHEFGLSSSIDMWVIEHTLQFMAENRAKMPAHRFAINLSPTSVCQARFPVEVSQLLAKYQIEAWQLIFEVTESNALTNVKQAQITLQHLQELGCQIAIDDFGTGYASYARLKNVNADLLKIDGSFIRNIVSNSLDYQIVASICHLARMKKMRVVAEYVENEEIREAVLSLGIDYMQGYLIGKPQPLIDTLNEIEPIRESA

SEQ ID NO: 6013 - DNA, 192 bp, Escherichia coli
gtgagtcaggcaaccagtatgcgaaaacgacaccgatttaacagtcgcatgacccgtatcgtactgctcatcagctttatcttcttctttggccgttttatctactcgtccgtcggtgcctggcagcaccatcagagcaaaaaagaagctcagcaatccacactctccgtcgaatcaccggtacaacgttag

SEQ ID NO: 6014 - protein, 63 aa, Escherichia coli
MSQATSMRKRHRFNSRMTRIVLLISFIFFFGRFIYSSVGAWQHHQSKKEAQQSTLSVESPVQR

SEQ ID NO: 6015 - DNA, 189 bp, Escherichia coli
gtggccgataacaccgccagcgacagcgccaataagcgcgccgaaggcttgtgcgttccgtttattttgggcgttgtctacggcaacttttgcgggaagaatggaaataatattaacggttttagtttcttgtttggtattcagttgatcggtttgataaacatcggcggcatgatcatcagcatttga

SEQ ID NO: 6016 - protein, 62 aa, Escherichia coli
MADNTASDSANKRAEGLCVPFILGVVYGNFCGKNGNNINGFSFLFGIQLIGLINIGGMIISI

SEQ ID NO: 6017 - DNA, 516 bp, Escherichia coli
atgaaatttaaaaaatgtcttctgcctgtggcaatgttagcgtcattcactctggcaggatgccagtcaaatgctgatgatcatgccgccgatgtttatcaaaccgatcaactgaataccaaacaagaaactaaaaccgttaatattatttccattcttcccgcaaaagttgccgtagacaacgcccaaaataaacggaacgcacaagccttcggcgcgcttattggcgctgtcgctggcggtgttatcggccacaacgtcgggtctggcagcaattccggaacgacggcaggtgcagttggcggcggagctgtaggcgcggcagcgggttctatggtgaatgataaaaccttagtggaaggtgtttctttaacatataaggaaggcaccaaagtgtatacctccacccaggtgggtaaagagtgccagtttacgacaggtttagccgttgttattaccacgacgtataacgaaacgcgtattcagccaaataccaaatgtcctgaaaagagctaa

SEQ ID NO: 6018 - protein, 171 aa, Escherichia coli
MKFKKCLLPVAMLASFTLAGCQSNADDHAADVYQTDQLNTKQETKTVNIISILPAKVAVDNAQNKRNAQAFGALIGAVAGGVIGHNVGSGSNSGTTAGAVGGGAVGAAAGSMVNDKTLVEGVSLTYKEGTKVYTSTQVGKECQFTTGLAVVITTTYNETRIQPNTKCPEKS

SEQ ID NO: 6019 - DNA, 540 bp, Escherichia coli
atgaagaaagtttttctttgcgccatcttagcctccttaagctatccggctatcgcctcatcattgcaggatcaactctcggctgtcgcagaagcggaacagcaaggtaaaaatgaagagcaaaggcagcatgacgaatgggtcgcggagcgcaacagggaaatccagcaagagaagcaacgtcgcgcaaacgcccaggccgcggctaataaaagagcggcaacggcagcagcgaataagaaagctcgtcaggataaactggacgccgaagccactgcggacaaaaaacgcgatcaaagttatgaagatgagctacgtagcttagagattcagaaacaaaaactggcgctggcgaaagaagaagcccgcgtcaagcgcgaaaacgaatttatcgatcaggaactgaagcacaaagctgcgcaaaccgatgtggtgcaatctgaagctgacgcaaacagaaatatgactgaaggcggtcgcgatctgatgaaaagcgtgggtaaagcagaagagaataaatcagatagctggtttaactaa

SEQ ID NO: 6020 - protein, 179 aa, Escherichia coli
MKKVFLCAILASLSYPAIASSLQDQLSAVAEAEQQGKNEEQRQHDEWVAERNREIQQEKQRRANAQAAANKRAATAAANKKARQDKLDAEATADKKRDQSYEDELRSLEIQKQKLALAKEEARVKRENEFIDQELKHKAAQTDVVQSEADANRNMTEGGRDLMKSVGKAEENKSDSWFN

SEQ ID NO: 6021 - DNA, 483 bp, Escherichia coli
atgatctgggcattcgtaaaagcatactggaaacagtttcttatcgtggcagtgcttgctgttctggtcatatcaggagtggttgcctggaatatacacggcagtcgccagtacgatgccgggtatgctcaggcggaagaagacagcaaagccgaagaagacaaagttcgtcagtactacgaacaggagaaagtgaccaatgaacgtgaagctcagcagaggatcgaccaggcgcgcaatgatgctcttgatgctgccgctagcgctggccggttgcagcaacaactctttgccatccgtgagcagctcaggcagtataacgccattgtcggcgctgggtcgtcagccgcagacaccggagttttgcttgccgacgtgctcagcaaatctctcgagagaaacagacaactggcagagtatgctgaccgggcagccgaagccggaagagtctgcgaaaaacagtacgacactttgaccagatag

SEQ ID NO: 6022 - protein, 160 aa, Escherichia coli
MIWAFVKAYWKQFLIVAVLAVLVISGVVAWNIHGSRQYDAGYAQAEEDSKAEEDKVRQYYEQEKVTNEREAQQRIDQARNDALDAAASAGRLQQQLFAIREQLRQYNAIVGAGSSAADTGVLLADVLSKSLERNRQLAEYADRAAEAGRVCEKQYDTLTR

SEQ ID NO: 6023 - DNA, 792 bp, Escherichia coli
ttgctgcggccagtattcctgttcgagtcgcctatgcaatctggttacgtacgccaatggctgtggatttatctgaggtcattatcaacgctgtcatgctggctgcggttattaaaacgcgcggtaacgtcgttcaaatttttaaagtatcgaggtctaaacatggagattaaacaattccagcgagctgctggtatcagcgaggcactggccgcacgctggttctcgcatataacttctgcgatgaaagagtttggtatcagcaaagcagaagatcaggcaatgtttattgctcaagtcgggcatgagtctgggggcttcaccaggttgcaggagaatttcaactacagtgtcagcggactggctaacttcgttcgggctgggcgtctcactcaggggcaggctaatgcactggggcgccgtgctggtgaaccaccattgccacttgagcgccagcgcgcgatcgcaaatctggtatacagcaaacgcatggggaacaatgcccctggtgatggctggaattaccgagggcgcggacttatccagattaccggtttgaataactatcgtgattgcggaaacggtctgaaggttgacctgctggagagccctgaactgctggcgcaggacgaatatgcggctcgtagcgcggcgtggttcttcgccagcaaaggatgcatgaagtataccggcgatattgcacgtgtaactctgattatcaatggtggccggaacggcatcgacgaccggcgagcgcggtacatcactgccagtaaggtgctggcggtatga

SEQ ID NO: 6024 - protein, 263 aa, Escherichia coli
MLRPVFLFESPMQSGYVRQWLWIYLRSLSTLSCWLRLLKRAVTSFKFLKYRGLNMEIKQFQRAAGISEALAARWFSHITSAMKEFGISKAEDQAMFIAQVGHESGGFTRLQENFNYSVSGLANFVRAGRLTQGQANALGRRAGEPPLPLERQRAIANLVYSKRMGNNAPGDGWNYRGRGLIQITGLNNYRDCGNGLKVDLLESPELLAQDEYAARSAAWFFASKGCMKYTGDIARVTLIINGGRNGIDDRRARYITASKVLAV

SEQ ID NO: 6025 - DNA, 282 bp, Escherichia coli
atcactaatgcagttatttgcactggcatagcaattcgcgttgtcacattccggcgtaacggctctcaacatcgaaggtggggaggatggcttgcttatttcctgattgttgctgcggccagtattcctgttcgagtcgcctatgcaatctggttacgtacgccaatggctgtggatttatctgaggtcattatcaacgctgtcatgctggctgcggttattaaaacgcgcggtaacgtcgttcaaatttttaaagtatcgaggtctaaacatggagattaa

SEQ ID NO: 6026 - protein, 93 aa, Escherichia coli
ITNAVICTGIAIRVVTFRRNGSQHRRWGGWLAYFLIVAAASIPVRVAYAIWLRTPMAVDLSEVIINAVMLAAVIKTRGNVVQIFKVSRSKHGD

SEQ ID NO: 6027 - DNA, 501 bp, Escherichia coli
gtggttaccagtgacggaacattaaagacagagccggtctctcctgacgaagcattgctggatgcctggggtgacgtcaggtatatcgcttataaatggctgaacgctgtcgctataaagggggaagaaggggcgaggatacatcatggtgtaatcgcgcagcaacttcgtgatgttcttatttctcacggactcatggaagaagaaagcacaacatgccgctatgcctttctttgctatgacgattatcccgcagtatatgatgacgtcattactggccaaagggaaatgccgctgactgataatgacgggagcatcattgttgatgaggatgataatccagtgatggtaatagaagacatcattgagcgcgttgaaataacgccagcaggatctagatggggggtcagacctgatctcttattctatatcgaggcagcatggcagcgcagagaaatggataagataaaagagcgggttcagtctctggaagaacgttaa

SEQ ID NO: 6028 - protein, 166 aa, Escherichia coli
MVTSDGTLKTEPVSPDEALLDAWGDVRYIAYKWLNAVAIKGEEGARIHHGVIAQQLRDVLISHGLMEEESTTCRYAFLCYDDYPAVYDDVITGQREMPLTDNDGSIIVDEDDNPVMVIEDIIERVEITPAGSRWGVRPDLLFYIEAAWQRREMDKIKERVQSLEER

SEQ ID NO: 6029 - DNA, 126 bp, Escherichia coli; identical to SEQ ID NO: 5691

SEQ ID NO: 6030 - protein, 41 aa, Escherichia coli; identical to SEQ ID NO: 5692

SEQ ID NO: 6031 - DNA, 2562 bp, Escherichia coli
atgacggtctcaaccgaagttgaccacaacgaatacaccggtaacggcgttacgacatcgtttccgtatacttttcgagttttcagaaaatcagacctggttgttcaggtgtctgacctgaacggaaacgtaacagaattggttctggataccggttatacggtaactggggcgggcacttatagtggcggttctgtggttcttccgtctccgcttgctactggatggcgaattacgatagatcgtgtgcttgatgtagtgcaggagacagaccttcgcaatcagggaaaatttttccccgaagtgcatgaagatgcctttgactacctgacgatgctgatccagcaatgttttgggtggttcagacgtgcattgatgaaaccatctttgcttgcaaaatattacgatgcaaagcaaaacaaaatttctaaccttgcagatccatcatttgagcaggacgctgtaaataatcgctcaatgcgtaattatgtcgatgctgcaatctccggggttgttggtggttttggttggtttattcagtatggttctggggctgtgtaccgaacgttccaggataaaatgcgtgatgctattagccccaaagattttggagctgttggtgatggtataaatgacgattccactgcaataagcgcgtgccttgaagcctcatctccaggttataaaattgacggattagggcttacttttaaagtatcaactcttccggatgtcagtcgatttaaaaatgctcgttttttatttgagagaataccgggccagcctcttttttatgcttctgaagattttatccagggagagttatttaaaattacagatacaccgtggtacaacgcctggacgcaggataaaacgtttgtatatgacaatgtcatctatgcgccttttatggctggagaccgccatggtgtaaataacctccatgttgcatgggttcgctcaggagatgacgggaagacctggacaacgccggaatggcttacagatttacatgaaaactatcccacagttaactatcactgcatgagtatgggggttgtcagaaatcgcctttttgctgtaattgagacgcggaccgtgagcggaaataaactgcaggttgcagagttgtgggatcgcccaatgagtcgcagccttcgcgtttatggtggtataacgaaagcagcaaatcagcaagtcgcttatattcgcattactgatcacggattatttgctggtgattttgtcaacttctcaaactctggtgttacaggtgttaccgggaatatgacggtgactactgttattgataaaaatacttttacagttacgacgcaaaatacccaggatgtggatcagaataacgagggtagatactggagttttggtacatcatttcactcgtcaccatggagaaaaaccagtcttggaactattccttcttttgttgacggaagcactcctgttactgagattcacagttttgcgacgattagcgataacagttttgctgttggctaccataatggtgatattggtccacgcgagcttgggatactctatttctctgatgctttcggttctcctggtagctttgttcgcagacgcatacctgcagaatatgaggcgaatgcatctgagccatgtgtaaaatattatgatggcattctgtatctgacgaccagggggacattaagtactcaacccggtagttcattgcacagaagctctgatttaggtacatcatggaattctcttcgcttcccaaataatgttcatcactcaaaccttccttttgccaaagttggcgatgagctgattatttttggcagtgagcgcgcatttggtgagtgggaaggaggagaacctgataaccgttatgcaggaaattatccaagaacatttatgaccagagttaacgtcaatgagtggagtctggataatgtagagtgggttaatgttactgatcagatttatcagggcggaatagttaactctgcggttggtgttggttcagtttgtatcaaagacaactggctgtactacattttcggtggggaagactttctaaacccatggagcataggggataacaacagaaaatatccttatgttcacgatggtcacccggctgatttgtattgtttcagggtgaaaattaaacaggaagaatttgtttcaagggattttgtctacggagccactcctaacagaacgcttcctacttttatgtcgacgtcaggcgtgaggacggttcctgtacccgttgatttcacagatgatgttgccgtccagtcactgactgtccatgcaggtacatcaggacaagttcgcgcggaagtcaaacttgagggtaattacgccattattgcgaagaaagtaccgtctgatgatgttaccgctcagagattaatcgttagcggcggtgaaacaacgtcttcagcagatggtgcaatgataacgttgcatggtccggaagcagtactccacgtcgcgcggtatataacgcactcgaacatctttttgagaacggagatgttaaaccttatcttgataatgtaa

SEQ ID NO: 6032 - protein, 853 aa, Escherichia coli
MTVSTEVDHNEYTGNGVTTSFPYTFRVFRKSDLVVQVSDLNGNVTELVLDTGYTVTGAGTYSGGSVVLPSPLATGWRITIDRVLDVVQETDLRNQGKFFPEVHEDAFDYLTMLIQQCFGWFRRALMKPSLLAKYYDAKQNKISNLADPSFEQDAVNNRSMRNYVDAAISGVVGGFGWFIQYGSGAVYRTFQDKMRDAISPKDFGAVGDGINDDSTAISACLEASSPGYKIDGLGLTFKVSTLPDVSRFKNARFLFERIPGQPLFYASEDFIQGELFKITDTPWYNAWTQDKTFVYDNVIYAPFMAGDRHGVNNLHVAWVRSGDDGKTWTTPEWLTDLHENYPTVNYHCMSMGVVRNRLFAVIETRTVSGNKLQVAELWDRPMSRSLRVYGGITKAANQQVAYIRITDHGLFAGDFVNFSNSGVTGVTGNMTVTTVIDKNTFTVTTQNTQDVDQNNEGRYWSFGTSFHSSPWRKTSLGTIPSFVDGSTPVTEIHSFATISDNSFAVGYHNGDIGPRELGILYFSDAFGSPGSFVRRRIPAEYEANASEPCVKYYDGILYLTTRGTLSTQPGSSLHRSSDLGTSWNSLRFPNNVHHSNLPFAKVGDELIIFGSERAFGEWEGGEPDNRYAGNYPRTFMTRVNVNEWSLDNVEWVNVTDQIYQGGIVNSAVGVGSVCIKDNWLYYIFGGEDFLNPWSIGDNNRKYPYVHDGHPADLYCFRVKIKQEEFVSRDFVYGATPNRTLPTFMSTSGVRTVPVPVDFTDDVAVQSLTVHAGTSGQVRAEVKLEGNYAIIAKKVPSDDVTAQRLIVSGGETTSSADGAMITLHGPEAVLHVARYITHSNIFLRTEMLNLILIM

SEQ ID NO: 6033 - DNA, 507 bp, Escherichia coli
atgctgaataaattccaggggttggttcaccctggaatttttgggaaggaccctgagctaatacctatcaaaaacgcgttcatagatcactggcgctacggtcatcataaggatttcggaaaggacactctgtttcgggatccaccgaaagagatgctggaatatcacatacgccacgttcacgtaaacatcggaaactatactgacaagtttggtgagagcggtacggaacaatgctggaaaaactgggcatccgggaagaaagacaagaccaccaacaagcataaaaaaataccaaccagtgatgtgtatgtgatttatcttgtaacgtctgagcgacatgcgtttcttctggattactgggatgagccagcacacaaaaaagtagaaattgacgaacaaaaacaaaaacttcttgtcgagtgtgacagaattttgcggctgaaaaatttagaatccatgccgcgcgatgcaagtttgtgggacccggaattttacgactgttaa

SEQ ID NO: 6034 - protein, 168 aa, Escherichia coli
MLNKFQGLVHPGIFGKDPELIPIKNAFIDHWRYGHHKDFGKDTLFRDPPKEMLEYHIRHVHVNIGNYTDKFGESGTEQCWKNWASGKKDKTTNKHKKIPTSDVYVIYLVTSERHAFLLDYWDEPAHKKVEIDEQKQKLLVECDRILRLKNLESMPRDASLWDPEFYDC

SEQ ID NO: 6035 - DNA, 696 bp, Escherichia coli
atgacagctacaaaaagcacgtccattttttctttcgaatcccaagccgatatacgggtaatcgtcattaatggtgagccatggtttatcgcttcagatgtttgtcgggctataggcatagcaaatcatcgagatgctgttcgaaaacttgatgatgatgagaagggcgtcgcttcaaccgacacccctggcggtgagcaagaatcgatcatcatctccgagtcaggcctctacacactgatcctccgctgccgcgacgcagtgacaccaggcactatcccctaccgctttcgtaaatgggttacaggtgaggttcttcctcagatccgccgcaccggaagttacattaaaaactcgctcccgcaggaagaacgcataaagatggttgccgaccaggtagccaacgccacagcatcagcagtgatgcaggcaatgaagatagagaacaaaacctacagtgccccactgaagcccggctaccgcagcctgattcattcgccgtctggtgttctcggcctgacggagaactcactgctgatgaatctgctgaaccagttacaggaagacgggcacgacgtatcgggcgcggcggcggagctgaccaccatgttctgctacatcgtcggtgtgagcaagtgcctgcgtgatatccagacgcacgcggagtacatcaacgacaaggctgggttcttctga

SEQ ID NO: 6036 - protein, 231 aa, Escherichia coli
MTATKSTSIFSFESQADIRVIVINGEPWFIASDVCRAIGIANHRDAVRKLDDDEKGVASTDTPGGEQESIIISESGLYTLILRCRDAVTPGTIPYRFRKWVTGEVLPQIRRTGSYIKNSLPQEERIKMVADQVANATASAVMQAMKIENKTYSAPLKPGYRSLIHSPSGVLGLTENSLLMNLLNQLQEDGHDVSGAAAELTTMFCYIVGVSKCLRDIQTHAEYINDKAGFF

SEQ ID NO: 6037 - DNA, 234 bp, Escherichia coli
gtggacgaaacaaaagtcagtgctacactcattgacgccacattgaggtggcttatagatggaaatttcacaatgaaaaaagcatttgctgcactgttcgttttgttgtctctggtagcttcaactcaggcctttgccggtcgttgtcagcacgacagcgatactgctgctgacggctcccgctgcggtgggcgttctgcggattcccgcccgggtggcggtggcattcgttaa

SEQ ID NO: 6038 - protein, 77 aa, Escherichia coli
MDETKVSATLIDATLRWLIDGNFTMKKAFAALFVLLSLVASTQAFAGRCQHDSDTAADGSRCGGRSADSRPGGGGIR

SEQ ID NO: 6039 - DNA, 852 bp, Escherichia coli
atgaaaaaaataaatttgttttttggcatagtgctttcaatagtctctgtaaatcctacagctgccagttcattgcaatgcaataaggataactttgatgcatgcaaaacgtgtgaacaattatcaaaggctatcgacttaaaagaacctaatcgtggcgattactatagaggggctttatggaatgggctttacgcctcttatgtaattaattgccctgtggttgctgagaagttactgagccatggtgctataccatcatatggcggatatatggggtctatgggggcggttctgacaggaaaatggcctcataacaatgaatcaataaatctttcatgggcagatttgcttataaaacatggatttgatgttaataggcatacggggaattataaatcagctactgaagtatgggctatagataaaaaacagattgaatataagtcagtttttgacaagttaattcaatccagcgaagtaaaaccactcgatccttcaagaaatttagaatggtgtgcgtctgaagggtatcgctcagttgtcgtttattcccttaactcatgtatagaaaatgctataaaacgtttggatgatggtgtttcttcagcgtctgatatttcatcagcagccgtaaattcctgtactagcgatgtagaaaatttcaataagcatttggcatgcaaagcagctgttaaagaaaactctgataaagagagaagcaacgtttaccagttattaaccagtgatagtcaaatgaataaaaatgttattgatatgctgaaggaaagaaatattgaaacggttcttgaatttagagctgaaaatcgatcagcgaaaactgcacagtga

SEQ ID NO: 6040 - protein, 283 aa, Escherichia coli
MKKINLFFGIVLSIVSVNPTAASSLQCNKDNFDACKTCEQLSKAIDLKEPNRGDYYRGALWNGLYASYVINCPVVAEKLLSHGAIPSYGGYMGSMGAVLTGKWPHNNESINLSWADLLIKHGFDVNRHTGNYKSATEVWAIDKKQIEYKSVFDKLIQSSEVKPLDPSRNLEWCASEGYRSVVVYSLNSCIENAIKRLDDGVSSASDISSAAVNSCTSDVENFNKHLACKAAVKENSDKERSNVYQLLTSDSQMNKNVIDMLKERNIETVLEFRAENRSAKTAQ

SEQ ID NO: 6041 - DNA, 3390 bp, Escherichia coli
atgccgatatatgaacaggatcctaaagagttgcttggcgaggatattcagcaaatagcagcacctgatgacagtaatttctatatggaaacaccttctttgctttctgctgtgaacccatttaccagtgatcaacgcgttcaaaggtctagacaagcagcatttcgtatagataacacgctgggtagctttattgccagtgctcctttcagtcagtttgacagggttgaaggatataacccatttgataacgatgcagcagatattaaaggctatgaagattttgcagattcgtttatcaactccggttcgcctgaagaaacaatggcaattaaacatcgaatcgatcagcagagagctgacatggaatacaattcaggcttgggatttgctggtacagtctcttctgtagcaatgagattagcagatccattcaatgcgatttctatgtttattccgttcggcgctgtcgttcgtggcggtcgtattgcagaaacagccgggcgttttgccctggcgaatgctgctggcagtgttgcttcagaggccgcattacaggccactcaggaagctcgctcaccgatggagagcgtatcgaacgttgttgttgatgctctcgttggtgggatccttggtgctggtgcacagctacttgctggacctggcgcgcgcgaggcagtggttaactcagtaggtaatcatttgcgaggtatggattctcctcaaagcattggtgcagctcaggttttcaataccacactcgatcaggaacagctcgctggacttggacttgctaacaaaacgttgagtgtcactcctgctggccgcttggcgcaatcaccatctcttgtctcccgtcagattaaccagcagcttgccgaaaataactatttcttcgccaaaaatgatgaggggttggctacgtttacggcagtcgagactaagattaagcaatacgacgccatgctttataagcagatggaagccactcgtgatgcttaccagcagtacagcaaatctgttagcgcccgcggcgtgaagaggatgaactttattgatttcaatgaagctgttggcatggctatgcgccgtggtgatcagagtgatattcctgaggtttcacaagcagctgccagaatccgccccattttcgagaccacaaaagcccgtatgcaggaactggggatccttcctgaggatatcgatgtcgtgacggcgaaaagttatcttccccgcatttataagttcgataagatactttccgaccgcactgaattcagagggcgaattgccaactggatacaagggattagtgccaaaggtgctgacaaggcaggtcagcgaattgaaaggataaattcattgctaaaaactgcagaggaatcggcaccgcgcgctgatgctctcgctagtgaaatcgctgaagcggagaaatggtctggtaaaaaaattctactcatggaagaactggataaacgaaataagcttatatctcaggagactgacacacaggcgcgtcttacaagaatagaaaaagagttggccgagacttcatcagaaaaacttcaggcaagaatgatgaaagaaagctctgaccttaaaacacgccttgatgatatagcgcaggcaaagagtgagcttcctgtctatcagcgccatatggagttgctggataatccacggaaatatcgttctgagcttcgccgactgcaaaaacgggcaaattcaaccacaaggctgaatgcaagccgcgaacgagcactgaagcagatggagcctctatcccgagaggaagcagaggacgctgctgacgagatcgtgaataaaataataggtgcaccttccgggcttgtaccagccgatattatcccagagagactcgttggtcgggctggtttcactaaaagcagaacgctgcttattcctgatgagcgtatagaagattttcttgaatcagatgttaactacatcatggaaagttatctccggcaggtggcaccagaaattgagctgactgcgcagtttggccgtaaagatatgggggagcaaatccgtcaggttagtgaggaatatacccggctaataaaagaggctaaaacgcctaaacgacgtgcagttcttgagaagcaacgggaggctgatattagggatattacggctatgcgtgatcgactgcttggtacttacggtgcacctcaagatccacgcagtttctttgttcgtgccgggcgagttgctaggaatattaacttcctccgtttgcttggtggaatgactgtctccgctgcaactgatctgatgcgaccgatgatgcagcatggcctgagaaaatctctcggaccaatggtaagcatgcttaaaaatatggactcagtgaaaattgcaaccagggatttgcgagaaatggccgttgggcttgattatgtcctgtctacgcgtacaaaggctatagcggatcttactgacccatatagccggagaagcgccgctgagcgaggcctgaactggatgacgcagaaattcggtaactggacgctgatgaatcagtggaacagcgcacttaaatcatggtccgggatgatagtgcagtcgaggatacttgacgcggctcgccaagtttctgctggtggcacgctctccaaaagtgaaatgcggaagatggcacaggtcggcatcaatgaagatgttctgcgccgaatcggggagcaattcgggaagcacggagaggatatggacgggctgttaaccgggcatagtcatctgtgggatgaccgtttcgctagagagattttccagtctgcagtgctgaaagatgtagactcagtgattgtaacgcctggcgtaggtgatacaccgctgttttttagtaaagaaggctggaagatgatcacgcagttcaaaacgtttatcttcgcacagcataacagggtgctggtatctggtatccagcagggcgatgctgcattctatcttggtgcgcttggcacgattgcgcttggctcaatggtctatatgatgaaacagaagttaagcggtcgcgatattgactacagctggaataaccttgtgaaagaggggatcgaccggggcggaatgcttggctggctctctgagccgctgaataccgttgagaacataagcggcggtaggtttggtcttggcgcgatgtttggtgcgcctccggtatcaaggtttcagagtcgtaatgctattggtgctttacttggtcctacctttgatcttggcggtgatgccgcgacggttgcgaatggtgtacttaacggagaatttgacagccagcaaacccacgcggtccgtaaaatgctaccttttcagaacctgtgggcaatatcaccgttactaaataaagttgaagagcagatgaaatag

SEQ ID NO: 6042 - protein, 1129 aa, Escherichia coli
MPIYEQDPKELLGEDIQQIAAPDDSNFYMETPSLLSAVNPFTSDQRVQRSRQAAFRIDNTLGSFIASAPFSQFDRVEGYNPFDNDAADIKGYEDFADSFINSGSPEETMAIKHRIDQQRADMEYNSGLGFAGTVSSVAMRLADPFNAISMFIPFGAVVRGGRIAETAGRFALANAAGSVASEAALQATQEARSPMESVSNVVVDALVGGILGAGAQLLAGPGAREAVVNSVGNHLRGMDSPQSIGAAQVFNTTLDQEQLAGLGLANKTLSVTPAGRLAQSPSLVSRQINQQLAENNYFFAKNDEGLATFTAVETKIKQYDAMLYKQMEATRDAYQQYSKSVSARGVKRMNFIDFNEAVGMAMRRGDQSDIPEVSQAAARIRPIFETTKARMQELGILPEDIDVVTAKSYLPRIYKFDKILSDRTEFRGRIANWIQGISAKGADKAGQRIERINSLLKTAEESAPRADALASEIAEAEKWSGKKILLMEELDKRNKLISQETDTQARLTRIEKELAETSSEKLQARMMKESSDLKTRLDDIAQAKSELPVYQRHMELLDNPRKYRSELRRLQKRANSTTRLNASRERALKQMEPLSREEAEDAADEIVNKIIGAPSGLVPADIIPERLVGRAGFTKSRTLLIPDERIEDFLESDVNYIMESYLRQVAPEIELTAQFGRKDMGEQIRQVSEEYTRLIKEAKTPKRRAVLEKQREADIRDITAMRDRLLGTYGAPQDPRSFFVRAGRVARNINFLRLLGGMTVSAATDLMRPMMQHGLRKSLGPMVSMLKNMDSVKIATRDLREMAVGLDYVLSTRTKAIADLTDPYSRRSAAERGLNWMTQKFGNWTLMNQWNSALKSWSGMIVQSRILDAARQVSAGGTLSKSEMRKMAQVGINEDVLRRIGEQFGKHGEDMDGLLTGHSHLWDDRFAREIFQSAVLKDVDSVIVTPGVGDTPLFFSKEGWKMITQFKTFIFAQHNRVLVSGIQQGDAAFYLGALGTIALGSMVYMMKQKLSGRDIDYSWNNLVKEGIDRGGMLGWLSEPLNTVENISGGRFGLGAMFGAPPVSRFQSRNAIGALLGPTFDLGGDAATVANGVLNGEFDSQQTHAVRKMLPFQNLWAISPLLNKVEEQMK

SEQ ID NO: 6043 - DNA, 2748 bp, Escherichia coli
atgccagttgttcctactacatccggacgccaggtgcaaagtcgtggtgtgcaaaccggtggttttcagaccttcgatgttcctcaagcaggtcaggtgctggcgaatgtcgcagatcagtatgcggtggcatatggtgaagccaggcagaaagcgaatgttgctatggctcaggaggcgttactgcaatttaaccaatttgcagatgaccagattaacaaccctgaaaatgggctgatttctaaacagggtaaaaacgctcttggtcagagtgacgctgttatgaaaaatatgcaggaaagggctcaggcattattaggctcaattcctgaaagtgaggaaaggaataaattatcctttcaactccagcagtctatgcagtcttattacaatcaggcacgtcgatatgaagttgggcagtttcagcaattccaagatcaaacgtatttgtcaggaaatgcattggctgtcactcagtctgcggggctatatagcgataaccaagcatttgtcgatttagccaagcagcgatttgaatctattgatcaatacgctgatgcacatgggcttcctgatgggtggcgtgttcagcagaaaactcagctcaaggaacaaatggggcagcaagcatggataggaaatatcgctcaaaaatacaacgagtttcttcaggttaatggagagccaggggatcttgatggtgtgagtcgtgcaatatcacatggtaattcattggatgctcgtggtttacgtaataataaccctggtaatattgaagcgagcaaatctaacccgtgggaaggtcagatcggtagcgatggacgttttgcaacgtttgctacccctgagcatggaatccgcgcgttgggtaaaaatatgttgtcttaccagcgtcaaggctatgacaccgttagcgagattgttaatcgctatgctccggctagtgatggtaataatactgatgcttatattagggcattgtgtagtgagcttggtgttggggagaatgatcagcttgatatctctaacccaaagacactagctgctttatgtgctgggattattaaacacgaaaatggcagtatgccttatagcaccgaacagcttgaaactggtatctcggcatcccttggtctaactaaccttgattcacctaagcgttatacgggcaatgcggcatttgacgctatgagccctcaaatgcaaatacaggcattgaggcaggctaatgagctgagaaatcagtaccgccagcagtatgcggaccagcttagcaccgtagttaaagatgcatattcagcccttgatgaaggattgaaacctgagaagttaccttctgaggacgattttatccgggccaatggtccgcgcattggcgctatgaagtggaaggatatgcaggcgcagatacaatatggaggtgtcattggtgccgctaaagacctcactccagaaggacgacaagacattcttgaacgtttacgtccacaggatccaaacgctcctggatttgcagctaaccagcaacgctgggagaaaatgcaggccaaatttaaagagatggatagggagtgggagattcagcagggaagaaacaggttcgtgtcttcaatgcaaaataacttcccgctggacccgaacgacaaaaacaatcaggcagcggtagaccgttatttcgcgcaggatatcgcgccttcgttttccatatctgatccgcagagcatcaatacactggtcaccgtcacaactaaaagcggcatgataccaactcaggttaaaacaatgcttaacagtggagcaacatcaagagatcctgcgctggttgtcccgatggcaaaattctacggtcagttatttgataataatccggcggcagcggcaacacttgataaaagtacgatggcattttacggcaaggtttacgattattcccgcgctggcgtgccggaggataaggctgttgatatggcttacagccaggtgttccaacaggatgaccgaatgaaacagatgctttccactgccatgcgagacaaaaaatatgtcgcggcgagggcaactgctgcacaaaataacgccagcagtctgacttcctttggttcgtggtctccggatattaccgatccaggaaaatcaaatgcggcctatcagcgagattaccagacaatttacgatgctaactttgtacagacaggtggcgatgcagaacaggctgagaaaatgaccaatgccatgatcagaaccacctggggagtttctacagttaatggcaaagcagaggttatgaagtatgcacctgaggcattgtacggagtaaataatggtgctggtaactggatacaggggcagtgggagcaggaaaaacgcgagcttaaatcaaaatcctttggcggtcctcgcagtgatacggacttaatacttgtttctgatggccttacggcaagggataggagttatgctgttatggttttacagcctgacgcaaacggagcgatagaaccgagaaattatattggagaaaatggtctccctgttcgtttcaagccggatcagctgacatctccaatgtacaggcaaaccattcagttccagcaacagcgtgttgatgaggctagagtgcggagagaaggcaatccgctgccgcagttcagcaataaagatggatatactcctccagatctgaccaaaccattcggttatggttcagccaattaccttccgagcaatatatacgcagggggcaaataa

SEQ ID NO: 6044 - protein, 915 aa, Escherichia coli
MPVVPTTSGRQVQSRGVQTGGFQTFDVPQAGQVLANVADQYAVAYGEARQKANVAMAQEALLQFNQFADDQINNPENGLISKQGKNALGQSDAVMKNMQERAQALLGSIPESEERNKLSFQLQQSMQSYYNQARRYEVGQFQQFQDQTYLSGNALAVTQSAGLYSDNQAFVDLAKQRFESIDQYADAHGLPDGWRVQQKTQLKEQMGQQAWIGNIAQKYNEFLQVNGEPGDLDGVSRAISHGNSLDARGLRNNNPGNIEASKSNPWEGQIGSDGRFATFATPEHGIRALGKNMLSYQRQGYDTVSEIVNRYAPASDGNNTDAYIRALCSELGVGENDQLDISNPKTLAALCAGIIKHENGSMPYSTEQLETGISASLGLTNLDSPKRYTGNAAFDAMSPQMQIQALRQANELRNQYRQQYADQLSTVVKDAYSALDEGLKPEKLPSEDDFIRANGPRIGAMKWKDMQAQIQYGGVIGAAKDLTPEGRQDILERLRPQDPNAPGFAANQQRWEKMQAKFKEMDREWEIQQGRNRFVSSMQNNFPLDPNDKNNQAAVDRYFAQDIAPSFSISDPQSINTLVTVTTKSGMIPTQVKTMLNSGATSRDPALVVPMAKFYGQLFDNNPAAAATLDKSTMAFYGKVYDYSRAGVPEDKAVDMAYSQVFQQDDRMKQMLSTAMRDKKYVAARATAAQNNASSLTSFGSWSPDITDPGKSNAAYQRDYQTIYDANFVQTGGDAEQAEKMTNAMIRTTWGVSTVNGKAEVMKYAPEALYGVNNGAGNWIQGQWEQEKRELKSKSFGGPRSDTDLILVSDGLTARDRSYAVMVLQPDANGAIEPRNYIGENGLPVRFKPDQLTSPMYRQTIQFQQQRVDEARVRREGNPLPQFSNKDGYTPPDLTKPFGYGSANYLPSNIYAGGK

SEQ ID NO: 6045 - DNA, 465 bp, Escherichia coli
atgatcgatgttcaaattattcccgcaaccgaagagcatcttcagatgattttgccggatgttcgtcaggctgatattgacgaactgtatgcggtatcactgatgactaccgaagatgcgctgcgtgttggtctgcgtactgcgactatggcctggtcagggttcgcgaacggagaactggtaaccatgtttggcgtatctccggcgtcaatgatcggtggcaatggtacgccctggctggtcgggaccagccgtattgaaaaatatcagaagacatttctgcgccactgccgccctgtattgcagcagatgctggcagtttatccgcgcctggaaaactacgtcgacgagcgaaaccatgttgccaaagcatggctgcactggcttggattcaggcttgaagaagccgcgccttatggtgctattggtcttaatttccacagatttcacatggagagaaaataa

SEQ ID NO: 6046 - protein, 154 aa, Escherichia coli
MIDVQIIPATEEHLQMILPDVRQADIDELYAVSLMTTEDALRVGLRTATMAWSGFANGELVTMFGVSPASMIGGNGTPWLVGTSRIEKYQKTFLRHCRPVLQQMLAVYPRLENYVDERNHVAKAWLHWLGFRLEEAAPYGAIGLNFHRFHMERK

SEQ ID NO: 6047 - DNA, 132 bp, Escherichia coli
atggctgactggtattttgcctgcttgctctggctgtacattgacgcggctgtggatgccactgtgacggcaaccaaagcgatggctgggttacacattattttctctccatgtgaaatctgtggaaattaa

SEQ ID NO: 6048 - protein, 43 aa, Escherichia coli
MADWYFACLLWLYIDAAVDATVTATKAMAGLHIIFSPCEICGN

SEQ ID NO: 6049 - DNA, 2472 bp, Escherichia coli
atggctatcagttggatccagcccagctttgccggtggtgagattggaccgtcgttgtacgggcgtattgacatggcgaagtaccaggtagcattgcgcaagtgcgataactttatcgtgcggcagtatggcggcgttgagaatcgacctggtacgcgttttgtcggtgccgccaaatacccaaatcggaaatgccgcctgatcccgttccaattctcgacggttcagacttatgctctggagttcggacaccagtacatgcgcgttatcaaagatggtgcgttggtgctgaacagcagcaatgttatttatgaaattgccacgccatatactgaagccgatctgttccgaattaaattcacgcaaagcgccgacgtgcttacgctggttcacccggcatacccgccgaaagagctgcgccgctatgcgcatgacaactggcaactggttgatgtggtaacgaagaacgggccatttgaagatatcaatattgatgagtcagtgacggtttatgccagcgccagcaccgggacaattacgttaacggcaagcgcctctatttttggcgcggagcaggtaggcaaattgttctatctggaacagcctgcagtggattctgtgccggtatgggaaaccagtaagagtacgtcgattggcgatattcgccgtgcagacagtaactactatcgcgccgttacagcaggcaaaacaggcactttgcgcccttcgcatacagaaggcacatcatgggatggctggggcggatccggtgatgatgatactggcattgagtgggagtatctgcacagtggttttggcattgcccgtataactgctgtaaatggcactactgcaactgctgaggtgatttcctatatcccttcgcaggtcgttggcgaggataatgccagctataaatgggctaaatatgcctggaacagtgttaacggttatcctggcacggttgtttattatcaacaacgtctttacttcgccgcatcgacagcgttccctcagactatctgggccagccgtactggggattataaggattttggcaaaagcaatcctacgcaggatgacgacagaattatctacacctatgccgggcgtcaggttaatgagatccgccacctgattgatgtcggttcgctggtggcactgacttccggaggtgagtacgtcatcaccggcgaccagaacaaagtattaactccatcatcatttgcattcagctctcagggatcaaatggttcgagcaatgtcccaccaattgccgtggcgaatattgctctgttcgtccaggagaaaggcagtgttgtccgtgatctggcctactcattcgatgttgacggctatcaggggaacgaccttactatccttgccaatcatctttttcagaagcacagcattgttgactggtgcttctctattgtcccttactccagcgccttctgcattcgtgatgacggtaaattactggtgatgacctatttgcgtgatcaacaggtttttgcatgggcaccacagtccagtaccggaaaatatgaaagcacatgcagtatcagcgaaggcaatgaagatgcggtgtatttcgtcattaaccgaaccgttaacgggcaaacagtgagatacatcgagcgactgtccagccgtttatttaccagcgatgaagatgctttctttgttgattctggccttagctatgatggaagaaatacgtctgacagaacgatgaccatcactggtggttctggtgaatgggattaccgtgcggaatatacaatcagtgtttctggtggtgcgtacttcaccagtagtgatgtcggcgcgcaactacagttcccttataccggaactgatcctgatactggcgatgaagtgtcaaaagaattacgttgcgacattatttctgtaaccagcaataccgctgtagtggttcgtgctaacaggaacgtcccgccatccctcaggaatgtggccaccacgaactggcagatggcgcgccggacatttggaggcctgtctcatcttgaaggccagaccgtaaacattctctctgatgcgaacgtggaaccacagaaagtggtttccggaggtgccgtcacgctggaatctccgggggctgtagtgcacatcggcctgccaataactgctgaattcgaaacactggatatcaacattaacggacaggaaacgctgctggacaaaaaacaggtgatcccctccgttactctggttgtgaatgccagtcgcggcatctgggcgactacgcccggcggtaaatggtacgaatatccacagcgtgaattcgagttctacgatgatcctgttgatgatgctaccggaaaagtagaagtgaaactggacagtaactggggcaaaaacggacgtgtaaaaatccgtcagcttgatccgttgccgctgtctgttcttgccgttattcctcgccttactgttgggggattctga

SEQ ID NO: 6050 - protein, 823 aa, Escherichia coli
MAISWIQPSFAGGEIGPSLYGRIDMAKYQVALRKCDNFIVRQYGGVENRPGTRFVGAAKYPNRKCRLIPFQFSTVQTYALEFGHQYMRVIKDGALVLNSSNVIYEIATPYTEADLFRIKFTQSADVLTLVHPAYPPKELRRYAHDNWQLVDVVTKNGPFEDINIDESVTVYASASTGTITLTASASIFGAEQVGKLFYLEQPAVDSVPVWETSKSTSIGDIRRADSNYYRAVTAGKTGTLRPSHTEGTSWDGWGGSGDDDTGIEWEYLHSGFGIARITAVNGTTATAEVISYIPSQVVGEDNASYKWAKYAWNSVNGYPGTVVYYQQRLYFAASTAFPQTIWASRTGDYKDFGKSNPTQDDDRIIYTYAGRQVNEIRHLIDVGSLVALTSGGEYVITGDQNKVLTPSSFAFSSQGSNGSSNVPPIAVANIALFVQEKGSVVRDLAYSFDVDGYQGNDLTILANHLFQKHSIVDWCFSIVPYSSAFCIRDDGKLLVMTYLRDQQVFAWAPQSSTGKYESTCSISEGNEDAVYFVINRTVNGQTVRYIERLSSRLFTSDEDAFFVDSGLSYDGRNTSDRTMTITGGSGEWDYRAEYTISVSGGAYFTSSDVGAQLQFPYTGTDPDTGDEVSKELRCDIISVTSNTAVVVRANRNVPPSLRNVATTNWQMARRTFGGLSHLEGQTVNILSDANVEPQKVVSGGAVTLESPGAVVHIGLPITAEFETLDININGQETLLDKKQVIPSVTLVVNASRGIWATTPGGKWYEYPQREFEFYDDPVDDATGKVEVKLDSNWGKNGRVKIRQLDPLPLSVLAVIPRLTVGGF

SEQ ID NO: 6051 - DNA, 606 bp, Escherichia coli
atggcctctgtagtagagatctgtaatcgtgcgctgtccaatattggcaacagccgcagcattaacagcctgacggaagccagcaaggaagcgggggaatgttcgctgcactttgaggcctgtcgtgatgctgtgctttctgattttgactggaactttgctaccaaacgcgtggcgcttgcagatacgagcaatccaccgcctgactgggaatatgcgtaccagtacccgtcagattgtctgcgcattactgaaattatgcttcctggtgtacgcaatccaacagcagcaatgcgcgttcagtacgaagttggtgcagacaccaacggaacaggaaagttgatctacacagaccagcctcaggcatggctcaagtatgtctctcgcgttacagatgtgaacatgtttgatgccatttttatggaggcgttggcctggcgtcttgcggcagctattaacatggcgctgactgggaatgcagacctcggtacgtttgccctcaatatgtacaatcgcgtgattcttagtgctggctcgcatagccagaatgaatcacaggaaccacagccaccggttgatgagtttaccattgcgaggttgtcctga

SEQ ID NO: 6052 - protein, 201 aa, Escherichia coli
MASVVEICNRALSNIGNSRSINSLTEASKEAGECSLHFEACRDAVLSDFDWNFATKRVALADTSNPPPDWEYAYQYPSDCLRITEIMLPGVRNPTAAMRVQYEVGADTNGTGKLIYTDQPQAWLKYVSRVTDVNMFDAIFMEALAWRLAAAINMALTGNADLGTFALNMYNRVILSAGSHSQNESQEPQPPVDEFTIARLS

SEQ ID NO: 6053 - DNA, 324 bp, Escherichia coli
atggaactcgtaaacctcaaaaccggcactgacagctaccaggatgagagcggagaaaccagaactcgcgatgaatacccgtgggggctgtgcatcactcttaataacgacacattgaataagctgaaggcgcaacctaagggcgtcggaacggaagtgatgataactgcaaaggctgttattcgaggcctgtctgccagagaaactaacgatggcgttaatcgcagcgccgatctgcagatcactgatatggcgatcgctcctgtttccggggatgtagaaaaatcagcggctgaaactctgtacggtaacggaggtgagtga

SEQ ID NO: 6054 - protein, 107 aa, Escherichia coli
MELVNLKTGTDSYQDESGETRTRDEYPWGLCITLNNDTLNKLKAQPKGVGTEVMITAKAVIRGLSARETNDGVNRSADLQITDMAIAPVSGDVEKSAAETLYGNGGE

SEQ ID NO: 6055 - DNA, 336 bp, Escherichia coli
atgtcaggtgagaaaccaagataccgcgttctgcgcctctctcatatccataacactctgtggccggagggggcagaaatcgaatacgaaggtgagcctggtagcgcactggaacctgttaacgatgcagccagacaggcaaaagcaaaggtagcaggaaaggtgtctatggcagcaaccagcaccaaaatcatcaacgatgtgtcagatgatggtgaactggataagctccgtgaagagtacgaattgctctttaacgagaagccacaccataacgccaaagccgaaacgctccgcgagaagatcgcagataagcgtaaagaactgggcgtgtaa

SEQ ID NO: 6056 - protein, 111 aa, Escherichia coli
MSGEKPRYRVLRLSHIHNTLWPEGAEIEYEGEPGSALEPVNDAARQAKAKVAGKVSMAATSTKIINDVSDDGELDKLREEYELLFNEKPHHNAKAETLREKIADKRKELGV

SEQ ID NO: 6057 - DNA, 438 bp, Escherichia coli
atgatcaccgacaaactgttgatgttctccgaagctcaggcggttacgaataccgcggcttctactgacgtaatcgatctcggtccaattgacggaaaacgtcgtgatatcggcgtgggttacccgcttgagttttgggcgctggttaacacagccgccgcggcaagcggtgatgcaactgtaaacatccagttgcagacgagtgagaataacagctcatggaccactatttatgatagtggcgcactggcaaagaccgccctgacagcaggtaaacgagttgtttctgcaaaggtgcctgccggtgttcagcgatatctgcgtgttaactactccgtcgcaactggcccactaacggctggcgaattcactgctggtatcagtcttgatgttgatgccaatacgccgtatccgatcctctcaaaagtaactggttaa

SEQ ID NO: 6058 - protein, 145 aa, Escherichia coli
MITDKLLMFSEAQAVTNTAASTDVIDLGPIDGKRRDIGVGYPLEFWALVNTAAAASGDATVNIQLQTSENNSSWTTIYDSGALAKTALTAGKRVVSAKVPAGVQRYLRVNYSVATGPLTAGEFTAGISLDVDANTPYPILSKVTG

SEQ ID NO: 6059 - DNA, 987 bp, Escherichia coli
atggctgttaaaggcttaactgcgctaacgctggctgactggggtaagcgcgtcgataaaaacgggaaagtcgataagattatcgagcttctcggtcaaactaacccgatccttcaggatatgccttttgtcgaagggaaccttcctaccggacaccgaaccaccattcgttctggtttaccttcagccacctggcgtttgctgaactatggcgtacagccaagcaaatcaaccacagtgcaggtcaccgattccgttggaatgctggaaacctatgctgaagtcgataagtcactggctgatctgaacggtaataccgccgaattccgcctgtctgaagaccgcgcatttattgaagcgatgaatcagcagatggcgcagacgctgttttatggtgattccagcgttaaccctcagcagtttatgggactgtcctcccgctattccagcctgtctgcaggtaatgctcagaacatcattgatgctggtggcacgggtacagataacacctcaatctggttagtggtgtggggcgaaaacacagtgcatggcatcttcccgaaagggcagaaggctggcattcagatggaagataaaggccaggtgacactggaagatgctaatggcggcaagtacgaaggctaccgtacccattacaaatgggacaacggacttgctctgcgtgactggcgttatgttgttcgcattgcaaacatcgatgtcagcaatctttcagaaccttcctctgccgcaaatattgcgaagttgatggttaaagcactgcatcgcattccaaatcgtggcatgggtcgcccggtgttctacatgaaccgcactgtaggccaggctcttgatctgcaatctctggagaaaacatctctggcgatcagcgtaaaagagacagaaggcgagtggtggacttcattccgtggtgtaccaatccgtgaaactgatgcgcttctggaaacagaagcccgcgtggtgtaa

SEQ ID NO: 6060 - protein, 328 aa, Escherichia coli
MAVKGLTALTLADWGKRVDKNGKVDKIIELLGQTNPILQDMPFVEGNLPTGHRTTIRSGLPSATWRLLNYGVQPSKSTTVQVTDSVGMLETYAEVDKSLADLNGNTAEFRLSEDRAFIEAMNQQMAQTLFYGDSSVNPQQFMGLSSRYSSLSAGNAQNIIDAGGTGTDNTSIWLVVWGENTVHGIFPKGQKAGIQMEDKGQVTLEDANGGKYEGYRTHYKWDNGLALRDWRYVVRIANIDVSNLSEPSSAANIAKLMVKALHRIPNRGMGRPVFYMNRTVGQALDLQSLEKTSLAISVKETEGEWWTSFRGVPIRETDALLETEARVV

SEQ ID NO: 6061 - DNA, 696 bp, Escherichia coli
atgaatttatttgagcgtttgctgtatagccgtctttgcaatgagcaaccagtcgatggtggagcagctccggctgcgtcagaaccgtcagcgcctgcaggtgataaccctgctccagttggtgatccatcacaacaggaaggtgataagccacaacctgttgctgatggcgataaacctgctgatgacaaaaagcctgaaaacgataagcaggatgaaaaaaaggacggcgataaaccagagggtgcgcctgagaagtacgagtttcaggctgccgaaggcgtagagctggatacagaagcgttgaaggaattcgagccggtggcgcgagaacttaacctgaccaacgagcaagcgcaaaagctggttgatgcttatccgaagattctggcaggtgttcagcagcgccaggcagaagcctggcagaaaacaaccgagcagtgggctgcggatgtaaaagctgacaaagaaatcggtggcgacaagttgatttctaaccttagcgccgcacagcgtgcgcttgaccagttcgggacacctgaactcaaagaatatctgaacaccaccgggctgggtaatcaccctgatctggtcaaaacgttcgtgaaaatcggaaaggcgatgtctgaagatggcatggtcaccggtggtaatgaaggccagcgtagtgcggccgaagtgctctatggcaaataa

SEQ ID NO: 6062 - protein, 231 aa, Escherichia coli
MNLFERLLYSRLCNEQPVDGGAAPAASEPSAPAGDNPAPVGDPSQQEGDKPQPVADGDKPADDKKPENDKQDEKKDGDKPEGAPEKYEFQAAEGVELDTEALKEFEPVARELNLTNEQAQKLVDAYPKILAGVQQRQAEAWQKTTEQWAADVKADKEIGGDKLISNLSAAQRALDQFGTPELKEYLNTTGLGNHPDLVKTFVKIGKAMSEDGMVTGGNEGQRSAAEVLYGK

SEQ ID NO: 6063 - DNA, 156 bp, Escherichia coli
gtggcttatcaccttcctgttgtgatggatcaccaactggagcagggttatcacctgcaggcgctgacggttctgacgcagccggagctgctccaccatcgactggttgctcattgcaaagacggctatacagcaaacgctcaaataaattcatga

SEQ ID NO: 6064 - protein, 51 aa, Escherichia coli
MAYHLPVVMDHQLEQGYHLQALTVLTQPELLHHRLVAHCKDGYTANAQINS

SEQ ID NO: 6065 - DNA, 297 bp, Escherichia coli
atgacagattacgaagacgatcaactgaaagaagaaaacgcccgtaagcaacgtgacatggcacagcgtgaaattgatgacattcgctttgtcatgagcagtgaacaggggcgtcgcgttgtctggtcggtgctggagaaaggccgtgtgttttccgctatctcaccgatggacgctatggcaatggcatttaatgaggggcaacgcaatctggcgctggaactgtttcagcgcgttatggcgcattgtcctgaacagtatttgaagatggccaaagaggccagtgaacaggagtga

SEQ ID NO: 6066 - protein, 98 aa, Escherichia coli
MTDYEDDQLKEENARKQRDMAQREIDDIRFVMSSEQGRRVVWSVLEKGRVFSAISPMDAMAMAFNEGQRNLALELFQRVMAHCPEQYLKMAKEASEQE

SEQ ID NO: 6067 - DNA, 1680 bp, Escherichia coli
atggcggaaacaactaaagagcgattgaacaaacagttcgcacaacttgaaagcgagcgtcagtcgttcgagccgcactggcgcgagttgagtgattacatcaacccgcgtggttcccgctttctgacttctgaagtcaaccgtaacgatcgacgcaatacacgcattattgattcgaccgggactatggcggcgcgcactctcgccagcggcatgatgtcaggcatcacaagccctgcgcgtccgtggtttcgcctggctacgccagatcctgaaatgatggattatggtcctgttaagttgtggctcgaggcggtgcagaaccgcatgaacgatatgttcaataagtcgaatctctaccagtctcttccgcagttatacggaagcctcggcacatacagcactggtgcaatggcggtgctggaggatgacgaggacatcattcgcacaatgccattcccgataggcagttactacctggctaactcacctcgtggcagtgtggacacctgttttcgcaagttctctatgactgttcgtcagcttgttcaggagttcgggctaaataacgtcagcgaatccgtaaaaagcatgtgggaaagcggcacctacgagaagtggattgaagtgatgcattcggtttacccgaacattgaccgcgatacatcgaagctggatagcaagaacaagccattcaaatcggtttattacgaggttggtggcgataacgacaagttgttgcgtgagtccggattcgatgagtttccaattatggctccgcgctgggaagttaacggcgaagatgtttatggatcatcatgcccgggtatgctggcgcttggacctgttaaggcattgcagcttctccagaagcgcaagtcgcagttgattgataaagccaccaatccgccgatggttgctccgacttccctcaagaatcagcgtgcctcccttcttcctggcgacatcacgtatatcgatcagattactggtcaggatggtttcaggcctgcttatctggttaaccccagtacagcagatttggtggcagacattcaggacactcgtcaaatcattaacagcgcctactttgtcgatctgttcatgatgttgcagaacatcaatacccgctcgatgcctgttgaagcggtgatcgaaatgaaagaagaaaaacttctgatgttggggccggttctggagcgtctgaacgacgaatgtcttaatcctctcattgaccgctctttctcgatgatggtgcgtaaaaacatgctgccgccaccgccagacgtgatggaaggtatgcccctgaaggtcgaatacatttccgtcatggctcaggcgcagaagtctatcggcctgtccagtctggcgtccacggttaacttcattggtcaacttgcgcaagcgaaaccagaagctctcgacaaactcaacgttgatcaggcgatcgatgcattcgctgatatgtccggagtgtctccaaccgtcattgttccgcaggaacaggttgagcaggctcgccagcaacgggcacagcagcaacagcagcaacaaatgatggcgatggggatggcggcggcacagggtgccaagacgctaagcgaagctaaaacttcggatccgagtgttttgtcagctatggcgaatgcagttagtggtcagggtgggcaatcacaatga

SEQ ID NO: 6068 - protein, 559 aa, Escherichia coli
MAETTKERLNKQFAQLESERQSFEPHWRELSDYINPRGSRFLTSEVNRNDRRNTRIIDSTGTMAARTLASGMMSGITSPARPWFRLATPDPEMMDYGPVKLWLEAVQNRMNDMFNKSNLYQSLPQLYGSLGTYSTGAMAVLEDDEDIIRTMPFPIGSYYLANSPRGSVDTCFRKFSMTVRQLVQEFGLNNVSESVKSMWESGTYEKWIEVMHSVYPNIDRDTSKLDSKNKPFKSVYYEVGGDNDKLLRESGFDEFPIMAPRWEVNGEDVYGSSCPGMLALGPVKALQLLQKRKSQLIDKATNPPMVAPTSLKNQRASLLPGDITYIDQITGQDGFRPAYLVNPSTADLVADIQDTRQIINSAYFVDLFMMLQNINTRSMPVEAVIEMKEEKLLMLGPVLERLNDECLNPLIDRSFSMMVRKNMLPPPPDVMEGMPLKVEYISVMAQAQKSIGLSSLASTVNFIGQLAQAKPEALDKLNVDQAIDAFADMSGVSPTVIVPQEQVEQARQQRAQQQQQQQMMAMGMAAAQGAKTLSEAKTSDPSVLSAMANAVSGQGGQSQ

SEQ ID NO: 6069 - DNA, 207 bp, Escherichia coli
atgtgcatgggtagctcaccatcagtgcctgcaacaccagaagttcaggcagcaccacaggagcaggatgccgccgttgttgatgcccgcgacgaagaaacacgtcgccgtcgcgctgctgctggtcgtagttctacgctgcttaccggttctcagggcgacacatcaaccgctaataccagcggtaaaacgctgcttggtcagtaa

SEQ ID NO: 6070 - protein, 68 aa, Escherichia coli
MCMGSSPSVPATPEVQAAPQEQDAAVVDARDEETRRRRAAAGRSSTLLTGSQGDTSTANTSGKTLLGQ

SEQ ID NO: 6071 - DNA, 252 bp, Escherichia coli
atgcccggcgaaccgggcgaactggaagcaatgagttatgccttccgtggctgtacgggtttacagcatgaagtcatcgcaatggcgtcctgctgtaaaaagggcggtgatagtccttcaagggaaaccatcaccgccaagcacctggaacttctggcatcacggtccttaggcgtgattctggcgtggcatgcaggattcgaacctgcgaccaaccgcttagaaggcggttgctctgtccaactgagctaa

SEQ ID NO: 6072 - protein, 83 aa, Escherichia coli
MPGEPGELEAMSYAFRGCTGLQHEVIAMASCCKKGGDSPSRETITAKHLELLASRSLGVILAWHAGFEPATNRLEGGCSVQLS

SEQ ID NO: 6073 - DNA, 423 bp, Escherichia coli
atgaaaacaattgatatgttggctaagtatctaaatgaatggccattaaaatattctcgtatcgttcaggctgaagactgcgttttttatggcgtttttgctggtaatgaaatgcattacgaagtaattcagagtgagggactggccgggttaacgcttagcgatgaccatggaataggagttacttgccatgactggatttcagcgcagaaaactgaaatggaaaaaggcaatgtgtttgatatttctcgcgctgtatacgccaaagaaaaaagtgatgatgattacatgcgcgaaaacttatacaacatgaagttacaatgcctggctgaagtgcttagtaaaagatctttacttgatgtggttggtgctgagcaggacgccaaggcaatcaacgccgcattcgataaaataaccttctaa

SEQ ID NO: 6074 - protein, 140 aa, Escherichia coli
MKTIDMLAKYLNEWPLKYSRIVQAEDCVFYGVFAGNEMHYEVIQSEGLAGLTLSDDHGIGVTCHDWISAQKTEMEKGNVFDISRAVYAKEKSDDDYMRENLYNMKLQCLAEVLSKRSLLDVVGAEQDAKAINAAFDKITF

SEQ ID NO: 6075 - DNA, 450 bp, Escherichia coli
atggcgaagcgtatcgctgactttgaagaccagtatcaggctgacgcggtgttcatcgacttcggttacggaaccggtttgaagtcaatcggtgacggctggggtcgtacatggcaacttgttccgttcggtggcgcgtctactgacccgcagatgctcaacaagcgtggggagatgttcaactcatgcaagacatggctgaggctcggcggcatgctggatgaccaggaaacagcggacgacctgtcgacggcagagtacaaagttcgcgtggacggtaaaatcgttatcgaaccgaaggaagatatcaaagagcgacttgggcgttctcctggtaaaggcgatgcgctactgctgacgtttgcgttccctgtgtcgaagcgtctgcgaattcccgggcagcagaaccagcaaggcaaagccatcacagactatgatccttttgcataa

SEQ ID NO: 6076 - protein, 149 aa, Escherichia coli
MAKRIADFEDQYQADAVFIDFGYGTGLKSIGDGWGRTWQLVPFGGASTDPQMLNKRGEMFNSCKTWLRLGGMLDDQETADDLSTAEYKVRVDGKIVIEPKEDIKERLGRSPGKGDALLLTFAFPVSKRLRIPGQQNQQGKAITDYDPFA

SEQ ID NO: 6077 - DNA, 231 bp, Escherichia coli
atgagcgataacggacatttcgatttcaaaaagcactggcttgcacttactccggatgagcgtgaagccttcgcacaggaagccggaacgacgagtcactatatccagactcacttaacaggtaagcgcaaaatgccaggtaaggtattgatgaatgggctttttaaagcctgtaaaacaagacaatggctgcgctcaaaagcagaattggcatacttcttctactcatga

SEQ ID NO: 6078 - protein, 76 aa, Escherichia coli
MSDNGHFDFKKHWLALTPDEREAFAQEAGTTSHYIQTHLTGKRKMPGKVLMNGLFKACKTRQWLRSKAELAYFFYS

SEQ ID NO: 6079 - DNA, 585 bp, Escherichia coli
atgaaaagtatccaggacgtccgcaggcaaaatctcaacgacttgatcgaccgtgaattcaatggtgttcagacgcggatggcagaaaaacttggaactcaggcaaatctggtaaaccgctgggctcttggcaagaaggttatcggcgaccaggttgcgcgaaaaattgaagctgccgccaataaaccccgtaactggcttgatatcgatcgctcgctttctcaggaaggttttcagcctgtcggcccaagcgacattggccagctggcggctcacaacctggaacgctggatgagcgaaagccgcgacctttcaacacagggaaaacttcaccgcgcatccggcgtcgcccaggtgacaatcagccgcctgttaaacaatgaggtcagcgtttccatttccaccctggagaatgttgcatccgcattcgggcgtcacggctatgaattactgattcacccgcacgaccctgcgaccatcaactatgaccgctcgcgctacgcattgttacccgaaaccgagaaagcaaagatcgaaagttacattgaatttgtcatcaaccagaacgaaaaaaacaaacaataa

SEQ ID NO: 6080 - protein, 194 aa, Escherichia coli
MKSIQDVRRQNLNDLIDREFNGVQTRMAEKLGTQANLVNRWALGKKVIGDQVARKIEAAANKPRNWLDIDRSLSQEGFQPVGPSDIGQLAAHNLERWMSESRDLSTQGKLHRASGVAQVTISRLLNNEVSVSISTLENVASAFGRHGYELLIHPHDPATINYDRSRYALLPETEKAKIESYIEFVINQNEKNKQ

SEQ ID NO: 6081 - DNA, 153 bp, Escherichia coli
atgcagtggaaaatcatcaacggttggtactgcgttactgcatgcggattcatgagctggaagttccgcaccttacaggaaggcattaagtgggctttcgtcagcaaagaagctcgcgatgtggccaacgataacgagatatgggaggtctga

SEQ ID NO: 6082 - protein, 50 aa, Escherichia coli
MQWKIINGWYCVTACGFMSWKFRTLQEGIKWAFVSKEARDVANDNEIWEV

SEQ ID NO: 6083 - DNA, 300 bp, Escherichia coli
atgaacgttaatcagcagaaaaatcttcaaaaaatcatgctggcattcgacaaggactaccgcctgtcagaacagctatatgaccgacaagttgaactgatcgagagcatccggcttcatcaactggcctcaactttcgacgctgtaacaggtaaaggcgttcgccaggaagtactggaggccgctaaagacagtccagagttcgaagaactgatggattcctaccggcgcgaggcaatggcaattatagcgcgctgggatctggctgatcagcttgatgggcagagggacgcggcatga

SEQ ID NO: 6084 - protein, 99 aa, Escherichia coli
MNVNQQKNLQKIMLAFDKDYRLSEQLYDRQVELIESIRLHQLASTFDAVTGKGVRQEVLEAAKDSPEFEELMDSYRREAMAIIARWDLADQLDGQRDAA

SEQ ID NO: 6085 - DNA, 822 bp, Escherichia coli
atgaatactggcatctatttcgacatcagcaatgaggactaccacgccggtgacggcgtgagtaagtcgcaactggacatggttgccaagaatccggcgcttcttaaatgggttcaggcagcaccagaagacgaagagaaaaagtctgcactggatatgggaaccgcattgcactgtctgcttctggagcctagagagttcgacaaacgcttcattgtttcaccgaaattcgatcgtcggacgaaacaaggtaaagctgacgaagaggcatttcttcgtgatgtggcggatatggggattacggtacttgatgccgagcagtggcggaaactggaactgatgcgtgatagcgcaatggctcacccggcggcacgctggatgttggaagcacctggttactgcgaagcgtcaatgtactggaacgatgaagaaacgggtgagttgtgccgaattcgtccagacaaatggctgaacgagcacaacgtgatcatcgacgtgaaaaaggttgcagatatggaccgttttgcacgtcacatcgaggaattccgctaccacgtgcaggacgcaatgtaccgcgaaggcgcaatgagggttactggtcagccgcatggttttttctttcttgccgtgagcgaaagcattgattgtggtcggtatccggtacgcgtgttcgagctggatgcgccggatgtcgatgccgggcacgctctgttccgccgggatctgaatacctatcacgaatgccgcatcaacgatgagtggggcggagtggaaattattaaacgccctgactgggcacgtaaacaggatatgtacgtatga

SEQ ID NO: 6086 - protein, 273 aa, Escherichia coli
MNTGIYFDISNEDYHAGDGVSKSQLDMVAKNPALLKWVQAAPEDEEKKSALDMGTALHCLLLEPREFDKRFIVSPKFDRRTKQGKADEEAFLRDVADMGITVLDAEQWRKLELMRDSAMAHPAARWMLEAPGYCEASMYWNDEETGELCRIRPDKWLNEHNVIIDVKKVADMDRFARHIEEFRYHVQDAMYREGAMRVTGQPHGFFFLAVSESIDCGRYPVRVFELDAPDVDAGHALFRRDLNTYHECRINDEWGGVEIIKRPDWARKQDMYV

SEQ ID NO: 6087 - DNA, 882 bp, Escherichia coli
atgagcaatgatatcgcaatcacatcacaaccaggcgcaactgtaggcactgctgcggcaatcttcagccccgagggaatgaatcaactggtgcgtttcgctgagttgatgtcacaaagcaaagcgactgtaccgaaacatcttgaaggcaaacctgccgattgcctggcggtgaccatgcaggcggcacagtggggaatgaaccctttcgccgtggcgcagaaaacgcatgtggtaaacggaacgttaggctacgaagcacagttggtaaacgcggtcgtatcctcgtcaagcctgctggcgacacgcctgaattatcgctggagcggtgactggtcgaatgttaacggcaaaacagataaatcaccgaatctgacggtaactgtgtcagcagttcttaaaggagaagcagaaccacgtgagcttaccatcagtatggcgcaagccggagtgcgtaactctccattgtgggaacaggatccgcgccagcagcttgcctatctttgcacgaaacgatgggctcgcctgcacgctcctgatgtacttctcggtgtttacacaccagacgaattacaggaaacggcaccgcgcgttgagcgagacattactccgcaaactaccactgctgcgggaatgaacagtctgatcaacgctaaaacagtgaaaaagcctgatgagcaaacgcgtaaagcggatagccgtgatccagaagaaatgctgatggcctttaccagcgcagcgatgaattacagcactgtctccgaactggataaggcttacaaatacattgcacaaaaactttcagatgatgacgaactgctggcaaaagccaccgacgtttacagcgttcgtcgggaagaattaaacgaaacatctatgtaa

SEQ ID NO: 6088 - protein, 293 aa, Escherichia coli
MSNDIAITSQPGATVGTAAAIFSPEGMNQLVRFAELMSQSKATVPKHLEGKPADCLAVTMQAAQWGMNPFAVAQKTHVVNGTLGYEAQLVNAVVSSSSLLATRLNYRWSGDWSNVNGKTDKSPNLTVTVSAVLKGEAEPRELTISMAQAGVRNSPLWEQDPRQQLAYLCTKRWARLHAPDVLLGVYTPDELQETAPRVERDITPQTTTAAGMNSLINAKTVKKPDEQTRKADSRDPEEMLMAFTSAAMNYSTVSELDKAYKYIAQKLSDDDELLAKATDVYSVRREELNETSM

SEQ ID NO: 6089 - DNA, 249 bp, Escherichia coli
atgaaaggtgcattaggtaagaaggaactcctggcggtggtgccactgtcatggagcactatcgaccgtatggagcgcgcaggggaatttcctaaacgctggtatatcactgacaaacgctgtgcatggaaccgtgacgaagttgagcgttggcttgatgaacgtcaggcagcaagcccggcagagttccagggtaaaaaacctcctgttcagcaacgtgtatatcgtcccgtgagcaacgctgcatga

SEQ ID NO: 6090 - protein, 82 aa, Escherichia coli
MKGALGKKELLAVVPLSWSTIDRMERAGEFPKRWYITDKRCAWNRDEVERWLDERQAASPAEFQGKKPPVQQRVYRPVSNAA

SEQ ID NO: 6091 - DNA, 300 bp, Escherichia coli
gtgagaaagttaagccgacttgaaaaatatcacatgaataaggtttcaatgcgcagtccgtcaaagattgtcgccgttactcctgcggcgatagagatcgaaaaacgcgcgattgaaagagagaaaaaagggcagttccgcattgccgctcacctttggcttcagtgtatggatgttgcttctggtgatgttgaacgtgcaaggatcgcggttcgcagggaccaatgtatcacaaaaggtaacggccttcgccgtggcgactatagcggcataggatgttgtggggtggtttatgactaa

SEQ ID NO: 6092 - protein, 99 aa, Escherichia coli
MRKLSRLEKYHMNKVSMRSPSKIVAVTPAAIEIEKRAIEREKKGQFRIAAHLWLQCMDVASGDVERARIAVRRDQCITKGNGLRRGDYSGIGCCGVVYD

SEQ ID NO: 6093 - DNA, 471 bp, Escherichia coli
gtggggtggtttatgactaagaaatacacactaatctatgcagatccaccctgggtataccgggacaaagccgcagatggtaatcgcggtgccggttttaaatatccggttatgagtgtgctggatatctgccgccttcctgtgtgggatttggccgatgaaaactgtctgttggccatgtggtgggtgccaacacaaccactcgaagcactaaaagttgttgaagcctggggattccgtctgatgacgatgaagggcttcacgtggataaaatgtggtagtcgacaaccagataaacttgttatgggtatgggacacatgactcgcgccaatagtgaagattgcctgtttgcggtaaagggaaactacctccgcgcattaatgcagggatcgttcagtcatttaccgcaccgcggcttgagcactcaagaaaaccagatgtcgttcgtgaaaaacttgtgcaattgttag

SEQ ID NO: 6094 - protein, 156 aa, Escherichia coli
MGWFMTKKYTLIYADPPWVYRDKAADGNRGAGFKYPVMSVLDICRLPVWDLADENCLLAMWWVPTQPLEALKVVEAWGFRLMTMKGFTWIKCGSRQPDKLVMGMGHMTRANSEDCLFAVKGNYLRALMQGSFSHLPHRGLSTQENQMSFVKNLCNC

SEQ ID NO: 6095 - DNA, 321 bp, Escherichia coli
ttgcctgtttgcggtaaagggaaactacctccgcgcattaatgcagggatcgttcagtcatttaccgcaccgcggcttgagcactcaagaaaaccagatgtcgttcgtgaaaaacttgtgcaattgttaggcgatgtttctcgcattgaactattcgcccgccagtcgtctcatggcttcgatgtttggggtaatcagtgcgaagacccggcagtgcaactacaccctggatacgcgttggatattggcggattaacaaatgcattcagcatttctccgctgtcaccaacagacaaccaggggcgggagcgtgctgcatga

SEQ ID NO: 6096 - protein, 106 aa, Escherichia coli
MPVCGKGKLPPRINAGIVQSFTAPRLEHSRKPDVVREKLVQLLGDVSRIELFARQSSHGFDVWGNQCEDPAVQLHPGYALDIGGLTNAFSISPLSPTDNQGRERAA

SEQ ID NO: 6097 - DNA, 1251 bp, Escherichia coli
gtgcttaccgatacaaaattaaaaaacctcaagccgcaggacaaactgtacaaggtctccgatcgtgacgggctgtatgtagctgtgcttacgtcaggcacggtctcgtttcgctatgactaccgtatcaacggtcgccgcgaaacactggtaatcgggcagtatgggcgtgacggtatcagcctggcagaagcgcgagaagaactgattgctgcaaagaagctgcttaaagcaggccagtcgccggctgcggctaaacgtgacggtatcaaaaagattcgtggtgccgagacgtttgcggtacataccgacagttatatgaaacacgtcatcctggctgacagtacccgcgcaatgaagcaggcggtgatcgaccgtgacatacttccggttcttggcaacaaaatgatggctgaaattaccacatcgatggttcgtgatttgtgtgaccggattgtcgaacgcggtggtcgggcaacagcagtacaggccagggagatcatcagcagcgtataccgtcacgccaatgaccgtggtcatggtttgtttaatcctgcggctgacattaaaccttcgtctatcgccatatttaaaccacgagagcgaacactgacaccagaagaaattggcctgttcttccgcacgctggatgccattggtgctatgggcactatgaaaatggctttaaagctggtgcttatcactatggttcgtaaaggcgaattcaccaatgcaacgtgggatgaaatagattttaaaaaatggacatggacaattccttcagaccgcatgaagggaagccgggcgcacgttatttacctgcctaaacaggcacaggatatattggttgggttgcagatgtgcgctggtggaagtgaatatctggttcctggtcgttacaatttccggaagccattatctaatgccgcgctgaactctctgatcgacagaacggtgaaaataataaatgaagatggtgagcatattcagggcttcaccgtacacgatatgcgccgtacagccagtacgttgttgcatgaggctggttatccttcagactggattgaaaaggctctggcacatgagcagaaaggtgtgcgcgccgtatataacaaagcggaatacgccagacagcgcgcctacatgttgcagcagtgggccgatatgattgattcctggattaacggggagcatacggatctgattccgttctccccgtcgaagtttgagaagtggatggcgggggaataa

SEQ ID NO: 6098 - protein, 416 aa, Escherichia coli
MLTDTKLKNLKPQDKLYKVSDRDGLYVAVLTSGTVSFRYDYRINGRRETLVIGQYGRDGISLAEAREELIAAKKLLKAGQSPAAAKRDGIKKIRGAETFAVHTDSYMKHVILADSTRAMKQAVIDRDILPVLGNKMMAEITTSMVRDLCDRIVERGGRATAVQAREIISSVYRHANDRGHGLFNPAADIKPSSIAIFKPRERTLTPEEIGLFFRTLDAIGAMGTMKMALKLVLITMVRKGEFTNATWDEIDFKKWTWTIPSDRMKGSRAHVIYLPKQAQDILVGLQMCAGGSEYLVPGRYNFRKPLSNAALNSLIDRTVKIINEDGEHIQGFTVHDMRRTASTLLHEAGYPSDWIEKALAHEQKGVRAVYNKAEYARQRAYMLQQWADMIDSWINGEHTDLIPFSPSKFEKWMAGE

SEQ ID NO: 6099 - DNA, 1578 bp, Escherichia coli
atgacggaaaacattcataagcatcgcatcctcattctggacttcggttctcagtacactcaactggttgcgcgccgcgtgcgtgagctgggtgtttactgcgaactgtgggcgtgggatgtgacagaagcacaaattcgtgacttcaatccaagcggcattattctttccggcggcccggaaagcaccaccgaagaaaacagcccgcgtgcgccgcagtatgtctttgaagcaggcgtaccggtattcggcgtttgctatggcatgcagaccatggcaatgcagttgggcggtcacgttgaagcctctaacgaacgtgaatttggctacgcgcaggttgaagtcgtaaacgacagcgcactggttcgcggtatcgaagatgcgctgaccgcagatggtaaaccgctgctggacgtctggatgagccacggcgataaagttaccgctatcccgtccgacttcgtcaccgtagccagcaccgaaagctgcccgtttgccatcatggccaacgaagaaaaacgcttctatggcgtacagttccacccggaagtgactcacacccgccagggtatgcgcatgctggagcgttttgtgcgtgatatctgccagtgtgaagccctgtggacgccagcgaaaattatcgacgacgctgtagcccgcatccgcgagcaagtgggcgacgataaagtcatcctcggcctctctggtggcgtggattcctccgttaccgcaatgctgttgcaccgcgctatcggtaaaaacctgacttgcgtattcgtcgacaacggcctgctgcgtctcaacgaagcagagcaggttctggatatgtttggcgatcactttggtctgaacattgttcacgtaccggcagaagatcgcttcttgtctgcgctggctggcgaaaacgatccggaagcaaaacgtaaaattatcggtcgcgttttcgttgaagtattcgatgaagaagcgctgaaactggaagacgtgaagtggctggcgcagggcaccatctaccctgacgttatcgaatctgctgcttctgcaaccggtaaagcacacgtcatcaaatctcaccacaacgtgggtggcctgccgaaagagatgaagatgggcctggttgaaccgctgaaagagctgttcaaagacgaagtgcgtaagattggtctggagctgggcctaccgtatgacatgttgtaccgtcacccgttcccgggaccaggccttggcgttcgtgttctgggagaagtgaagaaagagtattgtgacctgctgcgccgtgctgacgccatcttcattgaagaactgcgtaaagcggacctgtacgacaaagtcagccaggcgttcaccgtcttcttgccagtacgttccgttggcgtaatgggcgatggtcgtaagtatgactgggttgtctctctgcgtgctgtcgaaaccatcgactttatgaccgcacactgggcacatctgccgtacgacttcctcggccgcgtttccaaccgcattatcaatgaagtgaatggtatttcccgcgtggtgtatgacatcagcggcaagccaccagcaactattgagtgggaatga

SEQ ID NO: 6100 - protein, 525 aa, Escherichia coli
MTENIHKHRILILDFGSQYTQLVARRVRELGVYCELWAWDVTEAQIRDFNPSGIILSGGPESTTEENSPRAPQYVFEAGVPVFGVCYGMQTMAMQLGGHVEASNEREFGYAQVEVVNDSALVRGIEDALTADGKPLLDVWMSHGDKVTAIPSDFVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVLDMFGDHFGLNIVHVPAEDRFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 6101 - DNA, 1536 bp, Escherichia coli
atgcaatcggttacgctctgtataatgccgcggcaatatttattaaccactctggtcgagatattgcccatgctacgtatcgctaaagaagctctgacgtttgacgacgttctcctcgttcctgctcattctaccgttctgccgaatactgctgacctcagcacccagctgacgaaaactattcgtctgaatatccctatgctttccgcagcaatggataccgtaacggaagcgcgcctggctattgctctggctcaggaaggcggtatcggctttatccacaaaaacatgtccattgaacgccaggcagaagaagttcgccgtgtgaaaaaacacgaatctggcgtggtgactgatccacagaccgtactgccaaccacgacgctgcgtgaagtgaaagaactgaccgagcgtaacggctttgctggctacccggttgttaccgaagaaaacgaactggtcggcattatcaccggtcgtgacgtgcgttttgtgaccgacttgagccagccggttagcgtttacatgacgccgaaagagcgtctggtaaccgtgcgtgaaggcgaagcccgtgaagtggtgctggcaaaaatgcacgaaaaacgcgttgaaaaagcgctggtggttgatgatgaattccacctgatcggcatgatcactgtgaaggacttccagaaagcggaacgtaaaccgaacgcgtgtaaagacgaacaaggccgtctgcgtgtaggtgcagcggttggcgcgggcgctggtaacgaagagcgtgttgatgcgctggttgccgcaggcgttgacgttctgctgatcgactcctctcacggtcactctgaaggtgttctgcagcgtatccgtgaaactcgcgctaaatatcctgacctgcaaatcatcggcggcaacgtggcaactgctgcaggtgcccgcgcgctggcagaagccggttgcagtgccgttaaagtgggtatcggccctggttctatctgtacgacgcgtatcgtgactggtgtcggtgttccgcagatcaccgccgttgctgatgcagtagaagccctggaaggtaccggcattccggttatcgctgacggcggtatccgtttctcaggcgatatcgctaaagctatcgccgctggcgcaagcgcggtgatggtaggttccatgctggcaggtactgaagaatctccgggtgaaatcgaactctaccagggccgttcttacaaatcttaccgtggtatgggttccctgggcgcgatgtccaaaggttcttctgaccgttacttccagagcgacaacgctgccgacaaactggtgccggaaggtatcgaaggccgcgtagcctataaaggtcgcctgaaagagatcattcaccagcagatgggcggcctgcgctcctgtatgggcctgaccggctgtggtactatcgacgaactgcgtactaaagcggagtttgtacgtatcagcggtgcgggcattcaggaaagccacgttcacgacgtgaccattactaaagagtccccgaactaccgtctgggctcctga

SEQ ID NO: 6102 - protein, 511 aa, Escherichia coli
MQSVTLCIMPRQYLLTTLVEILPMLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLSQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 6103 - DNA, 1377 bp, Escherichia coli
atgttaccttctcaatcccctgcaatttttaccgttagccgcctgaatcaaacggttcgtctgctgcttgagcatgagatggggcaggtgtggatcagcggcgaaatctctaattttacacaaccagcctccggtcactggtactttacgcttaaagacgataccgcgcaggtgcgctgtgcgatgttccgaaacagcaaccgccgggtcaccttccgcccacagcacgggcaacaggttttagttcgcgccaatattacactctacgagccgcgcggcgattatcaaattatcgtcgaaagtatgcagccggccggtgaaggattgctgcaactgaagtacgaacagcttaaagcgaagttgcaggctgaaggtttgttcgatctgcaatacaaaaaatcactcccctcccctgcgcattgcgttggtgtgatcacctcaaaaaccggtgctgcgctacatgatattttgcatgtgttaaaacgtcgcgatccttctctgccggtgatcatctaccccaccgccgttcagggcgatgacgcgccagggcaaattgttcgcgccattgaactggcgaatcagcgcaatgagtgcgacgtgttgatcgttgggcgcggcggcggttcgctggaagatttatggagttttaacgacgaacgtgtagcgcgggcgatttttgccagccgcattccgatagtcagcgccgtcgggcatgaaaccgatgtgacgattgccgactttgtcgctgatctgcgtgcgccaacgccgtcagccgccgctgaagtggtgagccgcaatcagcaagagttactgcgccaggtgcaatcgacccatcaacggctggagatggcgatggattattatctcgccaaccgcacgcgtcgttttacgcagatccatcatcgcttgcagcagcagcatccgcagctccggctggcacgtcagcaaactatgctcgaacgtctgcaaaagcggatgagctttgcgctggagagtcagcttaaacgcgcgggtcagcaacagcagcgattaacacggcaactcgtccagcaaaatccgcagtcgcgtattcatcgcgcgcaaacgcgcattcagcaactggaatatcgtttagcagaaaccctgcgcgcacagcttagcgccacgcgtgaacgtttcggtaatgcagtaacacacctcgaagccgtaagcccactgtcaacgctggcgcgcggttatagcgtcaccagcgccgctgatggcgcggtgttaaaacaggttaagcaagtgaaagtgggtgagacactgaccacacgactgggagatggtgtggtgattagtgaagtcagcgccgtaacaaaaacccgcaaatcacgtaaaaaaacgtctaatccgtag

SEQ ID NO: 6104 - protein, 458 aa, Escherichia coli
MLPSQSPAIFTVSRLNQTVRLLLEHEMGQVWISGEISNFTQPASGHWYFTLKDDTAQVRCAMFRNSNRRVTFRPQHGQQVLVRANITLYEPRGDYQIIVESMQPAGEGLLQLKYEQLKAKLQAEGLFDLQYKKSLPSPAHCVGVITSKTGAALHDILHVLKRRDPSLPVIIYPTAVQGDDAPGQIVRAIELANQRNECDVLIVGRGGGSLEDLWSFNDERVARAIFASRIPIVSAVGHETDVTIADFVADLRAPTPSAAAEVVSRNQQELLRQVQSTHQRLEMAMDYYLANRTRRFTQIHHRLQQQHPQLRLARQQTMLERLQKRMSFALESQLKRAGQQQQRLTRQLVQQNPQSRIHRAQTRIQQLEYRLAETLRAQLSATRERFGNAVTHLEAVSPLSTLARGYSVTSAADGAVLKQVKQVKVGETLTTRLGDGVVISEVSAVTKTRKSRKKTSNP

SEQ ID NO: 6105 - DNA, 8061 bp, Escherichia coli
atgtccctgaccctgaataaaatccttgtgttatgcgcattgctgataagcgcaatgctgcctgggtggtcatgggcagaatctgcatggcaagactcttcagatacggtcggcgaatttaacggtaccgtgcccaccgccgacagcgccagcatacccgtctaccagggcagtgtctttctcgatcctacaaagacgcatgaggtagcgtttaccgctaaaccgagtgaattcaacgcggatgttagcgtctctaaattgctcgtcaccaacccgcaagacagagaaggcgatatcattgccaccccacgttgggaaaaccaaacgccaccggctgtatctttagtttgggcggatgccgccacgccggacaccttactggacccacagccagtcgcagatcgctcgttttgtgcacagggacttgccgggcgttcgctggtcgcctgggcgcagcctgatccccagcagaccatgccgctgttatatttactcacctcgacgggctatccctatgaaagtgttctgatgctcgccgatcagaaagtgacgctgaagattgcgcccgcgcagggtgaccttatttccgtcagcgctgcgggctatgacgaatcctcaggtgcggcgaaaatgacggttgggggcagtatcacgttaacggtcaccaccaaagattgcgtcggtaatgttgtggggaatattccttttgttatcaaacgcaaagatgctgaaaaccgccagggtgtggtgaacaatactgcgcctgtaaaactgggcacgaccgaattaaccaccaccgcgacggaatatcgtggtactaccgatgcgaatggtgttgccacggttacggtcacccaggccaacggccctggtgtaaaaacgccgttggtcgcgagcctcgcgggtattgctcaggccagtgaaacggcagtgatctttaccgtcctcaccagcccggatgttccgcaggctacaatgtggggtcatatgcccgatacgctgaaggcccgtgattacacttttagtcgaccaaaactggcggcggaagtcgataatgaaggcggtacggttaacgatcacaatgaaacctggtccacctttacctggagcggcgcggataaacattgcgacattttgcccggaatgcgtcagttcggtgcgctggcgacggtggtgccaacgtcagtgcaggatgtggctggttggccgatgcagggtaatttctactggtcatcactggcggggatgagcggccagcaccatgcggcggatgtttcgaaccgcagcgaagcgcaaaaaccggacgatacgacgtttattgtgagctgtgtcgataaagaagcgcccgatgttgaaccgaagctggtactgacgccgggcagctatgattcgacgataaaagcgatgaaagtaaaggtgggggaagaggcttctttacgtctgacgattaccgatagcaagaacaacgatcagccgctggcttactactacttttcgctgcatctggatgacggcattaaccgtaagaatcaaactgacgccgcgtgggagacgcatccggtacaaattgatggcggcagtaacgttcgcaaagttgacgcccatacctatgaagggatcactgatgctaacggagaggccactctgacgctgacccagccaggcggcgtgggggtgaaaactcacatcaccgcgagaatgcgcagtgattttactgcctcggatgagaaagacgttatttttacggtgatcaccagccccgataccgacaaagcgcggatgtggggccatatgttgggcattattgaagcgaacaatatctttaaacgcccacggctggcggatgaaaccgacaacgaacagggatcggtgcgggaaaataacgaagactgggcgctgtttgatcagaatagcagtatgcaggctgagtgtggtttaggtcatattccgagccaaagttcattgcacagtttgtttgccgctcatccagccaatgccatcggcaccgaatatggctggccaacgttgcaaaaagcgtatcttagtgcggtggaagagacgtcgcacgcgtcggtaaacctggccacgggcaacatcgacacctattccggctttaagcaaaactatctctcttgttcgggcaatgagatggtcgcccagattgccgcgaccaccgatcgtgatgtttccgcaggcagcagagcgcaggccaaagtgggtgacacgatcaccatgacggtacgcacctttaatgccttgaataatgcacccgtgccgtataccgcgttcaccattactaaagatatggggaaaaatcgtcaggggcagactacaggttttgatgatccaacccgcggcgcaatcgagatgaatggcacactctacggaacatcgcaaccgtctttagtctatgccggtactacggatgcgcagggttttgcgactgtggaaattaagcaatcgcaaggtgtgggcttatcgacgccgctaaatattgtgcctgtgaactcctatattcccaatactgttaattacaatgtgattttcactacgctcaccagtccggatgcggttggcgcgcagatgtgggggcatatggatgagacgattaccgtcgatgctttaacctttgcccgaccccgactggctgcggaagtgttcagtccggacggcacattaacggaaaataacgaagtctggtcgcgagtcagccaggccaacgcctccagcaccagtaaaggtggctgtggcgccaatatgctcccacgccgttctcagcttagcgcgctctatgatgccaataacggtgacggtgtacagacagtacacggctggccaacgcagcgtcagccctactggagcagttcgcccgcagatcaggtaccgcattattacaccatagccctcaacgatggggcgcggaccgttggcggtagcacggcggtttatgtcagttgcctgacgacggctaacaatcctgccagtagcattacgctggaagtggtggatccggcgcagtggaacgcggctgcaaatgcggcgaagctgaaaaaaggcgaaacgctacaggtaaaggtgacggtaaaagatgcgcagggcaatccattgggtgatataccctttaccctgaaacgtggcgatggttatacccgctcagaggaaaaacacgttgctggtagcagtgatgcgctggttgcgccggttgtggtcaatggtggcctggcggacgaaacttcgcttaataataccgctgcagcatacagcgccatgaccggcagcgacggaactaaaattctcactattacccgcccggatacccatggcacgaaaacgtcgctgaccgctaggctctattcagatacaacgaaaaaagcgaccctcgataccatttttaccgttgtaaccagtccggacagcgataaggcgaaaatgtgggggcatatgcctgaaacagtgacggctgcagatggagcggtctttaaacgcccattattgttgaaagagttatccagtacgtcgggtcgaacagcgattgcggaagataatgaagactgggcgcaatttacccaagctcaggctataagcacatcctctaatggttgtggtagtgaatatgttccctctcaggccgggctggagtcattgtatgaagccaaccgcggaaatgcgatgaaaacggttcagggctggcccgtcgcctcaagttacctttccagcacgacaggtagtagtagcctggaacagcgtgacttcaaggctgtcaatctcagttcaggcaccagttcgataattccatctgccacaaaagaactgcttacctgccagacgacgccgattgttaaggcaagccaaatcgttcttgaagctgcagacctcacaaaatttgaccgtatgaataatgttgtcaaagtgaaaaagggtgaagaagccgtattacgagtgaccactaaagatgcgcagggtaagcctgtgggaaataccgcatttaccctcaaacgaaacaccagcgtgaacagggccaatgtgtcaactacgacgtcgattgcttcactggcggtaacggatgcctggggaaatactcaaaatgattttctttcaacgaccctggttatttatggcgtgacgggggctgatggcaccaccactttcacattgaagcaagaccagactaccgggctaaaaacagaactcacggcagcgttggattcctccagcagcactaaatcgacgcttcccgttgtctttacggtgcttaccagcccggattcgccaaaagccaaattctgggggcatatggctgaaacggcgacaggcgatgacggtcttatttatcgaaggcctttgctgagggacgagaatagtgctaccaccagtatcggtaccctggtggaagagggggaggcctggtctacgttcccgtcgggccaggctaacgatacctcgataaatggttgtggcgcggagtatgttccaactgacaatgaacttagggccatttatgcgcaccaggggagtagcgcattacatgacgctattggctggccagtgtcgaggttctatatctcgaataccgttgcagatacgttcactcaaacctttacgtatgatgtcgtttcgctgaagacaggagatgaaacgcagatgccctcatctggtggtgcattactgagctgccggaccacgcctgtcgccgttgccagtcagatcattgttgaggcgaatgatacggcgcaatttgtcaaagttgacgacaccttgagtgcgttgaaagtgaaaaaaggcgaagacgcggtgattcgcgtggtgactaaaaatgcgcagggaaatagcgtgcccaatgtcccctttattctcagacgtgaaggctcgaagaaccgtcaaaatgccgagatgataaataagtcgattacggtaattaacgcggcaggcgcttctgcgaggatgaatagttcttcaagcctgctttatggggtgactggcgcggacgggactacctcctttacggtaaaacaagatgattctatgggcctggtaaccaatatgtacgcccagttgtatcagctgacgatagaatccaacaaattaccggtcatgtttaccgtcataaccagcccggatacgccactggcaagttactgggggcatatgcctgaaacgtttactacccggtcgggaattgcctttaagcggccattgcttactgccgagcatccagcggggcagtcaaccatggctaataatgaatcatggctttctttgaatacggcagcaaaaaatgatgtcagcaaatcagactgcggcgaaccttatcaaccgttattaagcgaatttcaagagttatacagtgaacatcctaatggtgcgatagggaccgatttaggccttccgctgactaacacctggtgggcttacgataaaattgcctacgcgaacgtctggtacgatcagtctattaatttatcgaatggatcaagctccagggcattatcaaacaccgtggcatttgtgtcctgtctggtaaaccctcatgcagtggcagcttctatagagatgacctccacggcactggatgcggagaaaacggccagcaacgatggtcgccctagtgcaacggcggcgaaaggtacggcgatccggatgacggtgattgtgcgggatagcggaggaaatctgttgccaggcgcaaactttaatctcatacgcgggactgcgttggatcgtgcaaaaaacaggctagattctacgtatgatgatcttactatcgtgccggtcacccctgccggagtaaacatgtcactctataataatggggcacaggcacttctgacgacaggaagtgatggtaaagcgacttttgatgtgacgcaaaacgagacttatgggctggcaactccgctcactgcaacattgatgcgcgacaccacaaaaagtgccacgatggatgttattttcactgtgataaccagtccgaactcaccgaaagcaaaatactggggtcatatgcccgacacgtttaccagtagggcgggggtgacctttaaacgaccgctactggcagcagaagcgaccttggggtcctcggtaagtaataataatgagtcgtggtcataccttttttataccaataaagttacgccggattgcccggttgagtatcagccgcgtctcaatgagttacaggggctatataatgatcatccaggcgggacaatactgacagatttggggttgcctataactgccggaagtggaaattggtggacttatgaaatgagcaccactgacgcgttgacgtggtattacggcgtcattaatttgaaaacgggacaatcgacgacgactattaatggatacgctttaatgctctgtctgacgcagccacattcggcaccagcaagccttacgctgtcatcgactgcctatgatgagggccgaactgccagcaatggtggtacccccacgtcatctgtgaaaaaaggtgagatgcttcccatcgtggtgacgatcaaagatgccaatggtaatcctgttggcggcgaaggtgttacgctcaagcgcgtgcaggcgaaaagccgttcagggatctctgtatcctccaataccgtagatgatctcattttagatgaagtcaccccgacatcggcgcgtatctccttcaaccagaatacgtcggcatggagcggcttcaccggcagtgatggcacgataacgttcaacgttacccaaaataacaccgttggtctggtaacgccgtttacagcttcattggcgcgaaatccgcaggttacggctaatcaggacctgatattcacggtagtcacggtagtgaccagcccggattctgcgaaggctaactactgggggcatatgccagcaaccttgacggcagtgaatggtgcggtatttgaacgcccgaaattgtggagtgaactgacatcgacttctggcgtcggcaagatcaataacaataatgaagactggccgtactttaccccaacacagaaatcagatgcgagtgtgagcccttgtgaagtagcaaggcagccactattcaatgatttaagttcgttgtctgcgcgttatccgaataacacgtttgtcactgaaactggctggcctgcgtattacacctggtgggcagaggataaatccgccgatggtaaagaccagtcggttgatttgagaaatggcacgctgtatacgggttcaacaaaatcatttcagccttgcctggctaacgcgcgttcaacggtttccagcgtcacacttacctcaacagcgtttgatgcagccactcaggcggcgaaagtgaaaaaaggcgaagccatgtccgttaccgtgacggtgaaagacagcgccgggaatacggtgccgaatgttgaatttactttgaaacgtggtgaggcatcgccgcgtaacgctggggcaacgttgtatggcaatgtagtggcgatggacgatctcgtcgttcagccgttatcaggttcggctgttacgctgagtgaaagcggtaataccattagtggcatgacaggcgcggatgggacggcaagttttacgctccgccaggataatacccctggttataaaatgccactgacggttactctggctaattacgcttccgcgacagacacgctggatgctatttttacggtgccaaccagcccaaatgtttcatcggcgcacttttggggacatatggcagacacggtagtggtgaatagtaaatcgctacatcgaccgttgttaacgacggaattgccgtccggggctaatcccgtatcctcaccgattattaactacgaaaactgggcttctgcacatatcattgatgccagtaaatgggatatcgcaaggcagtgtggcagcatagaaaatgcaccgacatacaatgaattagagttgttgcatactgtttttaattcactgggatggccgtcttcacccagttttccttatttgtcctctcaacagtgtgggatggacgaaggtactggagcgcaggattgtagtatcacgctaataaataaaccgggtctggtgacctgcttccagtaa

SEQ ID NO: 6106 - protein, 2686 aa, Escherichia coli
MSLTLNKILVLCALLISAMLPGWSWAESAWQDSSDTVGEFNGTVPTADSASIPVYQGSVFLDPTKTHEVAFTAKPSEFNADVSVSKLLVTNPQDREGDIIATPRWENQTPPAVSLVWADAATPDTLLDPQPVADRSFCAQGLAGRSLVAWAQPDPQQTMPLLYLLTSTGYPYESVLMLADQKVTLKIAPAQGDLISVSAAGYDESSGAAKMTVGGSITLTVTTKDCVGNVVGNIPFVIKRKDAENRQGVVNNTAPVKLGTTELTTTATEYRGTTDANGVATVTVTQANGPGVKTPLVASLAGIAQASETAVIFTVLTSPDVPQATMWGHMPDTLKARDYTFSRPKLAAEVDNEGGTVNDHNETWSTFTWSGADKHCDILPGMRQFGALATVVPTSVQDVAGWPMQGNFYWSSLAGMSGQHHAADVSNRSEAQKPDDTTFIVSCVDKEAPDVEPKLVLTPGSYDSTIKAMKVKVGEEASLRLTITDSKNNDQPLAYYYFSLHLDDGINRKNQTDAAWETHPVQIDGGSNVRKVDAHTYEGITDANGEATLTLTQPGGVGVKTHITARMRSDFTASDEKDVIFTVITSPDTDKARMWGHMLGIIEANNIFKRPRLADETDNEQGSVRENNEDWALFDQNSSMQAECGLGHIPSQSSLHSLFAAHPANAIGTEYGWPTLQKAYLSAVEETSHASVNLATGNIDTYSGFKQNYLSCSGNEMVAQIAATTDRDVSAGSRAQAKVGDTITMTVRTFNALNNAPVPYTAFTITKDMGKNRQGQTTGFDDPTRGAIEMNGTLYGTSQPSLVYAGTTDAQGFATVEIKQSQGVGLSTPLNIVPVNSYIPNTVNYNVIFTTLTSPDAVGAQMWGHMDETITVDALTFARPRLAAEVFSPDGTLTENNEVWSRVSQANASSTSKGGCGANMLPRRSQLSALYDANNGDGVQTVHGWPTQRQPYWSSSPADQVPHYYTIALNDGARTVGGSTAVYVSCLTTANNPASSITLEVVDPAQWNAAANAAKLKKGETLQVKVTVKDAQGNPLGDIPFTLKRGDGYTRSEEKHVAGSSDALVAPVVVNGGLADETSLNNTAAAYSAMTGSDGTKILTITRPDTHGTKTSLTARLYSDTTKKATLDTIFTVVTSPDSDKAKMWGHMPETVTAADGAVFKRPLLLKELSSTSGRTAIAEDNEDWAQFTQAQAISTSSNGCGSEYVPSQAGLESLYEANRGNAMKTVQGWPVASSYLSSTTGSSSLEQRDFKAVNLSSGTSSIIPSATKELLTCQTTPIVKASQIVLEAADLTKFDRMNNVVKVKKGEEAVLRVTTKDAQGKPVGNTAFTLKRNTSVNRANVSTTTSIASLAVTDAWGNTQNDFLSTTLVIYGVTGADGTTTFTLKQDQTTGLKTELTAALDSSSSTKSTLPVVFTVLTSPDSPKAKFWGHMAETATGDDGLIYRRPLLRDENSATTSIGTLVEEGEAWSTFPSGQANDTSINGCGAEYVPTDNELRAIYAHQGSSALHDAIGWPVSRFYISNTVADTFTQTFTYDVVSLKTGDETQMPSSGGALLSCRTTPVAVASQIIVEANDTAQFVKVDDTLSALKVKKGEDAVIRVVTKNAQGNSVPNVPFILRREGSKNRQNAEMINKSITVINAAGASARMNSSSSLLYGVTGADGTTSFTVKQDDSMGLVTNMYAQLYQLTIESNKLPVMFTVITSPDTPLASYWGHMPETFTTRSGIAFKRPLLTAEHPAGQSTMANNESWLSLNTAAKNDVSKSDCGEPYQPLLSEFQELYSEHPNGAIGTDLGLPLTNTWWAYDKIAYANVWYDQSINLSNGSSSRALSNTVAFVSCLVNPHAVAASIEMTSTALDAEKTASNDGRPSATAAKGTAIRMTVIVRDSGGNLLPGANFNLIRGTALDRAKNRLDSTYDDLTIVPVTPAGVNMSLYNNGAQALLTTGSDGKATFDVTQNETYGLATPLTATLMRDTTKSATMDVIFTVITSPNSPKAKYWGHMPDTFTSRAGVTFKRPLLAAEATLGSSVSNNNESWSYLFYTNKVTPDCPVEYQPRLNELQGLYNDHPGGTILTDLGLPITAGSGNWWTYEMSTTDALTWYYGVINLKTGQSTTTINGYALMLCLTQPHSAPASLTLSSTAYDEGRTASNGGTPTSSVKKGEMLPIVVTIKDANGNPVGGEGVTLKRVQAKSRSGISVSSNTVDDLILDEVTPTSARISFNQNTSAWSGFTGSDGTITFNVTQNNTVGLVTPFTASLARNPQVTANQDLIFTVVTVVTSPDSAKANYWGHMPATLTAVNGAVFERPKLWSELTSTSGVGKINNNNEDWPYFTPTQKSDASVSPCEVARQPLFNDLSSLSARYPNNTFVTETGWPAYYTWWAEDKSADGKDQSVDLRNGTLYTGSTKSFQPCLANARSTVSSVTLTSTAFDAATQAAKVKKGEAMSVTVTVKDSAGNTVPNVEFTLKRGEASPRNAGATLYGNVVAMDDLVVQPLSGSAVTLSESGNTISGMTGADGTASFTLRQDNTPGYKMPLTVTLANYASATDTLDAIFTVPTSPNVSSAHFWGHMADTVVVNSKSLHRPLLTTELPSGANPVSSPIINYENWASAHIIDASKWDIARQCGSIENAPTYNELELLHTVFNSLGWPSSPSFPYLSSQQCGMDEGTGAQDCSITLINKPGLVTCFQ

SEQ ID NO: 6107 - DNA, 978 bp, Escherichia coli
atgaagcaggataaaagacgcggtctgacccggatcgcattagcgctggcactggcaggttattgtgtggcacctgtggcgctggctgaagacagcgcctgggtcgacagcggtgaaaccaatattttccaggggaccattccgtggctctattcggaagggggaagtgctacgacagatgccgaccgtgtaacgttgacttctgatctaaaaggcgctcgcccgcaaggcagtgaaacggacaagcgtctttactcgggtgataaattaaccgtaagttgggaaattggtgataccgaaggcgacgtggatcttgggggattgggcgataacgcgaaaactatcgatactatccgctggatgagctacaaggatgcgcaggggggggatccaaaagagctggtaacgaaggtgaccagttacactcttaccgatgccgaccgtggtcgttatatcggtattgaaattacgccaaccacgcagaccggtacgccaaacgtcgggactgcgctgcatctttatgacgtttctactgccagcggcggcggaagcgacagcgataacgttgcaccggggccggtggttaaccagaacctgaaagtcgccatctttgttgatggtaccagtatcaaccttatcaacggtagcacaccaatcgaacttggcaaaacctacgtggccaaactgtactcggatgagaacaaaaatggcaagtttgatgcgggtaccgatgctgacgtcaccgccaattatgacttccgttgggtactttctggcagcagccaacagcttggcacttcgggtggcatcgttaactcaagcttcgataataacaatttggtcatccctgcgaccaacgacgaagccagaaccaaccttaacggccctgcgcgcgatggaaaagaggcactttccatcccgaccaacggcgacggggtacagggttacaaacttcacattatttacaaacacaaataa

SEQ ID NO: 6108 - protein, 325 aa, Escherichia coli
MKQDKRRGLTRIALALALAGYCVAPVALAEDSAWVDSGETNIFQGTIPWLYSEGGSATTDADRVTLTSDLKGARPQGSETDKRLYSGDKLTVSWEIGDTEGDVDLGGLGDNAKTIDTIRWMSYKDAQGGDPKELVTKVTSYTLTDADRGRYIGIEITPTTQTGTPNVGTALHLYDVSTASGGGSDSDNVAPGPVVNQNLKVAIFVDGTSINLINGSTPIELGKTYVAKLYSDENKNGKFDAGTDADVTANYDFRWVLSGSSQQLGTSGGIVNSSFDNNNLVIPATNDEARTNLNGPARDGKEALSIPTNGDGVQGYKLHIIYKHK

SEQ ID NO: 6109 - DNA, 2205 bp, Escherichia coli
atgctgcgatggaaacgctgtattattctaacatttatctctggtgctgctttcgcggcgccagagataaatgttaagcaaaacgaatcgttacctgatttaggtagccaggcagcacaacaggatgaacaaaccaacaagggtaaatcgctgaaagagcgcggagccgattacgtcatcaactccgccacgcaagggtttgaaaacttgacccctgaggcgctgaaatctcaggccagaagctatctgcaaagtcaaatcacctcaaccgcacaatcttatattgaagacacactctctccctacggtaaggtccgttcgaacctctccattggtcagggcggcgatctggatggcagttccatcgattattttgttccctggtacgataatcaaaccactgtttatttcagccaattttctgcgcaacgaaaagaagatcgtacgatcgggaatattggccttggggtaaggtataattttgataaatatctattgggtggaaatatattttatgattatgactttacccgtggacatcgccgtttaggtttaggcgccgaagcctggacggattatttaaaattctcaggcaactattatcacccactttctgactggaaagactctgaagatttcgacttttatgaagaacgccctgcgcgcggctgggatattcgcgctgaagcctggctacccgcttacccgcagcttggcggaaaaattgtcttcgaacaatattatgggaatgaagtcgcgctttttggtaccgatagtctggagaaagatcccttcgctgtcacgctgggtgtgaaataccagcccgttccgctcattgttgtcggtacagatttcaaagctggcactggcgataataccgatctttctgttaacgcaacgctgaactaccagtttggcgtcccgctcaaagaccagcttgatcctgacaaagtgagcgcggctcactcgctcatgggtagccgtcatgactttgttgaacgtaacaactttattgttctggaatacaaagagaaagatcccctctatgtcactttgtggctgaaagccgacgtcacgaatgaacatcccgagtgcgtgattaaagatacgcctgaagaagctatcgggctggaaaaatgtaaatggaccattaacgcgctcattaaccatcactacaaaatcgttgctgcctcctggcaggcgaaaaacaatgctgcctcctggcaggcgaaaaacaatgctgcccgcacgctggtgatgccggttatcaaagagaataccctgacagagggtaacaataaccactggaacctggtgctgcccgcctggcagtacagttccgatcaagccgaacaagaaaaactcaatacctggcgagtacgtctggcgctggaagatgaaaagggcaatcggcagaactctggcgtggtggaaatcaccgttcagcaggaccgtaaaatagagttgattgttaataacatcgcgaacgtgccagaagagaacaaccacagccacgaagccagcgctcaggcagatggcgttgatggtgtggtgatggatctcgatgtaaccgacagctttggcgataacaccgaccgcaatggcgatgcgctgccggaagataacctcacgccgcagctttacgacgcgcaggacaaacgagtgacgttaaccaacaagccttgctcgaccgacaacccctgcgtttttatcgctaaacaagataaagaaaagggcactgtcaccctctccagtaccttacccggcacctatcgctggaaagcaaaagccgcgccctacgatgacagtaactatgtggatgtcactttcctcggggcagaaattggtgggctaaatgcttttatctatcgtgtgggggcggctaaacccagcaacctgataggtaaagataaagaaccgttgccgctcaacaacacttatcgatttgttttgtggcgcgacaacaataaagacggtgtcttccagcaggtcgaaaaactgactgacgaagagatggtgcagtacgactacaagtgggaatttaccggcaagagcatcaatggtgaagtgggtgcacaggcgaacacttccaatgaggacattgtgattccggccactaaccgtgaagcggcgcaaacctatggcgcacaagcgggagatggcttgcagggatacggtttacgcgtgctgtataccaaaaaataa

SEQ ID NO: 6110 - protein, 734 aa, Escherichia coli
MLRWKRCIILTFISGAAFAAPEINVKQNESLPDLGSQAAQQDEQTNKGKSLKERGADYVINSATQGFENLTPEALKSQARSYLQSQITSTAQSYIEDTLSPYGKVRSNLSIGQGGDLDGSSIDYFVPWYDNQTTVYFSQFSAQRKEDRTIGNIGLGVRYNFDKYLLGGNIFYDYDFTRGHRRLGLGAEAWTDYLKFSGNYYHPLSDWKDSEDFDFYEERPARGWDIRAEAWLPAYPQLGGKIVFEQYYGNEVALFGTDSLEKDPFAVTLGVKYQPVPLIVVGTDFKAGTGDNTDLSVNATLNYQFGVPLKDQLDPDKVSAAHSLMGSRHDFVERNNFIVLEYKEKDPLYVTLWLKADVTNEHPECVIKDTPEEAIGLEKCKWTINALINHHYKIVAASWQAKNNAASWQAKNNAARTLVMPVIKENTLTEGNNNHWNLVLPAWQYSSDQAEQEKLNTWRVRLALEDEKGNRQNSGVVEITVQQDRKIELIVNNIANVPEENNHSHEASAQADGVDGVVMDLDVTDSFGDNTDRNGDALPEDNLTPQLYDAQDKRVTLTNKPCSTDNPCVFIAKQDKEKGTVTLSSTLPGTYRWKAKAAPYDDSNYVDVTFLGAEIGGLNAFIYRVGAAKPSNLIGKDKEPLPLNNTYRFVLWRDNNKDGVFQQVEKLTDEEMVQYDYKWEFTGKSINGEVGAQANTSNEDIVIPATNREAAQTYGAQAGDGLQGYGLRVLYTKK

SEQ ID NO: 6111 - DNA, 213 bp, Escherichia coli
gcactcaactgtccaacctgcaaaacccctctcgaacgcaatggcgagactgctcactgtgcaacttgcgacaaagactttaccgtccaggcactttgccctgagtgtcatcaggcgttacaagtgttaaaagcttgtggtgctgtggattatttctgccaacatgggcacggtttaatatctaaaaaacgcgttgaatttattattgcttaa

SEQ ID NO: 6112 - protein, 70 aa, Escherichia coli
ALNCPTCKTPLERNGETAHCATCDKDFTVQALCPECHQALQVLKACGAVDYFCQHGHGLISKKRVEFIIA

SEQ ID NO: 6113 - DNA, 1473 bp, Escherichia coli
atggtacctgtggtcgcgcttgtcgggcgccctaacgtaggaaaatccacgttatttaaccgtctaactcgcacccgagatgcgctggttgcggatttcccgggtctgactcgtgaccgtaagtacggtcgtgcggaaattgaaggccgtgagtttatctgcattgataccggcgggattgatggcacagaagacggtgtagaaacccgcatggcggaacagtcgctgctggcgattgaagaagcggacgtcgtactgtttatggtggatgcgcgctcgggcctgatgccggcggatgaagcgattgctaaacatctgcgctcccgtgaaaaaccgaccttcctggtggcaaacaaaactgacggtctggatcccgatcaggcagtggttgatttctacgcgcttggtttaggtgaaatctacccgatcgccgcgtctcacggtcgtggcgtattaagtctgctggagcacgtgctgctgccgtggatggaagatctcgcaccgcaagaagaagtcgacgaagacgccgaatactgggcgcaatttgaagcggaagagaacggcgaagaagaagaggaagacgacttcgacccgcaaagtctgccgatcaaactggcgattgtgggtcgcccgaacgtaggtaagtctacactcactaaccgtattcttggtgaagagcgcgttgttgtttacgacatgcctggcacgacgcgtgacagtatctacattccaatggaacgcgacggacgtgagtatgtgctcattgacaccgctggcgtacgtaaacgcggcaaaatcaccgatgcggtagagaaattctcggtaatcaaaacgttgcaggccattgaagatgccaacgtggtgatgttggtgattgatgcgcgtgaaggtatttccgatcaggatctctccttgctgggctttattctcaatagtgggcgctcacttgtgattgtagtgaacaagtgggacggcctgagccaggaagtgaaagagcaggtgaaagagacgctggacttccgtctgggctttatcgattttgctcgtgtgcactttatctctgccttgcacggcagtggtgttggtaacttgtttgaatcagtacgtgaagcgtatgacagctccacccgtcgtgtggggacctctatgctgacgcgcatcatgacgatggctgttgaagatcaccaaccaccgctggtacgcggtcgtcgtgtgaagctgaaatacgcccacgccgggggttataacccgccgattgtggtgattcacggcaatcaggtgaaagacctgcctgattcctacaagcgttacctgatgaactacttccgcaaatcgctggacgtaatgggatcgccgattcgtattcagttcaaagaaggggaaaacccgtatgcgaacaagcgtaacaccctgacgccaacccagatgcgtaaacgtaagcgtctgatgaagcatatcaagaaaagtaagtaa

SEQ ID NO: 6114 - protein, 490 aa, Escherichia coli
MVPVVALVGRPNVGKSTLFNRLTRTRDALVADFPGLTRDRKYGRAEIEGREFICIDTGGIDGTEDGVETRMAEQSLLAIEEADVVLFMVDARSGLMPADEAIAKHLRSREKPTFLVANKTDGLDPDQAVVDFYALGLGEIYPIAASHGRGVLSLLEHVLLPWMEDLAPQEEVDEDAEYWAQFEAEENGEEEEEDDFDPQSLPIKLAIVGRPNVGKSTLTNRILGEERVVVYDMPGTTRDSIYIPMERDGREYVLIDTAGVRKRGKITDAVEKFSVIKTLQAIEDANVVMLVIDAREGISDQDLSLLGFILNSGRSLVIVVNKWDGLSQEVKEQVKETLDFRLGFIDFARVHFISALHGSGVGNLFESVREAYDSSTRRVGTSMLTRIMTMAVEDHQPPLVRGRRVKLKYAHAGGYNPPIVVIHGNQVKDLPDSYKRYLMNYFRKSLDVMGSPIRIQFKEGENPYANKRNTLTPTQMRKRKRLMKHIKKSK

SEQ ID NO: 6115 - DNA, 1179 bp, Escherichia coli
atgcaattgcgtaaattactgctgccaggactgctttccgttacccttttaagcggctgttcgctgtttaacagcgaagaagatgtggtaaagatgtccccattgccaaccgttgaaaaccagtttacgccgactactgcgtggagcacttccgttggtagcggcattggcaacttctattccaatcttcatccggcactggcggacaacgttgtctatgcagcggaccgcgctggtttagtaaaagcgctgaatgcggatgacggcaaagaaatctggtctgtcaacctggccgagaaagatggctggttctctaaagatcctgcattactttctggcggcgtgaccgtgtctggtgggcatgtctacattggcaccgaaaaggcgcaggtttacgcgctgaataccagcgatggtactgtggcatggcaaactaaagtcgcgggtgaagcactttcgcgcccggtggtcagcgacggtctggtgttaatccacaccagtaacggtcagttacaagcgctgaacgaagctgacggcgctgtcaaatggacagttaacctcgatatgccttcgctctctttgcgtggcgagtctgcgccggcaacggcttttggtgcggccgtcgtgggtggcgataatggtcgcgtcagcgcagtgctgatggaacagggccagatgatttggcagcagcgtatttcccaggcgaccggttctaccgaaattgaccgtctgagcgatgttgacacgactcccgtcgttgttaacggcgttgttttcgcgctggcctataatggtaacctgacggcgcttgatctgcgcagcggtcagattatgtggaaacgcgaactgggttcggtgaatgatttcatcgtcgacggcaatcgcatctatctggtcgatcaaaatgaccgggtgatggcgttgaccattgatggcggcgttacgctgtggacacaaagcgatctgctgcatcgcctgctgacttctccggtgctgtataatggcaacctggtggtaggtgacagcgaaggttatctgcactggattaacgtcgaagatggtcgtttcgttgcccagcaaaaagttgatagttctggtttccagactgaaccggttgccgctgacggcaaactgctgatccaggcaaaagacggaaccgtgtactctattacacgttaa

SEQ ID NO: 6116 - protein, 392 aa, Escherichia coli
MQLRKLLLPGLLSVTLLSGCSLFNSEEDVVKMSPLPTVENQFTPTTAWSTSVGSGIGNFYSNLHPALADNVVYAADRAGLVKALNADDGKEIWSVNLAEKDGWFSKDPALLSGGVTVSGGHVYIGTEKAQVYALNTSDGTVAWQTKVAGEALSRPVVSDGLVLIHTSNGQLQALNEADGAVKWTVNLDMPSLSLRGESAPATAFGAAVVGGDNGRVSAVLMEQGQMIWQQRISQATGSTEIDRLSDVDTTPVVVNGVVFALAYNGNLTALDLRSGQIMWKRELGSVNDFIVDGNRIYLVDQNDRVMALTIDGGVTLWTQSDLLHRLLTSPVLYNGNLVVGDSEGYLHWINVEDGRFVAQQKVDSSGFQTEPVAADGKLLIQAKDGTVYSITR

SEQ ID NO: 6117 - DNA, 621 bp, Escherichia coli
gtggaaatttacgagaacgaaaacgaccaggttgaagcggttaaacgcttttttgctgaaaatggcaaagcactggctgttggggtgattttgggcgttggcgcactgattggctggcgctactggaacagccatcaggttgattctgcacgctccgcttctcttgcctatcaaaatgcggttaccgcagtgagcgaaggcaaaccggatagcatcccagcggcggaaaaatttgctgctgaaaataaaaatacttatggtgcgctggcttctttggaacttgcgcagcaatttgttgacaaaaatgaactagagaaagctgccgcccagttacaacaggggctggcagacacgagcgatgaaaatctcaaagccgtgataaatctgcgtcttgctcgcgttcaggtacagctcaagcaggctgatgccgcgctaaaaacccttgatgctatcaaaggtgaagggtgggctgccattgttgccgacctgcgtggtgaagcattgctgagcaaaggtgataagcaaggtgcgcgtagtgcatgggaagcaggcgtgaaaagcgatgttaccccggcactgagcgaaatgatgcagatgaaaattaataatttgtccatctga

SEQ ID NO: 6118 - protein, 206 aa, Escherichia coli
MEIYENENDQVEAVKRFFAENGKALAVGVILGVGALIGWRYWNSHQVDSARSASLAYQNAVTAVSEGKPDSIPAAEKFAAENKNTYGALASLELAQQFVDKNELEKAAAQLQQGLADTSDENLKAVINLRLARVQVQLKQADAALKTLDAIKGEGWAAIVADLRGEALLSKGDKQGARSAWEAGVKSDVTPALSEMMQMKINNLSI

SEQ ID NO: 6119 - DNA, 1275 bp, Escherichia coli
gtggcaaaaaacattcaagccattcgcggcatgaacgattacctgcctggcgaaacggccatctggcagcgcattgaaggcacactgaaaaacgtgctcggcagctacggttacagtgaaatccgcttgccgattgtagagcagaccccgctattcaaacgtgcgattggtgaagtcaccgacgtggttgaaaaagagatgtacacctttgaggatcgcaatggcgacagcctgactctgcgccctgaagggacggcgggctgtgtacgcgccggcatcgagcatggtcttctgtacaatcaggaacagcgtctgtggtatatcgggcctatgttccgtcacgagcgtccgcagaaagggcgttatcgtcagttccatcagttgggctgcgaagttttcggtctgcaaggtccggatatcgacgccgaactgattatgctcactgcccgctggtggcgcgcgctgggtatttccgagcacgtaactcttgagctgaactctatcggttcgctggaagctcgtgcgaattaccgcgatgcgctggtggcattccttgagcagcataaagaaaagctggacgaagactgcaaacgccgcatgtacactaacccgttgcgcgtactggattcaaaaaatccggaagtgcaggcgcttctcaacgacgctccggcattaggcgattatctggacgaggaatctcgtgagcactttgccggtctgtgcaaactgcttgagagcgcggggatcgcttacaccgtaaaccagcgtctggtgcgcggtctggattactataaccgtaccgttttcgagtgggtgactaacagcctcggttcccagggcaccgtgtgtgcaggtggtcgttatgacggtctggtggaacaactgggtggtcgtgcaacaccggcagtcggttttgcgatgggcctcgaacgtcttgtattgttagttcaggccgttaatccggaatttaaagccgatcctgttgtcgatatatacctggtggcttcaggtgctgacacacaatctgcggctatggcattagcagagcgtctgcgtgatgaattaccgggcgtgaaactgatgaccaaccacggcggcggcaactttaagaaacagtttgcccgtgctgataaatggggtgcccgcgttgctgtggtgctgggtgagtctgaagtggctaacggcacagcagtagtgaaggatttgcgctctggtgagcaaactgcagttgcgcaggatagcgtagccgcgcatttgcgcacgttactgggttaa

SEQ ID NO: 6120 - protein, 424 aa, Escherichia coli
MAKNIQAIRGMNDYLPGETAIWQRIEGTLKNVLGSYGYSEIRLPIVEQTPLFKRAIGEVTDVVEKEMYTFEDRNGDSLTLRPEGTAGCVRAGIEHGLLYNQEQRLWYIGPMFRHERPQKGRYRQFHQLGCEVFGLQGPDIDAELIMLTARWWRALGISEHVTLELNSIGSLEARANYRDALVAFLEQHKEKLDEDCKRRMYTNPLRVLDSKNPEVQALLNDAPALGDYLDEESREHFAGLCKLLESAGIAYTVNQRLVRGLDYYNRTVFEWVTNSLGSQGTVCAGGRYDGLVEQLGGRATPAVGFAMGLERLVLLVQAVNPEFKADPVVDIYLVASGADTQSAAMALAERLRDELPGVKLMTNHGGGNFKKQFARADKWGARVAVVLGESEVANGTAVVKDLRSGEQTAVAQDSVAAHLRTLLG

SEQ ID NO: 6121 - DNA, 1119 bp, Escherichia coli
atgcataaccaggctccaattcaacgtagaaaatcaacacgtatttacgttgggaatgtgccgattggcgatggtgctcccatcgccgtacagtccatgaccaatacgcgtacgacagacgtcgaagcaacggtcaatcaaatcaaggcgctggaacgtgttggcgctgatatcgtccgtgtctccgtaccgacgatggacgcggcagaagcgttcaaactcatcaaacagcaggttaacgtgccgctggtggctgacatccacttcgactatcgcattgcgctgaaagtagcggaatacggcgtcgattgtctgcgtattaaccctggcaatatcggtaatgaagagcgtattcgcatggtggttgactgtgcgcgcgataaaaacattccgatccgtattggcgttaatgccggatcgttggaaaaagatctgcaagaaaagtatggcgaaccgacgccgcaggcgttgctggaatctgccatgcgtcatgttgatcatctcgatcgcctgaacttcgatcagttcaaagtcagcgtgaaagcgtctgacgtcttcctcgctgttgagtcttatcgtttgctggcaaaacaaatcgatcagccgctgcatctggggatcaccgaagccggtggtgcgcgtagcggggcagtaaaatccgctattggtttaggtctgctgctgtctgaaggcatcggcgacacgctgcgcgtatcgctggcggccgatccggtcgaagagatcaaagtcggtttcgatattttgaaatcgctgcgtatccgttcgcgcgggatcaacttcatcgcctgcccgacctgttcgcgtcaggaatttgatgttatcggtacggttaacgcgctggagcaacgcctggaagatatcatcactccgatggacgtttcgattatcggctgcgtggtgaatggccctggtgaggcgctggtttctacactcggcgtcactggcggcaacaagaaaagcggcctctatgaagatggcgtgcgcaaagaccgtctggacaacaacgatatgatcgatcagctggaagcgcgcattcgtgcgaaagccagtcagctggacgaagcgcgtcgaattgacgttcagcaggttgaaaaataa

SEQ ID NO: 6122 - protein, 372 aa, Escherichia coli
MHNQAPIQRRKSTRIYVGNVPIGDGAPIAVQSMTNTRTTDVEATVNQIKALERVGADIVRVSVPTMDAAEAFKLIKQQVNVPLVADIHFDYRIALKVAEYGVDCLRINPGNIGNEERIRMVVDCARDKNIPIRIGVNAGSLEKDLQEKYGEPTPQALLESAMRHVDHLDRLNFDQFKVSVKASDVFLAVESYRLLAKQIDQPLHLGITEAGGARSGAVKSAIGLGLLLSEGIGDTLRVSLAADPVEEIKVGFDILKSLRIRSRGINFIACPTCSRQEFDVIGTVNALEQRLEDIITPMDVSIIGCVVNGPGEALVSTLGVTGGNKKSGLYEDGVRKDRLDNNDMIDQLEARIRAKASQLDEARRIDVQQVEK

SEQ ID NO: 6123 - DNA, 1008 bp, Escherichia coli
atgaatactgaagccacgcacgaccaaaatgaagcacttactaccggcgctcgcctgcgtaatgctcgcgaacaactaggacttagtcaacaggccgttgccgagcgactttgcctgaaggtttccacggtacgcgacattgaagaagataaggcacctgccgatcttgcttcaacattcctgcgcggatatatccgctcttatgcgcgtctggtacatattccagaagaagaactgctgccagggctggaaaagcaggctccactacgggctgcaaaagttgcgccgatgcagagtttttccctcggtaaacgccgcaaaaaacgtgacggctggctgatgaccttcacctggctggtgttgtttgtggttattggcctgagcggtgcctggtggtggcaagaccacaaagctcagcaggaagagatcaccactatggccgatcaatcttctgcggaactgaataataatcaaagccagagtgtaccgttagatacgtcgacaaccacagatcaggctatggcgaccacgccgacatcacctgtggataccaccgcaaccaacacgcaaacacctgccgtaactgcgccagcaccagctgttgatccgcaacagaatgcggttgttccaccttcgcaggcaaatgttgataccgctgcgactccggcaccagcggcaacaacaacaccagatggcgctgcgccgttgccaaccgatcaggctggcgtgaccacgccggcggttgacccgaatgcgctggtgatgaactttactgccgattgctggctggaagtcaccgatgctaccggtaaaaaactgtttagcggtatgcagcgtaaagacggtaatttgaacttaaccggccaggcaccgtacaaactgaaaattggtgcgccagccgcagtacagatccagtatcaagggaaacctgtcgatctgagtcgttttatcagaactaaccaggttgcgcgtctgaccctcaatgccgaacaatcaccggcgcagtaa

SEQ ID NO: 6124 - protein, 335 aa, Escherichia coli
MNTEATHDQNEALTTGARLRNAREQLGLSQQAVAERLCLKVSTVRDIEEDKAPADLASTFLRGYIRSYARLVHIPEEELLPGLEKQAPLRAAKVAPMQSFSLGKRRKKRDGWLMTFTWLVLFVVIGLSGAWWWQDHKAQQEEITTMADQSSAELNNNQSQSVPLDTSTTTDQAMATTPTSPVDTTATNTQTPAVTAPAPAVDPQQNAVVPPSQANVDTAATPAPAATTTPDGAAPLPTDQAGVTTPAVDPNALVMNFTADCWLEVTDATGKKLFSGMQRKDGNLNLTGQAPYKLKIGAPAAVQIQYQGKPVDLSRFIRTNQVARLTLNAEQSPAQ

SEQ ID NO: 6125 - DNA, 1155 bp, Escherichia coli
atgtctgaacaattagtcacacctgaaaacgtcaccacgaaagatggaaaaatcaacctgctggatctcaaccgtcagcagatgcgggagttttttaaagatttaggtgaaaaacccttccgcgccgatcaggtgatgaagtggatgtatcactattgctgcgacaactttgatgagatgaccgacatcaataaagtgttgcgcggcaaactgaaagaggtggcggaaatccgtgcaccggaagtggttgaagaacagcgttcatctgacggcaccattaaatgggcgatcgccgttggcgatcagcgcgttgaaacggtatatatcccggaagacgaccgtgccacgctctgcgtctcttcgcaggtggggtgtgcgctggagtgtaaattctgttccaccgcccagcagggctttaaccgcaacctgcgggtatcggaaattatcggccaggtgtggcgtgcggcgaaaattgtcggcgcagcaaaagtcaccggtcagcgcccaatcactaacgtagtgatgatgggtatgggcgagccgctgctcaacctgaacaacgtcgttccggcgatggaaatcatgcttgatgatttcggttttggcctgtcaaaacgtcgcgtcacgctttccacttccggtgtggttccggcgctggataaactgggcgatatgatcgacgtagcgctggcaatttccctgcacgcgccgaacgacgaaattcgtgacgagattgtgccgatcaacaaaaagtacaatatcgaaacgttccttgcggcggtgcgccgttatctggagaaatccaacgccaatcagggccgagtcactattgaatacgtgatgcttgaccacgttaacgacggcactgaacacgcgcaccaactggcggaactactgaaagatacgccgtgtaagatcaacctgatcccgtggaacccgttcccgggcgcgccgtatggacgcagttcgaacagccgtatcgaccgtttctcaaaagtgctgatgagctacggtttcaccactattgtgcgtaaaactcgtggtgatgatatcgatgctgcttgtggtcagttggcgggcgatgttatcgaccgtacgaaacgtactctgcgtaagcggatgcagggtgaagccatcgacattaaagcggtctga

SEQ ID NO: 6126 - protein, 384 aa, Escherichia coli
MSEQLVTPENVTTKDGKINLLDLNRQQMREFFKDLGEKPFRADQVMKWMYHYCCDNFDEMTDINKVLRGKLKEVAEIRAPEVVEEQRSSDGTIKWAIAVGDQRVETVYIPEDDRATLCVSSQVGCALECKFCSTAQQGFNRNLRVSEIIGQVWRAAKIVGAAKVTGQRPITNVVMMGMGEPLLNLNNVVPAMEIMLDDFGFGLSKRRVTLSTSGVVPALDKLGDMIDVALAISLHAPNDEIRDEIVPINKKYNIETFLAAVRRYLEKSNANQGRVTIEYVMLDHVNDGTEHAHQLAELLKDTPCKINLIPWNPFPGAPYGRSSNSRIDRFSKVLMSYGFTTIVRKTRGDDIDAACGQLAGDVIDRTKRTLRKRMQGEAIDIKAV

SEQ ID NO: 6127 - DNA, 432 bp, Escherichia coli
atggctattgaacgtactttttccatcatcaaaccgaacgcggtagcaaaaaacgtgattggtagtatctttgcgcgctttgaagctgcagggttcaaaattgtcggcaccaaaatgctgcacctgaccgttgaacaggctcgtggcttttatgctgaacacgatggaaaaccgttctttgatggtctggttgaattcatgacttctggcccgatcgttgtttccgtgctggaaggtgaaaatgctgttcagcgtcaccgcgatctgctgggcgcgaccaatccggcaaacgcactggccggtactctgcgtgctgattacgctgacagcctgaccgaaaatggtacccacggttctgattccgtcgaatctgccgctcgcgaaatcgcttatttcttcggcgaaggcgaagtgtgcccgcgcacccgttaa

SEQ ID NO: 6128 - protein, 143 aa, Escherichia coli
MAIERTFSIIKPNAVAKNVIGSIFARFEAAGFKIVGTKMLHLTVEQARGFYAEHDGKPFFDGLVEFMTSGPIVVSVLEGENAVQRHRDLLGATNPANALAGTLRADYADSLTENGTHGSDSVESAAREIAYFFGEGEVCPRTR

SEQ ID NO: 6129 - DNA, 2313 bp, Escherichia coli
atgcctcgcctgttaaccaaacgcggctgctggataatgctggcagccgcgccttttatcatcattctggcagcatgggcagcagataaactctggcctctgccattgcaagaagtgaatcctgcacgcgtggtggtggcgcaggatggtacgccactctggcgtttcgccgatgctgacggcatctggcgttatccggtaacaatcgaagatgtttctccacgttaccttgaagcgctgatcaattatgaagatcgctggttctggaagcatccgggggtgaatccgttctcggtggcgcgtgcagcctggcaagatctcacgtcgggtcgggtcatttccggcggcagcacgctcaccatgcaggtggcgcgcctgcttgatcctcaccccaaaacgtttggcggcaaaattcgccagctctggcgcgcgttgcaactggaatggcatctgtctaaacgtgaaattctgaccttgtatcttaaccgtgccccgtttggcggtacgttgcaggggattggtgcggcaagttgggcttacctcgggaaatcgcctgcgaatttaagctattccgaggcggcaatgctggcggttttgccgcaagcgcccagccgtcttcgcccggatcgttggccggagcgtgccgaagccgcgcgtaataaagtgctcgaacggatggccgtgcaaggtgtgtggtcccgtgagcgggtaaaagagtcaagggaagaacccatctggctggcaccccgacaaatgccgcaactggcaccgctgttttcgcgcatgatgctcggtaaaagcaaaagcgacaaaatcgttactacgctggatgccggtcttcaacgacgtctggaagaactggcgcaaaactggaaaggacgattgccaccgcgcagctcactggcgatgatcgtggttgatcataccgatatgcgtgttcgcggctgggtgggatcagttgatctcaacgatgattcacgctttggtcatgttgatatggtcaatgcgatccgatcgccaggatcggtgctcaaaccgtttgtttatggtctggcgctggatgaaggcttgatccacccggcatcgctgttgcaagacgtccccagacgcaccggtgattaccgacctggcaactttgacagcggttttcatggcccgatcagcatgagcgaggcgctggtgcgctcgctgaatttaccagctgtgcaggtgctggaagcctatggaccgaaacggtttgcggcaaaattacgcaatgttggattgccgttgtatctgcccaacggtgctgcgccgaatctttcgctcattctcggcggcgctggtgcaaaactggaagatatggcggcggcctataccgcgtttgctcgccacggcaaggcaggtaaattgcgcttacagcctgacgatccgctgcttgaacggcctttaatgtcgtcgggggctgcgtggatcattcgccggattatggctgatgaagcgcaacccttgccggatggtgccttgccgcgcgtcgccccactggcatggaaaacgggcaccagctatggctatcgtgatgcctgggcgattggggttaacgctcgctatgtcattgggatctggactggcagaccggacggcacgcccgttgttggtcagtttggctttgccagtgccgtaccgctgttgaatcaggttaataatatcttactgtcgcgcagtgtgaatttgccggaagacccacgtcctgactctgtaagtcgtggcgttatctgctggccgggcggacagtctttgccggaaggtgacggtaactgtcgccgccgcctggcaacctggctgctggacgggagccagccgccaactctattactgccggagcaggaaggcattaatggcattcgtttccccatctggctggatgaaaacggcaaacgtgttgccgctgattgccctcaggcgcgacaagaaatgataaatgtctggccgctaccgctggaaccctggctgcccgcatcagaacgtcgcgctgtgcgcttgccaccggcctcgacaatttgcccgccatacggtcacgatgcacaactcccgctgcagctaacaggtgtgcgcgatggcgcgattattaaacgtttaccgggcgcagcggaagcgactttgccgttgcaatcaagtggaggggcaggtgaacgctggtggtttctgaatggcgaaccgttaactgaacgtgggcgcaacgtgaccctgcatttgacggataaaggcgattatcaattgctggtgatggatgacgtggggcaaatagcgacagtgaaatttgtcatgcaatag

SEQ ID NO: 6130 - protein, 770 aa, Escherichia coli
MPRLLTKRGCWIMLAAAPFIIILAAWAADKLWPLPLQEVNPARVVVAQDGTPLWRFADADGIWRYPVTIEDVSPRYLEALINYEDRWFWKHPGVNPFSVARAAWQDLTSGRVISGGSTLTMQVARLLDPHPKTFGGKIRQLWRALQLEWHLSKREILTLYLNRAPFGGTLQGIGAASWAYLGKSPANLSYSEAAMLAVLPQAPSRLRPDRWPERAEAARNKVLERMAVQGVWSRERVKESREEPIWLAPRQMPQLAPLFSRMMLGKSKSDKIVTTLDAGLQRRLEELAQNWKGRLPPRSSLAMIVVDHTDMRVRGWVGSVDLNDDSRFGHVDMVNAIRSPGSVLKPFVYGLALDEGLIHPASLLQDVPRRTGDYRPGNFDSGFHGPISMSEALVRSLNLPAVQVLEAYGPKRFAAKLRNVGLPLYLPNGAAPNLSLILGGAGAKLEDMAAAYTAFARHGKAGKLRLQPDDPLLERPLMSSGAAWIIRRIMADEAQPLPDGALPRVAPLAWKTGTSYGYRDAWAIGVNARYVIGIWTGRPDGTPVVGQFGFASAVPLLNQVNNILLSRSVNLPEDPRPDSVSRGVICWPGGQSLPEGDGNCRRRLATWLLDGSQPPTLLLPEQEGINGIRFPIWLDENGKRVAADCPQARQEMINVWPLPLEPWLPASERRAVRLPPASTICPPYGHDAQLPLQLTGVRDGAIIKRLPGAAEATLPLQSSGGAGERWWFLNGEPLTERGRNVTLHLTDKGDYQLLVMDDVGQIATVKFVMQ

SEQ ID NO: 6131 - DNA, 4962 bp, Escherichia coli
atgaaaaagttacgcgtagccgcctgcatgctaatgctggcgctggcagggtgcgacaacaacgataacgcgccaacagcggtgaaaaaagatgcgccttctgaagttactaaagcggcctcttcagaaaacgtgagttcagcaaaactttccgcgccggagcgacaaaaactggcccaacagagtgccggtaaggcgctgacattgctggatctctctgaagttcaactcgatggcgcagccacgctggtgctgacgttctccatccctctcgacccggatcaggatttctcacgcgttattcatgtcgtcgataaaaaaagcggcaaagtggatggtgcctgggagctgtcacataatcttaaagagctgcgtttacgccacctcgaaccgaaacgtgatttgatcgtcactattggcaaggaggtcaaagcgctcaataacgcaacctttagtaaagatgacgaaaaaactataactacccgcgatatccaacccagcgtcggttttgccagtcgtggttcgttgcttcctggtaaggtcgttgaagggctgccggtaatggcgcttaacgttaacaatgtcgatgttaacttcttccgtgtgaaaccagaatcactgcccgctttcattagccagtgggaataccgcaattcgctggcgaactggcagtcagataaactgctgcagatggcggatctggtctacaccggacggtttgatctcaatcctgcgcgtaacacccgtgaaaaattattgctgccgctgggcgatatcaaaccgcttcagcaggcgggcgtgtatctggctgtgatgaatcaggctggacgttacgattacagtaatcccgcgacgctgtttacgttaagtgatattggcgtttcagctcaccgttatcacaatcgtctggatatctttacccaaagtctggaaaacggcgcggcccagcaaggaattgaagtctctttattaaatgagaaagggcagactctgactcaggcaaccagtgacgctcaggggcatgtgcagctggaaaatgataaaaacgcggcattactgctggcgcgtaaaaacggtcggacaacgctgctcgatttaaaactcccggcgctggacttagcggaatttaacattgctggcgcgccgggctatagcaaacagtttttcatgtttggcccgcgcgatctttatcgcccgggtgaaacggtcatcctcaatggtttgctgcgtgatgcagacggtaaagcattgcccgatcaacccatcaagttagacgtgattaaacccgacgggcaggtactcaggagcgtcgttagtcagccggagaatggcctctaccactttacctggccactcgatagcaatgcggcaaccggtatgtggcatattcgcgctaacacgggcgataaccagtatcggatgtgggatttccacgtcgaagattttatgccagagcgtatggcgctgaatctgaccggtgagaaaaccccgctaacgccgaaagatgaagtgaaattctccgtggtggggtactacctgtatggtgcacctgctaatggtaatactttgcaagggcaacttttcctgcgcccactgcgtgaagctgtgtcagccttacctggttttgaattcggcgatatagctgccgaaaatctttcccgcacgctggatgaagttcagttgacgctggatgataaagggcgcggcgaagtttctacagaaagccagtggaaggaaacacattccccattacaggttattttccagggtagtttgctggaatcgggcggtcgcccggtgacgcgccgtgctgagcaggctatctggcctgctgatgcattgccagggatccgtccgcagttcgcctcgaaatcggtttacgattatcgcaccgacagcacggtgaaacagcccattgttgatgaaggtagtaacgccgcttttgacatcgtttatagcgatgcgcaaggcgtgaaaaaagccgtgtcgggcttgcaggtgcgcttgattcgcgaacgccgcgattactactggaactggtcggaatatgaaggctggcagtcacagtttgatcaaaaagatctgatcgaaaatgaacaaactctggatctgaaagcggacgaaaccggtaaggtcagtttcccggtagagtggggcgcttatcgtctggaagttaaagcgccgaatgaagcggtcagtagtgtgcgtttctgggctgggtatagctggcaggataacagcgacgggggtggtgcagtgcgacccgaccgtgtcacgctgaaactggataaagccagctattgccctggcgataccattaagttgcatattgccgcgccaacggcgggtaaaggttatgcgatggtcgagtccagtgaagggccgctgtggtggcaagagattgatgttccggctcaagggctggatctgacgattccggtcgataaaacctggaatcgtcatgatctgtatttaagtacgctggtggtacgtcctggcgataaatctcgctccgcgacgccaaaacgcgcggttggggtgttgcatctgccgcttggtgatgaaaaccgtcgcctcgatctggcgctggaaacccccaccaaaatgcgccccaatcagccattaaccgtgaaaattaaagccagcaataaaaatggtgagatgccaaaacaggtgaatgtgctggtgtctgcggttgatagcggtgtgctgaatattactgattacgtcacgccagatccgtggcaggcgttctttggtcagaaacgctatggcgcagacatttacgatatttacggtcaggtcattgaaggtcaggggcgtctggcagctctgcgttttggtggcgatggtgatgagctgaaacgtggtggtaaaccgccggtcaatcacgtcaatattgtcgcgcagcaggcgctgccggtaacgctcaatgaacagggcgaaggctcggttacactgccaattggcgattttaacggtgaattgcgcgtcatggcgcaagcctggacggcagatgacttcggaagcaacgaaagcaaagtgattgttgccgcaccggtgattgctgaactgaacatgccgcgctttatggcgagtggcgatacctcgcgcctgacgctggatatcactaatcttaccgataaaccgcaaaaacttaatgttgctctgaccgccagtggcttgcttgaactggtgagtaattcccccgcacctgttgaattagcgccaggggtgcgtactacgctgtttatcccggtgcgtgcattgccgggttatggcgatggagacattcaggccaccattagcgggttagcgttaccgggggaaaccgttgccgatcagcataagcagtggaaaatcggcgtccgtccggcattcccggcacaaacggtcaattacggtacggcgttacagcctggtgaaacctgggcgctcccggctgatggattgcaaaacttctcgcctgttacgctggaagggcaattgttgttgagtggcaaaccaccgctgaacatcgcacgttatatcaaagagttaaaagcgtatccgtacggctgtctcgagcaaaccgccagcggcctgttcccgtcactttataccaatgcagcccaactgcaggcgttgggcatcaaaggcgacagtgatgagaaacgccgtgcatcggtcgatatcggcatttcccgtttgctgcaaatgcaacgtgataacggcggctttgcgttgtgggataaaaacggtgacgaagagtactggctgacggcttacgtgatggatttcctggtccgcgcaggcgaacagggttacagcgtgccgacagacgccattaaccggggtaatgagcgtctgctgcgctatttacaagatccgggcatgatgtcgatcccgtacgctgataatctcaaagccagtaaattcgccgtacagtcttacgctgcgctggtgttggcccgtcagcaaaaagcaccactgggtgcgctgcgtgaaatctgggagcatcgtgcagatgccgcttctggtttaccgctgctgcaacttggcgttgcgctgaaaaccatgggtgatgcaatgcgtggtgaagaagcgattgtgctggcgctgaaaacgccgcgtaatagtgatgagcggatatggctgggtgattacggtagtccactgcgcgacagcgcgttgatgctctcattgctggaagagaacaaactgctacccgatgagcagtactccctgttgaacacactttcgcagcaggcgttcggtgaacgctggctatcgacgcaggaaagtaacgcgttgttcctggctgcccgtactcttcaggatttaccgggcaaatggcaggcgcaaaccactttctctgctgagccgctgacaggcgagaaagcgcaaaccagcaatctgaatagcgatcaacttgccaccttgcaggtgaccaacagtggcgatcagccgttatggctgcgtgtggatgccagcggttatccgcaatccgcacctttaccggcgagcaatgtgctgcaaattgagcgtcatattctgggtactgacggtaagagcaaatcgctggactcgttacgtagcggcgatctggtgctggtgtggttgcaggttaaagccagtaacagtgtaccggatgcgttagtcgtggatctgttgcctgcggggctggaactggaaaaccagaatctggcgaacggcagcgccagcctggagcaaagtggtggtgaagtgcagaacttgctgaaccagatgcagcaggcgagcattaagcacatagagttccgtgacgatcgctttgtggcggcggttgccgttgatgaatatcaaccggtaacgctggtgtatctggcgcgggcggtgacgccgggaacgtatcaggtgccgcagcctatggtggaatcaatgtatgttcctcaatggcgggcgactggtgcggctgacgatctgttgatagtcagaccgtaa

SEQ ID NO: 6132 - protein, 1653 aa, Escherichia coli
MKKLRVAACMLMLALAGCDNNDNAPTAVKKDAPSEVTKAASSENVSSAKLSAPERQKLAQQSAGKALTLLDLSEVQLDGAATLVLTFSIPLDPDQDFSRVIHVVDKKSGKVDGAWELSHNLKELRLRHLEPKRDLIVTIGKEVKALNNATFSKDDEKTITTRDIQPSVGFASRGSLLPGKVVEGLPVMALNVNNVDVNFFRVKPESLPAFISQWEYRNSLANWQSDKLLQMADLVYTGRFDLNPARNTREKLLLPLGDIKPLQQAGVYLAVMNQAGRYDYSNPATLFTLSDIGVSAHRYHNRLDIFTQSLENGAAQQGIEVSLLNEKGQTLTQATSDAQGHVQLENDKNAALLLARKNGRTTLLDLKLPALDLAEFNIAGAPGYSKQFFMFGPRDLYRPGETVILNGLLRDADGKALPDQPIKLDVIKPDGQVLRSVVSQPENGLYHFTWPLDSNAATGMWHIRANTGDNQYRMWDFHVEDFMPERMALNLTGEKTPLTPKDEVKFSVVGYYLYGAPANGNTLQGQLFLRPLREAVSALPGFEFGDIAAENLSRTLDEVQLTLDDKGRGEVSTESQWKETHSPLQVIFQGSLLESGGRPVTRRAEQAIWPADALPGIRPQFASKSVYDYRTDSTVKQPIVDEGSNAAFDIVYSDAQGVKKAVSGLQVRLIRERRDYYWNWSEYEGWQSQFDQKDLIENEQTLDLKADETGKVSFPVEWGAYRLEVKAPNEAVSSVRFWAGYSWQDNSDGGGAVRPDRVTLKLDKASYCPGDTIKLHIAAPTAGKGYAMVESSEGPLWWQEIDVPAQGLDLTIPVDKTWNRHDLYLSTLVVRPGDKSRSATPKRAVGVLHLPLGDENRRLDLALETPTKMRPNQPLTVKIKASNKNGEMPKQVNVLVSAVDSGVLNITDYVTPDPWQAFFGQKRYGADIYDIYGQVIEGQGRLAALRFGGDGDELKRGGKPPVNHVNIVAQQALPVTLNEQGEGSVTLPIGDFNGELRVMAQAWTADDFGSNESKVIVAAPVIAELNMPRFMASGDTSRLTLDITNLTDKPQKLNVALTASGLLELVSNSPAPVELAPGVRTTLFIPVRALPGYGDGDIQATISGLALPGETVADQHKQWKIGVRPAFPAQTVNYGTALQPGETWALPADGLQNFSPVTLEGQLLLSGKPPLNIARYIKELKAYPYGCLEQTASGLFPSLYTNAAQLQALGIKGDSDEKRRASVDIGISRLLQMQRDNGGFALWDKNGDEEYWLTAYVMDFLVRAGEQGYSVPTDAINRGNERLLRYLQDPGMMSIPYADNLKASKFAVQSYAALVLARQQKAPLGALREIWEHRADAASGLPLLQLGVALKTMGDAMRGEEAIVLALKTPRNSDERIWLGDYGSPLRDSALMLSLLEENKLLPDEQYSLLNTLSQQAFGERWLSTQESNALFLAARTLQDLPGKWQAQTTFSAEPLTGEKAQTSNLNSDQLATLQVTNSGDQPLWLRVDASGYPQSAPLPASNVLQIERHILGTDGKSKSLDSLRSGDLVLVWLQVKASNSVPDALVVDLLPAGLELENQNLANGSASLEQSGGEVQNLLNQMQQASIKHIEFRDDRFVAAVAVDEYQPVTLVYLARAVTPGTYQVPQPMVESMYVPQWRATGAADDLLIVRP

SEQ ID NO: 6133 - DNA, 1005 bp, Escherichia coli
atgcgtgagaatttacgttatgtaattcagtatcacgcccatacaatccgaattttagtgagaattgtggctcagacagccaaatcagcctcttttgcttgtcgcttttcactaaacatccgacaatttagcctaaccccggcaaaaatggagatgcctatgtccacgacatggtttgtaggagccgactggctcgccgaacatattgatgacccggaaattcagattatcgatgcccgcatggcgtcgcctggacaggaagatcgtaacgttgctcaggagtatctgaatggacatattccaggcgcagtgttttttgatatcgaagcgctttctgatcacacttccccgcttccgcacatgctgccgcgcccggaaacgttcgccgtggcgatgcgtgaattaggcgttaaccaggataagcacctgattgtctatgacgaaggtaatcttttctcagccccacgagcatggtggatgctgcgcacctttggtgtagagaaagtgtcgattctgggtggtggacttgcaggctggcagcgtgatgatctgctattagaggaaggcgcagtagagctgccggaaggagagtttaacgccgcgtttaatcctgaagccgtggtgaaagtaaccgatgtattattggcaagccatgaaaatacggcgcaaattattgatgcccgcccggctacacgttttaacgcagaagttgatgaacctcgcccaggtttacgtcgcggacatattcccggtgcattgaacgttccgtggacggaactggtacgtgaaggcgaactaaaaacgaccgatgaactggatgcgatattttttggtcgcggtgtcagctacgacaaaccaattatcgtcagctgcggttctggtgtaacagcagccgtggttttgttggcacttgcgacgctggatgtgacaaacgtgaaactgtacgacggcgcatggagtgaatggggcgcacgggcagatttaccggttgagcccgtaaaataa

SEQ ID NO: 6134 - protein, 334 aa, Escherichia coli
MRENLRYVIQYHAHTIRILVRIVAQTAKSASFACRFSLNIRQFSLTPAKMEMPMSTTWFVGADWLAEHIDDPEIQIIDARMASPGQEDRNVAQEYLNGHIPGAVFFDIEALSDHTSPLPHMLPRPETFAVAMRELGVNQDKHLIVYDEGNLFSAPRAWWMLRTFGVEKVSILGGGLAGWQRDDLLLEEGAVELPEGEFNAAFNPEAVVKVTDVLLASHENTAQIIDARPATRFNAEVDEPRPGLRRGHIPGALNVPWTELVREGELKTTDELDAIFFGRGVSYDKPIIVSCGSGVTAAVVLLALATLDVTNVKLYDGAWSEWGARADLPVEPVK

SEQ ID NO: 6135 - DNA, 786 bp, Escherichia coli
gtggttcttatgtccgaaacaaaaaacgaacttgaagacctgctggaaaaagcagcaaccgaaccggctcaccgcccggcctttttccgtactctactggaatccaccgtctgggtgcctggtacggcggcgcagggcgaggcagtagttgaagatagcgcgcttgatttacagcactgggaaaaagaagacggcaccagcgtcattcctttttttacctcgttagaagcacttcaacaggcggttgaagacgaacaggcatttgtcgtaatgcccgttcgcacattgtttgagatgacccttggcgaaacgctcttccttaatgccaaactgccaaccggtaaagagtttatgccgcgtgaaatcagtttgttgattggtgaagaagggaatccgctgagtagccaggaagtactggaaggcggtgaatcgctgatattatcggaggtcgcagagccgccagcgcaaatgattgattcacttaccaccttatttaaaaccattaagccggtgaagcgtgcttttatttgttcaattaaagagaacgaagaggcacagcctaatttacttattggcattgaagccgatggtgatatcgaagaaattattcaggcggcgggaagtgtagcgaccgatacattacctggcgatgaacccatcgatatttgtcaggtgaaaaaaggggaaaaaggtattagccactttattaccgaacatattgcgccattctatgaacgtcgctggggtggttttttgcgtgactttaaacagaaccggataatttaa

SEQ ID NO: 6136 - protein, 261 aa, Escherichia coli
MVLMSETKNELEDLLEKAATEPAHRPAFFRTLLESTVWVPGTAAQGEAVVEDSALDLQHWEKEDGTSVIPFFTSLEALQQAVEDEQAFVVMPVRTLFEMTLGETLFLNAKLPTGKEFMPREISLLIGEEGNPLSSQEVLEGGESLILSEVAEPPAQMIDSLTTLFKTIKPVKRAFICSIKENEEAQPNLLIGIEADGDIEEIIQAAGSVATDTLPGDEPIDICQVKKGEKGISHFITEHIAPFYERRWGGFLRDFKQNRII

SEQ ID NO: 6137 - DNA, 1284 bp, Escherichia coli
atgacagaagcgatgaagattaccctctcgacccaacctgccgacgcacgttggggagaaaaagcgacttacagcattaataatgatggcattaccctgcatttgaacggggcagacgatctggggttgatccagcgtgcggcgcgcaagattgacggtctgggcatcaagcatgttcagttaagcggtgaaggctgggatgcggatcgctgctgggcattctggcaaggttacaaagccccgaaaggcatacgtaaagtggagtggccggatctggacgatgcccagcgtcaggaactggataaccgcctgatgatcatcgactgggtgcgtgacaccatcaacgcaccggcagaagagctggggccatcgcaactggcacagcgtgctgttgatctgatcagcaacgtcgcaggggatcgtgtgacttaccggatcaccaaaggcgaagatctgcgtgagcaaggttatatggggctgcacacggtcgggcgcggttcagaacgttctccggtattgctggcgctggattacaacccaactggcgataaagaagcgccagtgtacgcgtgcctggttggtaaaggcatcacttttgattccggcggctacagcatcaaacagactgcgtttatggactcgatgaagtcggacatgggcggcgcggcaacggttaccggggcgctggcatttgccattacgcgcggactgaacaagcgcgtgaagctgttcctctgttgtgcggataacctgatcagcggcaacgcgttcaaactgggcgatattattacctatcgcaacggtaaaaaagttgaagtgatgaacactgatgccgaagggcgtctggtgctggccgatggcctgattgatgccagtgcgcagaaaccggaactgatcattgatgcggcgaccctcaccggggcggcgaaaaccgcgctgggtaatgattatcacgcgctgttcagttttgacgatgcgcttgccggtcgcttgttggcgagtgccgcgcaggagaatgaaccgttctggcgtctgccgctggcggagttccaccgcaatcaattgccgtctaactttgccgaactgaacaacaccggaagcgcggcgtatccggcaggcgcgagcacagcggcgggcttcctgtcgcactttgttgagaactatcagcaaggctggctgcatatcgactgctcggcgacttaccgtaaagcgccggttgaacagtggtctgcgggtgctacgggacttggtgtgcgcacgattgctaatctgttaacggcgtaa

SEQ ID NO: 6138 - protein, 427 aa, Escherichia coli
MTEAMKITLSTQPADARWGEKATYSINNDGITLHLNGADDLGLIQRAARKIDGLGIKHVQLSGEGWDADRCWAFWQGYKAPKGIRKVEWPDLDDAQRQELDNRLMIIDWVRDTINAPAEELGPSQLAQRAVDLISNVAGDRVTYRITKGEDLREQGYMGLHTVGRGSERSPVLLALDYNPTGDKEAPVYACLVGKGITFDSGGYSIKQTAFMDSMKSDMGGAATVTGALAFAITRGLNKRVKLFLCCADNLISGNAFKLGDIITYRNGKKVEVMNTDAEGRLVLADGLIDASAQKPELIIDAATLTGAAKTALGNDYHALFSFDDALAGRLLASAAQENEPFWRLPLAEFHRNQLPSNFAELNNTGSAAYPAGASTAAGFLSHFVENYQQGWLHIDCSATYRKAPVEQWSAGATGLGVRTIANLLTA

SEQ ID NO: 6139 - DNA, 201 bp, Escherichia coli
atgggacttaagtggacggatagccgcgaaattggcgaagcactgtacgatgcgtatcccgatcttgatccgaaaacggttcgattcaccgatatgcatcagtggatttgcgatctggaagatttcgacgacgacccgcaggcatccaacgagaaaatcctcgaagcgattttgttggtctggcttgacgaggccgagtaa

SEQ ID NO: 6140 - protein, 66 aa, Escherichia coli
MGLKWTDSREIGEALYDAYPDLDPKTVRFTDMHQWICDLEDFDDDPQASNEKILEAILLVWLDEAE

SEQ ID NO: 6141 - DNA, 336 bp, Escherichia coli
atgccaaagattgttattttgcctcatcaggatctctgccctgatggcgctgttctggaagcgaatagtggtgaaaccattctcgacgttgcgctgcgtaacggtatcgagattgaacacgcctgtgaaaaatcctgtgcttgcaccacctgccactgcatcgttcgtgaaggttttgactcgctgccggaaagctcagagcaggaagacgacatgctggacaaagcctggggactggagccggaaagccgtttaagctgccaggcgcgcgttaccgacgaagatttagtggtcgaaatcccgcgttacactatcaaccatgcgcgtgagcattaa

SEQ ID NO: 6142 - protein, 111 aa, Escherichia coli
MPKIVILPHQDLCPDGAVLEANSGETILDVALRNGIEIEHACEKSCACTTCHCIVREGFDSLPESSEQEDDMLDKAWGLEPESRLSCQARVTDEDLVVEIPRYTINHAREH

SEQ ID NO: 6143 - DNA, 1905 bp, Escherichia coli
gtgccgaacaactcgaagaaaaactgctcgatttttaatttctggaagctaaacatggccttattacaaattagtgaacctggtttgagtgctgcgccgcatcagcgtcgtctggcggccggtattgacctgggcacaaccaactcgctggtggcgacagtgcgcagcggtcaggccgaaacgttagctgaccatgaaggccgtcacctgttgccatctgttgttcactatcaacagcaagggcattcggtgggttatgacgcgcgtactaacgcagcgctcgacaccgccaacaccattagttctgttaaacgcctgatggggcgctcgctggctgatatccagcaacgctatccgcatctgccttatcaattccaggccagcgaaaatggcctgccgatgattgaaacggcggcggggctgctgaacccggtgcgcgtttctgcggacatcctcaaagcactggcggcgcgggcaactgaagccctggcaggcgagctggatggtgtagttatcaccgttccggcgtactttgacgatgcccagcgtcagggcaccaaagacgcggcgcgtctggcggggttgcatgttctgcgcttacttaacgaaccgaccgctgcggctatcgcctacgggctggattccggtcaggaaggcgtgatcgccgtttatgacctcggcggcgggacgtttgatatttccattctgcgcttaagtcgcggcgtgtttgaagtgctggcaaccggcggtgattccgcgctcggcggcgatgatttcgaccatctgctggcggattatattcgcgagcaggcgggcattcctgatcgtagcgataaccgcgttcagcgtgaactgctggatgccgccattgcggccaaaatcgcgctgagtgatgcggactccgtgaccgttaacgttgcgggctggcagggcgaaatcagccgtgaacaattcaatgaactgatcgcgccactggtaaaacgaaccttactggcttgtcgtcgcgcgctgaaagacgcgggtgtagaagctgatgaagtgctggaagtggtgatggtgggcggttctactcgcgtgccgctggtgcgtgaacgggtaggcgaatttttcggtcgtccaccgctgacttccatcgacccggataaagtcgtcgctattggcgcggcgattcaggcggatattctggtgggtaacaagccagacagcgaaatgctgctgcttgatgtgatcccactgtcgctgggcctcgaaacgatgggcggcctggtggagaaagtgattccgcgtaataccacgattccggtggctcgcgcccaggatttcaccacctttaaagatggtcagacggcgatgtctatccatgtaatgcagggtgagcgtgaactggtgcaggactgccgctcgctggcgcgttttgcactgcgtggtatcccggcgctaccggctggcggcgcgcatattcgcgtgacgttccaggtcgatgccgacggtcttttgagcgtgacggcgatggagaaatccaccggcgttgaggcgtctattcaggtcaaaccttcttatggcctgaccgacagcgaaatcgcctcgatgattaaagactcaatgagctatgccgagcaggacgtaaaagcccgaatgctggcagaacaaaaagtagaagcggcgcgtgtgctggaaagtctgcacggcgcgctggctgctgatgccgcgctgttaagcgccgcagagcgtcaggtcattgacgatgctgccgctcacctgagtgaagtggcgcagggcgatgatgttgacgccatcgaacaagcgattaaaaacgtagacaaacaaacccaggatttcgccgctcgccgcatggaccagtcggttcgtcgtgcgctgaaaggccattccgtggacgaggtttaa

SEQ ID NO: 6144 - protein, 634 aa, Escherichia coli
MPNNSKKNCSIFNFWKLNMALLQISEPGLSAAPHQRRLAAGIDLGTTNSLVATVRSGQAETLADHEGRHLLPSVVHYQQQGHSVGYDARTNAALDTANTISSVKRLMGRSLADIQQRYPHLPYQFQASENGLPMIETAAGLLNPVRVSADILKALAARATEALAGELDGVVITVPAYFDDAQRQGTKDAARLAGLHVLRLLNEPTAAAIAYGLDSGQEGVIAVYDLGGGTFDISILRLSRGVFEVLATGGDSALGGDDFDHLLADYIREQAGIPDRSDNRVQRELLDAAIAAKIALSDADSVTVNVAGWQGEISREQFNELIAPLVKRTLLACRRALKDAGVEADEVLEVVMVGGSTRVPLVRERVGEFFGRPPLTSIDPDKVVAIGAAIQADILVGNKPDSEMLLLDVIPLSLGLETMGGLVEKVIPRNTTIPVARAQDFTTFKDGQTAMSIHVMQGERELVQDCRSLARFALRGIPALPAGGAHIRVTFQVDADGLLSVTAMEKSTGVEASIQVKPSYGLTDSEIASMIKDSMSYAEQDVKARMLAEQKVEAARVLESLHGALAADAALLSAAERQVIDDAAAHLSEVAQGDDVDAIEQAIKNVDKQTQDFAARRMDQSVRRALKGHSVDEV

SEQ ID NO: 6145 - DNA, 516 bp, Escherichia coli
atggattacttcaccctctttggcttgcctgcccgttatcaactcgatacccaggcgctgagcctgcgttttcaggatctacaacgtcagtatcatcctgataaattcgccagcggaagccaggcggaacaactcgccgccgtacagcaatctgcaaccattaaccaggcctggcaaacgctgcgtcatccgttaatgcgcgcggaatatttgctttctttgcacggttttgatctcgccagtgagcagcatactgtgcgcgacaccgcgttcctgatggaacagctggagctgcgcgaagaactggacgagatcgaacaggcgaaagatgaagcgcggctggaaagctttatcaaacgtgtgaaaaagatgtttgatacccgccatcagttgatggttgaacagttagacaacgagacgtgggacgcggcggcggataccgtgcgtaagctgcgttttctcgataaactgcgaagcagtgccgaacaactcgaagaaaaactgctcgatttttaa

SEQ ID NO: 6146 - protein, 171 aa, Escherichia coli
MDYFTLFGLPARYQLDTQALSLRFQDLQRQYHPDKFASGSQAEQLAAVQQSATINQAWQTLRHPLMRAEYLLSLHGFDLASEQHTVRDTAFLMEQLELREELDEIEQAKDEARLESFIKRVKKMFDTRHQLMVEQLDNETWDAAADTVRKLRFLDKLRSSAEQLEEKLLDF

SEQ ID NO: 6147 - DNA, 330 bp, Escherichia coli
ttggttatgtcgattacactgagcgacagtgcagcagcgcgagtaaatacctttctggctaaccgcggtaaagggtttggcctgcgtctgggcgtgagaacctccgggtgttcaggtatggcttatgtactggaatttgttgacgaaccgacgccggaagacatcgtgtttgaagacaaaggcgtgaaagtcgtggtcgatggcaaaagcctgcaatttctggacggtacgcagctggacttcgtcaaagaaggccttaacgaagggtttaaattcaccaacccgaacgtcaaagatgagtgtggttgcggcgaaagcttccacgtttga

SEQ ID NO: 6148 - protein, 109 aa, Escherichia coli
MVMSITLSDSAAARVNTFLANRGKGFGLRLGVRTSGCSGMAYVLEFVDEPTPEDIVFEDKGVKVVVDGKSLQFLDGTQLDFVKEGLNEGFKFTNPNVKDECGCGESFHV

SEQ ID NO: 6149 - DNA, 387 bp, Escherichia coli
atggcttacagcgaaaaagttatcgaccattacgagaatccgcgtaacgtgggttcctttgacaacaacgacgagaacgtcggcagcggcatggtgggtgcaccggcctgtggcgacgtgatgaagttgcagattaaagtcaacgatgaaggtatcattgaagacgcgcgttttaaaacttacggctgcggttccgctatcgcttccagctccctggtcaccgaatgggtgaaagggaagtctctcgacgaagcacaggcgatcaaaaacaccgatattgctgaagaacttgaactgccgccggtgaaaattcactgttctattctggcagaagacgcgatcaaagccgccattgcggactataaaagcaaacgtgaagcaaaataa

SEQ ID NO: 6150 - protein, 128 aa, Escherichia coli
MAYSEKVIDHYENPRNVGSFDNNDENVGSGMVGAPACGDVMKLQIKVNDEGIIEDARFKTYGCGSAIASSSLVTEWVKGKSLDEAQAIKNTDIAEELELPPVKIHCSILAEDAIKAAIADYKSKREAK

SEQ ID NO: 6151 - DNA, 1215 bp, Escherichia coli
atgaaattaccgatttatctcgactactccgcaaccacgccggtggacccgcgtgttgccgagaaaatgatgcagtttatgacgatggacggaacctttggtaacccggcctcccgttctcaccgtttcggctggcaggctgaagaagcggtagatatcgcccgtaatcagattgccgatctggtcggcgctgatccgcgtgaaatcgtctttacctctggtgcaaccgaatctgacaacctggcgatcaaaggtgcagccaacttttatcagaaaaaaggcaagcacatcatcaccagtaaaaccgaacataaagcggtactggatacctgccgtcagctggagcgcgaaggttttgaagtcacttacctggcaccgcagcgtaatggcattatcgacctgaaagaactcgaagcagcgatgcgtgacgacaccatccttgtttccatcatgcacgtaaataacgaaatcggcgtggtgcaggatatcgcggctatcggcgaaatgtgccgtgctcgtggcattatctatcacgttgatgcaacccagagcgtgggcaaactgcctatcgacctgagccagttgaaagttgacctgatgtctttctccggtcacaaaatctatggcccgaaaggtattggtgcgctgtatgtgcgtcgtaaaccgcgcgtacgtatcgaagcacaaatgcatggcggcggtcacgagcgcggtatgcgttccggcactctgcctgttcaccagatcgtcggtatgggcgaagcctatcgcatcgcaaaagaagagatggcgaccgagatggaacgtctgcgcggcctgcgtaaccgtctgtggaacggcatcaaagatatcgaagaagtttacctgaacggtgacctggaacacggtgcgccgaacattctcaacgtcagcttcaactacgttgaaggtgagtcgctgattatggcgctgaaagacctcgcggtttcttcaggttccgcctgtacgtcagcaagcctcgaaccgtcctacgtgctgcgcgcgctggggctgaacgacgagctggcacatagctctatccgtttctctttaggtcgttttactactgaagaagagatcgactacaccatcgagttagttcgtaaatccatcggtcgtctgcgtgacctttctccgctgtgggaaatgtacaagcagggcgtggatctgaacagcatcgaatgggctcatcattaa

SEQ ID NO: 6152 - protein, 404 aa, Escherichia coli
MKLPIYLDYSATTPVDPRVAEKMMQFMTMDGTFGNPASRSHRFGWQAEEAVDIARNQIADLVGADPREIVFTSGATESDNLAIKGAANFYQKKGKHIITSKTEHKAVLDTCRQLEREGFEVTYLAPQRNGIIDLKELEAAMRDDTILVSIMHVNNEIGVVQDIAAIGEMCRARGIIYHVDATQSVGKLPIDLSQLKVDLMSFSGHKIYGPKGIGALYVRRKPRVRIEAQMHGGGHERGMRSGTLPVHQIVGMGEAYRIAKEEMATEMERLRGLRNRLWNGIKDIEEVYLNGDLEHGAPNILNVSFNYVEGESLIMALKDLAVSSGSACTSASLEPSYVLRALGLNDELAHSSIRFSLGRFTTEEEIDYTIELVRKSIGRLRDLSPLWEMYKQGVDLNSIEWAHH

SEQ ID NO: 6153 - DNA, 489 bp, Escherichia coli
atgagactgacatctaaagggcgctatgccgtgaccgcaatgcttgacgttgcgctcaactctgaagcgggcccggtaccgttggctgatatttccgaacgtcagggaatttccctttcttatctggaacaactgttttcccgtctgcgtaaaaatggtctggtttccagcgtacgtggaccaggcggtggttatctgttaggcaaagatgccagcagcatcgccgttggcgaagtgattagcgccgttgacgaatctgtagatgccacccgttgtcagggtaaaggcggctgccagggcggcgataaatgcctgacccacgcgctgtggcgtgatttgagcgaccgtcttaccggttttctcaataacattactttaggcgaactggttaataaccaggaagtgctggatgtgtctggtcgtcagcatactcacgacgcgccacgcacccgcacacaagacgcgatcgacgttaagttacgcgcttaa

SEQ ID NO: 6154 - protein, 162 aa, Escherichia coli
MRLTSKGRYAVTAMLDVALNSEAGPVPLADISERQGISLSYLEQLFSRLRKNGLVSSVRGPGGGYLLGKDASSIAVGEVISAVDESVDATRCQGKGGCQGGDKCLTHALWRDLSDRLTGFLNNITLGELVNNQEVLDVSGRQHTHDAPRTRTQDAIDVKLRA

SEQ ID NO: 6155 - DNA, 741 bp, Escherichia coli
atgctgcaaaatattcgaattgtgctggtggagacgtcacacaccggcaatatgggttctgttgcccgtgccatgaaaacaatgggattaaccaatctgtggctggttaatccactagtgaaaccagactcccaggcgattgccctggcagcaggggccagcgatgtgattggtaatgctcacatcgtcgatacgctcgacgaagcgttagccggttgtagtctggtggtgggcaccagcgctcgctcccgcacgctgccgtggccgatgctcgacccgcgcgaatgcggtctgaaaagcgtcgctgaagcggcaaataccccggtggcgctggtgtttggtcgcgagcgcgtcggcttgaccaatgaagagttgcagaaatgccattatcatgtcgcgattgcggctaacccggaatacagttcgctgaacctggcgatggcggttcaggttattgcctatgaagtgcgcatggcctggctggcaactcaggaaaatggcgagcaggtcgagcatgaagagacgccgtatccgctggtcgatgatctggagcgtttttatggtcatctggagcaaacgctgctggcaaccggttttatccgtgaaaaccatccggggcaggtgatgaataaattgcgccgtctgtttacccgtgcacgcccggaaagccaggaattgaatatcctgcgcgggattctggcttctattgagcagcagaataaaggtaacaaggccgaataa

SEQ ID NO: 6156 - protein, 246 aa, Escherichia coli
MLQNIRIVLVETSHTGNMGSVARAMKTMGLTNLWLVNPLVKPDSQAIALAAGASDVIGNAHIVDTLDEALAGCSLVVGTSARSRTLPWPMLDPRECGLKSVAEAANTPVALVFGRERVGLTNEELQKCHYHVAIAANPEYSSLNLAMAVQVIAYEVRMAWLATQENGEQVEHEETPYPLVDDLERFYGHLEQTLLATGFIRENHPGQVMNKLRRLFTRARPESQELNILRGILASIEQQNKGNKAE

SEQ ID NO: 6157 - DNA, 804 bp, Escherichia coli
atgcatccgatgctgaacatcgccgtgcgcgcagcgcgcaaggcgggtaatttaattgccaaaaactatgaaaccccggacgctgtagaagcgagccagaaaggcagtaacgatttcgtgaccaacgtagataaagctgccgaagcggtgattatcgacacgattcgtaaatcttacccacagcacaccatcatcaccgaagaaagcggtgaacttgaaggtactgatcaggatgttcaatgggttatcgatccactggatggcactaccaactttatcaaacgtctgccgcacttcgcggtatctatcgccgttcgtatcaaaggccgcaccgaagttgctgtggtatacgatcctatgcgtaacgaactgttcaccgccactcgcggtcagggcgcacagctgaacggctaccgtctgcgcggcagcaccgctcgcgatctcgacggtactattctggcgaccggcttcccgttcaaagcaaaacagtacgccactacctacatcaacatcgtcggcaaactgttcaacgaatgtgcagacttccgtcgtaccggttctgcggcgctggatctggcttacgtcgctgcgggtcgtgttgacggtttctttgaaatcggtctgcgcccgtgggatttcgcggcaggcgagctgctggttcgtgaagcaggcggcatcgtcagcgacttcaccggtggtcataactatatgctgaccggtaacatcgttgctggtaacccgcgcgttgttaaagccatgctggcgaacatgcgtgacgagttaagcgacgctctgaagcgttaa

SEQ ID NO: 6158 - protein, 267 aa, Escherichia coli
MHPMLNIAVRAARKAGNLIAKNYETPDAVEASQKGSNDFVTNVDKAAEAVIIDTIRKSYPQHTIITEESGELEGTDQDVQWVIDPLDGTTNFIKRLPHFAVSIAVRIKGRTEVAVVYDPMRNELFTATRGQGAQLNGYRLRGSTARDLDGTILATGFPFKAKQYATTYINIVGKLFNECADFRRTGSAALDLAYVAAGRVDGFFEIGLRPWDFAAGELLVREAGGIVSDFTGGHNYMLTGNIVAGNPRVVKAMLANMRDELSDALKR

SEQ ID NO: 6159 - DNA, 855 bp, Escherichia coli
atggcgctgccagtgaacaaacgcgttctcaaaattctgtttattctctttgttgttgccttctgcgtttatttagtgccgcgcgtcgccatcaacttcttctattatcctgacgataaaatatacggtcccgacccctggtcggcggaatccgtcgaatttacggctaaggacggtactcgtctgcaaggctggtttattccttcttcgacgggccctgctgacaacgccatcgcaaccatcattcatgctcacggcaatgccggaaatatgtccgcccactggccgctggtcagttggttacccgagcgtaatttcaacgtttttatgtttgattatcgcgggtttggtaaatcaaaaggcacgccgtcccaggccggattgctggacgatacgcaaagtgccatcaatgtggtgcgccatcgcagtgatgtaaacccacaacggctggtgctgttcgggcagagtattggcggggcgaatattctggatgttattggtcagggtgatcgtgaaggcatacgtgcggtgatcctcgactccacctttgcctcttatgcgaccattgccaaccagatgatccccggcagtggctacttacttgatgagagttacagcggcgaaaattacatcgccagcgtcagcccgatcccgcttttactcattcacggtaaagctgatcacgttatcccatggcagcacagtgaaaagttgtatagcctggcaaaagaaccaaaacggttgatcctaatcccggatggcgaacacattgatgctttttccgatcgtcacggcgatgtttatcgcgaacagatggtggattttattcttagcgcgttgaatccgcagaactaa

SEQ ID NO: 6160 - protein, 284 aa, Escherichia coli
MALPVNKRVLKILFILFVVAFCVYLVPRVAINFFYYPDDKIYGPDPWSAESVEFTAKDGTRLQGWFIPSSTGPADNAIATIIHAHGNAGNMSAHWPLVSWLPERNFNVFMFDYRGFGKSKGTPSQAGLLDDTQSAINVVRHRSDVNPQRLVLFGQSIGGANILDVIGQGDREGIRAVILDSTFASYATIANQMIPGSGYLLDESYSGENYIASVSPIPLLLIHGKADHVIPWQHSEKLYSLAKEPKRLILIPDGEHIDAFSDRHGDVYREQMVDFILSALNPQN

SEQ ID NO: 6161 - DNA, 1140 bp, Escherichia coli
atggttttgcaatccacgcgctggttggcgctcggctatttcacatacttttttagttacggcatttttctacctttctggagcgtctggcttaaagggattggtttaacgccagaaaccatcggcctgttattgggggcgggtctggttgcccgtttcctcgggagtttgctcatcgcgccccgcgtcagcgatccttcccgcctgatttccgccttgcgcgtgctggcactgctgacacttctctttgctgtcgccttctgggcgggggcgcacgtagcgtggctgatgctggtgatgattggctttaacctctttttctcaccgctggtaccgttgaccgatgcactggcgaatacgtggcaaaagcagttcccgcttgattacggcaaagtgagactgtggggctcggtggcgtttgtcattggctcggcgctgacgggcaaactggtcagtatgtttgattatcgggtgatcctcgcgctgttgacgttgggcgtggcatccatgctgctcggctttctcatccgtccgacgattcagccacaaggggcaagccgccagcaggagagcaccggctggtctgcgtggttggcgttggttcgccagaactggcgctttctggcctgcgtttgtttattgcagggggcacatgcggcctattacggttttagcgccatttactggcaggcagctggctactcggcctcggcggtggggtatttgtggtcgctgggcgtggtggcggaagtcattatctttgcgctgagtaataaacttttccgccgttgtagtgcacgcgatatgctgttgatctcggcgatttgcggcgtagtgcgctggggcattatgggagcaactacggcgttgccgtggttgatagtggtgcaaattctgcattgcggtaccttcacggtctgccacctggctgccatgcgctatattgctgctcgccagggtagcgaagtcatccgtttacaggcggtttactctgccgtcgcgatgggcggcagtatcgccatcatgaccgttttcgccggtttcctgtatcaatatctcggccacggcgtgttctgggtgatggcgctggtggcgcttccggcaatgtttttgcgcccgaaagttgttccctcatgctga

SEQ ID NO: 6162 - protein, 379 aa, Escherichia coli
MVLQSTRWLALGYFTYFFSYGIFLPFWSVWLKGIGLTPETIGLLLGAGLVARFLGSLLIAPRVSDPSRLISALRVLALLTLLFAVAFWAGAHVAWLMLVMIGFNLFFSPLVPLTDALANTWQKQFPLDYGKVRLWGSVAFVIGSALTGKLVSMFDYRVILALLTLGVASMLLGFLIRPTIQPQGASRQQESTGWSAWLALVRQNWRFLACVCLLQGAHAAYYGFSAIYWQAAGYSASAVGYLWSLGVVAEVIIFALSNKLFRRCSARDMLLISAICGVVRWGIMGATTALPWLIVVQILHCGTFTVCHLAAMRYIAARQGSEVIRLQAVYSAVAMGGSIAIMTVFAGFLYQYLGHGVFWVMALVALPAMFLRPKVVPSC

SEQ ID NO: 6163 - DNA, 1281 bp, Escherichia coli
atgatgcctacgcttgctccaccatctgtcctttcggctccccagcgccgctgccagatcttgctgacgctctttcagccggggttgaccgccaccacggcaactttcagcgagcttaatggtgtggatgatgatattgccagtcttgatatcagcgaaacaggacgggagatcctgcgctatcatcaactcacactgactactggttatgacggtagctaccgggttgaaggtacagtgcttaaccaacgtttgtgtttatttcactggctacgacgtggtttccgtctgtgtccgttatttattaccagccatttcacccccgccctgaagagtgaactgaagcggcgcggaattgcgcgtaacttttacgacgataccaatctacaagcgttagtgaatctctgctcccgacggctgcaaaaacgctttgaaacgcgcgatattcatttcctgtgtctgtatctgcaatattgtttgctgcaacaccacgctggaattacgcctcagtttaatccgctccaacgtcgctgggcggaatcctgccttgaatttcaggtagcgcaggaaattggacgccactggcagcgtcgggcgctccagcctgtaccgcctgatgagccactgtttatggcattacttttttccatgttgcgggttcccgatccactgcgggatgcgcatcagcgggacaggcaactgcgtaagtctatcaaacgtctggtaaaccactttcgtgagctgggaaatgttcgtttttatgatgaacaggggttatgcgatcagctttatacccacctcgcccaggcgttaaatcgcagtttgtttgccatcggtattgataacaccctgccggaagagttcgcccgcctgtatccacgcctggtgcgcaccacccgcgcggcgctggctggatttgaaagtgaatacggcgtccatctttctgatgaggaaagcggtctggtcgcggtgatttttggtgcctggctaatgcaggaaaacgacctgcatgagaaacagattattctactgaccgggaatgatagcgagcgagaagcgcagattgagcagcagctacgcgaactaacgttactgccgctcaacattaaacatatgtcggtaaaggtatttttgcagacaggcgctccgcgcggcgcggcactgattattgctccttataccatgccgttaccgctcttttcaccaccgctgatctatacggacctgacgctgacaacacatcaacaggagcagatccgcaaaatgctcgaatcagcatga

SEQ ID NO: 6164 - protein, 426 aa, Escherichia coli
MMPTLAPPSVLSAPQRRCQILLTLFQPGLTATTATFSELNGVDDDIASLDISETGREILRYHQLTLTTGYDGSYRVEGTVLNQRLCLFHWLRRGFRLCPLFITSHFTPALKSELKRRGIARNFYDDTNLQALVNLCSRRLQKRFETRDIHFLCLYLQYCLLQHHAGITPQFNPLQRRWAESCLEFQVAQEIGRHWQRRALQPVPPDEPLFMALLFSMLRVPDPLRDAHQRDRQLRKSIKRLVNHFRELGNVRFYDEQGLCDQLYTHLAQALNRSLFAIGIDNTLPEEFARLYPRLVRTTRAALAGFESEYGVHLSDEESGLVAVIFGAWLMQENDLHEKQIILLTGNDSEREAQIEQQLRELTLLPLNIKHMSVKVFLQTGAPRGAALIIAPYTMPLPLFSPPLIYTDLTLTTHQQEQIRKMLESA

SEQ ID NO: 6165 - DNA, 468 bp, Escherichia coli
gtgtgtattacgtttaaatcacatcatcttgcaaagggattggttatgaactcactacgttattttgattttggcactgcccgccccgttttattattaattgcccgtatcgccgtggtcttaattttcattatttttggttttcccaaaatgatgggctttggcggtacggtccaatatatggcctcgctgggcgcaccaatgccgatgctggcagcgattattgcggtagttatggaagtgcccgccgcgatattaatcgtgcttggctttttcacccgtccgctggcggtgctgtttattttctacacgctgggtacggcggtgattggccaccattactgggatatgaccggcgatgcggttgggccaaatatgattaatttctggaagaatgtcagtatcgctggcgcattcctgctgttggcaattaccgggccgggggcgatttctctcgatcggcgttag

SEQ ID NO: 6166 - protein, 155 aa, Escherichia coli
MCITFKSHHLAKGLVMNSLRYFDFGTARPVLLLIARIAVVLIFIIFGFPKMMGFGGTVQYMASLGAPMPMLAAIIAVVMEVPAAILIVLGFFTRPLAVLFIFYTLGTAVIGHHYWDMTGDAVGPNMINFWKNVSIAGAFLLLAITGPGAISLDRR

SEQ ID NO: 6167 - DNA, 873 bp, Escherichia coli
atgaccatctataccttatctcacgggccgctaaagctggacgtttctgatcagggcggcgtaatcgaaggcttctggcgcgatacgacgccgctgctacgtcctggtaaaaaaagcggtgtggcaaccgatgcctcttgttttccgctggtgccgtttgcaaaccgggtgagcggtaatcgttttgtctggcagggacgtgaatatcaactacaaccgaatgttgagtgggatgcgcactatctacacggtgatgcctggctggggcagtggcaatgtgtctcgcgcagcgaagatagcttgtgtctggtgtatgaacatcgcagcggtgtttatcactatcgggtaagtcaggcgtttcatttaacggcagatacgctgacggtgacgctctctgtcaccaataaaggggcagagacgctgccatttggtaccggctggcatccttattttccgttgtcaccacaaacgcggattcaggcgcaggcgagctgttactggcgggagcaggagcagtggctggcgggtgagttttgcgagcagctaccgcaggaactggattttaaccagctcgcgccgttaccgcgccagtgggtaaacaatggttttgccggatggaatggtcaggcccgcatcgagcagccgcaggagggttatgccatcatcatggaaacgacgccgcctgcaccgtgttatttcatctttgtttccgacccggcgtttgataaaggatatgcgtttgatttcttctgtctggaaccgatgagccatgcgccggatgaccatcatcgtccggaaggtggtgacctcattgcgcttgcaccaggggaatcaacaatttcagagatgtcgttgcgggttgcgttgctgtaa

SEQ ID NO: 6168 - protein, 290 aa, Escherichia coli
MTIYTLSHGPLKLDVSDQGGVIEGFWRDTTPLLRPGKKSGVATDASCFPLVPFANRVSGNRFVWQGREYQLQPNVEWDAHYLHGDAWLGQWQCVSRSEDSLCLVYEHRSGVYHYRVSQAFHLTADTLTVTLSVTNKGAETLPFGTGWHPYFPLSPQTRIQAQASCYWREQEQWLAGEFCEQLPQELDFNQLAPLPRQWVNNGFAGWNGQARIEQPQEGYAIIMETTPPAPCYFIFVSDPAFDKGYAFDFFCLEPMSHAPDDHHRPEGGDLIALAPGESTISEMSLRVALL

SEQ ID NO: 6169 - DNA, 1095 bp, Escherichia coli
atgaaaattaatcgtattgttaatgagggatttatgaaaacgatgctggcagcttatttaccaggaaattcgaccgtcgatctgcgggaagttgcggtgccgacgccggggattaaccaggtactgatcaaaatgaaatcctccgggatttgcggaagcgatgtccactatatctaccaccagcaccgcgctacggcggcggcacccgataaaccgttataccagggatttatcaacggtcatgaaccgtgcgggcagattgtggcgatggggcaaggctgtcgccattttaaagagggcgaccgcgtgctggtgtatcacatttccggttgtggcttttgcccgaactgccgtcgcggttttcctatctcctgcaccggtgaaggaaaagccgcttacggctggcagcgtgacggcggccatgctgaatacctgctggcggaagaaaaagatctgatcctcctgccggatgcactgagttacgaagatggtgcgtttatcagttgcggcgttggtacagcgtatgaagggattttgcgcggcgaagtttccggcagtgataacgtactggtggtcggtctggggccggtcggcatgatggcgatgatgctggcgaaaggtcgcggtgcaaaaaggatcatcggcgttgatatgttgccggaacgtctggcgatggcgaaacagttaggagtgatggatcacggctatttagcgaccaccgaaggtctgccgcagataatcgccgaactcactcacggcggcgcggatgttgcgcttgattgttccggtaatgccgcaggtcgcttactggcactgcaatccaccgctgactggggacgcgtggtttacattggtgaaaccggaaaagtcgagttcgaggttagcgctgacctgatgcaccatcaacggcggattatcggctcctgggtgaccagtctgttccatatggaaaaatgcgcccacgatttaacggactggaaactgtggccgcgtaatgccattacccaccgcttctcgctggaacaggcgggagatgcttatgcactgatggcaagcggcaaatgcgggaaagttgtgattaatttcccggattaa

SEQ ID NO: 6170 - protein, 364 aa, Escherichia coli
MKINRIVNEGFMKTMLAAYLPGNSTVDLREVAVPTPGINQVLIKMKSSGICGSDVHYIYHQHRATAAAPDKPLYQGFINGHEPCGQIVAMGQGCRHFKEGDRVLVYHISGCGFCPNCRRGFPISCTGEGKAAYGWQRDGGHAEYLLAEEKDLILLPDALSYEDGAFISCGVGTAYEGILRGEVSGSDNVLVVGLGPVGMMAMMLAKGRGAKRIIGVDMLPERLAMAKQLGVMDHGYLATTEGLPQIIAELTHGGADVALDCSGNAAGRLLALQSTADWGRVVYIGETGKVEFEVSADLMHHQRRIIGSWVTSLFHMEKCAHDLTDWKLWPRNAITHRFSLEQAGDAYALMASGKCGKVVINFPD

SEQ ID NO: 6171 - DNA, 999 bp, Escherichia coli
atgtctgcttcgtcattaccattgccgcagggcaagagcgtctcgctcaaacaatttgtcagtcgccatattaatgagatcggtttgctggtggtgattgccattctttatctggtcttctccctgaatgcgcctggctttatctcattgaataaccagatgaacgtgctgcgcgatgccgccaccattgggatcgccgcctgggcgatgacgctgattattatctccggtgaaattgatgtcagcgttgggccgatggtggcttttgtttcagtgtgcctggcgtttttgctgcaatttgacgttccgctggcgattgcttgtctgctggtgttgctgttaggtgcgctgatgggaacgctcgccggggtgctgcgcggcgtgtttaacgtgccaagttttgttgccacgctgggtttatggagcgccctgcgcggaatggggctgtttatgacgaacgccttgccagtgccaattaacgaaaacgaagtgctggactggctgggcggacaatttctcggggtgccggtatccgcgctgatcatgatggtgttatttgcgctgtttgtgttcattagccgcaaaaccgccttcgggcgctcggtttttgctgttggcggtaatgccactgcagcgcagttgtgcggtattaacgttcgtcgggtacgcattcttatttttaccctttcgggattattagcggcggtgaccggcattttgttggcggcgcgcctcggttccggtaacgcaggtgccgcaaacggtctggagtttgacgtcatcgccgcggtcgttgtcggcggtacggcgctttccggcggtcgcggctcgttgttcggtacgctgcttggcgtactggtgattacgctaatcggtaacggtctggtgctgctcgggattaactcctttttccagcaggtggtgcgcggcgtcatcatcgtggtggcggtgctggcgaatatcttgctgacccagcgtagcagtaaagcgaaacgctaa

SEQ ID NO: 6172 - protein, 332 aa, Escherichia coli
MSASSLPLPQGKSVSLKQFVSRHINEIGLLVVIAILYLVFSLNAPGFISLNNQMNVLRDAATIGIAAWAMTLIIISGEIDVSVGPMVAFVSVCLAFLLQFDVPLAIACLLVLLLGALMGTLAGVLRGVFNVPSFVATLGLWSALRGMGLFMTNALPVPINENEVLDWLGGQFLGVPVSALIMMVLFALFVFISRKTAFGRSVFAVGGNATAAQLCGINVRRVRILIFTLSGLLAAVTGILLAARLGSGNAGAANGLEFDVIAAVVVGGTALSGGRGSLFGTLLGVLVITLIGNGLVLLGINSFFQQVVRGVIIVVAVLANILLTQRSSKAKR

SEQ ID NO: 6173 - DNA, 1512 bp, Escherichia coli
atgttcacggcaacagaggcagtcccggtagcaaaagtggtggcaggaaataagcgttaccccggcgtcgttgcgctggataacgttaacttcacgctcaataaaggcgaagttcgcgcgctgttaggcaaaaacggtgcgggaaaatcgaccctcattcgaatgctgaccggtagcgaacgtccggatagcggtgatatctggattggcgagacgcgactggaaggtgacgaagctacgctgactcgccgtgccgctgaactgggggttcgtgcggtttatcaggagttaagtctggtggaagggctgacagtggcggaaaacctctgcctcggtcagtggccccgccgcaacggcatgattgattacctgcaaatggcgcaggacgcccaacgttgcttgcaggcgttgggcgttgacgttagtcctgaacaacttgtttcaacactaagcccggcgcaaaagcaactggtggaaattgcgcgggtgatgaagggcgagccgcgcgtggtcattcttgatgaacccaccagctcgcttgccagtgcggaagttgaactggtgatcagcgcggtgaaaaagatgtcggcactgggcgtggcggtgatttatgtcagccaccggatggaagaaattcgccgcattgcctcctgtgccaccgttatgcgcgatggtcaggtggcgggcgatgtgatgctcgaaaacacctctacgcatcatattgtgtcgctaatgctcgggcgcgatcacgttgatattgcgccggttgcccctcaggaaattatggatcaagccgtgctggaagtccgtgcgttacgccataagcccaagctggaggatatcagttttacgctacgttgtggcgaagtgctcggcattgctggtctgctgggggcagggcgcagtgaattgctgaaggcgattgttgggctggagacgtatgaacagggcgaaattgttatcaacggcgagaaaatcacgcgccccgattacggcgacatgctgaaacgcggcattggctatacgccagaaaaccgcaaagaagcggggatcattccctggttgggcgttgacgaaaatacagtgctgaccaatcggcaaaaaatcagcgccaacggtgtgctgcaatggtccaccatccgccgcctgaccgaagaggtgatgcagcggatgacggtcaaggccgccagtagcgaaacgcccatcggcacgctttctggcggcaatcagcaaaaagtggtgatcggtcgttgggtctatgccgccagccagattttgttgctcgacgagccaacgcgcggcgtcgatatcgaagccaaacagcagatttaccgtattgtccgcgagctggctgccgaaggaaaaagcgtggtgtttatctccagtgaagtggaggagttaccgttggtgtgcgaccgcattctgttgttacagcacggtacgttctcgcaggagtttcactctccggtcaatgtggatgagctgatgtccgccattctgtctgtgcactga

SEQ ID NO: 6174 - protein, 503 aa, Escherichia coli
MFTATEAVPVAKVVAGNKRYPGVVALDNVNFTLNKGEVRALLGKNGAGKSTLIRMLTGSERPDSGDIWIGETRLEGDEATLTRRAAELGVRAVYQELSLVEGLTVAENLCLGQWPRRNGMIDYLQMAQDAQRCLQALGVDVSPEQLVSTLSPAQKQLVEIARVMKGEPRVVILDEPTSSLASAEVELVISAVKKMSALGVAVIYVSHRMEEIRRIASCATVMRDGQVAGDVMLENTSTHHIVSLMLGRDHVDIAPVAPQEIMDQAVLEVRALRHKPKLEDISFTLRCGEVLGIAGLLGAGRSELLKAIVGLETYEQGEIVINGEKITRPDYGDMLKRGIGYTPENRKEAGIIPWLGVDENTVLTNRQKISANGVLQWSTIRRLTEEVMQRMTVKAASSETPIGTLSGGNQQKVVIGRWVYAASQILLLDEPTRGVDIEAKQQIYRIVRELAAEGKSVVFISSEVEELPLVCDRILLLQHGTFSQEFHSPVNVDELMSAILSVH

SEQ ID NO: 6175 - DNA, 984 bp, Escherichia coli
atgcctaaaaaaatgacaagaacccgtaatttattattaatggctacgctattgggtagcgcactatttgccagggcttctgataaagaaatgactattggcgcaatataccttgatacccagggatattacgccggagtgcgtcagggcgttcaggatgcggcaaaagattcttcagtacaggtacaattaattgaaactaacgctcagggcgatatttcgaaagaaagtacctttgttgataccctcgtggagcgtaatgtcgatgccattattttatcggcagtgtctgaaaatggcagtagccgtaccgttcgtcgcgccagtgaagcgggtattccggtgatttgctacaacacctgtattaatcaaaagggtgtcgataaatatgtctcggcatatctggttggtgacccgctggaatttggtaaaaaactgggtaacgcagccgccgattattttattgccaacaaaattgaccagccgaaaattgccgtcatcaattgcgaagcctttgaagtttgtgtgcaacgtcgtaaagggtttgaagaagtattaaaaacccgcgttcccggcgcgcaaattgtcgctaatcaggaagggactgttttagataaagcgatttctgtcggtgaaaaactgattatctccacgccggatctcaacgccattatgggggaatcgggcggagcgacactcggcgcggtaaaagcggtacgtaatcaaaatcaggccggaaaaattgctgttttcggttctgatatgaccactgaaattgctcaggagctggaaaacaaccaggtgctgaaagcggtggtggatatttccggtaagaaaatgggcaatgctgttttcgcgcaaacattgaaggttatcaataaacaagccgacggtgaaaaagtgattcaggtgccaatcgatctctataccaaaacggaagacggtaaacagtggctggcaacgcacgttgatggtctgccctaa

SEQ ID NO: 6176 - protein, 327 aa, Escherichia coli
MPKKMTRTRNLLLMATLLGSALFARASDKEMTIGAIYLDTQGYYAGVRQGVQDAAKDSSVQVQLIETNAQGDISKESTFVDTLVERNVDAIILSAVSENGSSRTVRRASEAGIPVICYNTCINQKGVDKYVSAYLVGDPLEFGKKLGNAAADYFIANKIDQPKIAVINCEAFEVCVQRRKGFEEVLKTRVPGAQIVANQEGTVLDKAISVGEKLIISTPDLNAIMGESGGATLGAVKAVRNQNQAGKIAVFGSDMTTEIAQELENNQVLKAVVDISGKKMGNAVFAQTLKVINKQADGEKVIQVPIDLYTKTEDGKQWLATHVDGLP

SEQ ID NO: 6177 - DNA, 3375 bp, Escherichia coli
ttgcgtgattattccgcgaaaacattgccagattgttcaatacactgccacaaatcttttaattcagtatgtcttgttaatattgagggcaccatgactccagtaaaagtgtggcaagagcgcgttgagatcccgacctatgaaaccgggccgcaggatatacatcccatgttcctggaaaatcgcgtttatcagggatcgtccggcgcggtttatccctacggcgtgaccgatacgctgagcgagcagaaaaccctgaaatcctggcaggcggtgtggctggaaaacgactacatcaaagtgatgatcctgccggaactgggcggtcgggtgcatcgcgcgtgggataaagtgaaacagcgcgattttgtttatcacaatgaagtcattaaaccggcgctggtgggactgctggggccgtggatctccggcgggattgagtttaactggccgcaacaccatcgcccgaccacctttatgcccgttgatttcaccctcgaagcccatgacgacggcgcacagacggtgtgggtcggcgaaacggagccgatgcacggtttacaggtgatgacaggtttcaccctgcgccctgaccgggcggcgctggaaatcgccagtcgcgtctataacggcaacgccacgccgcgtcatttcttgtggtgggccaacccggcagtgaaagggggtgaagggcatcagagcgttttcccaccggatgtgactgcggtgtttgatcacggtaaacgggccgtctccgctttccccatcgccaccggcacttactacaaagtggactactccgccggagtggacatttctcgctataaaaatgtgcccgttccaacctcatatatggctgaaaaatcacagtacgattttgttggcgcgtggtgtcacgatgaagatggtggtttgctacacgttgccaaccaccatattgcgccaggtaaaaaacagtggagctggggacacagtgaatttggccaggcgtgggataagagcctgactgacaataacggcccgtatatcgaactgatgaccggtatttttgccgataaccagcctgattttacctggcttgatgcttacgaggagaagcgtttcgagcagtatttcctgccttatcattctctgggcatggtgcaaaatgcctcccgcgatgcggtgataaaactccagcgtagtgagcgggggattgagtgggggctgtatgccatctctccgttgaacggataccgcctggcgatccgcgaaatcggcaaatgcaacgcgttgctcgatgatgccgtggccctgacaccagcgaccgccatccagggcgtgttgcacggtatcaatcctgaaaggctgaccattgagctctccgatgccgacggcaatattgtactgagttatcatgaacatcagtcgcaagcgttgccgttgccggacgtcgccaaagcgccactggcagcacaagacattaccagtacagatgaagcctggtttatcggtcaacatctggagcaatatcatcacgcgagccgttcaccgttcgattactacctgcgcggcgtggcgctggatccgctggattatcgctgtaacctggcgctggcgatgctggaatataaccgtgccgatttcccgcaagcggtggcgtatgccactcaggcgctgaaacgcgcacatgcgctgaacaaaaatccgcagtgcggacaggcgagtttgattcgcgccagtgcttacgaacgtcaggggcaatatcaacaagccgaagaggatttctggcgtgcggtctggagcggcaacagtaaagcaggcggctattatggtctggcacggctggcggcgcgtaatggtaactttgacgctggtctggatttttgccaacaaagtcttcgcgcctgcccaaccaatcaggaagtgctttgcctgcataacctgctactggtgttaagtggtcgtcaggacaacgcgcgtttgcagcgcgagaaactgctgcgtgattatccgctgaacgctactctgtggtggctgaactggttcgatggtcgtagcgaatctgccctcgtacagtggcgaggtctttgtcagggacgcgacgttaacgccctgatgaccgccgggcaactgattaactggggcatgcccgccctggcggcagatatgctgaacgcactggactgtcagcgcacgctaccgctttacctgcaagccagtttgctaccaaaagctgaacgcggagaactggtcgtaaaagctattgatgccttcccgcagtttgtccgtttcccgaatacgctggaagaagtggcggcgctggagagtatcgaagagtgctggtttgcccggcatttactggcctgcttctactacaacaagcgtagctacggtaaagccattgccttatggcagcgttgcgtagagatgtcgccggagtttgccgacggctggcgcgggttggcgatccatgcgtggaataagcagcacgattatgagctggccgcgcgttatcttgataatgcttatcagcttgcgccgcaggatgcacgtctgcttttcgaacgggatttgctggataagttaagcggtgtcacaccggagaaacgactggcgcgtctggaaaataatctggaaattgcgctgaaacgcgacgacatgaccgcagaactgctcaatttgtggcatctcactggtcaggcagacaaagcggcggacattctcgccacgcgcaaattccacccgtgggaaggtggggaagggaaggtcaccagccagtttatcctcaaccagttattacgcgcctggcagcatcttgatgccagagagccgcagcaggccagcgaactgcttcatgccgcgctgcattatccggagaatttaagcgaaggccgtttaccggggcaaactgacaacgacatctggttctggcaggcagtatgcgccaacgcgcagggcgatgaaactgaagcgatgcgttgtttacgtctggcggcgaccggcgatcgcaccattaacatccacagttattacaacgatcagccggttgattatctcttctggcaaggaatggcgctgcgactgctgggcgaacaacacaccgcacagcaactgtttagtgaaatgaaacagtgggcgaaagagatggcgaaaaccagtatcgaagcggatttctttgccgtctcgcagcctgacttgttgtcgctgtatagcgatttacaacagcagcataaagaaaaatgcctgatggtggcgatgctggcggccgcgggattaggggaggttgcgcactatgaatctgctcgcgctgaattgatggcgattaatccagcctggccgaaagcggcattattcaccaccgtgatgccttttatttttagctacgttcactaa

SEQ ID NO: 6178 - protein, 1124 aa, Escherichia coli
MRDYSAKTLPDCSIHCHKSFNSVCLVNIEGTMTPVKVWQERVEIPTYETGPQDIHPMFLENRVYQGSSGAVYPYGVTDTLSEQKTLKSWQAVWLENDYIKVMILPELGGRVHRAWDKVKQRDFVYHNEVIKPALVGLLGPWISGGIEFNWPQHHRPTTFMPVDFTLEAHDDGAQTVWVGETEPMHGLQVMTGFTLRPDRAALEIASRVYNGNATPRHFLWWANPAVKGGEGHQSVFPPDVTAVFDHGKRAVSAFPIATGTYYKVDYSAGVDISRYKNVPVPTSYMAEKSQYDFVGAWCHDEDGGLLHVANHHIAPGKKQWSWGHSEFGQAWDKSLTDNNGPYIELMTGIFADNQPDFTWLDAYEEKRFEQYFLPYHSLGMVQNASRDAVIKLQRSERGIEWGLYAISPLNGYRLAIREIGKCNALLDDAVALTPATAIQGVLHGINPERLTIELSDADGNIVLSYHEHQSQALPLPDVAKAPLAAQDITSTDEAWFIGQHLEQYHHASRSPFDYYLRGVALDPLDYRCNLALAMLEYNRADFPQAVAYATQALKRAHALNKNPQCGQASLIRASAYERQGQYQQAEEDFWRAVWSGNSKAGGYYGLARLAARNGNFDAGLDFCQQSLRACPTNQEVLCLHNLLLVLSGRQDNARLQREKLLRDYPLNATLWWLNWFDGRSESALVQWRGLCQGRDVNALMTAGQLINWGMPALAADMLNALDCQRTLPLYLQASLLPKAERGELVVKAIDAFPQFVRFPNTLEEVAALESIEECWFARHLLACFYYNKRSYGKAIALWQRCVEMSPEFADGWRGLAIHAWNKQHDYELAARYLDNAYQLAPQDARLLFERDLLDKLSGVTPEKRLARLENNLEIALKRDDMTAELLNLWHLTGQADKAADILATRKFHPWEGGEGKVTSQFILNQLLRAWQHLDAREPQQASELLHAALHYPENLSEGRLPGQTDNDIWFWQAVCANAQGDETEAMRCLRLAATGDRTINIHSYYNDQPVDYLFWQGMALRLLGEQHTAQQLFSEMKQWAKEMAKTSIEADFFAVSQPDLLSLYSDLQQQHKEKCLMVAMLAAAGLGEVAHYESARAELMAINPAWPKAALFTTVMPFIFSYVH

SEQ ID NO: 6179 - DNA, 1194 bp, Escherichia coli
atgagagcctgcattaacaatcaacagattcgccaccataacaaatgcgtgattctggaactgctgtaccggcaaaagcgcgccaataaatcaacgctggcccggctggcgcaaatttcgattccggcggtcagtaatattttgcaggaactggaaagcgaaaaacgggtggtgaatatcgacgatgaaagccagacgcgcgggcatagtagcggtacatggctgattgcgccggaaggagactggacgctgtgcctgaacgtgacgcccaccagcattgagtgtcaggtcgctaatgcctgtttaagtccgaaaggcgaatttgagtatttacagattgatgcaccgacgccgcaggcgctgctgtccgaaatcgaaaaatgctggcatcgccaccgtaaattgtggccggaccgcaccatcaatctggctctggcaatccacggtcaggttgatccagtgaccggcgtgtcgcaaaccatgccgcaagcgccgtgggcaacaccgattgaggtgaagtacctgctggaagagaagctgggcattcgggtaatggtcgataatgactgcgtgatgctggcgctggcggagaaatggcaaaataattcacaagtgcgtgatttctgcgtaatcaacgttgattacggcattggctcgtcgttcgtgattaacgagcaaatttatcgcggcagtttgtatggcagtggacagattggtcacaccatcgttaatccggatggcgtcgtctgcgactgcgggcgttatggctgcctggaaaccgtcgcctcgttaagcgcattaaaaaaacaggcgcgggtatggctaaaatcacaaccggttaatactcagcttgatcctgaaaaattgactaccgcgcagttaatcgctgcctggcagagtggagaaccgtggatcaccagttgggttgaccacagtgccaacgccattggtttgagtctgtataacttcctcaacatcctcaatattaatcagatttggttgtacggtcgcagttgtgcctttggtgagaactggcttaataccattattcgccagacgggatttaacccgttcgaccgcgacgaaggaccgagcgtgaaagcgacacagattggctttgggcaattaagccgcgcacaacaggtactgggaattggctatttgtatgttgaggcgcagttacggcagatttga

SEQ ID NO: 6180 - protein, 397 aa, Escherichia coli
MRACINNQQIRHHNKCVILELLYRQKRANKSTLARLAQISIPAVSNILQELESEKRVVNIDDESQTRGHSSGTWLIAPEGDWTLCLNVTPTSIECQVANACLSPKGEFEYLQIDAPTPQALLSEIEKCWHRHRKLWPDRTINLALAIHGQVDPVTGVSQTMPQAPWATPIEVKYLLEEKLGIRVMVDNDCVMLALAEKWQNNSQVRDFCVINVDYGIGSSFVINEQIYRGSLYGSGQIGHTIVNPDGVVCDCGRYGCLETVASLSALKKQARVWLKSQPVNTQLDPEKLTTAQLIAAWQSGEPWITSWVDHSANAIGLSLYNFLNILNINQIWLYGRSCAFGENWLNTIIRQTGFNPFDRDEGPSVKATQIGFGQLSRAQQVLGIGYLYVEAQLRQI

SEQ ID NO: 6181 - DNA, 1254 bp, Escherichia coli
atgttaaagcgtgaaatgaacattgccgattatgatgccgaactgtggcaggctatggagcaggaaaaagtacgtcaggaagagcacatcgaactgatcgcctccgaaaactacaccagcccgcgcgtaatgcaggcgcagggttctcagctgaccaacaaatatgctgaaggttatccgggcaaacgctactacggcggttgcgagtatgttgatatcgttgaacaactggcgatcgatcgtgcgaaagaactgttcggcgctgactacgctaacgtccagccgcactccggctcccaggctaactttgcggtctacaccgcgttgctggaaccaggcgataccgttctgggtatgaatctggcgcatggcggtcacctgactcacggttctccggttaacttctccggtaaactgtacaacatcgttccttacggtatcgatgctaccggtcatatcgactacgccgatctggaaaaacaagccaaagaacacaaaccgaaaatgattatcggtggcttctctgcatattccggcgtggtggactgggcgaaaatgcgtgaaatcgctgacagcatcggtgcttacctgttcgttgatatggcgcacgttgcgggcctggttgccgctggtgtctaccctaacccggttcctcatgctcacgttgttactaccaccactcacaaaaccctggcgggtccgcgcggcggcctgatcctggcgaaaggtggtagcgaagagctgtacaaaaaactgaactctgccgttttccctggtggtcagggcggtccgttgatgcacgtaatcgccggtaaagcggttgctctgaaagaagcaatggaacctgagttcaaaacttaccagcagcaggtcgcgaaaaacgccaaagcgatggtagaagtgttcctcgaacgtggctacaaagtggtttctggtggtactgataaccacctgttcctggttgatctggttgataaaaacctgaccggtaaagaagcagacgccgctctgggccgtgctaacatcaccgtgaacaaaaacagcgtaccgaacgatccgaagagcccgtttgtgacttccggtattcgtgtaggtactccggcgattacccgtcgtggctttaaagaagccgaagcgaaagaactggctggctggatgtgtgacgtgctggacagcatcaatgatgaagccgttatcgagcgcatcaaaggtaaagttctcgacatctgcgcacgttacccggtttacgcataa

SEQ ID NO: 6182 - protein, 417 aa, Escherichia coli
MLKREMNIADYDAELWQAMEQEKVRQEEHIELIASENYTSPRVMQAQGSQLTNKYAEGYPGKRYYGGCEYVDIVEQLAIDRAKELFGADYANVQPHSGSQANFAVYTALLEPGDTVLGMNLAHGGHLTHGSPVNFSGKLYNIVPYGIDATGHIDYADLEKQAKEHKPKMIIGGFSAYSGVVDWAKMREIADSIGAYLFVDMAHVAGLVAAGVYPNPVPHAHVVTTTTHKTLAGPRGGLILAKGGSEELYKKLNSAVFPGGQGGPLMHVIAGKAVALKEAMEPEFKTYQQQVAKNAKAMVEVFLERGYKVVSGGTDNHLFLVDLVDKNLTGKEADAALGRANITVNKNSVPNDPKSPFVTSGIRVGTPAITRRGFKEAEAKELAGWMCDVLDSINDEAVIERIKGKVLDICARYPVYA

SEQ ID NO: 6183 - DNA, 1191 bp, Escherichia coli
atgcttgacgctcaaaccatcgctacagtaaaagccaccatccctttactggtggaaacgggaccaaagttaaccgcccatttctacgaccgtatgtttactcataacccagaactcaaagaaatttttaacatgagtaaccagcgtaatggcgatcaacgtgaagccctgtttaacgctattgccgcctacgccagcaatattgaaaacctgcctgcgctgctgccagcggtagaaaaaatcgcgcagaagcacaccagtttccagatcaaaccggaacagtacaacatcgtcggtgaacacctgttggcaacgctggacgaaatgttcagcccggggcaggaagtgctggacgcgtggggtaaagcctatggcgtcctggctaatgtatttatcaatcgcgaggcggaaatctataacgaaaacgccagcaaagccggtggttgggaaggtactcgcgatttccgcattgtggctaaaacaccacgcagcgcacttatcaccagcttcgaactggagccggtcgacggtggcgcagtggcagaataccgtccggggcaatatctcggcgtctggctgaagccggaaggtttcccgcatcaggaaattcgtcagtactctttgactcgcaaaccggatggcaaaggctatcgtattgcggtgaaacgcgaagagggtgggcaggtatccaactggctgcacaatcacgccaatgttggcgatgtcgtgaaactggtcgctccggcaggtgatttctttatggctgtcgcagatgacacaccagtgacgttaatctctgccggtgtcggtcaaacgccaatgctggcaatgctcgacacgctggcaaaagcaggccacacagcacaagtgaactggttccatgcggcagaaaatggcgatgttcacgcctttgccgatgaagttaaggaactgggtcaatcactgccacgctttaccgcacacacctggtatcgtcagccgaatgaagccgatcgcgctaaaggtcagtttgatagcgaaggtctgatggatttgagcaaactggaaggtgcgttcagcgatccgacaatgcagttctatctctgcggcccggttggcttcatgcagtttgccgcgaaacagttagtggatctgggcgtgaaacaggaaaacattcattacgaatgctttggcccgcataaggtgctgtga

SEQ ID NO: 6184 - protein, 396 aa, Escherichia coli
MLDAQTIATVKATIPLLVETGPKLTAHFYDRMFTHNPELKEIFNMSNQRNGDQREALFNAIAAYASNIENLPALLPAVEKIAQKHTSFQIKPEQYNIVGEHLLATLDEMFSPGQEVLDAWGKAYGVLANVFINREAEIYNENASKAGGWEGTRDFRIVAKTPRSALITSFELEPVDGGAVAEYRPGQYLGVWLKPEGFPHQEIRQYSLTRKPDGKGYRIAVKREEGGQVSNWLHNHANVGDVVKLVAPAGDFFMAVADDTPVTLISAGVGQTPMLAMLDTLAKAGHTAQVNWFHAAENGDVHAFADEVKELGQSLPRFTAHTWYRQPNEADRAKGQFDSEGLMDLSKLEGAFSDPTMQFYLCGPVGFMQFAAKQLVDLGVKQENIHYECFGPHKVL

SEQ ID NO: 6185 - DNA, 339 bp, Escherichia coli
atgaaaaagattgatgcgattattaaacccttcaagctggacgatgtccgcgaagcactggctgaagtcggtattaccggcatgacggtcactgaggtgaaaggttttggccgccagaaaggccataccgagctgtaccgcggtgcggagtatatggtggattttctgccgaaagtgaaaattgagattgtcgtaccggacgacattgtcgatacctgtgtcgataccattattcgcacggcgcaaactggcaaaatcggtgacggtaaaatcttcgtcttcgacgtggcacgggtcattcgcatccgtaccggtgaagaggacgacgcggcaatttaa

SEQ ID NO: 6186 - protein, 112 aa, Escherichia coli
MKKIDAIIKPFKLDDVREALAEVGITGMTVTEVKGFGRQKGHTELYRGAEYMVDFLPKVKIEIVVPDDIVDTCVDTIIRTAQTGKIGDGKIFVFDVARVIRIRTGEEDDAAI

SEQ ID NO: 6187 - DNA, 1374 bp, Escherichia coli
gtgaaaagcccgcgccatccaccgatgaggtcactcctgatgagccataaacctgcgcatttattactggtcgatgatgatccgggattgctgaaactgcttggcctgcgcctgaccagcgaaggctacagcgtggtcacggcggaaagtggcgttgaaggattacgggtactgaatcgcgaaaaagtagatttagtcatcagcgacctgcggatggatgaaatggatggtatgcagctatttgctgaaattcagaaagtgcagccgggaatgccagtaattattcttaccgcgcatggttctattcctgatgccgttgctgcaacacagcagggcgtgttcagttttctcaccaagcctgtcgataaagatgcgctatatcaggtaattgacgatgcgctggaacaatccgcgccagccaccgacgaacgttggcgcgaggcgattgtcacccgcagcccgctgatgctgcgcttgctggaacaggcgcggctggtggcacaatcagacgttagcgttttgattaacggccagagcggcaccgggaaagagattttcgcccaggctatccacaacgccagcccgcgcaacagcaagccatttattgctattaactgtggcgcattacccgagcaattgctggagtcggagctgtttggtcatgcacgtggcgcgtttactggcgctgtcagcaatcgcgaaggtttattccaggcggcggaaggcggtacgctatttctcgatgagattggcgatatgcccgcaccgttgcaggtcaaactgctgcgcgtgttgcaggagcgtaaagtgcgcccgctgggcagtaaccgcgatattgatatcgacgtgcggattatttctgcgacccaccgcgacctgccaaaagcgatgacgcgcggggaattccgtgaagacctctattaccgcctcaacgttgtcagcctgaaaattccggcactggcggagcgcacagaagacattccgctactggcaaatcacctgttgcgccaggcggcagagcgacataaaccgtttgtccgcgcgttctccaccgatgcaatgaaacgcctgatgactgcgagctggccgggcaacgtgcgccagttggtcaacgtgattgaacagtgcgtggcgctgacatcatctccggtaattagtgatgcgctggtggagcaggcgctggagggcgaaaacacggcgctgccaacctttgttgaggcgcgtaatcagtttgaactcaactatttgcgtaagctgctgcaaatcaccaaaggcaacgtcacccacgcggcgagaatggcggggcgcaaccggacagaattttataaactgctttcccgacacgaactggatgcaaacgatttcaaggaatga

SEQ ID NO: 6188 - protein, 457 aa, Escherichia coli
MKSPRHPPMRSLLMSHKPAHLLLVDDDPGLLKLLGLRLTSEGYSVVTAESGVEGLRVLNREKVDLVISDLRMDEMDGMQLFAEIQKVQPGMPVIILTAHGSIPDAVAATQQGVFSFLTKPVDKDALYQVIDDALEQSAPATDERWREAIVTRSPLMLRLLEQARLVAQSDVSVLINGQSGTGKEIFAQAIHNASPRNSKPFIAINCGALPEQLLESELFGHARGAFTGAVSNREGLFQAAEGGTLFLDEIGDMPAPLQVKLLRVLQERKVRPLGSNRDIDIDVRIISATHRDLPKAMTRGEFREDLYYRLNVVSLKIPALAERTEDIPLLANHLLRQAAERHKPFVRAFSTDAMKRLMTASWPGNVRQLVNVIEQCVALTSSPVISDALVEQALEGENTALPTFVEARNQFELNYLRKLLQITKGNVTHAARMAGRNRTEFYKLLSRHELDANDFKE

SEQ ID NO: 6189 - DNA, 720 bp, Escherichia coli
gtgaatatgcgacacatttttcaacgattattgccccgacggctgtggctggcagggctgccatgtctggcattgctgggttgcgtgcagagtcacaataagccagccattgatacgccagcagaagaaaaaattccggtttatcaactggctgactatctttctactgaatgtagcgacatctgggcgctgcaaggtaaatcaaccgaaaccaatccgctttactggctgcgggcgatggattgtgctgatcgtttaatgcctgcgcagtcgcgtcagcaagcccgccaatatgacgacggcaactggcaaaatacctttaaacaagggattttgctcgccgacgccaaaattacgccgtatgagcgccgccagctggtcgcgcgcattgatgcgctaagtaccgagatcccggcacaggttcgcccactgtatcaactctggcgcgacggtcaggcgctgcaactgcaactggcggaagagcgccaacgctacagcaaactccagcagtccagcgacagcgagctggatactttgcgccagcaacatcacgttctacaacagcaactggaactcactacccgcaagctggaaaacctgaccgatattgaacgccagctctcgacccgcaaaccggctggaaatttctcgccggatacgccgcacgagagtgaaaagcccgcgccatccaccgatgaggtcactcctgatgagccataa

SEQ ID NO: 6190 - protein, 239 aa, Escherichia coli
MNMRHIFQRLLPRRLWLAGLPCLALLGCVQSHNKPAIDTPAEEKIPVYQLADYLSTECSDIWALQGKSTETNPLYWLRAMDCADRLMPAQSRQQARQYDDGNWQNTFKQGILLADAKITPYERRQLVARIDALSTEIPAQVRPLYQLWRDGQALQLQLAEERQRYSKLQQSSDSELDTLRQQHHVLQQQLELTTRKLENLTDIERQLSTRKPAGNFSPDTPHESEKPAPSTDEVTPDEP

SEQ ID NO: 6191 - DNA, 1491 bp, Escherichia coli
ttgttgtatctgaacttcccctcggttagcatcaggctattcgcgtctgacgagagtaacgccttgaaccgctggcccgtttttccccgctcattacgacaactggtaatgctggcatttttgctgattctgctgcccctgttggtgctggcatggcaagcctggcaaagcctgaatgcacttagcgatcaggcggcgctggttaaccgcactacgcttattgatgcccggcgcagtgaagcgatgaccaacgcggcactggagatggagcgcagctaccgtcagtactgcgtgctggacgaccctacgcttgcgaaggtttatcaaagccagcgcaagcgttacagcgaaatgctcgatgcccacgcaggcgtgctgccggacgataaactctaccaggcattacgtcaggatttgaataatctggctcaacttcagtgtaacaacagcggtcccgatgctgctgccgccgcgcgtctggaagcctttgccagtgccaataccgaaatggtgcaggccacgcgcacagtggtgttctctcgtgggcagcaacttcagcgtgaaatcgccgaacgtgggcaatattttggttggcaatcgctggtgctatttctggtgagtctggtgatggtactgcttttcacgaggatgattatcggtccggtgaaaaatatcgagcgcatgatcaaccggctgggggaagggcgttctctgggcaatagcgtctcgttcagtggaccgagcgagttacgctcggttgggcaacgtattctttggttaagtgagcgcctgtcatggctggaatcccaacgccatcaatttttaagacatttatctcatgaattaaaaacgccactggcgagtatgcgcgagggcactgaattactggctgatcaggttgtcgggccgcttacgccagagcaaaaagaggtggtgagcattcttgatagcagcagccgcaatttgcaaaagctgatcgaacaactgcttgattacaaccgtaaacaggcggacagtgcggtggaactggagaatgttgagttagcaccgctggtggagacagtggtttctgctcatagcctgcccgcacgggctaaaatgatgcataccgacgttgatctcaaagcaacagcttgcctggcggagccaatgctgctgatgagcgtactggataatctttactccaatgcggtgcactacggggctgaatccggtaacatttgccttcgcagcagtttacatggtgcgcgggtttatattgatgtcatcaatacaggcacgcccattccgcaagaggaacgcgccatgatcttcgaacccttttttcagggaagccaccagcgaaaaggggcggtgaagggcagcggtctgggattaagcattgccagggattgtattcgccgtatgcaaggggaactgtatctggtcgacgagagcgggcaagacgtttgtttccgcattgaattaccgtcgtcgaaaaacacgaaataa

SEQ ID NO: 6192 - protein, 496 aa, Escherichia coli
MLYLNFPSVSIRLFASDESNALNRWPVFPRSLRQLVMLAFLLILLPLLVLAWQAWQSLNALSDQAALVNRTTLIDARRSEAMTNAALEMERSYRQYCVLDDPTLAKVYQSQRKRYSEMLDAHAGVLPDDKLYQALRQDLNNLAQLQCNNSGPDAAAAARLEAFASANTEMVQATRTVVFSRGQQLQREIAERGQYFGWQSLVLFLVSLVMVLLFTRMIIGPVKNIERMINRLGEGRSLGNSVSFSGPSELRSVGQRILWLSERLSWLESQRHQFLRHLSHELKTPLASMREGTELLADQVVGPLTPEQKEVVSILDSSSRNLQKLIEQLLDYNRKQADSAVELENVELAPLVETVVSAHSLPARAKMMHTDVDLKATACLAEPMLLMSVLDNLYSNAVHYGAESGNICLRSSLHGARVYIDVINTGTPIPQEERAMIFEPFFQGSHQRKGAVKGSGLGLSIARDCIRRMQGELYLVDESGQDVCFRIELPSSKNTK

SEQ ID NO: 6193 - DNA, 3999 bp, Escherichia coli
atggtgattttatttccacgcaaacggtttcgtcagcgcatcagattctttataatgacgcccgtttcccccccccttgggtacaccgaaagcttagaagacgagagacttatgatggaaattctgcgtggttcgcctgcattgtcggcattccgaatcaacaaactgctggcacgttttcaggctgccaggctcctggttcacactatttacgccgagtatgtccattttgctgacctcaatgcgccgttaaacgatgatgagcacgcacaacttgaacgcctgctgaaatatggcccggcactcgccagccacgccccgcaaggcaaactcctgctggtgaccccgcgtcctggcaccatctctccctggtcttcgaaagcgaccgatattgcccataactgcgggctgcaacaggtaaaccgccttgagcgcggcgttgcttactatatagaagccggtacgctgaccaatgaacaatggcagcaggttaccgctgaactgcacgaccgcatgatggaaacggtcttttttgctttagatgatgcagagcagctgtttgcacaccatcaaccgactccggtcaccagcgttgatttgctggggcagggccgtcaggcgctaatcgacgctaacctgcgtcttggcctggcactggcggaagatgaaattgactatctgcaggatgctttcacaaggcttggtcgtaatccgaacgacatcgaactgtatatgtttgcccaggcgaactccgagcactgccgccacaaaatttttaacgccgactgggttatcgatggtgaacagcagccgaaatcgctatttaagatgatcaaaaacaccttcgaaaccacgccggatcacgttctctctgcttataaagataacgccgccgtaatggaaggttctgaagtgggccgctactttgctgaccacgaaacgggccgctacgatttccatcaggaaccggcgcatattctgatgaaagtcgaaactcacaaccacccgacggcgatttctccgtggccgggcgcggcgaccggttccggcggtgaaatccgcgatgaaggtgccaccggacgtggcgcaaagccgaaagctggtctggttggtttctccgtatccaacctgcgaattcctggcttcgaacagccgtgggaagaagatttcggtaaacctgagcgcattgttaccgcgctggacatcatgaccgaaggcccgctgggcggcgcggcgtttaacaacgaatttggtcgcccggcactgaacggctacttccgtacttatgaagaaaaagtgaacagccacaatggcgaagagctgcgcggttatcacaaaccgatcatgctggcgggtgggatcggcaacattcgcgccgatcacgtacaaaaaggcgagatcaacgttggtgcgaagctggtcgttctcggcggcccggcaatgaacatcggtcttggcggcggcgcggcgtcttctatggcatctggtcagtctgatgccgacctcgactttgcttccgtacagcgcgacaacccggagatggagcgtcgctgccaggaagtgatcgaccgttgctggcagcttggtgatgccaacccaatcctgtttatccacgacgttggcgcaggcggtctttctaacgccatgccggaactggtgagcgacggcgggcgcggcggtaaatttgaactgcgcgatatcctgagcgacgaaccgggcatgagcccgctggaaatctggtgtaacgaatcccaggaacgctacgtgctggcggttgctgccgatcagttaccgctgtttgacgaactgtgtaagcgtgagcgcgcgccatacgcggtgattggtgaagcgaccgaagaactgcatctttctttgcacgatcgtcattttgataatcagccgattgatctaccgctggacgtactgcttggcaaaacgccgaagatgacccgcgatgtacaaacgctgaaagcgaaaggcgacgcgctggcccgtgaagggatcaccatcgctgacgcggtgaaacgcgtgctgcatctgccgaccgtggcggagaaaactttcctggtgaccatcggtgaccgcagcgtaaccggcatggtagcgcgcgatcagatggtggggccgtggcaggtgccggtcgctaattgtgcggtcactaccgccagcctcgacagctactatggcgaagcgatggcaattggcgaacgtgcgccagttgcgctgctggatttcgccgcttctgcccgtctggcggtcggtgaagcgttaaccaacatcgccgcaacgcagattggcgatatcaaacgcatcaaactttccgccaactggatggcggcggcaggccaccctggtgaagatgcgggcctgtatgaagccgttaaagctgtgggcgaagaactttgtccggcgctgggcctgacgataccggtgggtaaagactctatgtcgatgaaaacccgctggcaggaaggtaacgaagagcgcgaaatgacgtcgccgttgtcgctggtgatttccgcatttgcccgcgtggaagatgtacgtcacaccattacgccgcagctttctaccgaagataacgcactgttgctgattgatttgggcaaaggcaataacgcgctgggcgcaacggcactggcgcaggtttatcgtcagcttggcgacaaaccggcagatgtacgcgatgttgcccaactgaaaggcttctatgacgcgattcaggcgctggttgcacagcgtaagctgctggcgtatcacgaccgctctgatggcggcctgctggtaacgctggcggaaatggcctttgctggtcattgtggcattgacgcggatatcgccactctgggtgacgatcgcctggcggcgttgtttaacgaagaactgggtgcggtgattcaggtgcgagccgctgaccgtgaagccgttgaagcggtactggcacagcatgggcttgctgattgcgtccattatgttgggcaggcggtttccggtgaccgttttgtgattaccgccaacgggcagactgtatttagcgaaagccgcaccacgttgcgtgtctggtgggcagaaacgacctggcagatgcagcgtctgcgtgacaacccggagtgtgccgatcaggagcaccaggcgaaatcaaacgacgccgatccgggcctgaatgtgaaactgtcgtttgatatcaacgaagatgtggcagcaccgtttattgccactggcgcgcgcccgaaagttgccgtactgcgtgagcagggtgtgaactcccatgttgaaatggcggcagctttccaccgtgcgggcttcgatgctatcgacgtgcatatgagcgatctgctggctggacgcacgggcctggagggtttccacgtcctggtagcgtgcggtggtttttcctacggtgatgtgctgggcgctggtgaaggttgggcgaagtctatcctgttcaatgaccgtgtacgcgatgagtttgcaaccttcttccatcgtccgcaaacgctggcgctgggggtatgtaacggttgccagatgatgtctaatctgcgtgaactgatcccgggtagcgagttgtggccacgttttgtgcgtaacacctccgatcgctttgaagcgcgtttcagtctggtagaagtaacccaaagcccgtcgctgctgttgcaggggatggtgggctcgcagatgccgattgctgtctctcacggtgaagggcgcgtggaagtgcgtgatgcggcgcatctggcggcactggaaagcaaagggctggtggcactgcgctatgtcgataacttcggcaaagtcactgaaacctacccggctaacccgaacggttctccgaatggtattacggcagtcacgactgaaagtggtcgagtcaccattatgatgccgcacccggaacgtgttttccgtactgtcagcaactcctggcatccggaaaactggggcgaggatggcccatggatgcgcattttccgcaatgcacgtaagcagttggggtaa

SEQ ID NO: 6194 - protein, 1332 aa, Escherichia coli
MVILFPRKRFRQRIRFFIMTPVSPPLGYTESLEDERLMMEILRGSPALSAFRINKLLARFQAARLLVHTIYAEYVHFADLNAPLNDDEHAQLERLLKYGPALASHAPQGKLLLVTPRPGTISPWSSKATDIAHNCGLQQVNRLERGVAYYIEAGTLTNEQWQQVTAELHDRMMETVFFALDDAEQLFAHHQPTPVTSVDLLGQGRQALIDANLRLGLALAEDEIDYLQDAFTRLGRNPNDIELYMFAQANSEHCRHKIFNADWVIDGEQQPKSLFKMIKNTFETTPDHVLSAYKDNAAVMEGSEVGRYFADHETGRYDFHQEPAHILMKVETHNHPTAISPWPGAATGSGGEIRDEGATGRGAKPKAGLVGFSVSNLRIPGFEQPWEEDFGKPERIVTALDIMTEGPLGGAAFNNEFGRPALNGYFRTYEEKVNSHNGEELRGYHKPIMLAGGIGNIRADHVQKGEINVGAKLVVLGGPAMNIGLGGGAASSMASGQSDADLDFASVQRDNPEMERRCQEVIDRCWQLGDANPILFIHDVGAGGLSNAMPELVSDGGRGGKFELRDILSDEPGMSPLEIWCNESQERYVLAVAADQLPLFDELCKRERAPYAVIGEATEELHLSLHDRHFDNQPIDLPLDVLLGKTPKMTRDVQTLKAKGDALAREGITIADAVKRVLHLPTVAEKTFLVTIGDRSVTGMVARDQMVGPWQVPVANCAVTTASLDSYYGEAMAIGERAPVALLDFAASARLAVGEALTNIAATQIGDIKRIKLSANWMAAAGHPGEDAGLYEAVKAVGEELCPALGLTIPVGKDSMSMKTRWQEGNEEREMTSPLSLVISAFARVEDVRHTITPQLSTEDNALLLIDLGKGNNALGATALAQVYRQLGDKPADVRDVAQLKGFYDAIQALVAQRKLLAYHDRSDGGLLVTLAEMAFAGHCGIDADIATLGDDRLAALFNEELGAVIQVRAADREAVEAVLAQHGLADCVHYVGQAVSGDRFVITANGQTVFSESRTTLRVWWAETTWQMQRLRDNPECADQEHQAKSNDADPGLNVKLSFDINEDVAAPFIATGARPKVAVLREQGVNSHVEMAAAFHRAGFDAIDVHMSDLLAGRTGLEGFHVLVACGGFSYGDVLGAGEGWAKSILFNDRVRDEFATFFHRPQTLALGVCNGCQMMSNLRELIPGSELWPRFVRNTSDRFEARFSLVEVTQSPSLLLQGMVGSQMPIAVSHGEGRVEVRDAAHLAALESKGLVALRYVDNFGKVTETYPANPNGSPNGITAVTTESGRVTIMMPHPERVFRTVSNSWHPENWGEDGPWMRIFRNARKQLG

SEQ ID NO: 6195 - DNA, 1419 bp, Escherichia coli
gtgagcaccattcatactcccctgacgtataacgaaatcaacgggaaaccttttggcctggattacgaactggcgaaacagtttgccgattacctcggtgtaaaactgaaagtgaccgtgcggcagaatatcagccagctgtttgacgacctcgataatggtaacgccgacctgctggcggcaggactggtctataacagtgagcgggtaaaaaattatcagcctggtcctacctattattccgtgtcacaacaactggtttataaagtgggtcagtatcgcccacgtacgctgggcaacctgacggcggagcaactcaccgttgcaccgggtcacgtggtggttaacgatctccagaccctgaaagacacaaaattcccggaattaagctggaaggtagacgacaaaaaaggctctgcggaattaatggaagatgtcatcgaaggaaaactcgattacaccattgctgattctgtcgccatcagcctgtttcagcgtgttcacccggaactcgccgtagcgctcgatatcaccgatgaacaaccggtgacctggtttagcccgttagatggcgataataccctttccgccgctctgctcgatttcttcaatgagatgaatgaagacggtacgctggcacgcattgaagagaaatacctggggcatggcgatgattttgattacgtcgatacgcgcacatttttacgcgccgtcgatgcggtactgccgcagttaaagcccctgtttgagaaatacgccgaagaaattgactggcgtttgctggccgctattgcttatcaggaatcgcactgggatgcgcaggccacttcaccgacgggtgtgcgcggcatgatgatgctaaccaaaaataccgcgcaaagcctcggcattacggatcgtaccgatgccgaacagagcatcagcggcggcgtgcgttatttgcaggatatgatgagtaaagtgccggaaagtgtgccggagaacgaacggatttggtttgccctcgccgcgtacaatatgggctatgcgcatatgctggatgcccgtgccctgacggcaaaaaccaaagggaatcctgacagttgggctgacgtaaaacagcgtctgcctttacttagccagaaaccctattacagcaagctgacttacggctacgctcgtgggcatgaagcctacgcttatgtcgaaaatattcgtaagtatcagattagcctggtgggttatctgcaagagaaagagaagcaggctacagaagcggcgatgcaactggcgcaggattatccggcggtatcgcctacggagttgggcaaagagaaatttccttttctctcgtttctttcccagtcgtcatcaaactatttgacccactctccctctctgctattttccagaaaagggagtgaagagaaacaaaattaa

SEQ ID NO: 6196 - protein, 472 aa, Escherichia coli
MSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 6197 - DNA, 504 bp, Escherichia coli
ttgtctgaagtcgaatttagccacgaatactggatgcgtcatgcaatgacgctggcgaagcgtgcctgggatgagcgggaagtaccggtcggcgcggtattagtgcataacaatcgtgttattggcgaaggctggaaccgtccgattggtcgacatgatcccaccgcacatgcagaaatcatggccctacggcagggcggtctggtgatgcaaaattatcgtctgatcgacgccacgttgtatgtcacgcttgaaccctgtgtaatgtgtgccggagcgatgatccacagtcgcattggtcgcgtggtctttggtgcgcgtgacgcgaaaactggcgctgcgggatctttaatggatgtgctacatcatccgggtatgaatcaccgggtggaaattacggaaggaatactggcggatgagtgcgcggcgttgctcagtgacttctttcgcatgcgccgccaggaaattaaagcgcagaaaaaagcgcaatcctcgacagattaa

SEQ ID NO: 6198 - protein, 167 aa, Escherichia coli
MSEVEFSHEYWMRHAMTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 6199 - DNA, 612 bp, Escherichia coli
gtgttttttgacttagatggaacattgcatcagcaggatatgttcggcagttttttgcgttatttactgcgtcgccaaccgctgaatgcgttacttgttctgccgctgttgccgatcatagccattgcgttattgataaaaggtcgtgcggcacgctggccgatgagtctgcttctgtggggatgcacttttggtcacaatgaagcgcgtttgcaggcgttgcaggccgatttcgtacgctggtttcgtgacaatgttaccgcctttccgctggttcaggagcgattaaccacctacctgttaagttccgatgctgatatctggttgattaccggctctccgcagccgctggttgaagcggtttatttcgatacgccctggctgccgcgggttaatcttatcgccagtcagattcagcgtggctatggtggttgggtattgacgatgcgttgtctgggacatgaaaaggtcgcgcaactggagcgcaaaatcggcacgccgctgcggctgtacagtggctatagcgacagtaatcaggacaacccgctgctttatttctgtcagcatcgttggcgagtaactccgcgcggtgaactccagcaactggaatag

SEQ ID NO: 6200 - protein, 203 aa, Escherichia coli
MFFDLDGTLHQQDMFGSFLRYLLRRQPLNALLVLPLLPIIAIALLIKGRAARWPMSLLLWGCTFGHNEARLQALQADFVRWFRDNVTAFPLVQERLTTYLLSSDADIWLITGSPQPLVEAVYFDTPWLPRVNLIASQIQRGYGGWVLTMRCLGHEKVAQLERKIGTPLRLYSGYSDSNQDNPLLYFCQHRWRVTPRGELQQLE

SEQ ID NO: 6201 - DNA, 921 bp, Escherichia coli
atggaatataaaattcactcgcgtgtgtctcatattgcctgttgtcgccattatttcatcgcgaggaaagatatgaacggcttacttcgtatccgtcagcgttaccaggggcttgcccagagtgataaaaaactggcggattatctgctgctacaacctgatacggcgcgccatttaagctctcagcaactggccaacgaagccggagtcagtcagtccagcgtcgtgaagttcgcgcaaaaactcggctataaaggttttccggcactaaagttggcgttgagtgaagcgctggcaagccagccggaatctccctccgtgcccattcataaccaaatccgcggtgatgatccgttacggctggtcggcgaaaaactgattaaagaaaatactgccgctatgtacgcaacgctaaacgttaatactgaagagaaactgcatgaatgcgtaacaatgttgcgctctgcgcggcggataattctgaccggtattggcgcttcgggtctggtggcgcaaaactttgcctggaagctgatgaagattggcttcaatgctgccgcagtgcgcgatatgcatgcgctactcgctacagtacaggcgtcgtcccctgacgatctgttattagccatttcctacaccggtgtacgacgcgagttaaacctggcggcagatgagatgctgcgagtgggcggaaaagtgctggctattaccggctttactcccaatgccctgcaacagcgtgcttctcattgcctgtataccattgccgaagaacaagcgacaaacagtgcttcaatctctgcttgtcacgcgcagggaatgttaacggatttgctgttcattgcgctgattcagcaggatctggaactggcaccagaacgtattcgtcatagcgaagcgctggtgaaaaaactggtctga

SEQ ID NO: 6202 - protein, 306 aa, Escherichia coli
MEYKIHSRVSHIACCRHYFIARKDMNGLLRIRQRYQGLAQSDKKLADYLLLQPDTARHLSSQQLANEAGVSQSSVVKFAQKLGYKGFPALKLALSEALASQPESPSVPIHNQIRGDDPLRLVGEKLIKENTAAMYATLNVNTEEKLHECVTMLRSARRIILTGIGASGLVAQNFAWKLMKIGFNAAAVRDMHALLATVQASSPDDLLLAISYTGVRRELNLAADEMLRVGGKVLAITGFTPNALQQRASHCLYTIAEEQATNSASISACHAQGMLTDLLFIALIQQDLELAPERIRHSEALVKKLV

SEQ ID NO: 6203 - DNA, 285 bp, Escherichia coli
ttgtgttgttttgagagtttccttatggcgctgttaatcactaaaaaatgcatcaattgtgatatgtgtgaacccgaatgcccgaatgaggcgatttcgatgggtgaacatatctacgagattaacagcgataagtgtaccgaatgcgtagggcactacgagacaccaacctgccagaaggtgtgtccgatccccaatactattgtgaaagatccgcaacatgtcgagacggaagaacagttgtgggataaatttgtgctgatgcaccacgcggataaaatttaa

SEQ ID NO: 6204 - protein, 94 aa, Escherichia coli
MCCFESFLMALLITKKCINCDMCEPECPNEAISMGEHIYEINSDKCTECVGHYETPTCQKVCPIPNTIVKDPQHVETEEQLWDKFVLMHHADKI

SEQ ID NO: 6205 - DNA, 381 bp, Escherichia coli
atggcaatattaggtttaggtacggatattgtagagatcgctcgcatagaagcggtgatcgcccgatccggtgagcgcctggcacgccgcgtattaagcgataacgaatgggaaatctggaaaacgcaccaccagccagtgcgttttctggcgaagcgttttgctgtgaaagaagcggcggcaaaagcatttggcacagggatccgcaatggtctggcgtttaatcagtttgaagtattcaatgatgagctcggcaaaccacggctacggctatggggtgaggcattaaaactggcggaaaagctcggcgttgtaaatatgcatgtaacgcttgccgatgagcgccactatgcttgtgccacggtaattattgaaagttaa

SEQ ID NO: 6206 - protein, 126 aa, Escherichia coli
MAILGLGTDIVEIARIEAVIARSGERLARRVLSDNEWEIWKTHHQPVRFLAKRFAVKEAAAKAFGTGIRNGLAFNQFEVFNDELGKPRLRLWGEALKLAEKLGVVNMHVTLADERHYACATVIIES

SEQ ID NO: 6207 - DNA, 732 bp, Escherichia coli
atggctgaattactgttaggcgtcaacattgaccatattgcaacgctgcgtaacgcgcgcggtactgcttacccggatccggtgcaggcggcgtttattgctgagcaggcgggagcggacggcattaccgtgcatttacgtgaagatcgccgccacattaccgaccgcgatgtgtgcatcctgcgccagacgctggatacccgcatgaatctggagatggcggtgaccgaagagatgctggcgatcgccgttgagacgaagccacatttttgctgtctggtaccggaaaagcgtcaggaagtcacaaccgaaggcggcctggacgtcgcagggcagcgtgaaaaaatgcgcgatgcctgcaaacgtctggcagatgccgggatccaggtttctctgtttatcgacgccgatgaagagcagatcaaagctgtggcagaggttggcgcaccgtttatcgagatccacaccggttgctatgctgatgccaaaactgacgccgaacaggcgcaagagttggcgcgtatcgccaaagccgcgacctttgccactagtctcggtctgaaagttaacgccggacacggtctgacctatcacaacgtgaaagccattgccgccatccctgagatgcatgaactgaatatcggtcatgccattattggtcgtgcagtgatgaccggactgaaagatgcggtggcagaaatgaaacgtctgatgctggaagcgcgtggctaa

SEQ ID NO: 6208 - protein, 243 aa, Escherichia coli
MAELLLGVNIDHIATLRNARGTAYPDPVQAAFIAEQAGADGITVHLREDRRHITDRDVCILRQTLDTRMNLEMAVTEEMLAIAVETKPHFCCLVPEKRQEVTTEGGLDVAGQREKMRDACKRLADAGIQVSLFIDADEEQIKAVAEVGAPFIEIHTGCYADAKTDAEQAQELARIAKAATFATSLGLKVNAGHGLTYHNVKAIAAIPEMHELNIGHAIIGRAVMTGLKDAVAEMKRLMLEARG

SEQ ID NO: 6209 - DNA, 729 bp, Escherichia coli
atggaaggctggcagcgcgcttttgtcctgcatagtcgcccgtggagcgaaaccagcctgatgctggacgtcttcacggaggaatcgggtcgcgtgcgtctggttgccaaaggcgcacgctctaaacgctctactctgaaaggggcattacagcctttcacccctctcttgctacgttttggcgggcgtggcgaagtcaaaacgctgcgcagtgctgaagctgtctcgctggcgctgccattaagcggtatcacgctttacagcggtctgtacatcaacgaacttctctcccgcgtactggaatacgagacgcgcttctctgaactctttttcgattacttgcactgcattcagtctcttgccggggtcactggtacgccagaacccgcgttgcgccgctttgaactggcactgctcgggcatctgggctatggcgtcaattttacccattgtgcgggtagcggcgagccggtagatgacaccatgacgtatcgttatcgcgaagaaaaagggtttatcgcaagcgtcgttatcgacaataaaacgttcaccggaaggcagttaaaagcgttaaacgcgcgggaatttcctgacgcagacacactgcgcgccgcgaaacgctttacccgcatggcgcttaagccgtatcttggcggtaaaccattaaagagcagggaactgttccggcagtttatgcctaagcgaacggtgaaaacacattatgaatga

SEQ ID NO: 6210 - protein, 242 aa, Escherichia coli
MEGWQRAFVLHSRPWSETSLMLDVFTEESGRVRLVAKGARSKRSTLKGALQPFTPLLLRFGGRGEVKTLRSAEAVSLALPLSGITLYSGLYINELLSRVLEYETRFSELFFDYLHCIQSLAGVTGTPEPALRRFELALLGHLGYGVNFTHCAGSGEPVDDTMTYRYREEKGFIASVVIDNKTFTGRQLKALNAREFPDADTLRAAKRFTRMALKPYLGGKPLKSRELFRQFMPKRTVKTHYE

SEQ ID NO: 6211 - DNA, 906 bp, Escherichia coli
atgagcatcgataaaagttactgcggatttattgctatcgtcggacgtccgaacgttggcaaatccacattgttgaataaactgctggggcagaagatctccatcacctcccgcaaggcgcaaacaactcgtcaccgcattgtggggatccatactgaaggcgcgtatcaggcgatctacgttgataccccaggcctgcatatggaagaaaaacgcgctattaaccgtctgatgaacaaagcggcgagcagctccattggcgacgttgagctggtgatttttgtcgtagaaggcacccgctggacgccggacgatgaaatggtgctcaacaagctgcgtgatggcaaagcgccggtaatcctcgcggtgaacaaagtggacaacgtgcaggaaaaagccgatctgctgccacacttacagttcctggcaagccagatgaacttcctcgatatcgtgccgatctctgccgaaaccgggctgaatgtcgacactatcgcggcaatcgtgcgtaagcatctgcctgaagcgacccatcacttcccggaagattacatcaccgatcgctcacagcgttttatggcgtctgaaattatccgcgaaaaactgatgcgttttctcggcgctgaactgccgtactccgtgaccgtggagatcgaacgtttcgtctctaacgaacgcggcggttatgacatcaacggtttgattctcgttgagcgtgaagggcagaagaagatggtcattggcaacaaaggggccaagatcaaaaccatcgggattgaagcgcgtaaagacatgcaggaaatgttcgaagcgcctgttcaccttgagctgtgggtaaaagtgaaatccggttgggccgacgacgaacgcgcactgcgcagtctcggttatgttgacgatctttaa

SEQ ID NO: 6212 - protein, 301 aa, Escherichia coli
MSIDKSYCGFIAIVGRPNVGKSTLLNKLLGQKISITSRKAQTTRHRIVGIHTEGAYQAIYVDTPGLHMEEKRAINRLMNKAASSSIGDVELVIFVVEGTRWTPDDEMVLNKLRDGKAPVILAVNKVDNVQEKADLLPHLQFLASQMNFLDIVPISAETGLNVDTIAAIVRKHLPEATHHFPEDYITDRSQRFMASEIIREKLMRFLGAELPYSVTVEIERFVSNERGGYDINGLILVEREGQKKMVIGNKGAKIKTIGIEARKDMQEMFEAPVHLELWVKVKSGWADDERALRSLGYVDDL

SEQ ID NO: 6213 - DNA, 681 bp, Escherichia coli
atgaaccccatcgtaattaatcggcttcaacggaagctgggctacacttttaatcatcaggaactgttgcagcaggcattaacccatcgtagcgccagcagcaaacataacgagcgtttagaatttttaggcgactctattctgagctacgttatcgccaacgcgctttatcaccgtttccctcgtgtcgatgaaggcgatatgagccggatgcgcgccacgctggtccgtggcaatacgctggcagaactggcgcgcgaatttgagttaggcgagtgcttacgtttagggccaggtgaacttaaaagcggtggatttcgtcgtgagtcaattctcgccgacaccgtcgaagcattaattggtggcgtattcctcgacagtgatattcaaaccgtcgagaaattaatcctcaactggtatcaaacccgtctggacgaaattagcccaggagataaacaaaaagatccgaaaacgcgcttgcaagaatatttgcagggtcgccatctgccgctgccgacttatctggtagtccaggtacgtggcgaagcgcacgatcaggaatttactatccactgccaggtcagcggcctgagtgaaccggtggttggcacaggttcaagccgtcgtaaggctgagcaggctgccgccgaacaggcgttgaaaaaactggagctggaatga

SEQ ID NO: 6214 - protein, 226 aa, Escherichia coli
MNPIVINRLQRKLGYTFNHQELLQQALTHRSASSKHNERLEFLGDSILSYVIANALYHRFPRVDEGDMSRMRATLVRGNTLAELAREFELGECLRLGPGELKSGGFRRESILADTVEALIGGVFLDSDIQTVEKLILNWYQTRLDEISPGDKQKDPKTRLQEYLQGRHLPLPTYLVVQVRGEAHDQEFTIHCQVSGLSEPVVGTGSSRRKAEQAAAEQALKKLELE

SEQ ID NO: 6215 - DNA, 975 bp, Escherichia coli
atggcgaatatgtttgccctgattctggtgattgccacactggtgacgggcattttatggtgcgtggataaattctttttcgcacctaaacggcgggaacgtcaggcagcggcgcaggcggctgccggtgactcactggataaagcaacgctgaaaaaggttgcgccgaagcctggctggctggaaaccggtgcttctgtttttccggtactggctatcgtattgattgtgcgttcgtttatttatgaaccgttccagatcccgtcaggttcgatgatgccgactctgttaatcggtgattttattctggtagagaagtttgcttatggcattaaagatcctatctaccagaaaacgctgatcgaaaccggtcatccgaaacgcggcgatatcgtggtctttaaatatccggaagatccaaagcttgattacatcaagcgcgcggtgggtttgccgggcgataaagtcacttatgatccggtctcaaaagagctgacgattcaaccgggatgcagttccggccaggcgtgtgaaaacgcgctaccggtcacttactccaacgtggaaccgagcgatttcgttcagaccttctcacgccgtaatggtggggaagcgaccagcggattctttgaagtgccgaaaaacgaaaccaaagaaaatggaattcgtctttccgagcgtaaagagacattgggtgatgtgacgcaccgcattctgacagtgccgattgcgcaggaccaggtggggatgtattaccagcagccagggcaacaactggcaacctggattgttccgccgggacaatacttcatgatgggcgacaaccgcgacaacagcgcggacagccgttactggggctttgtgccggaagcgaatctggtcggtcgggcaacggctatctggatgagtttcgataagcaagaaggcgaatggccgacaggtgtgcgcttaagtcgcattggcggcatccattaa

SEQ ID NO: 6216 - protein, 324 aa, Escherichia coli
MANMFALILVIATLVTGILWCVDKFFFAPKRRERQAAAQAAAGDSLDKATLKKVAPKPGWLETGASVFPVLAIVLIVRSFIYEPFQIPSGSMMPTLLIGDFILVEKFAYGIKDPIYQKTLIETGHPKRGDIVVFKYPEDPKLDYIKRAVGLPGDKVTYDPVSKELTIQPGCSSGQACENALPVTYSNVEPSDFVQTFSRRNGGEATSGFFEVPKNETKENGIRLSERKETLGDVTHRILTVPIAQDQVGMYYQQPGQQLATWIVPPGQYFMMGDNRDNSADSRYWGFVPEANLVGRATAIWMSFDKQEGEWPTGVRLSRIGGIH

SEQ ID NO: 6217 - DNA, 1800 bp, Escherichia coli
atgaagaatatacgtaacttttcgatcatagctcacattgaccacggtaaatcgacgctgtctgaccgtattatccagatctgcggtggcctgtctgaccgtgaaatggaggcgcaggttctcgattccatggatcttgagcgtgagcgtggcattaccatcaaagcgcaaagcgtgacgctggactacaaagcgtctgacggcgaaacctatcagcttaactttatcgacaccccgggccacgtagacttctcctatgaagtttctcgttcgctggctgcatgtgaaggtgcattgctggtggtcgacgccgggcagggcgtagaagcgcaaaccctggcaaactgctacaccgccatggaaatggatctcgaagtggtgccggtactgaacaagattgacctgccggcagctgatcctgaacgcgtggcggaagaaattgaagatatcgtcggcatcgacgccactgacgcggtgcgctgttcagcgaaaaccggcgttggcgtgcaggacgttctcgaacgtctggtgcgcgacattccgccgccggaaggcgatccggaaggcccgttacaggcactcattatcgactcctggttcgacaactacctgggcgttgtttcacttatccgtattaaaaacggcaccctgcgtaagggcgacaaagtgaaagtcatgagtaccgggcagacctataacgccgaccgtctgggtatttttacgccaaaacaggttgaccgcactgaactgaaatgtggcgaagtaggctggctggtatgtgcgattaaagatatccacggcgctccagtaggcgataccttaacgctggcgcgtaatccggcagaaaaggcgctgcctggctttaagaaagtcaaaccgcaggtatacgccggtctgttcccggtaagttccgacgactatgaagccttccgtgacgcgctgggtaaactcagcctgaacgatgcctcactgttctatgagccggaaagctcaagcgcgctgggctttggtttccgctgcggcttcctcggtctgctgcacatggagatcatccaggaacgtctggaacgtgaatacgatctggatctgatcaccactgcgccgaccgtagtgtatgaagttgaaaccacgtcaagagaagttatctacgtcgacagcccatccaagctgccagcggtaaataacatctacgaactgcgcgagccgattgcagaatgtcacatgctgctgccgcaggcatatctcggcaacgttattacgctgtgcgtagaaaaacgcggcgtgcagaccaatatggtttaccacggtaatcaggtggcgctgacgtacgagatcccgatggcggaagtggtgctcgatttcttcgatcgcctgaaatctacctcgcgtggttatgcgtctctggattacaacttcaaacgcttccaggcgtccgacatggtacgtgtagacgtattaatcaacggtgaacgtgttgatgcgttggcgctgatcacccatcgtggtaattcgcaaaaccgcggtcgcgagctggtggagaagatgaaagatctgatcccgcgccagcagtttgatatcgccattcaggcagcgattggtacgcacatcattgcgcgctccaccgtgaaacagctgcgtaaaaacgtactggctaaatgttatggcggcgatatcagtcgtaagaaaaagctgctgcagaagcagaaagaaggtaagaaacgcatgaagcagatcggtaacgtcgagctgccgcaggaagcgttcctcgccattctgcacgtcggcaaagacaacaaataa

SEQ ID NO: 6218 - protein, 599 aa, Escherichia coli
MKNIRNFSIIAHIDHGKSTLSDRIIQICGGLSDREMEAQVLDSMDLERERGITIKAQSVTLDYKASDGETYQLNFIDTPGHVDFSYEVSRSLAACEGALLVVDAGQGVEAQTLANCYTAMEMDLEVVPVLNKIDLPAADPERVAEEIEDIVGIDATDAVRCSAKTGVGVQDVLERLVRDIPPPEGDPEGPLQALIIDSWFDNYLGVVSLIRIKNGTLRKGDKVKVMSTGQTYNADRLGIFTPKQVDRTELKCGEVGWLVCAIKDIHGAPVGDTLTLARNPAEKALPGFKKVKPQVYAGLFPVSSDDYEAFRDALGKLSLNDASLFYEPESSSALGFGFRCGFLGLLHMEIIQERLEREYDLDLITTAPTVVYEVETTSREVIYVDSPSKLPAVNNIYELREPIAECHMLLPQAYLGNVITLCVEKRGVQTNMVYHGNQVALTYEIPMAEVVLDFFDRLKSTSRGYASLDYNFKRFQASDMVRVDVLINGERVDALALITHRGNSQNRGRELVEKMKDLIPRQQFDIAIQAAIGTHIIARSTVKQLRKNVLAKCYGGDISRKKKLLQKQKEGKKRMKQIGNVELPQEAFLAILHVGKDNK

SEQ ID NO: 6219 - DNA, 480 bp, Escherichia coli
atgatcaaagagtgggctaccgtcgtctcctggcaaaacgggcaggcgctggtcagttgtgatgttaaagcctcatgcagcagctgcgcttcacgcgccggttgcggtagccgcgtgttgaataaacttggcccgcaaaccacgcataccattgtcgtaccctgtgatgagccgttagtgccggggcaaaaagtagaattaggaatcgccgaaggcagcctgcttagctccgcattactggtttatatgtcgccgctggtgggattattcctcatcgcttcgctatttcagctactctttgcttctgacgtcgcagcattatgtggtgcgatcctcggcggttttggcgggttcctgattgcgcgcggctactcgcgtaagtttgctgcccgggcagaatggcaaccgatcatcttaagcgtggccttgccgcctggccttgtgcgatttgaaacatcttcggaagacgcgagccagtga

SEQ ID NO: 6220 - protein, 159 aa, Escherichia coli
MIKEWATVVSWQNGQALVSCDVKASCSSCASRAGCGSRVLNKLGPQTTHTIVVPCDEPLVPGQKVELGIAEGSLLSSALLVYMSPLVGLFLIASLFQLLFASDVAALCGAILGGFGGFLIARGYSRKFAARAEWQPIILSVALPPGLVRFETSSEDASQ

SEQ ID NO: 6221 - DNA, 957 bp, Escherichia coli
atgaagcaactttggtttgccatgtcattagtgacaggtagcctgttattctctgctaacgcctcggccactcccgcgtccggggcgttattacagcagatgaacctggccagtcagtcactgaattacgagctgtcattcatcagcatcaataaacagggtgttgagtctctgcgttatcgacatgcacgcctcgataaccgtccgcttgcacagctgttgcaaatggatggcccgcgccgggaagtggtacagcgcggcaatgaaatcagctactttgagccgggccttgaaccgttcacgcttaatggcgattacattgttgattctctgccatcgctcatttataccgatttcaaacgcctttctccttactacgactttatctccgtgggacgcacgcgtattgctgatcgtctttgcgaagtcattcgcgtagtcgcccgtgatggcacacgctacagctacattgtgtggatggacaccgaatcgaaattaccgatgcgggttgatctccttgatcgcgatggtgaaacgctggaacaatttcgcgtgattgcttttaacgtcaatcaggatatcagcagcagtatgcagacgctggcgaaggcaaatttgccgccgttgctttctgttcctgtaggtgaaaaagctaaattcagctggacgccaacctggttgccacagggttttagcgaagtttccagtagtcgacgtccgctaccgacgatggacaacatgcctatcgaatcacgtctctattccgacggattattcagcttctcggtaaacgttaaccgcgctacgccatcgagcagcgatcagatgttgcgcaccggacgcagaaccgtcagtacaagcgtacgtgataacgccgaaatcaccattgtcggtgaactgccgccgcaaacggcgaaacgcattgccgagaatattaagttcggggcagcgcaatga

SEQ ID NO: 6222 - protein, 318 aa, Escherichia coli
MKQLWFAMSLVTGSLLFSANASATPASGALLQQMNLASQSLNYELSFISINKQGVESLRYRHARLDNRPLAQLLQMDGPRREVVQRGNEISYFEPGLEPFTLNGDYIVDSLPSLIYTDFKRLSPYYDFISVGRTRIADRLCEVIRVVARDGTRYSYIVWMDTESKLPMRVDLLDRDGETLEQFRVIAFNVNQDISSSMQTLAKANLPPLLSVPVGEKAKFSWTPTWLPQGFSEVSSSRRPLPTMDNMPIESRLYSDGLFSFSVNVNRATPSSSDQMLRTGRRTVSTSVRDNAEITIVGELPPQTAKRIAENIKFGAAQ

SEQ ID NO: 6223 - DNA, 687 bp, Escherichia coli
ttgacgatagcgggatactggataagggtattaggcatgcagaaagaacaactttccgctttaatggatggcgaaacgctggatagtgagctgcttaacgaactggctcataacccagaaatgcagaaaacctgggaaagctatcacttgatccgtgactcaatgcggggtgatactcccgaggtgctccatttcgatatctcttcacgcgtgatggccgccattgaagaagagccagtacgtcaaccggcgacattgatcccggaagcccagcctgcgccgcatcaatggcagaaaatgccattctggcagaaagtacgtccgtgggcggcacagcttacccaaatgggcgtagcagcatgcgtatcgcttgcagttatcgttggcgtccagcactataatgggcaatctgaaacgtcccagcagcccgaaacgccagtatttaatacactgccgatgatgggtaaagccagcccggttagtctgggagtaccttctgaagcgaccgcaaataatggtcaacagcagcaggtacaggagcagcgtcgtcgcattaatgcaatgttgcaggattacgaactgcaacgccgactccactctgaacagcttcagtttgagcaggcacaaactcagcaagccgctgtacaggtgccaggaattcaaactttaggaacgcaatcgcagtaa

SEQ ID NO: 6224 - protein, 228 aa, Escherichia coli
MTIAGYWIRVLGMQKEQLSALMDGETLDSELLNELAHNPEMQKTWESYHLIRDSMRGDTPEVLHFDISSRVMAAIEEEPVRQPATLIPEAQPAPHQWQKMPFWQKVRPWAAQLTQMGVAACVSLAVIVGVQHYNGQSETSQQPETPVFNTLPMMGKASPVSLGVPSEATANNGQQQQVQEQRRRINAMLQDYELQRRLHSEQLQFEQAQTQQAAVQVPGIQTLGTQSQ

SEQ ID NO: 6225 - DNA, 576 bp, Escherichia coli
atgagcgagcagttaacggaccaggtcctggttgaacgggtccagaagggagatcagaaagcctttaacttactggtagtgcgctatcagcataaagtggcgagtctggtttcccgctatgtgccgtcgggtgatgttcccgatgtggtacaagaagcttttattaaagcctatcgtgcgctggattcgttccggggagatagcgctttttatacatggctgtatcggattgctgtaaatacagcgaaaaattacctggttgctcaggggcgtcgtccaccttccagtgatgtggatgccattgaagctgaaaacttcgaaagtggcggcgcgttgaaagaaatttcgaaccctgagaacttaatgttgtcagaagaactgagacagatagttttccgaactattgagtccctcccggaagatttacgcatggcaataaccttgcgggagctggatggcctgagctatgaagagatagccgctatcatggattgtccggtaggtacggtgcgttcacgtatcttccgagcgagggaagctattgataacaaagttcaaccgcttatcaggcgttga

SEQ ID NO: 6226 - protein, 191 aa, Escherichia coli
MSEQLTDQVLVERVQKGDQKAFNLLVVRYQHKVASLVSRYVPSGDVPDVVQEAFIKAYRALDSFRGDSAFYTWLYRIAVNTAKNYLVAQGRRPPSSDVDAIEAENFESGGALKEISNPENLMLSEELRQIVFRTIESLPEDLRMAITLRELDGLSYEEIAAIMDCPVGTVRSRIFRAREAIDNKVQPLIRR

SEQ ID NO: 6227 - DNA, 108 bp, Escherichia coli
gtgactaaacacgctgcctcagggcggcgagaaaacgagaagttactggctggtggaggattaggtggtgaaataaaaaggccgttgggttactcttcaggcagttaa

SEQ ID NO: 6228 - protein, 35 aa, Escherichia coli
MTKHAASGRRENEKLLAGGGLGGEIKRPLGYSSGS

SEQ ID NO: 6229 - DNA, 858 bp, Escherichia coli
gtgtggggcgctgattatagacgttacggctgcaatcttcatctgtttgtatggatatcgcttctcgggtattgttctcacccggtgctatcgccgtttttcctgcaaggttttattttcatgtcacagtctacatccgtgtttcgtcgtaatggatttacttttaaacagttttttgttgctcacgatcgctgtgcgatgaaagtgggaacggatggtattttgctgggcgcatgggcaccggtagctggggtaaaacgttgccttgatatcggcgcgggtagcgggttgctggcattaatgctggcgcagcgaacagatgacagcgtgatgattgatgcagttgaactggaaagtgaagctgccgcgcaagcgcaggaaaatatcaaccagtccccgtgggcagagcggattaatgtccacacggcggatattctgcagtggatcacacagcagacagtacgcttcgatttaatcatcagcaacccaccttactatcagcagggagtagagtgcgcgacacctcaacgggaacaggctcgctataccactacgcttgatcacccatcgttgctgacttgtgcggcggagtgcattaccgaagagggatttttctgcgtggtgctgccagagcagattggtaatggttttactgaactggcattaagtatgggctggcatttacgtttgcggacggatgtggcggaaaacgaagcgcgactgccgcatcgggtgctgctggcattctccccgcaggcgggagaatgctttagcgatcgcttagtcattcgtgggccagaccagaactattccgaagcgtatacggcgctgacccaggctttttatctgtttatgtaa

SEQ ID NO: 6230 - protein, 285 aa, Escherichia coli
MWGADYRRYGCNLHLFVWISLLGYCSHPVLSPFFLQGFIFMSQSTSVFRRNGFTFKQFFVAHDRCAMKVGTDGILLGAWAPVAGVKRCLDIGAGSGLLALMLAQRTDDSVMIDAVELESEAAAQAQENINQSPWAERINVHTADILQWITQQTVRFDLIISNPPYYQQGVECATPQREQARYTTTLDHPSLLTCAAECITEEGFFCVVLPEQIGNGFTELALSMGWHLRLRTDVAENEARLPHRVLLAFSPQAGECFSDRLVIRGPDQNYSEAYTALTQAFYLFM

SEQ ID NO: 6231 - DNA, 1623 bp, Escherichia coli
atgaatactctccctgaacattcatgtgacgtgttgattatcggtagcggcgcagccggactttcactggcgctgcgcctggctgaccagcatcaggtcatcgttctaagtaaaggcccggtaacggaaggttcaacattttatgcccagggcggtattgccgccgtgtttgatgaaactgacagcattgactcgcatgtggaagacacattgattgccggggctggtatttgcgatcgccatgcagttgaatttgtcgccagtaatgcacgatcctgtgtgcaatggctaatcgaccagggggtgttgtttgatacccacattcagccgaatggcgaagaaagctaccatctgactcgtgaaggtggacatagtcaccgtcgtattcttcatgccgccgacgccaccggtagagaagtagaaaccacgctggtgggcaaggcgcagaaccatccgaatattcgcgtgctggagcgcagcaacgcggttgatctgattgtttctgacaaaattggcctgccgggcacgcgatgggttgttggcgcgtgggtatggaaccgaaataaagaaacggttgaaacctgccacgcaaaagcagtggtactggcaaccggcggtgcttcaaaagtttatcagtacaccaccaatccggatatttcttctggcgatggcattgctatggcgtggcgcgcaggctgccgggttgccaatctcgaatttaatcagttccaccctaccgcgctgtatcacccacaggcacgcaatttcctgttaacggaagcactgcgcggcgaaggcgcttatctcaagcgcccggacggcacgcgttttatgcccgattttgatgagcgcggcgaactggccccgcgcgatattgtcgcccgcgccattgaccatgaaatgaaacgcctcggcgcagattgtatgttcctcgacatcagccataagcccgccgattttattcgccagcatttcccgatgatttatgaaaaattgctcgggctggggatagatctcacgaaagaacccgtgccgattgtgcctgctgcacattatacctgcggtggtgtaatggttgatgatcatgggcgtacggacgtcgatggtttgtatgccattggcgaagtgagttataccggcttacacggcgctaaccgcatggcctcgaattcattgctggagtgtctggtctatggctggtcggcggcagaagatatcagcagacgtataccttatgcccacggcgtcagtacgttaccgccgtgggatgaaagccgcgttgagaaccctgacgaacgggtagtaattcagcataactggcacgagctacgtctgtttatgtgggattacgttggcattgttcgcacaacgaagcgcctggcacgcgccctgcggcggataaccatgctccaacaagaaatagacgaatattacgcccatttccgcgtctcaaataatttgctggagctgcgtaatctggtacaggttgccgagttgattgttcgctgtgcgatgatgcgcaaggagagccgtggcctgcatttcacgctggattatccggaactgctcacgcattccggtccatcgatcctttctgccggcaatcattacataaacagataa

SEQ ID NO: 6232 - protein, 540 aa, Escherichia coli
MNTLPEHSCDVLIIGSGAAGLSLALRLADQHQVIVLSKGPVTEGSTFYAQGGIAAVFDETDSIDSHVEDTLIAGAGICDRHAVEFVASNARSCVQWLIDQGVLFDTHIQPNGEESYHLTREGGHSHRRILHAADATGREVETTLVGKAQNHPNIRVLERSNAVDLIVSDKIGLPGTRWVVGAWVWNRNKETVETCHAKAVVLATGGASKVYQYTTNPDISSGDGIAMAWRAGCRVANLEFNQFHPTALYHPQARNFLLTEALRGEGAYLKRPDGTRFMPDFDERGELAPRDIVARAIDHEMKRLGADCMFLDISHKPADFIRQHFPMIYEKLLGLGIDLTKEPVPIVPAAHYTCGGVMVDDHGRTDVDGLYAIGEVSYTGLHGANRMASNSLLECLVYGWSAAEDISRRIPYAHGVSTLPPWDESRVENPDERVVIQHNWHELRLFMWDYVGIVRTTKRLARALRRITMLQQEIDEYYAHFRVSNNLLELRNLVQVAELIVRCAMMRKESRGLHFTLDYPELLTHSGPSILSAGNHYINR

SEQ ID NO: 6233 - DNA, 1335 bp, Escherichia coli
atgactgtaacgactttttccgaacttgaactcgacgaaagcctgctggaagccctccaggataaaggtttcactcgcccgaccgccattcaggctgccgccattccgcctgcgctcgatggccgtgatgtactcggttctgcgccgacaggcaccggtaaaacggcggcgtatctgctgccagcgttgcagcacctgctcgatttcccacgtaagaaatccggtccgccgcgtattttgatcctcaccccaactcgcgagctggcgatgcaggtggccgatcatgcccgcgaactggcgaaacatacgcatctggatattgccaccatcaccggcggcgtggcttatatgaaccacgcagaagtgttcagcgaaaaccaggacattgtggtcgccacgaccggacgtctgctgcaatacataaaagaagagaacttcgattgccgcgcggttgaaacgctgatcctcgacgaagcagaccgtatgctggatatgggcttcgcccaggatatcgaacatattgctggcgaaacgcgctggcgtaaacagaccctgctcttttcggcaacgctggaaggcgatgcgattcaggactttgccgagcgtctgttggaagatccggtggaagtttctgccaatccgtccacccgtgagcgcaaaaaaattcatcagtggtattaccgcgccgatgatcttgagcataaaaccgcgttgctggtgcatctgttaaaacagccggaagcgacccgctcaattgtgtttgtgcgtaagcgtgagcgtgtgcatgagctggcaaactggctgcgcgaagcaggcatcaacaactgctatctcgaaggtgagatggtacaaggcaagcgtaacgaagcgattaaacgcttgaccgaaggccgcgtaaacgtactggttgctaccgatgttgccgcgcgcggtatcgacattccggatgtcagccacgtctttaacttcgatatgccgcgcagtggcgatacttatttgcaccgtatcggacgtaccgcgcgcgccggtcgtaaaggcaccgcgatttcgctggtggaagcccatgaccatctgctgctgggcaaagttggccgttatattgaagagccaattaaagctcgcgtaattgatgagttacgtccgaaaacgcgtgcgccaagcgagaagcagaccggcaagccatcgaagaaagtgttggctaaacgtgccgagaagaaaaaagctaaagagaaagagaagccgcgggtgaaaaaacgccatcgcgacactaaaaatattggtaagcgccgtaaaccaagcggaacgggcgtgccaccgcaaacgacagaagagtaa

SEQ ID NO: 6234 - protein, 444 aa, Escherichia coli
MTVTTFSELELDESLLEALQDKGFTRPTAIQAAAIPPALDGRDVLGSAPTGTGKTAAYLLPALQHLLDFPRKKSGPPRILILTPTRELAMQVADHARELAKHTHLDIATITGGVAYMNHAEVFSENQDIVVATTGRLLQYIKEENFDCRAVETLILDEADRMLDMGFAQDIEHIAGETRWRKQTLLFSATLEGDAIQDFAERLLEDPVEVSANPSTRERKKIHQWYYRADDLEHKTALLVHLLKQPEATRSIVFVRKRERVHELANWLREAGINNCYLEGEMVQGKRNEAIKRLTEGRVNVLVATDVAARGIDIPDVSHVFNFDMPRSGDTYLHRIGRTARAGRKGTAISLVEAHDHLLLGKVGRYIEEPIKARVIDELRPKTRAPSEKQTGKPSKKVLAKRAEKKKAKEKEKPRVKKRHRDTKNIGKRRKPSGTGVPPQTTEE

SEQ ID NO: 6235 - DNA, 927 bp, Escherichia coli
atgtttttacattctaaattcgatattttcgataggtttggggttatggatctgcgccgttttattacacttaaaaccgtggtggaagagggttcctttttgcgagcttcgcaaaaattgtgctgcacacaatcgacggtgacttttcatattcagcagcttgagcaggagttctcggtacaattgtttgagaaaattggtcgacgaatgtgccttacccgcgaaggaaaaaagctgctgccgcacatctatgaacttacccgagtgatggatacgcttcgtgaggctgctaaaaaagagtcggatccggacggggaactacgcgttatttcaggcgaaacgttgctctcttatcgaatgccgcaggtgttgcagcgttttcggcaacgcgctccaaaagtgcgtttatcgttgcagtcgctgaactgttacgtgatccgtgatgcgctactgaatgatgaggccgatgtcggggttttttatcgcgtagggaatgatgatgctctgaaccgacgagagttgggtgaacaaccgctggcgctggtggcttcaccgcaaattgcagatgtcgattttactgagccgggaagacataacgcctgtagctttattatcaacgaaccacaatgtgtcttccggcagatatttgagagcacgctgcgccagcggcggatcacggtggaaaacaccattgagcttataagtatcgaaagcatcaagcgttgtgtcgcggcaaatatcggagtcagttacctgccgcgttttgcggtggtaaaagagttgaagtgcggagaattaattgaattgccttttggcgaacagtcgcagaccattacggcaatgtgcgctcaccatgccggaaaagcggttagcccggcgatgcacacttttattcagtgtgttgaagagtgttttttgccgggataa

SEQ ID NO: 6236 - protein, 308 aa, Escherichia coli
MFLHSKFDIFDRFGVMDLRRFITLKTVVEEGSFLRASQKLCCTQSTVTFHIQQLEQEFSVQLFEKIGRRMCLTREGKKLLPHIYELTRVMDTLREAAKKESDPDGELRVISGETLLSYRMPQVLQRFRQRAPKVRLSLQSLNCYVIRDALLNDEADVGVFYRVGNDDALNRRELGEQPLALVASPQIADVDFTEPGRHNACSFIINEPQCVFRQIFESTLRQRRITVENTIELISIESIKRCVAANIGVSYLPRFAVVKELKCGELIELPFGEQSQTITAMCAHHAGKAVSPAMHTFIQCVEECFLPG

SEQ ID NO: 6237 - DNA, 588 bp, Escherichia coli
gtgacaccgacccttttaagtgctttttggacttacaccctgattaccgccatgacgccaggaccgaacaatattctcgcccttagctctgctacgtcgcatggatttcgtcaaagtacccgtgtgctggcagggatgagtctgggatttttgattgtgatgttactgtgtgcgggcatttcattttcactggcagtgattgacccggcagcggtacaccttttgagttgggcgggggcggcatatattgtctggctggcgtggaaaatcgccaccagcccaacaaaggaagacggacttcagacaaaaccaatcagtttttgggccagctttgctttgcagtttgtgaacgtcaaaatcattttgtacggtgttacggcactgtcgacgtttgttctgccgcaaacacaggcgctaagttgggtagttggcgtcagcgttttgctggcgatgattgggacgtttggcaatgtgtgctgggcgctggcggggcatctgtttcagcgattgtttcgccagtatggtcgccagttaaatatcgtgcttgccctgttgctggtctattgcgcggtacgcattttctattaa

SEQ ID NO: 6238 - protein, 195 aa, Escherichia coli
MTPTLLSAFWTYTLITAMTPGPNNILALSSATSHGFRQSTRVLAGMSLGFLIVMLLCAGISFSLAVIDPAAVHLLSWAGAAYIVWLAWKIATSPTKEDGLQTKPISFWASFALQFVNVKIILYGVTALSTFVLPQTQALSWVVGVSVLLAMIGTFGNVCWALAGHLFQRLFRQYGRQLNIVLALLLVYCAVRIFY

SEQ ID NO: 6239 - DNA, 384 bp, Escherichia coli
atgattacaggtatccagattactaaagccgctaacgacgatctgctgaactctttctggttgctggacagcgaaaaaggcgaagcgcgttgcatcgttgcgaaagcaggttttgcagaagacgaagtggttgcagtaagcaaactgggtgacattgaataccgtgaagttccagtagaagtgaaaccagaagttcgcgttgaaggtggtcaacacctgaacgttaacgttctgcgtcgtgaaactctggaagatgcagttaagcatccggaaaaatatccgcagctgaccatccgtgtatccggttatgcagttcgctttaactctctgactccggaacagcagcgcgacgttatcgctcgtacctttactgaaagcctgtaa

SEQ ID NO: 6240 - protein, 127 aa, Escherichia coli
MITGIQITKAANDDLLNSFWLLDSEKGEARCIVAKAGFAEDEVVAVSKLGDIEYREVPVEVKPEVRVEGGQHLNVNVLRRETLEDAVKHPEKYPQLTIRVSGYAVRFNSLTPEQQRDVIARTFTESL

SEQ ID NO: 6241 - DNA, 690 bp, Escherichia coli
atggctaacgaattaacctggcatgatgtgctggctgaagagaagcagcaaccctattttcttaatacccttcagaccgtcgccagcgagcggcagtccggcgtcactatctatccaccacaaaaagatgtctttaacgcgttccgctttacggagttgggtgacgttaaagtggtgattctcggtcaggatccttatcacggaccaggacaggcgcatggtctggcattttccgttcgccccggcattgcgacaccaccgtcactgctgaatatgtataaagagctggaaaatactattcccggtttcacccgccctaatcatggttaccttgaaagctgggcgcgtcagggtgttctgctgctcaatactgtcttgacggttcgcgctggtcaggcgcattcccacgccagcctcggctgggagacgtttactgataaagtcatcagcctcataaatcagcatcgcgaaggcgtggtgtttttgttgtggggatcacatgcgcaaaagaaaggggcgattatagataagcaacgccatcatgtactgaaagcaccgcatccgtcgccgctttcggcgcatcgtggattctttggctgcaaccattttgtgctggcaaatcagtggctggaacaacgtggcgagacgccgattgactggatgccagtattaccggcagagagtgagtaa

SEQ ID NO: 6242 - protein, 229 aa, Escherichia coli
MANELTWHDVLAEEKQQPYFLNTLQTVASERQSGVTIYPPQKDVFNAFRFTELGDVKVVILGQDPYHGPGQAHGLAFSVRPGIATPPSLLNMYKELENTIPGFTRPNHGYLESWARQGVLLLNTVLTVRAGQAHSHASLGWETFTDKVISLINQHREGVVFLLWGSHAQKKGAIIDKQRHHVLKAPHPSPLSAHRGFFGCNHFVLANQWLEQRGETPIDWMPVLPAESE

SEQ ID NO: 6243 - DNA, 1038 bp, Escherichia coli
atgaacgatgaaatgaaaggtaaaagcggcaaggtcaaagtgatgtatgtccgcagtgatgatgattctgataaacgtacccacaacccgcgtaccgggaaagggggcgggcgtccaggaaaatctcgtgctgacggtggccgtcgccccgcccgcgatgacaaacagagtcagcaccgtgaccgcaagtgggaagattcgccgtggcgcacggtttcccgcgcgccgggtgatgagacgccggaaaaggccgatcacggtggcatcagtggtaaaagttttattgatccggaagttttgcgtcgtcagcgtgcggaagaaacccgcgtctacggcgaaaacgcctgtcaggcactgttccagagccgtccggaagcgattgttcgcgcctggtttatccagagcgtaacgccacgttttaaagaagccttgcgctggatggcggcaaaccgcaaagcgtaccatgtggtggatgaagcggaactgacaaaagcgtcaggcacggaacatcacggcggcgtttgcttcctgatcaaaaagcgtaacggtacaaccgtgcagcagtgggtaagccaggcaggcgcgcaggattgtgtactggccctggaaaacgaatctaacccgcataacctgggcggcatgatgcgtagctgtgcgcacttcggcgtgaaaggtgttgtggtgcaggatgcagcactgctggagtctggggcggctatccgtaccgcagaaggcggcgcagagtacgttcagccgattactggcgacaacattgttaacgtgctggatgatttccgtcaggcgggttacaccgtagtgacaacttccagcgagcagggtaaaccgctgttcaaaaccagtctgccagcgaaaatggtactggtgctgggtcaggaatatgaagggttaccggatgccgcacgcgatccgaacgatctgcgcgtgaagattgatggtactggcaacgttgccgggctgaatatctctgtcgcaaccggcgttcttcttggcgaatggtggcgtcagaataaagcctga

SEQ ID NO: 6244 - protein, 345 aa, Escherichia coli
MNDEMKGKSGKVKVMYVRSDDDSDKRTHNPRTGKGGGRPGKSRADGGRRPARDDKQSQHRDRKWEDSPWRTVSRAPGDETPEKADHGGISGKSFIDPEVLRRQRAEETRVYGENACQALFQSRPEAIVRAWFIQSVTPRFKEALRWMAANRKAYHVVDEAELTKASGTEHHGGVCFLIKKRNGTTVQQWVSQAGAQDCVLALENESNPHNLGGMMRSCAHFGVKGVVVQDAALLESGAAIRTAEGGAEYVQPITGDNIVNVLDDFRQAGYTVVTTSSEQGKPLFKTSLPAKMVLVLGQEYEGLPDAARDPNDLRVKIDGTGNVAGLNISVATGVLLGEWWRQNKA

SEQ ID NO: 6245 - DNA, 96 bp, Escherichia coli
gtgaccgcagcgtccgcattttgccgcatcttcgatccgatcgtcgggaatgcgattgatggcctgacaatgggtacaaacggtattcataactaa

SEQ ID NO: 6246 - protein, 31 aa, Escherichia coli
MTAASAFCRIFDPIVGNAIDGLTMGTNGIHN

SEQ ID NO: 6247 - DNA, 327 bp, Escherichia coli
ttgtttgacggagaggtgattaatgcgaccggtgaaacgctcgacaaattgctgaaagatgatctacctgtggtgatcgacttctgggcaccgtggtgcggcccctgccgtaatttcgcaccaatttttgaagatgtcgcgcaagagcgtagcggtaaagtgcgctttgtgaaagtgaataccgaagctgaacgtgaattgagcagccgctttggtattcgcagtattccgacgatcatgattttcaaaaatggtcaggttgtcgacatgcttaatggcgcagtgccgaaagcgccgttcgatagctggctgaatgaatctctttaa

SEQ ID NO: 6248 - protein, 108 aa, Escherichia coli
MFDGEVINATGETLDKLLKDDLPVVIDFWAPWCGPCRNFAPIFEDVAQERSGKVRFVKVNTEAERELSSRFGIRSIPTIMIFKNGQVVDMLNGAVPKAPFDSWLNESL

SEQ ID NO: 6249 - DNA, 750 bp, Escherichia coli
ttgtgccccgttttctcctctgcgacaatggcgttttttcgacgctcccttatgaccgaaaacgctgttctccagttacgcgccgagcgtattgcgcgtgcaacacgtccttttcttgcccgcggtaatcgcgttcgtcgctgccaacgctgtcttttgccagagaaattatgtctctgttcgacaattaccccagcacaagcaaaaagtcgcttctgtttgctgatgttcgacaccgagccaatgaagcccagtaataccgggcgtctgattgctgatattttgcctgataccgttgcgtttcaatggtcgcgtaccgaaccctcgcaagatttgctggatctggtgcaaaacccggactatcagccaatggtggtctttcccgcttcgtatgctgatgagcaacgggaagtgatcttcacaccacctgccggtaagcctccgctatttatcatgctcgatggtacctggccagaagctcgcaagatgtttcgtaaaagtccgtatctggataatcttcccgtcatttccgtcgatctttctcggctttctgcctatcgcctgcgtgaagcccaggctgaaggccaatattgtactgccgaggtagccatcgcactgttagatatggccggcgataccagggcggcgacagggttaggcgagcattttacccgctttaaaacacgctatctggcaggaaaaacgcaacatccgggaagcatcacagcagaacagttagaaagcgtttaa

SEQ ID NO: 6250 - protein, 249 aa, Escherichia coli
MCPVFSSATMAFFRRSLMTENAVLQLRAERIARATRPFLARGNRVRRCQRCLLPEKLCLCSTITPAQAKSRFCLLMFDTEPMKPSNTGRLIADILPDTVAFQWSRTEPSQDLLDLVQNPDYQPMVVFPASYADEQREVIFTPPAGKPPLFIMLDGTWPEARKMFRKSPYLDNLPVISVDLSRLSAYRLREAQAEGQYCTAEVAIALLDMAGDTRAATGLGEHFTRFKTRYLAGKTQHPGSITAEQLESV

SEQ ID NO: 6251 - DNA, 2661 bp, Escherichia coli
atgagtcagcgaggactggaagcactactgcgaccaaaatcgattgcggtaattggcgcatcgatgaaacccaatcgcgcaggttacctgatgatgcgtaacctgctggcgggaggctttaacggaccggtactcccggtgacgccagcctggaaagcggtgttgggtgtgttggcctggccggatattgcccgcttgccctttacacccgaccttgcggttttatgtaccaatgccagccgtaatcttgctcttctggaagagctcggcgagaaaggctgtaaaacctgcattattctttccgccccggcatcgcaacacgaagatctccgcgcctgcgccctgcgccataacatgcgcctgctaggaccaaacagtctgggcttactggctccctggcaaggtctgaatgccagcttttcacctgtgccgattaaacgcggcaagctggcgtttatttcgcaatcggctgctgtctccaacaccatcctcgactgggcgcaacagcgtgagatgggcttttcctactttattgcgctcggcgacagcctggatatcgacgttgatgaattgctcgactatttggcgcgcgacagtaaaaccagcgccatcctgctctatctcgaacaattaagtgatgcgcgacgttttgtttcggcggcccgtagcgcctcacgtaataaaccgattctggtgattaaaagcggacgtagcccggcggctcaacgtctgttgaacaccacggcaggaatggatccggcgtgggatgcagctattcagcgtgccggtttgttgcgggtacaggacacccacgaactgttttcggcggtggaaacccttagccatatgcgcccgctgcgtggcgaccggttgatgattatcagcaacggtgctgcgcctgccgcgctggcgctggatgccttatggtcacgcaatggcaagctggcaacgctaagcgaagaaacctgccagaaactgcgcgatgcactgccagggcatgtggcaatctctaacccgctcgatctgcgcgatgacgccagcagcgagcattatgtcaaaacgctggacattctgctccacagccaggattttgatgcgctgatggttattcattcgcccagcgccgctgctcccgcaacagaaagcgcgcaagtattaattgaagcggtaaagcatcatccccgcagcaaatatgtctctttgctgacgaactggtgcggcgagcactcctcgcaagaggcacgacgtttattcagcgaagccgggctgccgacctaccgtactccggaaggaaccatcactgcttttatgcatatggtcgagtaccggcgtaatcagaagcaactacgcgaaacgccggcgttgcccagcaatctgacttccaataccgcagaagcgcatcttctgttgcaacatgcgattgccgaaggggctacgtcgctcgatacccatgaagttcagcccatcctgcaagcgtatggtatgaatactctccctacctggattgccagtaatagcaccgaagcggtacatattgccaaacagattggctatccggtggcactgaaattgcgctcgccggatattccacataaatcggaagttcagggcgtcatgctctacctacgtacagccaatgaagtccagcaagcggcaaacgctattttcgatcgcgtaaaaatggcctggccgcaggcgcgggtccacggcctgttggtgcaaagtatggctaaccgtgctggcgctcaggagttgcgggttgtggttgagcacgatccggttttcgggccgttaatcatgctgggtgaaggcggtgtggagtggcgtcctgaagatcaagccgtcgtcgcactgccgccgctgaacatgaacctggcccgctatctggttattcaggggatcaaaagtaaaaagattcgtgcacgcagtgcgctacgcccattggatgttgcaggcttgagccagcttctggtgcaggtttccaacttgattgtcgattgcccggaaattcagcgtctggatattcatcctttgctggcttctggcagtgaatttaccgcgctggatgtcacgctggatatcgcgccgtttgaaggtgataacgagagccggctggctgtgcgcccttatccgcatcagctggaagaatgggtagaattgaaaaacggtgaacgctgcttgttccgcccgattttgccagaagatgagccacagcttcagcaattcatttcgcgagtcaccaaagaagatctttattaccgctactttagcgagatcaacgaatttacccatgaagatttagccaacatgacgcagatcgactacgatcgggaaatggcatttgtagcggtacgacgaattgatcaaacggaagagatcctcggcgtcacacgtgcgatctccgaccctgataacatcgatgccgaatttgccgtgctggttcgctcggatctcaaagggttaggcttaggtcgacgcttaatggaaaagttgattacctatacgcgagatcacggactacaacgtctgaatggtattacgatgccaaacaatcgtggcatggtggcgctggcccgcaagctcgggtttaacgttgatatccagctcgaagaggggatcgttgggcttacgctaaatcttgcccagcgcgaggaatcatga

SEQ ID NO: 6252 - protein, 886 aa, Escherichia coli
MSQRGLEALLRPKSIAVIGASMKPNRAGYLMMRNLLAGGFNGPVLPVTPAWKAVLGVLAWPDIARLPFTPDLAVLCTNASRNLALLEELGEKGCKTCIILSAPASQHEDLRACALRHNMRLLGPNSLGLLAPWQGLNASFSPVPIKRGKLAFISQSAAVSNTILDWAQQREMGFSYFIALGDSLDIDVDELLDYLARDSKTSAILLYLEQLSDARRFVSAARSASRNKPILVIKSGRSPAAQRLLNTTAGMDPAWDAAIQRAGLLRVQDTHELFSAVETLSHMRPLRGDRLMIISNGAAPAALALDALWSRNGKLATLSEETCQKLRDALPGHVAISNPLDLRDDASSEHYVKTLDILLHSQDFDALMVIHSPSAAAPATESAQVLIEAVKHHPRSKYVSLLTNWCGEHSSQEARRLFSEAGLPTYRTPEGTITAFMHMVEYRRNQKQLRETPALPSNLTSNTAEAHLLLQHAIAEGATSLDTHEVQPILQAYGMNTLPTWIASNSTEAVHIAKQIGYPVALKLRSPDIPHKSEVQGVMLYLRTANEVQQAANAIFDRVKMAWPQARVHGLLVQSMANRAGAQELRVVVEHDPVFGPLIMLGEGGVEWRPEDQAVVALPPLNMNLARYLVIQGIKSKKIRARSALRPLDVAGLSQLLVQVSNLIVDCPEIQRLDIHPLLASGSEFTALDVTLDIAPFEGDNESRLAVRPYPHQLEEWVELKNGERCLFRPILPEDEPQLQQFISRVTKEDLYYRYFSEINEFTHEDLANMTQIDYDREMAFVAVRRIDQTEEILGVTRAISDPDNIDAEFAVLVRSDLKGLGLGRRLMEKLITYTRDHGLQRLNGITMPNNRGMVALARKLGFNVDIQLEEGIVGLTLNLAQREES

SEQ ID NO: 6253 - DNA, 1359 bp, Escherichia coli
gtgatgttgtcaaaatttaagcgtaataaacatcaacaacaccttgcccaactacccaagatttctcaatcagttgatgatgtcgatttcttttacgctcccgccgacttccgggagacgctgctggaaaaaatagccagcgcgaagcagcgcatttgcattgtcgccctgtatctcgaacaggatgacggtggcaaaggcattctgaacgcgttgtatgaggctaaaaggcagcgtccggaactggatgtgcgggtgctggtcgactggcatcgtgcacaacgtggacgcattggcgctgcggcatctaacactaacgctgactggtactgccgcatggcgcaggaaaatccgggcgtagatgttccggtttatggcgttccaatcaatacccgtgaagcccttggtgttctgcactttaaaggctttatcatcgacgatagcgtactttatagcggtgccagcctgaacgatgtttacctgcatcagcacgataaatatcgctacgaccgttatcatctgatccgtaaccgtaagatgtcagacattatgtttgaatgggttacacagaatattatgaatggccgcggcgttaatcgtctggatgatgttaatcggccaaaaagcccggaaatcaagaacgatattcgtctgttccgccaggagctgcgtgatgccgcttatcatttccagggcgatgccgacaacgatcagctttccgtaacgccgctagtggggctggggaaatcgagtctgttgaacaagaccattttccatcttatgccttgtgccgagcagaaactaaccatctgtacgccatacttcaacctgccagcaatccttgtgcgcaatattatccagttgctgcgcgaagggaaaaaggtcgaaattattgttggtgataaaaccgcgaatgacttctacattccggaagatgaacctttcaagataattggcgcattgccttatctctatgagatcaatctgcgtcgtttcctgagccgtttgcagtattacgtcaatactgaccagctagtggttcggttatggaaagatgacgacaacacctatcacctgaaagggatgtgggttgatgataagtggatgttgatcaccggtaataacctgaacccacgcgcctggcgtctggatctggaaaacgccattttgatccacgatccacaactggagcttgcgccgcagcgagagaaagaactggagctgatccgcgagcataccaccatcgttaagcactatcgcgatctgcaaagtattgccgattatccggtgaaggttcgtaaactcatccgccgtttgcgccgtatccgcatcgaccgattaattagccgcatcctgtaa

SEQ ID NO: 6254 - protein, 452 aa, Escherichia coli
MMLSKFKRNKHQQHLAQLPKISQSVDDVDFFYAPADFRETLLEKIASAKQRICIVALYLEQDDGGKGILNALYEAKRQRPELDVRVLVDWHRAQRGRIGAAASNTNADWYCRMAQENPGVDVPVYGVPINTREALGVLHFKGFIIDDSVLYSGASLNDVYLHQHDKYRYDRYHLIRNRKMSDIMFEWVTQNIMNGRGVNRLDDVNRPKSPEIKNDIRLFRQELRDAAYHFQGDADNDQLSVTPLVGLGKSSLLNKTIFHLMPCAEQKLTICTPYFNLPAILVRNIIQLLREGKKVEIIVGDKTANDFYIPEDEPFKIIGALPYLYEINLRRFLSRLQYYVNTDQLVVRLWKDDDNTYHLKGMWVDDKWMLITGNNLNPRAWRLDLENAILIHDPQLELAPQREKELELIREHTTIVKHYRDLQSIADYPVKVRKLIRRLRRIRIDRLISRIL

SEQ ID NO: 6255 - DNA, 324 bp, Escherichia coli
ttgcgtattctttttgtctgttcgctattgttactttctggatgcagccatatggctaacgatagctggagcgggcaggataaagctcaacactttatcgcctcggcgatgctttccgccgccggaaatgaatattcacagcatcaggggatgagccgggatcgcagtgccatgtttggattgatgttctctgtcagtctgggggcgtcaaaagagctttgggatagccgccctgaggggagcggctggagctggaaggattttgcctgggatatcgccggtgcaagcaccggctataccgtctggcaactgacccgtcactaa

SEQ ID NO: 6256 - protein, 107 aa, Escherichia coli
MRILFVCSLLLLSGCSHMANDSWSGQDKAQHFIASAMLSAAGNEYSQHQGMSRDRSAMFGLMFSVSLGASKELWDSRPEGSGWSWKDFAWDIAGASTGYTVWQLTRH

SEQ ID NO: 6257 - DNA, 1299 bp, Escherichia coli
atggctgaaagtactgtaacggcagacagcaaactgacaagtagtgatactcgtcgccgtatttgggcaattgttggggcctcttcaggtaatctgatcgagtggttcgatttctatgtctactcgttctgttcactctacttcgcccacatcttcttcccttccgggaacacgacgactcaactactgcaaacagcaggtgtttttgctgcgggatttctgatgcgcccaataggcggttggctatttggccgcatagccgataaacatggtcgcaaaaaatcgatgctattatcggtgtgtatgatgtgtttcggctcactggttatcgcctgtttgccaggctacgaaacaatcggtacctgggctccggcattattgcttcttgctcgtttattccagggattatccgttggcggagaatatggcaccagcgccacctatatgagtgaagttgccgttgaagggcgcaaaggtttttacgcatcatttcagtatgtgacgttgatcggcgggcaactgctagctctactggttgtcgtggttttacaacacaccatggaagacgctgtactcagagagtggggatggcgtattcctttcgcgttaggggctgtgttagctgttgtggcgttgtggttacgtcgtcagttagatgaaacttcacaacaagaaacacgcgctttaaaagaagctggatctctgaaaggattatggcgcaatcgccgtgcattcatcatggttctcggttttaccgctgcggcctccctttgtttctataccttcaccacttatatgcagaagtatctggtaaatactgcgggaatgcatgccaacgtggagagtggcattatgactgccgcattgtttgtattcatgcttattcaaccacttattggcgcgctgtcggataagattggtcgccgtacctcaatgttatgtttcggttctctggcaaccatttttaccgttcctattctctcagcattgcagaacgtttcctcgccttatgccgcttttggtctggtgatgtgcgccctgctgatagtgagtttttatacttcaatcagtggaatactgaaggctgagatgttcccggcacaggttcgcgcattaggcgttggtctgtcatatgcggtcgccaatgctatatttggtggttcggcggagtacgtagcgttgtcgctgaaatcaataggaatggaaacagccttcttctggtatgtgaccttgatggccgtggtggcgtttctggtttcactaacattgcaccgtaaaggaaaagggatgcggctttag

SEQ ID NO: 6258 - protein, 432 aa, Escherichia coli
MAESTVTADSKLTSSDTRRRIWAIVGASSGNLIEWFDFYVYSFCSLYFAHIFFPSGNTTTQLLQTAGVFAAGFLMRPIGGWLFGRIADKHGRKKSMLLSVCMMCFGSLVIACLPGYETIGTWAPALLLLARLFQGLSVGGEYGTSATYMSEVAVEGRKGFYASFQYVTLIGGQLLALLVVVVLQHTMEDAVLREWGWRIPFALGAVLAVVALWLRRQLDETSQQETRALKEAGSLKGLWRNRRAFIMVLGFTAAASLCFYTFTTYMQKYLVNTAGMHANVESGIMTAALFVFMLIQPLIGALSDKIGRRTSMLCFGSLATIFTVPILSALQNVSSPYAAFGLVMCALLIVSFYTSISGILKAEMFPAQVRALGVGLSYAVANAIFGGSAEYVALSLKSIGMETAFFWYVTLMAVVAFLVSLTLHRKGKGMRL

SEQ ID NO: 6259 - DNA, 219 bp, Escherichia coli
ttgagtaaagccggacatgtgtcgcttcgcaggccgttgtatatgcctgcaatggtagccaccagtaagactgagtggggacgggcgttggcagctaatggcaagaaaggaaaggtgattctcggctcgataatgcgcaagctggcacaggtggcgtatggagtgctgaagtcaggcgtgccgttcgatgcgtcacggcataatccggtagctgcgtaa

SEQ ID NO: 6260 - protein, 72 aa, Escherichia coli
MSKAGHVSLRRPLYMPAMVATSKTEWGRALAANGKKGKVILGSIMRKLAQVAYGVLKSGVPFDASRHNPVAA

SEQ ID NO: 6261 - DNA, 333 bp, Escherichia coli
atgctggcagagttctgtcgtcagaagcgccctgcagcctgggaagcgcatcacccgcttgaacgcgcgttgcatgccctggtagtacgccaccaggcgctgacagatatgcacaggcaggaactgaatcgcactgaaacggcgcgggaagtccagaggccgagcattgatgctcaccttctgtggcttgaagcagagctgaagcgtcttgagaagcagataaaagacctgacagacgatgatccggatatgaaacaccgcaggaaactgctggaaagcatcccgggtatcggagagaaaacatctgcggtattgctggcttacatggtctga

SEQ ID NO: 6262 - protein, 110 aa, Escherichia coli
MLAEFCRQKRPAAWEAHHPLERALHALVVRHQALTDMHRQELNRTETAREVQRPSIDAHLLWLEAELKRLEKQIKDLTDDDPDMKHRRKLLESIPGIGEKTSAVLLAYMV

SEQ ID NO: 6263 - DNA, 405 bp, Escherichia coli
atggaacatgaacttcattatatcggtatcgacaccgctaaagagaaactggatgtcgatgtgttgcgtcctgatggtcgtcatcgcaccaaaaaattcgctaacaccactaaagggcacgatgagctggtgagttggctgaaatgtcacaagattgaccatgcgcatatctgcatcgaagcgaccggcacctatatggaacctgtcgcagagtgcctttacgatgctggctacatagtgtcagtcattaatcctgcactgggtaaagctttcgctcagagtgaaggactgcgtaacaagactgataccgtggatgccgcatgctggcagagttctgtcgtcagaagcgccctgcagcctgggaagcgcatcacccgcttgaacgcgcgttgcatgccctggtag

SEQ ID NO: 6264 - protein, 134 aa, Escherichia coli
MEHELHYIGIDTAKEKLDVDVLRPDGRHRTKKFANTTKGHDELVSWLKCHKIDHAHICIEATGTYMEPVAECLYDAGYIVSVINPALGKAFAQSEGLRNKTDTVDAACWQSSVVRSALQPGKRITRLNARCMPW

SEQ ID NO: 6265 - DNA, 690 bp, Escherichia coli
atgcgcatggtcaatcttgtgacatttcagccaactcaccagctcatcgtgccctttagtggtgttagcgaattttttggtgcgatgacgaccatcaggacgcaacacatcgacatccagtttctctttagcggtgtcgataccgatataatgaagttcatgttccatagtgaaaccaaccttgcaaatacggattaccgggaaaaccggtctatgatactgtccggtttatcacttcgggagaaaggcagtccgccgcataaatctaccatacaggttagaacccaaggccggatacggcatgcggactgcaggcagagaaaactggccgattttctctgcactggagggataatacaaggtcggataagatgcgtcgcatccggcatttattccgcaccaacgcaaaaaagcccagtcttccgactgggctcttcgcttaatttgatgcctggcagttccctactctcgcatggggagaccccacactaccatcggcgctacggcgtttcacttctgagttcggcatggggtcaggtgggaccaccgcgctacggccgccaggcaaattctgttttatcaacacgtcctgttctgacctgtcgatttaatctgtatcaggctgaaaatcttctctcaatccgccaaaacagcttcggcgttgtaaggttaagcctcacggttcattag

SEQ ID NO: 6266 - protein, 229 aa, Escherichia coli
MRMVNLVTFQPTHQLIVPFSGVSEFFGAMTTIRTQHIDIQFLFSGVDTDIMKFMFHSETNLANTDYRENRSMILSGLSLREKGSPPHKSTIQVRTQGRIRHADCRQRKLADFLCTGGIIQGRIRCVASGIYSAPTQKSPVFRLGSSLNLMPGSSLLSHGETPHYHRRYGVSLLSSAWGQVGPPRYGRQANSVLSTRPVLTCRFNLYQAENLLSIRQNSFGVVRLSLTVH

SEQ ID NO: 6267 - DNA, 126 bp, Escherichia coli; identical to SEQ ID NO: 637

SEQ ID NO: 6268 - protein, 41 aa, Escherichia coli; identical to SEQ ID NO: 638

SEQ ID NO: 6269 - DNA, 2574 bp, Escherichia coli
atgcgtctggatcgtcttactaataaattccagcttgctcttgccgatgcccaatcacttgcactcgggcacgacaaccaattcatcgaaccacttcatttaatgagcgccctgctgaatcaggaagggggttcggttagtcctttattaacatccgctggcataaatgctggccagttgcgcacagatatcaatcaggcattaaatcgtttaccgcaggttgaaggtactggtggtgatgtccagccatcacaggatctggtgcgcgttcttaatctttgcgacaagctggcgcaaaaacgtggtgataactttatctcgtcagaactgttcgttctggcggcacttgagtctcgcggcacgctggccgacatcctgaaagcagcaggggcgaccaccgccaacattactcaagcgattgaacaaatgcgtggaggtgaaagcgtgaacgatcaaggtgctgaagaccaacgtcaggctttgaaaaaatataccatcgaccttaccgaacgagccgaacagggtaaactcgatccggtgattggtcgtgatgaagaaattcgccgtaccattcaggtgctgcaacgtcgtactaaaaataacccggtactgattggtgaaccaggcgtcggtaagactgccatcgttgaaggtctggcgcagcgtattatcaacggcgaagtgcccgaagggttgaaaggccgccgcgtactggcgctggatatgggcgcgctggtggctggggcgaaatatcgcggtgagtttgaagaacgtttaaaaggcgtacttaacgatcttgccaaacaggaaggcaacgtcatcctgtttatcgacgaattacataccatggtcggcgcgggtaaagccgatggcgcaatggacgccggaaacatgctgaaaccggcgctggcgcgtggtgaattgcactgcgtaggtgccacgacgcttgacgaatatcgccagtacatcgaaaaagatgctgcgctggaacgtcgtttccagaaagtgtttgttgccgagccttctgttgaagataccattgcgattctgcgtggcctgaaagaacgttacgagctgcaccaccatgtgcaaattactgacccggcaattgttgcagcggcgacgttgtctcatcgctacattgctgaccgtcagctgccggataaagccatcgacctgatcgatgaagcagcatccagcattcgtatgcagattgactcaaaaccagaagaactcgaccgactcgatcgtcgtatcatccagctcaaactggaacaacaggcgttaatgaaagagtctgatgaagccagtaaaaaacgcctggatatgctcaacgaagaactgagcgacaaagaacgtcagtactccgagttagaagaagagtggaaagcagagaaagcctcgctttctggtacgcagaccattaaagcggaactggaacaggcgaaaatcgctattgaacaggctcgccgtgtgggtgacctggcgcggatgtctgaactgcaatacggcaaaatcccggaactggaaaagcaactggaagccgcaacgcagctcgaaggcaaaactatgcgtctgttgcgtaataaagtgaccgatgccgaaattgctgaagtgctggcgcgttggacgggaattccggtttctcgcatgatggaaagcgagcgcgaaaaactgctgcgtatggagcaagaactgcatcatcgcgttattggtcagaacgaagcggttgatgcggtatctaacgctattcgtcgtagccgtgcggggctggcggatccaaatcgcccgattggttcattcctgttcctcggcccaacgggtgtggggaaaacagagctttgtaaggcgctggcgaactttatgtttgatagcgacgaggcgatggtccgtattgatatgtccgagtttatggagaaacactcggtgtctcgtctggttggtgcgcctccgggatatgttggttatgaagaaggtggctatctgaccgaagcggtgcgtcgtcgtccgtattccgtcatcctgctggatgaagtggaaaaagcgcatccggatgtcttcaacattctgttgcaggtactggatgatgggcgtctgactgacgggcaggggagaacggtcgacttccgtaatacggtcgtcattatgacctctaacctcggttctgatctgattcaggaacgttttggtgaactggattatgcgcacatgaaagagctggtgctcggtgtggtaagccataacttccgtccggaattcattaaccgtatcgatgaagtcgtcgtcttccatccgctgggtgaacaacacattgcgtcgattgcgcagattcagttgaaacgtctgtacaaacgtctggaagaacgtggttatgaaatccacatttctgacgaggtgctgaaactgctgagcgagaacggttacgatccggtctatggtgcacgtcctctgaagcgtgctatccagcagcagatcgaaaacccgctggcacagcaaatactgtctggtgaattggttccgggtaaagttattcgcctggaagttaatgaagaccggatcgtcgccgtccagtaa

SEQ ID NO: 6270 - protein, 857 aa, Escherichia coli
MRLDRLTNKFQLALADAQSLALGHDNQFIEPLHLMSALLNQEGGSVSPLLTSAGINAGQLRTDINQALNRLPQVEGTGGDVQPSQDLVRVLNLCDKLAQKRGDNFISSELFVLAALESRGTLADILKAAGATTANITQAIEQMRGGESVNDQGAEDQRQALKKYTIDLTERAEQGKLDPVIGRDEEIRRTIQVLQRRTKNNPVLIGEPGVGKTAIVEGLAQRIINGEVPEGLKGRRVLALDMGALVAGAKYRGEFEERLKGVLNDLAKQEGNVILFIDELHTMVGAGKADGAMDAGNMLKPALARGELHCVGATTLDEYRQYIEKDAALERRFQKVFVAEPSVEDTIAILRGLKERYELHHHVQITDPAIVAAATLSHRYIADRQLPDKAIDLIDEAASSIRMQIDSKPEELDRLDRRIIQLKLEQQALMKESDEASKKRLDMLNEELSDKERQYSELEEEWKAEKASLSGTQTIKAELEQAKIAIEQARRVGDLARMSELQYGKIPELEKQLEAATQLEGKTMRLLRNKVTDAEIAEVLARWTGIPVSRMMESEREKLLRMEQELHHRVIGQNEAVDAVSNAIRRSRAGLADPNRPIGSFLFLGPTGVGKTELCKALANFMFDSDEAMVRIDMSEFMEKHSVSRLVGAPPGYVGYEEGGYLTEAVRRRPYSVILLDEVEKAHPDVFNILLQVLDDGRLTDGQGRTVDFRNTVVIMTSNLGSDLIQERFGELDYAHMKELVLGVVSHNFRPEFINRIDEVVVFHPLGEQHIASIAQIQLKRLYKRLEERGYEIHISDEVLKLLSENGYDPVYGARPLKRAIQQQIENPLAQQILSGELVPGKVIRLEVNEDRIVAVQ

SEQ ID NO: 6271 - DNA, 732 bp, Escherichia coli
atgagtaagctgattgtcccgcagtggccgctgccaaaaggtgttgcggcctgtagctctacccgtatcggcggcgtgagcttacccccgtatgactcgctcaacctcggtgcccattgtggcgataacccggatcacgttgaggagaatcgcaagcgactttttgctgcgggcaatttgccttctaaaccggtctggcttgagcaggtacacggcaaagacgtgcttaagcttattggcgaaccttatgcctcaaaacgagcagatgcctcttatagcaatacgcctggcacggtttgcgctgtgatgactgccgactgcctgcccgtgctgttttgcaatcgtgcgggaacggaagtcgccgccgctcatgctggctggcgtggactgtgcgcaggcgtgctggaagagacagtttcctgttttgctgataatccagaaaatattctcgcctggttagggccggcaattggtccacgcgcgtttgaagtgggggcggaggttcgcgaggcgtttatggcagtagacgccgaagcgagtacagctttcattcagcatggtgataagtatctggcggatatttatcagcttgcccggcagcgtctggcgagcgttggtgttgaacaaattttcggcggcgaccgttgtacatatacggaaaatgagactttcttctcttatcgtcgcgacaagaccaccggtcgtatggcaagtttcatttggctgatataa

SEQ ID NO: 6272 - protein, 243 aa, Escherichia coli
MSKLIVPQWPLPKGVAACSSTRIGGVSLPPYDSLNLGAHCGDNPDHVEENRKRLFAAGNLPSKPVWLEQVHGKDVLKLIGEPYASKRADASYSNTPGTVCAVMTADCLPVLFCNRAGTEVAAAHAGWRGLCAGVLEETVSCFADNPENILAWLGPAIGPRAFEVGAEVREAFMAVDAEASTAFIQHGDKYLADIYQLARQRLASVGVEQIFGGDRCTYTENETFFSYRRDKTTGRMASFIWLI

SEQ ID NO: 6273 - DNA, 981 bp, Escherichia coli
atggcacaacgagtacagctcactgcaacggtgtccgaaaaccaactcggtcaacgcttagatcaggctttggccgaaatgttcccggattattcacgttcgcgaataaaagaatggatcctcgaccagcgcgtgctggttaacggcaaagtttgtgataagccgaaagaaaaagtattgggtggcgagcaggtggccatcaacgctgagattgaagaagaagcgcgttttgaaccgcaggatatcccgctggatatcgtctatgaagatgaagatatcatcgtcattaataaaccacgcgacctggtggtacatcctggcgcgggtaacccggatggtacggtactgaatgcgttgcttcattactatccgcccattgccgatgtaccgcgtgcgggcatcgtccatcgtctggataaagacaccaccggcctgatggttgtggcaaaaaccgttccggctcagacgcgtttagtcgaatctttgcaacggcgtgaaattactcgtgagtatgaagcggtggcaattggtcatatgaccgctggcggtacagtagatgaaccaatcagccgccacccgaccaaacgtactcacatggcggtgcatccgatgggtaaaccggcggtcactcactatcgcatcatggaacacttccgtgtgcacacgcgtctgcggttgcgtctggaaactggacgtacgcaccagatccgcgtgcatatggcccatatcactcatccgctggtgggcgatccggtttatggtggccgtccgcgtccgccaaaaggtgcttcggaagcgtttatctccacgctgcgtaagtttgaccgccagtcgcttcatgcaaccatgctgcgtctttatcacccgatctccggtatcgaaatggaatggcatgcgcctattccacaagatatggtggagctgattgaggtgatgcgcgccgatttcgaagagcataaggatgaagtggactggttatga

SEQ ID NO: 6274 - protein, 326 aa, Escherichia coli
MAQRVQLTATVSENQLGQRLDQALAEMFPDYSRSRIKEWILDQRVLVNGKVCDKPKEKVLGGEQVAINAEIEEEARFEPQDIPLDIVYEDEDIIVINKPRDLVVHPGAGNPDGTVLNALLHYYPPIADVPRAGIVHRLDKDTTGLMVVAKTVPAQTRLVESLQRREITREYEAVAIGHMTAGGTVDEPISRHPTKRTHMAVHPMGKPAVTHYRIMEHFRVHTRLRLRLETGRTHQIRVHMAHITHPLVGDPVYGGRPRPPKGASEAFISTLRKFDRQSLHATMLRLYHPISGIEMEWHAPIPQDMVELIEVMRADFEEHKDEVDWL

SEQ ID NO: 6275 - DNA, 738 bp, Escherichia coli
atgacgcgcatgaaatatctggtggcagccgccacactaagcctgtttttggcgggttgctcggggtcaaaggaagaagtacctgataatccgccaaatgaaatttacgcgactgcacaacaaaagctgcaggacggtaactggagacaggcaataacgcaactggaagcgttagataatcgctatccgtttggtccgtattcgcagcaggtgcagctggatctcatctacgcctactataaaaacgccgatttgccgttagcacaggctgccatcgatcgttttattcgccttaacccgacccatccgaatatcgattatgtcatgtacatgcgtggcctgaccaatatggcgctggatgacagtgcgctgcaagggttctttggcgttgaccgtagcgatcgcgatcctcaacatgcacgagctgcgtttagtgacttttccaaactggtgcgcggctatccgaacagtcagtacaccaccgatgccaccaaacgtctggtattcctgaaagatcgtctggcgaaatatgaatactccgttgccgagtattatacagaacgtggtgcatgggttgctgtcgttaaccgcgtagaaggcatgttgcgcgactatccggatacccaggctacgcgtgatgcgctgccgctgatggaaaatgcataccgtcagatgcagatgaatgcgcaagctgaaaaagtagcgaaaatcatcgccgcaaacagcagcaatacataa

SEQ ID NO: 6276 - protein, 245 aa, Escherichia coli [sequence omitted]

SEQ ID NO: 6277 - DNA, 342 bp, Escherichia coli
atgacaatgaacattaccagcaaacaaatggaaattactccggccatccgccaacatgtcgcagaccgtctcgccaaactggaaaaatggcaaacacatctgattaatccacatatcattctgtccaaagagccacaagggtttgttgctgacgccacaatcaatacacctaacggcgttctggttgccagtggtaaacatgaagatatgtacaccgcaattaacgaattgatcaacaagctggaacggcagctcaataaactgcagcacaaaggcgaagcacgtcgtgccgcaacatcggtgaaagacgccaacttcgtcgaagaagttgaagaagagtag

SEQ ID NO: 6278 - protein, 113 aa, Escherichia coli
MTMNITSKQMEITPAIRQHVADRLAKLEKWQTHLINPHIILSKEPQGFVADATINTPNGVLVASGKHEDMYTAINELINKLERQLNKLQHKGEARRAATSVKDANFVEEVEEE

SEQ ID NO: 6279 - DNA, 1161 bp, Escherichia coli
atgacatcggaaaacccgttactggcgctgcgagagaaaatcagcgcgctggatgaaaaattattagcattactggcagagcgacgcgaactggccgtcgaggtgggaaaagccaaactgctctcgcatcgcccggtacgtgatattgatcgtgaacgcgatttgctggaaagattaattacgctcggtaaagcgcaccatctggacgcccattacattactcgcctgttccagctcatcattgaagattccgtattaactcagcaggctttgctccagcaacatctcaataaaattaatccgcactcagcacgcatcgcttttctcggccccaaaggttcttattcccatcttgcggcgcgccagtatgctgcccgtcactttgagcaattcattgaaagtggctgcgccaaatttgccgatatttttaatcaggtggaaaccggccaggccgactatgccgtcgtaccgattgaaaataccagctccggtgccataaacgacgtttacgatctgctgcaacataccagtttgtcgattgttggcgagatgacgttaactatcgatcattgtttgttggtctccggcactactgatttatccgccatcaatacggtctacagccatccgcagccattccagcaatgcagcaaattccttaatcgttatccgcactggaagattgaatataccgaaagtacgtctgcggcaatggaaaaggttgcacaggcaaaatcaccgcatgttgctgcgttgggaagcgaagctggcggcactttgtacggtttgcaggtactggagcgtattgaagcgaatcagcgacaaaacttcacccgatttgtggtgttggcacgtaaagccattaacgtttctgaccaggttccggcgaaaacgacgttgttaatggcgaccggacaacaagctggtgcactggttgaagcgttgctggtactgcgcaatcacagtctgattatgacccgtctggaatcacgtccgattcacggtaatccgtgggaagagatgttttatctggatattcaggccaatcttgaatcagcggaaatgcaaaaagcattgaaagagttaggggaaatcacccgttcgatgaaggtattgggctgttacccaagtgagaacgtagtgcctgttgatccaacctga

SEQ ID NO: 6280 - protein, 386 aa, Escherichia coli
MTSENPLLALREKISALDEKLLALLAERRELAVEVGKAKLLSHRPVRDIDRERDLLERLITLGKAHHLDAHYITRLFQLIIEDSVLTQQALLQQHLNKINPHSARIAFLGPKGSYSHLAARQYAARHFEQFIESGCAKFADIFNQVETGQADYAVVPIENTSSGAINDVYDLLQHTSLSIVGEMTLTIDHCLLVSGTTDLSAINTVYSHPQPFQQCSKFLNRYPHWKIEYTESTSAAMEKVAQAKSPHVAALGSEAGGTLYGLQVLERIEANQRQNFTRFVVLARKAINVSDQVPAKTTLLMATGQQAGALVEALLVLRNHSLIMTRLESRPIHGNPWEEMFYLDIQANLESAEMQKALKELGEITRSMKVLGCYPSENVVPVDPT

SEQ ID NO: 6281 - DNA, 1122 bp, Escherichia coli
atggttgctgaattgaccgcattacgcgatcaaattgatgaagtcgataaagcgctgctgaatttattagcgaagcgtctggaactggttgctgaagtgggcgaggtgaaaagccgctttggactgcctatttatgttccggagcgcgaggcatctatgttggcctcgcgtcgtgcagaggcggaagctctgggtgtaccgccagatctgattgaggatgttttgcgtcgggtgatgcgtgaatcttactccagtgaaaacgacaaaggatttaaaacgctttgtccgtcactgcgcccggtggttatcgtcggtggtggcggtcagatgggacgtctgttcgagaagatgctgacactctcgggttatcaggtgcggattctggagcaacatgactgggatcgagcggctgatattgtttccgatgccggaatggtgattgttagtgtgcccatccacgttactgagcaagttatcggcaaattaccgcctttaccgaaagattgtattctggttgatctggcatcggtgaaaaatggaccattacaggccatgctggcggcgcacgatggcccggtgctggggttacacccgatgttcggcccggacagcggtagcctggcaaagcaagttgtggtctggtgtgatggacgtaagccggaagcataccaatggtttctggagcaaattcaggtctggggcgctcggttgcatcgtattagcgctgtcgagcacgatcagaatatggcgtttattcaggctctgcgccactttgctacttttgcttatgggctgcacctggcagaagaaaatgttcagcttgagcaactactggcgctctcttcgccgatttaccgccttgagctggcgatggtcgggcgactgtttgctcaggatccgcagctttatgccgacattattatgtcgtcagagcgtaatctggcgttaatcaaacgttactataagcgtttcggcgaggcgattgagctgctggagcagggcgataagcaggcgtttattgacagtttccgcaaggtggagcactggttcggcgattacgcacagcgttttcagagtgaaagccgcgtgttattgcgtcaggcgaatgacaatcgccagtaa

SEQ ID NO: 6282 - protein, 373 aa, Escherichia coli
MVAELTALRDQIDEVDKALLNLLAKRLELVAEVGEVKSRFGLPIYVPEREASMLASRRAEAEALGVPPDLIEDVLRRVMRESYSSENDKGFKTLCPSLRPVVIVGGGGQMGRLFEKMLTLSGYQVRILEQHDWDRAADIVSDAGMVIVSVPIHVTEQVIGKLPPLPKDCILVDLASVKNGPLQAMLAAHDGPVLGLHPMFGPDSGSLAKQVVVWCDGRKPEAYQWFLEQIQVWGARLHRISAVEHDQNMAFIQALRHFATFAYGLHLAEENVQLEQLLALSSPIYRLELAMVGRLFAQDPQLYADIIMSSERNLALIKRYYKRFGEAIELLEQGDKQAFIDSFRKVEHWFGDYAQRFQSESRVLLRQANDNRQ

SEQ ID NO: 6283 - DNA, 1140 bp, Escherichia coli
atgtgttatcgttacgtcatcctcgctgaggatcaactatcgcaaacgagcataaacaggatcgccatcatgcagaaagacgcgctgaataacgtacatattaccgccgaacaggttttaatgactccggaacaactgaaggccgcttttccattaagcctgcaacaagaagcccagattgctgactcgcgtaaaaccatttcagatattatcgccgggcgcgatcctcgtctgctggtagtatgtggtccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgatggcagtctggcaacggcaattaacgctatgcgtgccgccgcccagccgcaccgttttgttggcattaaccaggcagggcaggttgcgttgctacaaactcaggggaatccggacgggcatgtgatcctgcgcggtggtaaagcgccaaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaa

SEQ ID NO: 6284 - protein, 379 aa, Escherichia coli
MCYRYVILAEDQLSQTSINRIAIMQKDALNNVHITAEQVLMTPEQLKAAFPLSLQQEAQIADSRKTISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHRFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 6285 - DNA, 366 bp, Escherichia coli
atgatgaaaaaatttatcgcccccttgttggctttactggttagcggatgtcagattgatccttatactcacgcgccaaccttgaccagcaccgactggtatgatgttggtatggaagatgcgatatcgggcagcgccattaaagatgacgatgcatttagcgattcacaggcggatcgcggtctataccttaaaggatatgccgaagggcaaaagaaaacttgccagaccgattttacttatgcccggggactttctggtaaaagctttcctgccagctgcaataatgttgaaaatgccagccaactgcatgaagtatggcgaaaaggggctgatgaaaatgccagcacaatacgattaaattaa

SEQ ID NO: 6286 - protein, 121 aa, Escherichia coli
MMKKFIAPLLALLVSGCQIDPYTHAPTLTSTDWYDVGMEDAISGSAIKDDDAFSDSQADRGLYLKGYAEGQKKTCQTDFTYARGLSGKSFPASCNNVENASQLHEVWRKGADENASTIRLN

SEQ ID NO: 6287 - DNA, 519 bp, Escherichia coli
atgcgtttttctcaccgactgttcttactgctgattctcctgctgacgggagcaccaatactcgctcaggaaccttctgacgttgcgaaaaacgtgcgtatgatggtttccggtattgtcagttacacccgctggcctgggctatcagggccaccaaagttatgtatcttttcatcttcacgttttagtaccgccttacaagaaaatgctgctacatctttgccttatctgcctgtcatcattcatactcaacaagaggcgataatttcaggctgcaatggtttttattttggcaacgagtcaccgacattccagatggaattaaccgaacaatatccgtcaaaggcgttattattaattgccgaacaaaataccgagtgcattattggtagcgccttttgtctgatcatccacaataatgacgtcagatttgccgtaaacctggatgctttatctcgtagcggtgtaaaagtcaacccggatgtcttaatgctcgcacggaagaaaaatgatggataa

SEQ ID NO: 6288 - protein, 172 aa, Escherichia coli
MRFSHRLFLLLILLLTGAPILAQEPSDVAKNVRMMVSGIVSYTRWPGLSGPPKLCIFSSSRFSTALQENAATSLPYLPVIIHTQQEAIISGCNGFYFGNESPTFQMELTEQYPSKALLLIAEQNTECIIGSAFCLIIHNNDVRFAVNLDALSRSGVKVNPDVLMLARKKNDG

SEQ ID NO: 6289 - DNA, 1224 bp, Escherichia coli
atggataacgataattctcttaataagcgccccacgtttaaaagagcattacgcaacatcagtatgaccagcatatttatcactatgatgctgatctggctgctgctttccgtgacgtcagtgctgaccctgaaacagtacgcgcaaaaaaacctggcactgacagcagcaacaatgacttacagtctggaagcagctgtcgtttttgccgatggccctgcagcaactgaaacactggcagcgctgggccagcaaggccaattttcaactgcagaagtgcgtgataagcagcaaaatattctggcatcctggcattacacccataaggaaccaggcgatactttcagcaatttcataagccactggctcttccctgcccccatcattcagccgattcgccacaatggtgaaactattggcgaagtacgcttaactgctcgcgacagttcaatcagccattttatctggttttcgctcgctgtcctgaccggttgtattctgctggcatcaggcatcgcaattaccctcacccgccatttgcacaatggcctggtggaagcgctgaaaaatatcaccgatgtcgtacatgatgtgcgttctaaccgcaatttttcccgacgagtttcggaagaacgtatcgctgagtttcaccgcttcgctctcgacttcaacagtctgctggatgaaatggaagagtggcagcttcgtttacaggccaaaaatgcgcagcttctacgtaccgcgctacatgacccattaaccgggctggctaaccgcgcagcgtttcgtagcggcatcaacacgttgatgaacaattccgatgcccgaaaaacgtcggcgttactatttcttgatggcgataatttcaaatatatcaatgatacctggggtcatgcgacgggcgatagagtcttgattgaaatagcaaaacggttagctgaatttggcgggctgcgacataaagcataccgcctgggcggcgatgaattcgctatggtgctctatgatgtacagtcggaatctgaagtgcagcagatatgctcagcactgacacaaatttttaatctcccgtttgatcttcataatggccatcaaactaccatgacattaagcattggttacgcgatgactattgagcacgcctctgcggaaaatttacaagagcttgccgatcacaatatgtatcaggccaaacaccagcgtgccgaaaagctggtgagataa

SEQ ID NO: 6290 - protein, 407 aa, Escherichia coli
MDNDNSLNKRPTFKRALRNISMTSIFITMMLIWLLLSVTSVLTLKQYAQKNLALTAATMTYSLEAAVVFADGPAATETLAALGQQGQFSTAEVRDKQQNILASWHYTHKEPGDTFSNFISHWLFPAPIIQPIRHNGETIGEVRLTARDSSISHFIWFSLAVLTGCILLASGIAITLTRHLHNGLVEALKNITDVVHDVRSNRNFSRRVSEERIAEFHRFALDFNSLLDEMEEWQLRLQAKNAQLLRTALHDPLTGLANRAAFRSGINTLMNNSDARKTSALLFLDGDNFKYINDTWGHATGDRVLIEIAKRLAEFGGLRHKAYRLGGDEFAMVLYDVQSESEVQQICSALTQIFNLPFDLHNGHQTTMTLSIGYAMTIEHASAENLQELADHNMYQAKHQRAEKLVR

SEQ ID NO: 6291 - DNA, 483 bp, Escherichia coli
atgataaagcacctgctagcacccctgattttcacctcgctaatacttactggctgccagtcccctcagggaaagtttactcctgagcaagtcgccgctatgcaatcttatggatttactgaatccgccggcgactggtcgctgggcttatcagatgccattctgtttgcaaaaaatgactacaaattgctcccggaaagccagcaacagatccaaaccatggcagccaaattggcctcgacagggctaacacatgcccgtatggatggacacaccgacaactatggtgaagacagttacaacgaagtcttatcattgaaacgggcgaatgtcgtggccgatgcatgggctatgggtggacaaattccgcgcagcaatctcaccacacagggtttaggaaaaaaatatcccatagccagtaacaagaccgcccagggccgcgccgagaaccgccgcgtcgcagtggtgattacaaccccttaa

SEQ ID NO: 6292 - protein, 160 aa, Escherichia coli
MIKHLLAPLIFTSLILTGCQSPQGKFTPEQVAAMQSYGFTESAGDWSLGLSDAILFAKNDYKLLPESQQQIQTMAAKLASTGLTHARMDGHTDNYGEDSYNEVLSLKRANVVADAWAMGGQIPRSNLTTQGLGKKYPIASNKTAQGRAENRRVAVVITTP

SEQ ID NO: 6293 - DNA, 348 bp, Escherichia coli
atgagcaacattattaagcaacttgaacaagagcagatgaagcaggacgtaccttccttccgtccgggtgataccgtggaagtgaaagtatgggttgttgaaggttccaaaaaacgtctgcaggcattcgagggcgtggttatcgctattcgtaaccgcggtctgcactctgcattcactgttcgtaaaatttccaacggcgaaggcgttgagcgtgtcttccagactcactctccggtagttgacagcatttctgtcaaacgtcgtggtgctgttcgtaaagctaaactgtactacctgcgtgagcgtactggtaaggctgctcgtatcaaagagcgtcttaactaa

SEQ ID NO: 6294 - protein, 115 aa, Escherichia coli [sequence omitted]

SEQ ID NO: 6295 - DNA, 768 bp, Escherichia coli
atgtggattggcataattagcctgtttcctgaaatgttccgcgcaattaccgattacggggtaactggccgggcagttaaaaatggcctgctgagcatccagagctggagtcctcgcgacttcacgcatgaccggcaccgtaccgtggacgatcgtccttacggcggcggaccggggatgttaatgatggtgcaacccttgcgggacgccattcatgcagcaaaagccgcggcgggtgaaggcgcaaaggtgatttatctgtcaccacagggacgcaagcttgatcaagcgggcgtcagcgaactggcaacgaatcaaaaattgattctggtgtgtggtcgctacgaaggtatagatgagcgcgtgatccaaaccgaaattgacgaagaatggtcaatcggcgattacgttctcagtggtggtgagttaccagcaatgacgctgattgactccgtttcccggtttattccgggagtactgggacatgaagcctcggcaacggaagattcctttgctgaaggattgctggattgcccgcactatacgcggcctgaggtgttagaagggatggaagttccgccagtgttactgtcgggtaaccatgccgagatacgtcgctggcgtttgaaacagtcgctgggccgtacctggcttagaagacctgaacttctggaaaacctggctctgactgaagagcaagcaaggttgctggcggagttcaaaacggaacacgcacaacagcaacataaacatgatgggatggcgtaa

SEQ ID NO: 6296 - protein, 255 aa, Escherichia coli
MWIGIISLFPEMFRAITDYGVTGRAVKNGLLSIQSWSPRDFTHDRHRTVDDRPYGGGPGMLMMVQPLRDAIHAAKAAAGEGAKVIYLSPQGRKLDQAGVSELATNQKLILVCGRYEGIDERVIQTEIDEEWSIGDYVLSGGELPAMTLIDSVSRFIPGVLGHEASATEDSFAEGLLDCPHYTRPEVLEGMEVPPVLLSGNHAEIRRWRLKQSLGRTWLRRPELLENLALTEEQARLLAEFKTEHAQQQHKHDGMA

SEQ ID NO: 6297 - DNA, 558 bp, Escherichia coli
gtggtcatgatgagcaaacaactcaccgcgcaagcacctgttgatcccatcgttttgggaaaaatggggtcgtcttacggtattcgtgggtggctcagagtgttttcttccaccgaagacgccgaaagcatttttgactatcagccctggtttatccagaaggcgggtcagtggcagcaagtccagctggaaagctggaagcaccacaatcaggacatgatcatcaagctgaaaggcgttgacgatcgtgatgcggcgaacctgctgacgaattgtgaaattgtcgtggattcatcgcagttgcctcagcttgaagagggggactactactggaaagacctgatgggctgccaggtagtaaccactgaaggctacgatctcggtaaagtcgtagatatgatggaaaccggatctaatgacgttctcgtcattaaggcaaacctgaaagatgcgtttggtatcaaggaacgtctcgtaccgttcctcgatgggcaggttatcaagaaagtcgatctcactacacgttcaatcgaagtagattgggatcctggtttttaa

SEQ ID NO: 6298 - protein, 185 aa, Escherichia coli
MVMMSKQLTAQAPVDPIVLGKMGSSYGIRGWLRVFSSTEDAESIFDYQPWFIQKAGQWQQVQLESWKHHNQDMIIKLKGVDDRDAANLLTNCEIVVDSSQLPQLEEGDYYWKDLMGCQVVTTEGYDLGKVVDMMETGSNDVLVIKANLKDAFGIKERLVPFLDGQVIKKVDLTTRSIEVDWDPGF

SEQ ID NO: 6299 - DNA, 309 bp, Escherichia coli
atgacaccggactccgttcctcgatggggtccggttgttttattcacacaagaggatgttatggtaactattcgtttagcacgtcacggcgctaaaaagcgtccgttctaccaggttgttgtcgctgacagccgtaatgcacgcaacggtcgcttcatcgagcgcgttggtttcttcaacccaatcgctagcgaaaaagaagaaggcactcgcctggatctggatcgcatcgctcactgggttggccagggcgcaactatttctgatcgcgttgctgcgctgatcaaagaagtaaacaaagcagcttaa

SEQ ID NO: 6300 - protein, 102 aa, Escherichia coli
MTPDSVPRWGPVVLFTQEDVMVTIRLARHGAKKRPFYQVVVADSRNARNGRFIERVGFFNPIASEKEEGTRLDLDRIAHWVGQGATISDRVAALIKEVNKAA

SEQ ID NO: 6301 - DNA, 1362 bp, Escherichia coli
atgtttgataatttaaccgatcgtttgtcgcgcacgctgcgcaatatcagtggccgtggacgcctcactgaagacaacgtaaaagatacgctgcgcgaagtgcgcatggcgctgctggaggcggacgtcgctctgccggtagtgcgtgagtttatcaatcgcgtaaaagagaaagcggttggtcatgaagttaataagagcctgacgccggggcaggagttcgtcaaaattgtccgtaacgaactggttgcggcgatgggcgaagagaaccagaccctgaacctggctgcgcaaccgcctgcggtcgtgctgatggcgggcctgcaaggtgccggtaaaacaaccagcgttggtaaactcggtaagttcctgcgcgagaagcacaagaagaaagtgctggtggtttctgccgacgtctatcgcccggcggcaatcaaacagcttgagacgctggcagagcaggtgggcgttgatttcttcccttctgatgttggtcagaagccggtagatatcgttaacgcggcgctgaaagaagccaaactgaaattctacgacgtgctgctggtggatactgccggtcgtctgcacgttgacgaagcgatgatggacgagatcaaacaagtccatgcgtcgattaatccggttgaaaccctgtttgtggtcgatgccatgaccggtcaggatgcggccaatacggcaaaagcattcaatgaagcgttaccgcttaccggtgtagtgttgaccaaagtggacggcgatgcccgcggcggtgcggcgctctctattcgtcacatcactggcaaaccgatcaagttcctcggtgttggcgagaaaaccgaggcgctggagccattccatccggaccgtattgcctcccgtattctcggcatgggcgacgtactgtcactgatcgaagatatcgaaagcaaggttgaccgcgcgcaggcagagaaattagccagcaagctgaaaaaaggcgacggcttcgatctcaacgactttcttgagcagctgcgccagatgaaaaatatgggcggcatggctagcctgatgggcaagctgccgggcatggggcagatcccggataacgtcaagtcacagatggacgataaagtgctggtgcgtatggaagccatcatcaactcgatgacgatgaaagagcgcgctaagccagaaatcatcaaaggttcgcgtaagcgtcgtatcgctgccggttgcggtatgcaggtgcaggacgttaaccgtcttctgaaacagttcgacgacatgcagcgcatgatgaagaaaatgaaaaagggcgggatggcgaagatgatgagaagcatgaaagggatgatgccgccgggatttcctggtcgctaa

SEQ ID NO: 6302 - protein, 453 aa, Escherichia coli
MFDNLTDRLSRTLRNISGRGRLTEDNVKDTLREVRMALLEADVALPVVREFINRVKEKAVGHEVNKSLTPGQEFVKIVRNELVAAMGEENQTLNLAAQPPAVVLMAGLQGAGKTTSVGKLGKFLREKHKKKVLVVSADVYRPAAIKQLETLAEQVGVDFFPSDVGQKPVDIVNAALKEAKLKFYDVLLVDTAGRLHVDEAMMDEIKQVHASINPVETLFVVDAMTGQDAANTAKAFNEALPLTGVVLTKVDGDARGGAALSIRHITGKPIKFLGVGEKTEALEPFHPDRIASRILGMGDVLSLIEDIESKVDRAQAEKLASKLKKGDGFDLNDFLEQLRQMKNMGGMASLMGKLPGMGQIPDNVKSQMDDKVLVRMEAIINSMTMKERAKPEIIKGSRKRRIAAGCGMQVQDVNRLLKQFDDMQRMMKKMKKGGMAKMMRSMKGMMPPGFPGR

SEQ ID NO: 6303 - DNA, 867 bp, Escherichia coli
atgcaacggttggagcagcgttcacctgacgctatactgcttctctttcttattgctcaaactgtcgacattactatgcccgtttttgctctgctcgcgcttgtcgcctactccgtcagtcttgcgctgattgttcccggtctgctgcaaaaaaacggcggctggcggcgcatggctattatttctgcggtcatcgcgctggtctgccacgcaatcgctctggaagcccgcatcctgcccgacggtgatagcggacaaaacctcagcctgctgaacgttggttcattggtcagtttgatgatctgtacggtaatgaccattgtggcttctcgcaatcgtggctggttgttgctacccattgtctatgcctttgcgcttatcaacctggcgctggcgaccttcatgcccaatgaatacatcacccatctggaagcaacgccggggatgctggtgcacattggcttatcgcttttttcctatgccacgctaattatcgctgccctgtacgcgctgcaactggcgtggattgattaccaactgaagaacaagaagctggcgtttaaccaggaaatgcctccattgatgagtatcgagcgtaaaatgttccatatcacgcagattggcgtggtgctgctaacgctcactctttgcactggcctgttctacatgcacaacttatttagcatggaaaatatcgacaaggccgtgctctctatcgtggcgtggtttgtctatattgtgctgctgtggggacattatcatgaaggatggcgtggacgccgcgtcgtctggtttaacgttgcgggtgcagtcattctgacactggcctacttcggcagccgaattgtccagcagttaatcagctaa

SEQ ID NO: 6304 - protein, 288 aa, Escherichia coli
MQRLEQRSPDAILLLFLIAQTVDITMPVFALLALVAYSVSLALIVPGLLQKNGGWRRMAIISAVIALVCHAIALEARILPDGDSGQNLSLLNVGSLVSLMICTVMTIVASRNRGWLLLPIVYAFALINLALATFMPNEYITHLEATPGMLVHIGLSLFSYATLIIAALYALQLAWIDYQLKNKKLAFNQEMPPLMSIERKMFHITQIGVVLLTLTLCTGLFYMHNLFSMENIDKAVLSIVAWFVYIVLLWGHYHEGWRGRRVVWFNVAGAVILTLAYFGSRIVQQLIS

SEQ ID NO: 6305 - DNA, 1263 bp, Escherichia coli
ttgatcattattctgatcatcatggtggtcatttcagcctatttttccggttcagaaactggaatgatgacactcaaccgctatcgcctgagacacatggcgaagcaaggtaatcgctcggcaaaacgcgtcgaaaaattactgcgcaagccagaccgcctgataagcctggtgttaatcggcaataatctggtcaatatccttgcttccgcactcggcactattgtcgggatgcgcttgtatggcgatgctggcgtggcaattgcgactggcgtgctgaccttcgtagtgctggtttttgctgaagtattgccgaaaaccattgccgcgctgtacccggaaaaagtcgcttatccgagtagttttctactggctccgctgcaaattttgatgatgccgctggtctggttgctgaatgctattacccgcatgttaatgcgcatgatgggcatcaaaaccgatatcgtggttagcggctctttaagcaaagaagagttgcgtaccatcgtgcacgaatcacgctcacaaatttcccgtcgcaatcaggatatgctgctgtcggtgctcgatctggaaaagatgaccgtcgatgacatcatggtgccgcgcagtgaaattatcggtattgatatcaacgatgactggaaatcgattctgcgccaactctcccactcacctcacgggcgcatcgtgctctaccgtgattcgctggacgacgccatcagtatgctgcgtgtgcgtgaagcctggcgactcatgtcggagaaaaaagagttcaccaaagaaaccatgctacgcgccgcggacgagatctattttgtcccggagggtacgccgctcagcacacagttggtgaagtttcagcgcaacaaaaagaaagtcggcctggtcgtcaacgagtatggagacattcagggactggtgacggtcgaagatattctcgaagagattgtcggcgatttcaccacgtcgatgtcgccaacacttgccgaagaggtcacgccgcaaaacgacgggtcggtgattatcgatggcaccgccaacgtgcgagaaattaacaaagcctttaactggcatctaccggaagatgatgctcgtactgttaacggcgtcattctggaagcgctggaggagatcccggtagcaggcacccgcgtgcgtataggcgagtacgatatcgatattctcgacgtacaggacaatatgattaagcaggtaaaagtttttcctgtaaaaccgctgcgcgagagtgtggcggagtaa

SEQ ID NO: 6306 - protein, 420 aa, Escherichia coli
MIIILIIMVVISAYFSGSETGMMTLNRYRLRHMAKQGNRSAKRVEKLLRKPDRLISLVLIGNNLVNILASALGTIVGMRLYGDAGVAIATGVLTFVVLVFAEVLPKTIAALYPEKVAYPSSFLLAPLQILMMPLVWLLNAITRMLMRMMGIKTDIVVSGSLSKEELRTIVHESRSQISRRNQDMLLSVLDLEKMTVDDIMVPRSEIIGIDINDDWKSILRQLSHSPHGRIVLYRDSLDDAISMLRVREAWRLMSEKKEFTKETMLRAADEIYFVPEGTPLSTQLVKFQRNKKKVGLVVNEYGDIQGLVTVEDILEEIVGDFTTSMSPTLAEEVTPQNDGSVIIDGTANVREINKAFNWHLPEDDARTVNGVILEALEEIPVAGTRVRIGEYDIDILDVQDNMIKQVKVFPVKPLRESVAE

SEQ ID NO: 6307 - DNA, 594 bp, Escherichia coli
atgagtagtaaagaacagaaaacgcctgaggggcaagccccggaagaaattatcatggatcagcacgaagagattgaggcagttgagccagaagcttctgctgagcaggtggatccgcgcgatgaaaaaattgcgaatctcgaagctcagctggctgaagcccagacccgtgaacgtgacggcattttgcgcgtaaaagccgaaatggaaaacctgcgtcgtcgtactgaactggatattgaaaaagctcacaaattcgcgctggagaaattcatcaacgaattgctgccggtgattgatagcctggatcgggcgctggaagtggctgataaagctaacccggatatgtccgcgatggttgaaggtattgagctgacgctgaagtcgatgctggatgttgtgcgtaagtttggcgttgaagtgatcgccgaaaccaacgtcccactggacccaaatgtgcatcaggccatcgcaatggtggaatctgatgacgttgcgccaggtaacgtactgggcattatgcagaaaggttatacgctgaacggtcgtacgattcgtgcggcgatggttactgtagcgaaagcaaaagattaa

SEQ ID NO: 6308 - protein, 197 aa, Escherichia coli
MSSKEQKTPEGQAPEEIIMDQHEEIEAVEPEASAEQVDPRDEKIANLEAQLAEAQTRERDGILRVKAEMENLRRRTELDIEKAHKFALEKFINELLPVIDSLDRALEVADKANPDMSAMVEGIELTLKSMLDVVRKFGVEVIAETNVPLDPNVHQAIAMVESDDVAPGNVLGIMQKGYTLNGRTIRAAMVTVAKAKD

SEQ ID NO: 6309 - DNA, 879 bp, Escherichia coli
atgaataatcatttcaagtgtattggcattgtgggacacccacggcaccccactgcactgacaacacatgaaatgctctaccgctggctgtgcacaaaaggttacgaggtcatcgttgagcaacaaatcgctcacgaactgcaactgaagaatgtgaaaactggcacgctcgcggagattgggcaacaggctgatctcgcggttgtcgttggcggcgacggtaatatgctgggcgcggcgcgcacgctcgcgcgctatgatattaaagttattggaatcaaccgtggcaacctgggtttcctgactgaccttgatcccgataacgcccagcaacaattagccgatgtgctggaaggccactacatcagcgagaaacgttttttgctggaagcgcaagtctgtcagcaagattgccagaaacgcatcagcacggcgattaacgaagtggtacttcaccctggcaaagtggcgcatatgattgagttcgaagtgtatatcgacgagatctttgcgttttcgcagcgttccgatggactgattatttcgacgccaacaggctccaccgcatattccctctctgcgggcggtcctattctgacaccctctctggatgcgattaccctggtgcccatgttcccgcatacgttgtcagcacgaccactggtcataaacagcagcagcacgatccgtctacgtttttcgcatcgccgtaacgacctggaaatcagttgcgacagccagatagcactgccgattcaggaaggtgaagatgtcctgattcgtcgctgtgattaccatctgaatctgattcatccgaaagattacagttatttcaatacattaagcaccaagctcggctggtcaaaaaaattattctaa

SEQ ID NO: 6310 - protein, 292 aa, Escherichia coli
MNNHFKCIGIVGHPRHPTALTTHEMLYRWLCTKGYEVIVEQQIAHELQLKNVKTGTLAEIGQQADLAVVVGGDGNMLGAARTLARYDIKVIGINRGNLGFLTDLDPDNAQQQLADVLEGHYISEKRFLLEAQVCQQDCQKRISTAINEVVLHPGKVAHMIEFEVYIDEIFAFSQRSDGLIISTPTGSTAYSLSAGGPILTPSLDAITLVPMFPHTLSARPLVINSSSTIRLRFSHRRNDLEISCDSQIALPIQEGEDVLIRRCDYHLNLIHPKDYSYFNTLSTKLGWSKKLF

SEQ ID NO: 6311 - DNA, 111 bp, Escherichia coli
ttgcatatgcgtttctgtcatcgcaccatcggtttctttgctgacaaaatagtgttgatgaccacatcccgcgacttgtggcaggtgggtaacacacatcacctgagttga

SEQ ID NO: 6312 - protein, 36 aa, Escherichia coli
MHMRFCHRTIGFFADKIVLMTTSRDLWQVGNTHHLS

SEQ ID NO: 6313 - DNA, 1662 bp, Escherichia coli
atgttggcacaactgaccatcagcaactttgctatcgttcgtgagcttgagattgattttcatagcggcatgaccgtaataactggcgagaccggcgcgggtaaatctattgcaatagatgccctcggcctttgtctcggtggtcgcgctgaagccgacatggtgcgtaccggcgctgctcgtgccgacctgtgcgcccgtttttctctgaaagatacgccagcggccctgcgttggctggaagaaaaccagcttgaagacgggcatgaatgtttgcttcgtcgcgtaatcagcagcgatggtcgctcccgtggtttcatcaacggtacagctgttcctctgtcacaactgcgcgaactgggtcagttgctgattcagatccatggtcagcacgctcatcagttactcaccaaacccgagcaccaaaaattcctgcttgatggctatgccaatgaaacctctcagctccaggaaatgaccgcacgttatcagttgtggcatcaaagctgccgtgacctcgcgcatcatcagcagttaagtcaggaacgcgccgcccgtgcggagctgctgcaataccaattaaaagaacttaacgaatttaatccgcagcctggagagtttgagcaaatcgacgaagagtacaaacgtctggcgaacagcggtcaattgctgaccaccagccagaatgcattggcattaatggctgacggtgaagacgcaaatctgcaaagtcaactttacacggctaaacaactggtgagcgaattgattggcatggacagcaaactgtccggcgtacttgatatgctggaagaggctaccatccagattgctgaagccagtgatgaactacgccactactgcgatcgtctggatctcgatcccaaccgactgtttgaacttgaacagcgcatctcaaaacagatttcgctggcacgtaaacatcacgtcagccctgaggcattgccacagtattaccagtcgctactggaagaacagcagcaactggacgatcaggccgactcacaagaaacgctcgcgctggcggtaacgaaacatcatcagcaggcactggaaacggcgcgcgcgttacaccagcaacgccagcattatgcaaatgagttggcacagctgatcaccgatagtatgcatgcactctctatgccacatgggcagtttacgatcgatgttaaatttgacgagcatcacctgggcgctgacggcgctgatcgtattgagtttcgggtaaccaccaacccaggtcagccaatgcagcctattgccaaagtcgcatccggtggtgagttgtcccgcatcgcattggcaatccaggtcattaccgcgcgtaaaatggaaaccccggcactgatttttgatgaagtggatgtagggattagcggcccaacagcggcagttgtcggcaaactgctacgtcaacttggcgaatcaactcaggtgatgtgtgttacccacctgccacaagtcgcgggatgtggtcatcaacactattttgtcagcaaagaaaccgatggtgcgatgacagaaacgcatatgcaatccctggataaaaaagcgcggttacaagagttggcgcgcctgcttggtggcagtgaagtcacacgtaacacactggcgaatgcgaaagaactgcttgcggcgtaa

SEQ ID NO: 6314 - protein, 553 aa, Escherichia coli
MLAQLTISNFAIVRELEIDFHSGMTVITGETGAGKSIAIDALGLCLGGRAEADMVRTGAARADLCARFSLKDTPAALRWLEENQLEDGHECLLRRVISSDGRSRGFINGTAVPLSQLRELGQLLIQIHGQHAHQLLTKPEHQKFLLDGYANETSQLQEMTARYQLWHQSCRDLAHHQQLSQERAARAELLQYQLKELNEFNPQPGEFEQIDEEYKRLANSGQLLTTSQNALALMADGEDANLQSQLYTAKQLVSELIGMDSKLSGVLDMLEEATIQIAEASDELRHYCDRLDLDPNRLFELEQRISKQISLARKHHVSPEALPQYYQSLLEEQQQLDDQADSQETLALAVTKHHQQALETARALHQQRQHYANELAQLITDSMHALSMPHGQFTIDVKFDEHHLGADGADRIEFRVTTNPGQPMQPIAKVASGGELSRIALAIQVITARKMETPALIFDEVDVGISGPTAAVVGKLLRQLGESTQVMCVTHLPQVAGCGHQHYFVSKETDGAMTETHMQSLDKKARLQELARLLGGSEVTRNTLANAKELLAA

SEQ ID NO: 6315 - DNA, 342 bp, Escherichia coli
atgcgctgtaaaacgctgactgctgcagcagcagtactattgatgttgaccgcaggctgttccactctggagcgagtggtttaccgtcctgacatcaaccaggggaactatctgaccgctaacgacgtatccaaaatacgtgttggcatgacgcaacaacaagttgcgtacgcattgggtacaccgctgatgtccgatccatttggtacaaatacctggttctatgtcttccgccagcaacctggtcatgaaggtgtaacgcagcaaacgctgacgctgacctttaacagtagcggtgtgttgaccaacattgataacaaacctgcgctgagtggtaactaa

SEQ ID NO: 6316 - protein, 113 aa, Escherichia coli
MRCKTLTAAAAVLLMLTAGCSTLERVVYRPDINQGNYLTANDVSKIRVGMTQQQVAYALGTPLMSDPFGTNTWFYVFRQQPGHEGVTQQTLTLTFNSSGVLTNIDNKPALSGN

SEQ ID NO: 6317 - DNA, 291 bp, Escherichia coli
gtgccaggtaaaattgccgttgaggtggcttatgcgctacctgagaagcagtacctgcagcgcgtgacgttgcaggagggcgcgacggttgaagaagctattcgcgccagtggtttgctggaattgcgtaccgatatcgatttaactaaaaacaaagtcggcatttacagccgtccggcaaaactcagcgatattgtgcatgatggcgatcgggtggagatttatcgtcctctcattgccgatccgaaagagcttcgcaggcaacgagcagaaaaatcagcgaataaataa

SEQ ID NO: 6318 - protein, 96 aa, Escherichia coli
MPGKIAVEVAYALPEKQYLQRVTLQEGATVEEAIRASGLLELRTDIDLTKNKVGIYSRPAKLSDIVHDGDRVEIYRPLIADPKELRRQRAEKSANK

SEQ ID NO: 6319 - DNA, 477 bp, Escherichia coli
atgatattatttgttggatttttgttgatggaaattgttatgcctcagattagccggaccgcactggtgccctacagcgcggagcaaatgtatcagttagtgaatgacgttcagtcttatcctcagtttttgccgggttgtaccggaagtcggattctggagtccactcctgggcagatgactgctgcggtagatgtgtctaaggctgggatcagcaaaacgtttacaacccgcaaccagttgaccagtaatcaaagtattctcatgagtctggttgatggaccgtttaagaaattgatcggcggttggaagtttacgccgttgagccaggacgcgtgccgtattgagtttcatctcgactttgagtttaccaataagttgattgaactcgcctttggtcgtgtgtttaaagagctggcagctaatatggtgcaggcttttactgttcgtgcaaaagaggtctacagtgccaggtaa

SEQ ID NO: 6320 - protein, 158 aa, Escherichia coli
MILFVGFLLMEIVMPQISRTALVPYSAEQMYQLVNDVQSYPQFLPGCTGSRILESTPGQMTAAVDVSKAGISKTFTTRNQLTSNQSILMSLVDGPFKKLIGGWKFTPLSQDACRIEFHLDFEFTNKLIELAFGRVFKELAANMVQAFTVRAKEVYSAR

SEQ ID NO: 6321 - DNA, 483 bp, Escherichia coli
atgacgaagaaaaaagcacataaacctggttcagcgaccatcgcgcttaacaagcgcgcccgtcacgaatactttatcgaagaagagttcgaagcgggacttgccctgcaaggctgggaggttaaatccctgcgcgcaggaaaagccaatatcagcgacagctatgtccttctgcgcgacggagaggcatttctgtttggcgctaacatcacgccaatggctgtggcctccacgcatgtggtgtgcgatcctacccgtacccgcaagttacttctcaaccagcgcgaactggactcattgtacggtcgcgtcaatcgagaaggctataccgtagtggcgctctccctgtactggaaaaatgcctggtgcaaagtgaaaatcggcgtcgccaaaggtaagaaacagcacgataaacgttcagatatcaaagaacgcgaatggcaggtggataaagcgcgtatcatgaaaaatgcccaccgttaa

SEQ ID NO: 6322 - protein, 160 aa, Escherichia coli
MTKKKAHKPGSATIALNKRARHEYFIEEEFEAGLALQGWEVKSLRAGKANISDSYVLLRDGEAFLFGANITPMAVASTHVVCDPTRTRKLLLNQRELDSLYGRVNREGYTVVALSLYWKNAWCKVKIGVAKGKKQHDKRSDIKEREWQVDKARIMKNAHR

SEQ ID NO: 6323 - DNA, 789 bp, Escherichia coli
atgacaaatctacaactggaagaaagatttagggcgcttgagaaagattacgatgcgctcatttccacaaaatatactgcgcagaacgttctcactcacactatggaaacctatgttgattctggtaaatataaaaactggatcgccagagtgaaaaagttaatagaggacagctacggaaaagagtctgattattacaatgacttcaatactgtaaacagcaggtggtcttctaattacaatacactgatcaaaagttataaaccgttgtttgatgcggcgagagatgatcttgcgcactctgctgtcagtactaatactcctcaagaaggttcgccgctgagcctcgtacttaatattcttaacaggtttccgacctttgttcgccagttaaagaggcggtacaacggccgtgcgccgcttgaagttaatgatgagtatgacgtacaggatttgatttatgcactgctgacgcttcattttaatgatattagggcggaagagtatacccccagctttgcgggcgcggcctcaagacaggactttcttttgaaaaaagagaaaattgtgatagaggtgaagaaaacccgtgaatctctgggagcgggtaaagttggtggagagttgcttattgatatggcgcgctaccgcgctcaccaagactgcgatacgttgatcttgtttgtatatgacccggattgctacataaataatcctttgggcgtgaaaaccgatctggaatctaaagacgcggaaggaaaagtgaaggttgttattgcgcagttctga

SEQ ID NO: 6324 - protein, 262 aa, Escherichia coli
MTNLQLEERFRALEKDYDALISTKYTAQNVLTHTMETYVDSGKYKNWIARVKKLIEDSYGKESDYYNDFNTVNSRWSSNYNTLIKSYKPLFDAARDDLAHSAVSTNTPQEGSPLSLVLNILNRFPTFVRQLKRRYNGRAPLEVNDEYDVQDLIYALLTLHFNDIRAEEYTPSFAGAASRQDFLLKKEKIVIEVKKTRESLGAGKVGGELLIDMARYRAHQDCDTLILFVYDPDCYINNPLGVKTDLESKDAEGKVKVVIAQF

SEQ ID NO: 6325 - DNA, 774 bp, Escherichia coli
atggatattaatgaatttccatctggagtaatcgaacatcttggctggtatgtataccgcctaattgacccgagggatggcagtacgttctatgtaggtaaaggcaaaggtaatcgtgtctttgctcatatgcgtggtgaggttgcagcagtggatgatgatgagttactgaataataaactcaggcaacttcgagagatcagacttgctggtcttgatgtgatccatgttattcatcgacacggtatggccgaagaaaagaccgcttacgaggttgaagcagcgctcatagacgcttatcccggcttaactaacatcatgaacggtgctggcagtaatgagttcggtgctgcacacataaaagaattaatcgctacgtaccagcctgaaactattacgttccaacataaggccctaatgatatcggttaataggagttcaaaggatattgacctctatgatgctgtacgttttagctggcgtgtcagcgttgaccgcgctcgtaaggctgagatcatactggcaacagtaagaggtatcgtgaggggggtatacatcgctgatgagtggctcaagtctacccgtgagaatttcccagagatgacttcatgggaggcagacgatgagtttgaagcgactcaatgttcccgctttggtttccggggtagggtggcatctcctgaaatcacacaactttatataggtaagaaaattcctgatgatctcagaaagaaaggtgctatgtctcctgtgagatattctcccggtttttga

SEQ ID NO: 6326 - protein, 257 aa, Escherichia coli
MDINEFPSGVIEHLGWYVYRLIDPRDGSTFYVGKGKGNRVFAHMRGEVAAVDDDELLNNKLRQLREIRLAGLDVIHVIHRHGMAEEKTAYEVEAALIDAYPGLTNIMNGAGSNEFGAAHIKELIATYQPETITFQHKALMISVNRSSKDIDLYDAVRFSWRVSVDRARKAEIILATVRGIVRGVYIADEWLKSTRENFPEMTSWEADDEFEATQCSRFGFRGRVASPEITQLYIGKKIPDDLRKKGAMSPVRYSPGF

SEQ ID NO: 6327 - DNA, 138 bp, Escherichia coli
atgccaaacggcgctgtggacgcgttaaaggaagaattaacccaacacattggcaagcgttatgacgatgtggagatgatcgtaaaagccaccagcaacgatagtttttcagttagacatactgcagataaagattga

SEQ ID NO: 6328 - protein, 45 aa, Escherichia coli
MPNGAVDALKEELTQHIGKRYDDVEMIVKATSNDSFSVRHTADKD

SEQ ID NO: 6329 - DNA, 1950 bp, Escherichia coli
atgattgttctaaatcagattaactcctcacttttgtacaatgtcgcttacaggtataccatgaaatccgagacgctaactgtccaacaactttttcaagaccgccgacaatactgtgttccattctatcaacgtgcctatgtatggactcagcaagaccagtggtcagctctactggaggatatcctagagaaagtacaatcccggctctcgggtacaaaaccaactccccatttccttggtgcggttgtactggaacctcaatcaaaaaaaggattattaggtgtagattccatacatattattgatggtcagcaacgattgaccactcttcaatatgttctggcatccatccgattagcattacgtgctacggatctttccagcttagaggctctcatttcgccttgcctgaaaaactcaaacgaagacacaatgcgaaataaagaagtagaacgcttcaaactgtggccaacttttcgggatcaaactcattttattcaaagttttaatgttgaaaatattgacgatctccgggacgtattctctgatagtttcacgcagcatggtacgttgcgtaagcattttaatcacccgccatcactagaagcattatgtttttttactgaagcctttataaaatggattaaaatagaaaaccactcaccacaagaaaatgctgtagctctaattgaggctgtcttaacagatctgaaactggtaagcatatttctcgaagctgaagatgatgcccaaataatttttgaaacattaaatgggcgaggggcggaacttcatgctacggatcttattcgcaactatatctttatgtgcgctgagcatgaaaatattaatgctattgaattatatgaaaatgagtggaagagctttgaagataaatactggtcggaaaaacaacgccgtggacgtattaataaaccacgcatggagtggctagtacatgcgacattgcaatcagaaaggcaacgtgaaattgatctgtctcgcctttacaatgagtatcgtgattatgtaagtaaggacttgtcttcacaacgagcagatctgcaagtaaagcgcctcaaacaatatgcatcacaatataaagaattggttgatggttttggcacaacccccatctcacactttggatatcgcatcgcagactatgatgtgacgacactttatccgcttgctttgttcatttcgatagctaacatcgctgatgatgagaaagcagccatgtataatgatcttgtctcctacgtagtacgaagagccgtatgtggcctgacgccaaagaattacaacaatgtatttatgaatgtattgcggcacttggctaaaacggaaatttccagtgttgagttacgtaatatcctcaataacttaaatggcgaagcctcacgttggcctggtgactcagaatttctcaacgcttgcatcaatgctccactttatcctggcaggctcgacgcaccgaaaatgcgctcaatgttaacggaacttgaaagagaactttgtcgccaagtaaagacagaaaagcctgatgttccaaatctttctaatctcgatatcgatcatcttatgcctcaaagttggtattcctgttggcctctcgaaaatggtcgtatggtgacaaattcagatgctacggtattgaaccaaattgttctgtctggaaccgatcttacccctgaacagctactggtaaggaaacggcaacaagcgatatctactttgggaaatctaactttgcttaaccttagcgtaaaccgttctgttcagaatgctgtatttctgaaaaaacgtgatgctctcatcgtccacaccaatctacgactgaacattccacttatagttaaggataaatgggatgaggatgaaatcctggagcggggtaaaaagttgggggaaattgcattgaaagtatggccaaaacacgattaa

SEQ ID NO: 6330 - protein, 649 aa, Escherichia coli
MIVLNQINSSLLYNVAYRYTMKSETLTVQQLFQDRRQYCVPFYQRAYVWTQQDQWSALLEDILEKVQSRLSGTKPTPHFLGAVVLEPQSKKGLLGVDSIHIIDGQQRLTTLQYVLASIRLALRATDLSSLEALISPCLKNSNEDTMRNKEVERFKLWPTFRDQTHFIQSFNVENIDDLRDVFSDSFTQHGTLRKHFNHPPSLEALCFFTEAFIKWIKIENHSPQENAVALIEAVLTDLKLVSIFLEAEDDAQIIFETLNGRGAELHATDLIRNYIFMCAEHENINAIELYENEWKSFEDKYWSEKQRRGRINKPRMEWLVHATLQSERQREIDLSRLYNEYRDYVSKDLSSQRADLQVKRLKQYASQYKELVDGFGTTPISHFGYRIADYDVTTLYPLALFISIANIADDEKAAMYNDLVSYVVRRAVCGLTPKNYNNVFMNVLRHLAKTEISSVELRNILNNLNGEASRWPGDSEFLNACINAPLYPGRLDAPKMRSMLTELERELCRQVKTEKPDVPNLSNLDIDHLMPQSWYSCWPLENGRMVTNSDATVLNQIVLSGTDLTPEQLLVRKRQQAISTLGNLTLLNLSVNRSVQNAVFLKKRDALIVHTNLRLNIPLIVKDKWDEDEILERGKKLGEIALKVWPKHD

SEQ ID NO: 6331 - DNA, 492 bp, Escherichia coli
atgccatttgctcgttatttctgcattttcataaacgttggtttgggagaaggctctgcattacctgttggtgtgcctgttccatggccttcagccacaccgccaacaggctggctgaaatgcaacggtgcggctttttctgctgaagaatacccggaactggcaaaggcttatccgacaaataaattgcctgatttacgtggtgagtttattcgtggctgggatgatgggcgcggcgttgattcaaggcgtgcggtgctgtcaacacaagagccaactgtaggtactttttatgtggagctagctatcatctcgggaactttgagcggctcaggtgctaaatttaccgattcagtagggattggatcaaccagtagtaacattaccgttagcaacggtaatgaccagtccgtgtcgggtacagtggccgttaaccccgtcgatacccgtccacgcaacattgcatttaactatatcgtgagagcagcataa

SEQ ID NO: 6332 - protein, 163 aa, Escherichia coli
MPFARYFCIFINVGLGEGSALPVGVPVPWPSATPPTGWLKCNGAAFSAEEYPELAKAYPTNKLPDLRGEFIRGWDDGRGVDSRRAVLSTQEPTVGTFYVELAIISGTLSGSGAKFTDSVGIGSTSSNITVSNGNDQSVSGTVAVNPVDTRPRNIAFNYIVRAA

SEQ ID NO: 6333 - DNA, 228 bp, Escherichia coli
  n 201, 202, 203, 204, 205: n is any nucleotide
atggataaagcaatattaaatagtggacttgttgctacaaaggcaggggatattaccgtttataactatgatggtgaaactcgggaatatatttccacttcaagtgaatatcttgccgttggtgttggtatcccggcatattcctgtctggatgcaccaggtatacataaggcgggttatgctatctgtcgttctgtgaannnnncattccattcattaattaattaa

SEQ ID NO: 6334 - protein, 75 aa, Escherichia coli
  Xaa 67, 68, 69: Xaa is any amino acid
MDKAILNSGLVATKAGDITVYNYDGETREYISTSSEYLAVGVGIPAYSCLDAPGIHKAGYAICRSVXXXFHSLIN

SEQ ID NO: 6335 - DNA, 531 bp, Escherichia coli
  n 9, 10, 11, 12, 13, 513, 514, 515, 516, 517: n is any nucleotide
atggaatgnnnnncgaccaccgccaacattactcaagcgattgaacaaatgcgtggaggtgaaagcgtgaacgatcaaggtgctgaagaccaacgtcaggctttgaaaaaatataccatcgaccttaccgaacgagccgaacagggtaaactcgatccggtgattggtcgtgatgaagaaattcgccgtaccattcaggtgctgcaacgtcgtactaaaaataacccggtactgattggtgaaccaggcgtcggtaagactgccatcgttgaaggtctggcgcagcgtattatcaacggcgaagtgcccgaagggttgaaaggccgccgcgtactggcgctggcatgggtggagcgcaatattaaagtaccaatgaccgaaccacaaaaagcgggtatcgcgtcattctgtccctataacattggccccggtaagtgttttccgtcgacgttttataagcggctgaatgccggtgatcgtaagggcgcatgcgaggcgattcgctggtggatnnnnncattcattcattaa

SEQ ID NO: 6336 - protein, 176 aa, Escherichia coli
  Xaa 3, 4, 5, 171, 172, 173: Xaa is any amino acid
MEXXXTTANITQAIEQMRGGESVNDQGAEDQRQALKKYTIDLTERAEQGKLDPVIGRDEEIRRTIQVLQRRTKNNPVLIGEPGVGKTAIVEGLAQRIINGEVPEGLKGRRVLALAWVERNIKVPMTEPQKAGIASFCPYNIGPGKCFPSTFYKRLNAGDRKGACEAIRWWXXXFIH

SEQ ID NO: 6337 - DNA, 531 bp, Escherichia coli; identical to SEQ ID NO: 6335
  n 9, 10, 11, 12, 13, 513, 514, 515, 516, 517: n is any nucleotide

SEQ ID NO: 6338 - protein, 176 aa, Escherichia coli; identical to SEQ ID NO: 6336
  Xaa 3, 4, 5, 171, 172, 173: Xaa is any amino acid

SEQ ID NO: 6339 - DNA, 696 bp, Escherichia coli
atgcggctcagcgcacgcgggttaaggttgaggctgacagtcgaccttctgtggatacccacccgcctggtgtgcaaccttcgccaggcaccgggaggcacccggcaccacaactttatgctgtgtgtagtcctggcggtaccagcttgtacccttgcttccggctggtaccgctctttttacaaaacagagaagagcatcaccggacgacgggctcataacccaatccacccgggcggctgccaccgcaggtgttcttctctgttttgtggagaaaccaaccgaccttgcagggtcgatatgatgaggagcagcaaaatggctagcgaacgcagtaccaacgtgcaggaatttatcggggagctggacggcggcgtatttgaaaccaaaatcggcgcagttctcagtgaagtcgcttccggtgtgatgaacacgaaaaccaaaggtaaggtctcgctcaacctggaaatcgaaccgtttgatgagaaccgtgtgaaaataaaacacaaactctcatatgttcgtccgactaaccgcgggaaaatttccgaagaagacaccaccgaaacgccgatgtatgtcaatcgcggtggtcgcctgactattctgcaggaagaccagggacaattactgactcttgccggtgaacctgacggaaaactccgcgcagcagtcattaatatcgttcttaattaa

SEQ ID NO: 6340 - protein, 231 aa, Escherichia coli
MRLSARGLRLRLTVDLLWIPTRLVCNLRQAPGGTRHHNFMLCVVLAVPACTLASGWYRSFYKTEKSITGRRAHNPIHPGGCHRRCSSLFCGETNRPCRVDMMRSSKMASERSTNVQEFIGELDGGVFETKIGAVLSEVASGVMNTKTKGKVSLNLEIEPFDENRVKIKHKLSYVRPTNRGKISEEDTTETPMYVNRGGRLTILQEDQGQLLTLAGEPDGKLRAAVINIVLN

SEQ ID NO: 6341 - DNA, 825 bp, Escherichia coli
atgtctcagaacttagacgcaaccgcaattaatcaaatccatgcccttatttctgctcagggtgttaatgaaattatcagtaagattggtgccgacgcagtggcattacctgaaaatttccgcattcatgatctggaaaaatttaatttaaatcgcttccgtttccgtggtgcgctttccactgccagcatcgatgactttacccgttattctaaagatcttgcagatgaaggcacccgctgctttatcgatgccgataatatgcgtgccgtcagtgtgcttaacctgggtactattgatgaaccaggtcacgcagataacaccgccactctcaaactgaaaaagacagcaccgttctctgctctgttgtctgttaacggcgagcgtaactcccagaagtcactggcagaatggattgaagactgggccgactaccttgtgggctttgatgctaatggtgacgccattcaggcaacaaaagcggctgcggctgtccgtaaaatcacgattgaagcaaaccagaccgctgattttgaagacaatgacttcagcggcaaacgctccctgatggagtctgtcgaagcgaaaaccaaagatattatgccagtggcatttgaatttaaatgcgttccgtttgaaggcctgaaagaacgtccgtttaaattacgcctcagcattatcactggcgatcgtcctgtactggttctgcgcattattcagctggaagcagtgcaggaagaaatggctaacgaatttcgtgatctgcttgttgagaaattcaaggacagcaaagtagaaacctttattggtacttttaccgcctga

SEQ ID NO: 6342 - protein, 274 aa, Escherichia coli; identical to SEQ ID NO: 1284

SEQ ID NO: 6343 - DNA, 525 bp, Escherichia coli
atgtcatttattaaaactttttccgggaagcatttttattatgacaggataaataaagacgacatcgttattaacgatatcgcggtttctctttcaaatatctgtcgctttgcaggacatctttcacatttctacagcgtcgcccaacatgcggtgctttgcagccaactggtaccgcaggaatttgcttttgaagcgttaatgcatgatgcaacagaagcgtattgccaggacatcccggcgccactgaaacgccttcttcctgactataaacggatggaagaaaaaatagacgccgtaatccgtgagaaatacgggttacccccggttatgagtacgcccgtgaaatatgccgatctcatcatgctggcaaccgaacgccgcgatctcgggcttgatgatggctctttctggcccgtactggaaggtatcccggcaacagagatgttcaaagttattccactgtcgccaggccatacctatgggatgtttatggaacgctttaaagagttaactgagtcgtaa

SEQ ID NO: 6344 - protein, 174 aa, Escherichia coli
MSFIKTFSGKHFYYDRINKDDIVINDIAVSLSNICRFAGHLSHFYSVAQHAVLCSQLVPQEFAFEALMHDATEAYCQDIPAPLKRLLPDYKRMEEKIDAVIREKYGLPPVMSTPVKYADLIMLATERRDLGLDDGSFWPVLEGIPATEMFKVIPLSPGHTYGMFMERFKELTES

SEQ ID NO: 6345 - DNA, 117 bp, Escherichia coli
ttgatgatgatctcttcagattggcatatcattatgtttatgagttttcaaaacaacatcaaacaaaaattcaaaactatgttgcattatatggtttttgcagaaacatatgtttaa

SEQ ID NO: 6346 - protein, 38 aa, Escherichia coli
MMMISSDWHIIMFMSFQNNIKQKFKTMLHYMVFAETYV

SEQ ID NO: 6347 - DNA, 867 bp, Escherichia coli
atgaatcaaaatccattctcattctatgactttcttggatatttaataccaggtggtttttttatcctattaatgtatttctgtggtttgacattcgatctagatattgttattgacttaagtgaattgctcagaggtcaaagtcaaatctttggcattttgaactacgcttcaatagttattatatcttatatagctggacattttatttctatcacgtcagcattttttatcgaaaaatacatgaataaagaattaggatatccttccaaatatctatttaaaaaattgatagatacctcagaaagcatttgtagcccatcatgcgatgagagaagcgctgataaaaaaacaaaaataaagaatcgcataatcaaatgcgtattatgtccaataatactatgggattttataacacaaaaactatgttattctcaatctctaccatttcatttagctaatacaacatggttaatgatcaaagaaggttatgagaaaaagttcataacaaatcgccaattattacaagataaaaacggacttgatgatgatctcttcagattggcatatcattatgtttatgagttttcaaaacaacatcaaacaaaaattcaaaactatgttgcattatatggtttttgcagaaacatatgtttaatctttataatttcattttgggtatcagttccaacctttatttatcgattatgtactcatagtgattatctttatagtttactttcaataatgcttagctttttcttcgtctatgttttctatgttggttttgttaaattttatagaagatatactttagaagtattaatggcatttgctgtacttcaaagtaacgacactattcgttaa

SEQ ID NO: 6348 - protein, 288 aa, Escherichia coli
MNQNPFSFYDFLGYLIPGGFFILLMYFCGLTFDLDIVIDLSELLRGQSQIFGILNYASIVIISYIAGHFISITSAFFIEKYMNKELGYPSKYLFKKLIDTSESICSPSCDERSADKKTKIKNRIIKCVLCPIILWDFITQKLCYSQSLPFHLANTTWLMIKEGYEKKFITNRQLLQDKNGLDDDLFRLAYHYVYEFSKQHQTKIQNYVALYGFCRNICLIFIISFWVSVPTFIYRLCTHSDYLYSLLSIMLSFFFVYVFYVGFVKFYRRYTLEVLMAFAVLQSNDTIR

SEQ ID NO: 6349 - DNA, 1173 bp, Escherichia coli
atgggccagacaaaactgctcaaactaccgcgcggcgtaacaatcaggaaacaccaccagggagaaacgatcaatataactttcacctacaaaggagttagatgtcgtgagccgctttccaatctggaagtaacaccaaagaacattaaatacgccgagcgtacactcggcgaaatccataataagatcgaaaggggaacattcatttatgcagaatattttccccgttctgctcgtttgaaaatttttggtaatgctgctgcaagcaaaacggtaaagatgtacctggacgaatatcttgaaatctgcgaaacaagaaaactttcaccctctacgattggtggctataaaaaatgccgtagtgcgttagcctcacttcacatttgccctgcaagtgaattaacaccagcaaccctgaaagcgtggattcaaagccagaaaacaaccttaaaaaccattcgcaaccagttatctttcctacggtcagcacttgatgaagccgtgaccgatggggtacttcaaattaaccccgtatcgttagtaacagcttcgcgctaccaaagtgataagtcagaagcagaaagcagctatgtggttgatccgctatcaccagcagaagttgatgcattactagcagcagccggaaacaaacaatgggaaaatctgttccggttcgccatacatacaggcctgcgtagttctgaattatgtgccctacgatggcatgatatcgactttgttggaaaaacagcccatgttcagagcgcaagtgttgtcggagttatcaaaggaacaaagacaaaagccggtacccgtaaagttgaactgactgaagaagcaatgttggcgttgataaaccagaagccatttacattcatgaaggatgctactgtctttgaagatccaaagaccaataaaccctgggcaagtgctgatgcaattaggaaaaaagcatgggtgccaacattgcgaaaagcaggtattcgttacagaaacccatatcaaaccaggcatacattcgccaccagccatatcagccggggagcaaacctgttttggcttgcggctcaaatgggccataaagggcctgaaatgttattcaggcactatggacaatacttgaaagagtatgatgggagggcaagtatcaaggataaaaaggctttattttaa

SEQ ID NO: 6350 - protein, 390 aa, Escherichia coli
MGQTKLLKLPRGVTIRKHHQGETINITFTYKGVRCREPLSNLEVTPKNIKYAERTLGEIHNKIERGTFIYAEYFPRSARLKIFGNAAASKTVKMYLDEYLEICETRKLSPSTIGGYKKCRSALASLHICPASELTPATLKAWIQSQKTTLKTIRNQLSFLRSALDEAVTDGVLQINPVSLVTASRYQSDKSEAESSYVVDPLSPAEVDALLAAAGNKQWENLFRFAIHTGLRSSELCALRWHDIDFVGKTAHVQSASVVGVIKGTKTKAGTRKVELTEEAMLALINQKPFTFMKDATVFEDPKTNKPWASADAIRKKAWVPTLRKAGIRYRNPYQTRHTFATSHISRGANLFWLAAQMGHKGPEMLFRHYGQYLKEYDGRASIKDKKALF

SEQ ID NO: 6351 - DNA, 912 bp, Escherichia coli
atgaccatactggtacccccaagcaaattttgcatttactcagatgattctagggctgggacattgaacttcatcaactcgattgaatcgattggagtaaaaaataaaggtcgagttatagttgatttgtccaaggtaaaatttgcctcagctgcggcatcggtactgttctttgccatagtaaatagagctcaatttttaacccgggaccctaattttatacgttttaaatggcctaaaaaggatgataacccatctgggcatagatggatcgttggtactggacttgctcgtgctttgcttgctggcacagaagagaaactgaatgcacttacgagggaggaacgatactttcagtcagctgtcgaaccttacgagcatattgttgaaacagtactcatgctgcagaaaagtgctctgcttaataatgaacagttaggcttactgctgacagcgattagtgaagctttgctcaatgtttctcatcatgcgtatgaagatgaggggttcgagtcagatattcagcttctcaaaggtaaacgatggtggcagtgcgcttggttcaatcgtgatgaaaataaagtcgtttttatcgtttgtgaccttggattggggatttatagaagtttcgtgcctaatggtgatggtcatagcattcaaaacgaagtatcttctgtggaaagagctatgttagtaggggaatcccgctttgttggttccggacggggaaatggctctgaagatatcaagagacctattggggcaggttgtgaggataatgagacacttctgatactaacaggaagggctcgttatagctataattctaatgacagtagtcctcgatgtgagaagctagctgagtacataccgggtactttactacaatggtcgctggttcccaggagatga

SEQ ID NO: 6352 - protein, 303 aa, Escherichia coli
MTILVPPSKFCIYSDDSRAGTLNFINSIESIGVKNKGRVIVDLSKVKFASAAASVLFFAIVNRAQFLTRDPNFIRFKWPKKDDNPSGHRWIVGTGLARALLAGTEEKLNALTREERYFQSAVEPYEHIVETVLMLQKSALLNNEQLGLLLTAISEALLNVSHHAYEDEGFESDIQLLKGKRWWQCAWFNRDENKVVFIVCDLGLGIYRSFVPNGDGHSIQNEVSSVERAMLVGESRFVGSGRGNGSEDIKRPIGAGCEDNETLLILTGRARYSYNSNDSSPRCEKLAEYIPGTLLQWSLVPRR

SEQ ID NO: 6353 - DNA, 978 bp, Escherichia coli
atgaatgcactgaccgccgtacaaaataacgctgtcgattcaggccaggactatagcggattcactctcatcccgtcggcgcaatccccgcgtctgctggaactcaccttcaccgaacagacgaccaatcggttcctcgaacaggttgccgagtggcccgtgcaggcgctggagtacaaatcgtttctgcgttttcgggtaggcaaaattctcgacgatctgtgtgcgaatcagctgcaaccgctgctgttgaagaccctgttaaaccgcgctgaaggtgcgctgttgatcaatgcggtgggtatcgatgatgtcgcgcaggcggatgagatggtgaagctggcgacggcggtggcgcatctgattggtcgctccaattttgacgccatgagcggtcagtattacgcgcgtttcgtggtgaaaaatgttgataactcagacagctatcttcgtcagccgcaccgcgtaatggagctgcacaacgacggcacttacgttgaagagatcactgattacgtgctgatgatgaaaatcgacgagcaaaacatgcagggcggtaactcgctgctgctgcatctcgatgactgggaacatctggaccactttttccgccatccgctggcgcgccgtccgatgcgctttgccgcgccgccgagcaaaaacgtcagcaaagatgtcttccatccggtgttcgatgtcgatcagcagggccgcccggtgatgcgctatatcgaccagtttatccagccgaaagacttcgaagaaggcgtgtggttgagcgagctttcggacgccattgaaaccagtaaaggcattctttctgtacccgttcccgttggcaaattcctgttgattaacaacctgttctggctgcacggtcgcgaccgctttactccgcacccggatctgcgccgtgaactgatgcgtcagcgtggctatttcgcttacgccactcaccactaccagacgcatcagtaa

SEQ ID NO: 6354 - protein, 325 aa, Escherichia coli
MNALTAVQNNAVDSGQDYSGFTLIPSAQSPRLLELTFTEQTTNRFLEQVAEWPVQALEYKSFLRFRVGKILDDLCANQLQPLLLKTLLNRAEGALLINAVGIDDVAQADEMVKLATAVAHLIGRSNFDAMSGQYYARFVVKNVDNSDSYLRQPHRVMELHNDGTYVEEITDYVLMMKIDEQNMQGGNSLLLHLDDWEHLDHFFRHPLARRPMRFAAPPSKNVSKDVFHPVFDVDQQGRPVMRYIDQFIQPKDFEEGVWLSELSDAIETSKGILSVPVPVGKFLLINNLFWLHGRDRFTPHPDLRRELMRQRGYFAYATHHYQTHQ

SEQ ID NO: 6355 - DNA, 1269 bp, Escherichia coli
atgtatgattttttgattattggcggcggcatcatcggcatgtcgaccgccatgcaactaattgatgtttatccggatgcccgcatagcgttgctggaaaaagagcccggcccggcctgtcaccagacgggccacaacagtggcgtaatccatgccggggtctattacacgcccggcagcctgaaggcgcagttttgcctggcaggaaaccgcgccaccaaagccttttgcgatcaaaacggtattcgctacgacaactgcggcaagatgctggtcgccacgtctgaactcgaaatggaacggatgcgcgccttatgggaacgcacggcggcgaacggaatcgatcgcgagtggttaaacgccgaagagctgcgcgagcgcgaaccaaatatcaccgggctgggcggtatttttgtgccgtccagcggcattgtcagctaccgcgaagtgacggcggcaatggcaaaaatttttcaggccagaggcggtgagattatctataacgccgaagtcagcgccctcagtgagcataaaaacggcgtggtgatatgtacccgtcagggcggtgaatatgaagcatcgacgctgattagctgttccgggctgatggctgaccggctggtgaaaatgctcggcctcgaaccgggctttattatctgcccgttccgcggcgagtatttccgccttgcgccggagcataaccagattgttaaccacctgatttaccccattcccgacccggcaatgccgtttttgggcgtgcatctcacccgcatgatcgacggcagtgtgaccgtcgggccaaacgcggtgctggctttcaaacgcgaaggctatcgtaagcgcgacttctcatttagcgacacgctggaaattttgggctcgtcggggattcgccgggtgctgcaaaaccatctacgctcaggactgggcgagatgaaaaactcgctgtgcaaaagcggctatctgcggctggtgcaaaagtattgtccccggctttcgttaagcgatctccagccctggcccgccggtgtgcgggcgcaggcggtatcgccggacggcaagctgattgacgattttctgtttgtcaccaccccgcgcacgatccacacctgtaatgcgccctccccggcagcgacatcagcaattcctattggtgcgcatattgtcagcaaggtacaaacgctgttggcaagccagagtaaccccggacgcacgctgcgagcggcacgtagtgtggatgccttacacgccgcatttaatcaataa

SEQ ID NO: 6356 - protein, 422 aa, Escherichia coli
MYDFLIIGGGIIGMSTAMQLIDVYPDARIALLEKEPGPACHQTGHNSGVIHAGVYYTPGSLKAQFCLAGNRATKAFCDQNGIRYDNCGKMLVATSELEMERMRALWERTAANGIDREWLNAEELREREPNITGLGGIFVPSSGIVSYREVTAAMAKIFQARGGEIIYNAEVSALSEHKNGVVICTRQGGEYEASTLISCSGLMADRLVKMLGLEPGFIICPFRGEYFRLAPEHNQIVNHLIYPIPDPAMPFLGVHLTRMIDGSVTVGPNAVLAFKREGYRKRDFSFSDTLEILGSSGIRRVLQNHLRSGLGEMKNSLCKSGYLRLVQKYCPRLSLSDLQPWPAGVRAQAVSPDGKLIDDFLFVTTPRTIHTCNAPSPAATSAIPIGAHIVSKVQTLLASQSNPGRTLRAARSVDALHAAFNQ

SEQ ID NO: 6357 - DNA, 1449 bp, Escherichia coli
atgaaacttaacgacagtaacttattccgccagcaggcgttgattaacggggaatggctggacgccaacaatggcgaggtcatcgacgtcaccaatccggcgaacggcgacaagctgggtagcgtgccgaaaatgggcgctgatgaaacccgcgccgctatcgacgccgccaaccgcgccctgcccgtctggcgtgcgctcactgccaaagaacgcgccaacattctgcgcaactggttcaatttaatgatggagcatcaggacgatttagcgcgcctgatgaccctcgaacagggcaaaccactggctgaagcgaaaggcgaaatcagctacgccgcctcatttattgagtggtttgcagaagaaggcaaacgtatttatggcgacaccattcccggtcatcaggccgataaacgcctgattgttatcaagcagccgattggcgtcaccgcggctatcacgccgtggaacttcccggcggcgatgattacccgtaaagccggtccggcgctggcggcaggctgcacgatggtgctgaagcccgccagtcagacgccgttctctgcgctggcgctggcagaactggcgattcgcgcgggcgttccggctggcgtgtttaacgtagtcaccggttcggcgggcgcggtcggtaacgaactgaccagcaacccgctggtgcgcaagctgtcgtttaccggctcgaccgaaattggccgtcagttaatggaacagtgcgcgaaagacatcaaaaaagtgtcgctggagctgggcggcaacgcaccgtttattgtctttgacgatgccgatctcgataaagccgtggaaggcgcgctggcctcgaaattccgtaacgccgggcaaacctgcgtctgcgccaaccgcctgtatgtgcagaacggcgtgtatgaccgctttgccgaaaaattgcagcaggcggtgagcaaactgcacatcggcaacgggctggagaaaggcgtcaccatcgggccgctgatcgatgaaaaagcggtagcaaaagtggaagagcatattgccgatgcgctggagaaaggcgcgcgcgtggtttgcggcggtaaagcacatgaacgcggcggtaacttcttccagccgaccattctggtggacgttccggctaacgccaaagtgtcgaaagaagagacgtttggccccctcgccccgctgttccgttttaaagatgaagccgatgtgattgcgcaagccaatgacaccgaatttggccttgcagcctatttctacgcccgtgatttaagccgcgtcttccgcgtgggcgaagcactggagtacggcatcatcggcatcaacaccggcattatttccaatgaagtggccccgtttggcggcattaaagcctcgggtctgggtcgtgaaggttcgaagtatggcatcgaagattacttagaaatcaaatatatgtgcatcggtctttaa

SEQ ID NO: 6358 - protein, 482 aa, Escherichia coli
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQNGVYDRFAEKLQQAVSKLHIGNGLEKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIIGINTGIISNEVAPFGGIKASGLGREGSKYGIEDYLEIKYMCIGL

SEQ ID NO: 6359 - DNA, 1281 bp, Escherichia coli
atgagcagcaataaagagttaatgcagcgccgcagtcaggcgattccccgtggcgttgggcaaattcacccgattttcgctgaccgcgcggaaaactgccgggtgtgggacgttgaaggccgtgagtatcttgatttcgcgggcgggattgcggtgctcaataccgggcacctgcatccgaaagtggttgcggcggtggaagcgcagttgaaaaaactgtcgcacacctgcttccaggtgctggcttacgagccgtatcttgaactgtgcgagattatgaatcagaaggtgccgggcgattttgccaagaaaactctgctggttacgaccggttccgaagcggtggaaaatgcggtgaaaatcgcccgcgccgccactaaacgtagcggtactatcgcctttagcggtgcgtatcacgggcgcacgcattacacactggcgctgaccggcaaggtgaatccatactctgcgggcatggggctgatgccgggtcatgtttatcgcgcgctttatccttgcccgctgcacggcataagcgaggatgacgctatcgccagcatccaccggatcttcaaaaatgacgccgcgccggaagatatcgccgccatcgtgattgagcccgttcagggcgaaggcggtttctacgccgcgacgccagcctttatgcagcgtttacgcgcgctgtgtgacgagcacgggatcatgctgattgccgatgaagtgcagagcggcgcagggcgtaccggcacgctgtttgcgatggagcaaatgggcgtggcaccagatctcaccacctttgcgaaatcgatcgcgggcggcttcccgctggcgggcgtcaccgggcgcgcggaagtgatggatgccgtcgctccaggcggtctgggcggcacctatgccggtaacccgattgcctgcgtagcggcgctggaagtgttaaaagtgtttgagcaggaaaatctgctgcaaaaagccaacgatctggggcagaaactgaaagacggattgctggcgatagccgaaaaacatactgagatcggcgacgtacgcgggctgggagcgatgattgccatcgagctgtttgaagatggcgatcacagcaaaccggacgccaaactcaccgccgagatcgtggcgcgtgcccgcgataaaggcctgattcttctctcctgcggcccgtataacaacgtgctgcgcatccttgtaccgctcaccattgaagacgctcagatccgtcagggtctggagatcatcagccagtgttttgctgaggcgaagcagtag

SEQ ID NO: 6360 - protein, 426 aa, Escherichia coli
MSSNKELMQRRSQAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYAATPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHTEIGDVRGLGAMIAIELFEDGDHSKPDAKLTAEIVARARDKGLILLSCGPYNNVLRILVPLTIEDAQIRQGLEIISQCFAEAKQ

SEQ ID NO: 6361 - DNA, 1464 bp, Escherichia coli
gtgacccgacgcgggaaatgtcggggcgctctcccaagtgacacactttcgagaggattcaggatggggcaatcatcgcaaccacatgagttaggcggcgggctgaagtcacgccacgtcaccatgttgtctattgccggtgttatcggcgcaagtctgtttgtcggttccagcgtcgccatcgccgaagcgggcccggcggtattactggcctatctgttcgccggattactggtggttatgattatgcggatgttggcggaaatggcagttgccacgcccgataccggttcgttttccacctatgccgataaagccattggccgctgggcgggctataccatcggctggttgtactggtggttttgggtactggttatcccacttgaagccaacatcgccgccatgatcctgcactcgtgggttccaggcattcccatctggttattttccctcgtcattaccctcgccttaaccggcagtaatttattaagcgttaaaaactacggcgaatttgagttctggctggcgctgtgtaaagtcatcgctatcctggcctttattttccttggtgcagtcgcaattagcggtttttacccgtatgccgacgtgagcggtatttcaagattgtgggatagcggcggctttatgcccaacggcttcggtgcggtattaagcgcgatgttgatcaccatgttctcgtttatgggcgcagaaattgtcaccattgccgccgcggaatccgacacgccggaaaaacatattgtccgcgccaccaactcggttatctggcgtatctctattttctatttgtgttctatttttgtcgttgtggcattaatcccgtggaatatgccagggctgaaagccgttggttcttatcgctcggttctggaattgctcaatattcctcatgcgaaattaatcatggactgcgtgatattactttccgtaaccagttgcctgaactcggcgctgtataccgcttccaggatgctctactccttaagccgtcgcggtgatgctcccgcggtaatgggtaaaatcaaccgcagtaaaaccccgtacgtagcggtgttactctccaccggcgcggcattcttaacggtggtggtgaactattacgcgcctgcgaaggtgtttaaatttctgatcgacagctccggcgctatcgccctgctggtttatttagtcatcgccgtttcacaattgcggatgcgcaaaattctgcgagcagaaggaagcgaaattcgcctgcggatgtggctttatccgtggctcacctggctggtaatcggttttattacctttgtgttggtagtgatgctattccgcccggcgcaacagttagaagtgctctccaccggcttattagcgattgggattatctgtaccgtgccaattatggctcgctggaaaaagctgataatgtggcaaaaaacacccattcataatacgcgctga

SEQ ID NO: 6362 - protein, 487 aa, Escherichia coli
MTRRGKCRGALPSDTLSRGFRMGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVLSTGLLAIGIICTVPIMARWKKLIMWQKTPIHNTR

SEQ ID NO: 6363 - DNA, 663 bp, Escherichia coli
atgaccattacctctctggatggctatcgctggctgaagaacgatattattcgcggcaattttcagccggatgaaaaattacggatgagtttgctgacatcgcgttatgcacttggcgtcggaccgttgcgggaggcgctttcgcaactggtggcagaacgactggtcacggtggtgaatcaaaaagggtatcgggtggcgtctatgtcagagcaggagctgctcgatattttcgacgcccgcgccaatatggaagcgatgctggtgagtctggcgattgcccgcggtggcgatgaatgggaggcagacgttcttgcgaaggcgcatctgctcagtaagcttgaggcctgtgacgccagtgagaaaatgcttgatgagtgggatctgcgtcatcaggcgtttcatactgcaattgtggcgggctgtggttcttactatttgctgcaaatgcgtgaacggttgtttgatctggcagcgcgttatcgatttatctggctgcggcgaacagtgctttcggtggaaatgctggaagataaacacgatcagcaccagaccctgactgcgacggtactggcgcgagataccgcgcgcgccagtgagttaatgcgccagcatttactgacgccaattcccattatccagcaggcgatggctggcaattaa

SEQ ID NO: 6364 - protein, 220 aa, Escherichia coli
MTITSLDGYRWLKNDIIRGNFQPDEKLRMSLLTSRYALGVGPLREALSQLVAERLVTVVNQKGYRVASMSEQELLDIFDARANMEAMLVSLAIARGGDEWEADVLAKAHLLSKLEACDASEKMLDEWDLRHQAFHTAIVAGCGSYYLLQMRERLFDLAARYRFIWLRRTVLSVEMLEDKHDQHQTLTATVLARDTARASELMRQHLLTPIPIIQQAMAGN

SEQ ID NO: 6365 - DNA, 450 bp, Escherichia coli
atgggtctgttcaattttgtgaaagatgccggagaaaaactctgggacgcggttacaggtcagcacgataaagacgatcaggcgaagaaggtgcaggagcatctgaacaaaaccggtatacctgatgccgataaagtgaacattcaaattgccgacggcaaagcgacggtcacgggtgacggcttaagtcaggaggcgaaggagaaaatccttgttgcggtggggaatatttccggtattgccagtgtcgatgatcaggtgaaaacggcgacaccagccactgccagccagttttataccgttaagtctggcgacactctgagtgccatttccaaacaggtctacggtaacgctaatctgtacaataaaatcttcgaagcgaataaaccgatgctaaaaagcccggataaaatttacccggggcaagtgttgcgtattcctgaagagtag

SEQ ID NO: 6366 - protein, 149 aa, Escherichia coli
MGLFNFVKDAGEKLWDAVTGQHDKDDQAKKVQEHLNKTGIPDADKVNIQIADGKATVTGDGLSQEAKEKILVAVGNISGIASVDDQVKTATPATASQFYTVKSGDTLSAISKQVYGNANLYNKIFEANKPMLKSPDKIYPGQVLRIPEE

SEQ ID NO: 6367 - DNA, 159 bp, Escherichia coli
atgggtttctggagaatcgtcatcaccatcattctgccgccgctcggcgtgctgctcggtaaagggttcggttgggcgttcattattaatattctgctgacactgcttgggtatatccccggtttgattcacgcgttctgggtgcaaacccgcgattaa

SEQ ID NO: 6368 - protein, 52 aa, Escherichia coli
MGFWRIVITIILPPLGVLLGKGFGWAFIINILLTLLGYIPGLIHAFWVQTRD

SEQ ID NO: 6369 - DNA, 300 bp, Escherichia coli
atgactgaactcgcgcaattacaggctagtgccgaacaggcagcggccttattgaaagcaatgagccaccctaaacggttgctgattctgtgcatgcttagcggttcccccggcaccagtgcgggagagctgacgcgcattaccggactaagtgcctctgcaacatcacagcatctcgctcgtatgcgggacgaagggcttatcgacagccaacgggatgcccaacgcattctatattccattaaaaatgaggcggtaaatgccattatcgccaccctgaaaaatgtctattgtccgtaa

SEQ ID NO: 6370 - protein, 99 aa, Escherichia coli
MTELAQLQASAEQAAALLKAMSHPKRLLILCMLSGSPGTSAGELTRITGLSASATSQHLARMRDEGLIDSQRDAQRILYSIKNEAVNAIIATLKNVYCP

SEQ ID NO: 6371 - DNA, 525 bp, Escherichia coli
atggctttgacaaccatttcgccgcatgatgcacaagaattaatcgcacgcggcgcaaagttaatcgatattcgtgacgctgatgaatatcttcgtgaacatattcctgaagcagatctggctccattatccgtgctggaacagtcaggtcttccggctaaattacgtcgcgagcaaataatattccactgccaggcaggtaaacgcaccagtaataacgccgataaattagcagcgattgccgcccccgcagaaatctttttactcgaagatgggattgatggctggaaaaaagcaggattaccagtagcggtaaataaatctcaacccttgccgttaatgcgccaggtgcagatcgctgcgggtggtttaatattaatcggcgttatactaggttataccgtaaatagcggtttcttcttattaagcggctttgttggtgccgggttactgtttgcaggaattagcggtttttgtgggatggcaaggttgttagataagatgccgtggaaccaacgagcttga

SEQ ID NO: 6372 - protein, 174 aa, Escherichia coli
MALTTISPHDAQELIARGAKLIDIRDADEYLREHIPEADLAPLSVLEQSGLPAKLRREQIIFHCQAGKRTSNNADKLAAIAAPAEIFLLEDGIDGWKKAGLPVAVNKSQPLPLMRQVQIAAGGLILIGVILGYTVNSGFFLLSGFVGAGLLFAGISGFCGMARLLDKMPWNQRA

SEQ ID NO: 6373 - DNA, 405 bp, Escherichia coli
atgtccgtaatgttacaaagtttaaataacattcgcaccctccgtgcgatggctcgcgaattctccattgacgttcttgaagaaatgctcgaaaaattcagggttgtcactaaagaaagacgtgaagaagaagaacaacagcagcgtgaactggcagagcgccaggaaaaaattagcacctggctggagctgatgaaagctgacggaattaacccggaagagttattgggtgatagctctgctgcggcaccacgcgctggtaaaaaacgccagccgcgtccggcgaaatataaattcatcgatgttaacggtgaaactaaaacctggaccggtcagggccgtacaccgaagccaatcgctcaggcgctggcagaaggtaaatctctcgacgatttcctgatctaa

SEQ ID NO: 6374 - protein, 134 aa, Escherichia coli
MSVMLQSLNNIRTLRAMAREFSIDVLEEMLEKFRVVTKERREEEEQQQRELAERQEKISTWLELMKADGINPEELLGDSSAAAPRAGKKRQPRPAKYKFIDVNGETKTWTGQGRTPKPIAQALAEGKSLDDFLI

SEQ ID NO: 6375 - DNA, 435 bp, Escherichia coli
atgttctcaccgcagtcacgcttgcgtcatgcagttgcagatacgttcgcgatggttgtttactgttctgtcgtgaacatgtgtattgaagttttcctctccggaatgagtttcgaacagtctttttattccagattggtagcgattccggtgaacatcttaattgcatggccatacggtatgtaccgcgatctgtttatgcgcgcagcacgcaaagttagcccgtcgggctggataaaaaatctggcggatatcatggcttatgtgacgttccagtcaccggtgtatgtggcgatcttgttagtggtgggcgcagactggcatcagattatggcggcggtcagttcaaacatcgttgtttcgatgttgatgggggcggtttatggctacttcctcgattattgccgccgactgtttaaagtcagccgcaggtaa

SEQ ID NO: 6376 - protein, 144 aa, Escherichia coli
MFSPQSRLRHAVADTFAMVVYCSVVNMCIEVFLSGMSFEQSFYSRLVAIPVNILIAWPYGMYRDLFMRAARKVSPSGWIKNLADIMAYVTFQSPVYVAILLVVGADWHQIMAAVSSNIVVSMLMGAVYGYFLDYCRRLFKVSRR

SEQ ID NO: 6377 - DNA, 345 bp, Escherichia coli
atgtatttacgaccagacgaggtggcgcgcgtacttgaaaaagtcggttttactgtcgatgtggtaacccagaaagcgtatggttaccgccgtggggaaaattatgtctatgttaatcgcgaagcgcgaatgggacgtaccgccctggtgattcatccaacattaaaagaacgtagttcaacactggctgaacccgcttccgatattaaaacttgcgatcattaccagcaatttccgctctatttagcaggcgagcgacacgagcattacggtatcccgcatggctttagttcgcgtgttgcgcttgaacgttatttgaatggtttatttggcgaagccagttaa

SEQ ID NO: 6378 - protein, 114 aa, Escherichia coli
MYLRPDEVARVLEKVGFTVDVVTQKAYGYRRGENYVYVNREARMGRTALVIHPTLKERSSTLAEPASDIKTCDHYQQFPLYLAGERHEHYGIPHGFSSRVALERYLNGLFGEAS

SEQ ID NO: 6379 - DNA, 330 bp, Escherichia coli
atgtttaaccgaccgaaccgcaacgacgttgatgatggcgtgcaggatatccagaatgatgtcaatcaattagctgatagtctcgaatctgtattgaagtcctggggcagcgacgccaaaggggaagccgaagccgctcgtagtaaagcgcaggctctactgaaagaaaccagggcgcgaatgcatggtcgtactcgcgtccagcaagccgcgcgtgatgccgttggctgcgcggattcttttgttcgtgaaagaccctggtgtagtgtgggtacagcggcagcggtgggtatttttatcggcgcactgttaagcatgcgcaaatcgtag

SEQ ID NO: 6380 - protein, 109 aa, Escherichia coli
MFNRPNRNDVDDGVQDIQNDVNQLADSLESVLKSWGSDAKGEAEAARSKAQALLKETRARMHGRTRVQQAARDAVGCADSFVRERPWCSVGTAAAVGIFIGALLSMRKS

SEQ ID NO: 6381 - DNA, 1335 bp, Escherichia coli
atgccgcgctatcaggatatcgcccgtcagttaaaaacggctattgagcaaggggaactgaaacccggcgcaaggctgccttcaagtcgtacctggtcgcaggagctgggggtgtctcgatccactgtcgaaaatgcgtatgctgagctggtggcgcaaggatggctgatcaggcggggacaggctggcacatttgtcagtgagcggatatatccgcaacaatctactgtacaagttgtagcttttgccggtgaaagtcagcaaccgttgccatttcaaatgggattacccgcactcgatctctttccgcgagagctgtgggcgcgggtgatggggcgtcgccttcgtacccagacgcgctttgatttggcgttaggcgatgtctgcggtgaggcggcgttgcgcgaggcaatagttgattacttacgcgtttcacgtgggattgattgtcagccagagcaggtctttatcactcacggttatgcggcctcaatagctttaattctgcacgcgctggcgaaaccgggaaacgggatgtggatagaagatcccggctttccactgattcgcccgattgtcactcgccatgatgtggaaattttgcctgtgccggttgatgacaatggactggatatcacaagcggaatacaaaattatcctgatgcgcgttttgccctgataacaccagcacaccaaagtccgctgggtgtggcgctctctttagcgcgcaggcatcagatactggaatgggcagatcgtagtcaggcatggattattgaagatgattatgacagtgagtttcgctatcacggtaagccgttaccggcgttaaaaagtctcgacgcaccgcagcgggtaatttatgccggaacattcagcaaagcgctatttcctgcattgcgctgtgcgtggctggtggtgccggtgaagcaaattgcacaattccgccaccaggcgtcactggctccatgtgcggtacctgttctatggcagaacacactggcagactttcttcgcgaggggcatttctggcggcatctgaagaaaatgcgtcagcattatgctcaacgtcggcaatggattgagcaagcgttgacgcagcaaggatttcaggttgtgccgcagaaaggtggtatccagatggtgatcagaatgataggcgatgatattgcccatgcgcgtaaagccaatgctgcaggccttgcggtgcaggcacttagcgactggcgtatccgttcaagtggggaaggtggattactgctttcgtttactaatatcgttaacgaaggtatggcgcgacaggtagcacaacaattacgtaaagccttaagctaa

SEQ ID NO: 6382 - protein, 444 aa, Escherichia coli
MPRYQDIARQLKTAIEQGELKPGARLPSSRTWSQELGVSRSTVENAYAELVAQGWLIRRGQAGTFVSERIYPQQSTVQVVAFAGESQQPLPFQMGLPALDLFPRELWARVMGRRLRTQTRFDLALGDVCGEAALREAIVDYLRVSRGIDCQPEQVFITHGYAASIALILHALAKPGNGMWIEDPGFPLIRPIVTRHDVEILPVPVDDNGLDITSGIQNYPDARFALITPAHQSPLGVALSLARRHQILEWADRSQAWIIEDDYDSEFRYHGKPLPALKSLDAPQRVIYAGTFSKALFPALRCAWLVVPVKQIAQFRHQASLAPCAVPVLWQNTLADFLREGHFWRHLKKMRQHYAQRRQWIEQALTQQGFQVVPQKGGIQMVIRMIGDDIAHARKANAAGLAVQALSDWRIRSSGEGGLLLSFTNIVNEGMARQVAQQLRKALS

SEQ ID NO: 6383 - DNA, 432 bp, Escherichia coli
atgactacattacgtcagccttactacgaacttagcccggcagtgtataacgcactagtgcaggccaaaacggcactggaaaatagcacgctggataccacgttgatggagttagtttatttgcgcgtctcgcaaatcaacggctgcgcattttgtctggagatgcacagcaaagcattgcgcaaatccggcgtgccacagcacaaactggacgccctggcaggttggcgcgtaagccatcattttgatgaacgcgagcgggcggcgctggcatgggcggaatcggtaaccgaaattgccagaacccatgcggaagacgaggtttatcagcctttgcttgagcatttcagcgcagcagagatcagcgacttaacgtttgccatcgggctgatgaattgttttaaccgtctggccgtttccatgcggatgtaa

SEQ ID NO: 6384 - protein, 143 aa, Escherichia coli
MTTLRQPYYELSPAVYNALVQAKTALENSTLDTTLMELVYLRVSQINGCAFCLEMHSKALRKSGVPQHKLDALAGWRVSHHFDERERAALAWAESVTEIARTHAEDEVYQPLLEHFSAAEISDLTFAIGLMNCFNRLAVSMRM

SEQ ID NO: 6385 - DNA, 246 bp, Escherichia coli
atgcgcattactatttacactcgtaacgattgcgtccagtgccacgccaccaaacgggcgatggaaaaccggggctttgattttgaaatgattaatgtcgatcgcgttcctgaagcggcagaagcgctgcgtgctcagggctttcgtcagttgccggttgtgattgcaggcgatcttagctggtctggtttccgcccggacatgatcaatcgtctgcatccagcgccacacgcggccagtgcatga

SEQ ID NO: 6386 - protein, 81 aa, Escherichia coli
MRITIYTRNDCVQCHATKRAMENRGFDFEMINVDRVPEAAEALRAQGFRQLPVVIAGDLSWSGFRPDMINRLHPAPHAASA

SEQ ID NO: 6387 - DNA, 411 bp, Escherichia coli
atgagccagctcgtctacttttccagcagctccgaaaatacgcagcgttttatcgaacgtttagggctgcccgcggtgcgcatcccgctcaatgagcgggaacggattcaggtagacgagccttacatcctgatcgtgccctcttacggcggcggcggtacggctggcgcggtgccacgacaggtcattcgctttttaaacgacgagcataaccgggcgttgctgcgcggcgttattgcttcgggtaatcgcaactttggtgaggcatatggccgcgccggagatgtgattgcccggaaatgcagcgtgccgtggctgtaccgctttgaactcatgggtacgcaaagcgatatcgaaaacgttcgtaaaggagtaaccgaattttggcaacgacaaccgcagaacgcctga

SEQ ID NO: 6388 - protein, 136 aa, Escherichia coli
MSQLVYFSSSSENTQRFIERLGLPAVRIPLNERERIQVDEPYILIVPSYGGGGTAGAVPRQVIRFLNDEHNRALLRGVIASGNRNFGEAYGRAGDVIARKCSVPWLYRFELMGTQSDIENVRKGVTEFWQRQPQNA

SEQ ID NO: 6389 - DNA, 2145 bp, Escherichia coli
ttggcaacgacaaccgcagaacgcctgacgcaggaaacgatggattatcacgctctgaatgcgatgcttaacctttacgatagcgcaggtcgcattcagttcgataaagacagccaggccgtagacgcctttatgacgacgcatgtgcgtccgaacagtgtggccttcagtagccagcagcagcgcctgaactggctggttaacgaaggttactatgatgaaagcgtccttaatcgctactctcgcgattttgtcattacgctgtttgcccacgcgcacgccagcggttttcgtttccagacattcctcggagcatggaagttttacaccagctatacgttgaagacattcgacggtaagcgttatctggaagattttgccgatcgcgtcacgatggtggcgctgacgctggcacaaggcgatgaaacactggcgacgcagctcactgatgagatgctgtcaggacgctttcagccagccacgccaacattcctcaactgcggtaagcagcagcgcggcgaactggtttcctgttttctgctgcgtattgaagacaatatggagtcgattggccgggcagtaaattccgcactacaactgtcgaaacgcggcggcggcgtagcatttttgctgtcgaatctgcgggaagcgggcgcgccaattaaacgtattgaaaatcaatcttctggcgtgattccggtgatgaaaatgctggaagacgcattttcctatgccaaccaactcggcgcgcgtcagggggctggtgcagtctatttacatgctcatcatcccgatattctgcgttttctcgatacaaaacgggaaaatgccgacgaaaaaatccgcattaaaacactgtcgctgggcgtggtgatcccggatatcactttccatctggcaaaagagaatgcgcagatggcgctgttttcgccctatgacgtagagcgagtttatggcaagccgtttgccgatgtcgccatcagtgaacactatgacgaactggttgccgatgaacgcatccgcaaaaaatacctcaacgcccgtgatttcttccagcgactggcagaaatccagtttgagtctggctatccgtacatcatgtatgaagacacggttaaccgtgctaaccctatcgccgggcgcataaatatgagcaatctctgctcagaaattttgcaggttaacagcgcctcagaatatgacgagaatctcgactatgctcgtacaggacatgatatttcctgcaatctagggtcgttgaatattgcccacaccatggattcccccgactttgcccgcacggtagagactgccgtacgcggtttaacggcggtgtcagatatgagtcatatccgcagcgtgccgtccatcgaagccggaaatgccgcctcacacgccatcggtctggggcagatgaatttacacggttatctggcacgagaaggcatcgcttatgggtcgccggaagcactggatttcaccaatctctatttctataccatcacctggcacgcactgcgtacctcgatgttgctggcgcgcgaacgcggtgaaaccttcgccgggttcaaacagtcacgctatgccagtggtgaatatttcagccaatatctgcaaggtaactggcagccgaaaacggcgaaagttggcgaactgtttgcccgtagcggtattacgttacctacccgtgagatgtgggcacagctgcgcgacgacgtgatgcgctatggtatctacaaccagaatctccaggcggtgccgccaaccggttctatctcttatatcaaccatgccacgtcgagtattcatccgattgtggcgaaagtagagatacgcaaagagggcaaaacaggacgcgtttactaccctgccccgtttatgactaacgaaaatctggcgctgtatcaggacgcttacgaaatcggcgcagaaaagatcatcgacacctacgcggaagcgactcgccatgtcgatcaggggctgtcgctgacgctgtttttccccgataccgccaccactcgcgatatcaacaaagcgcagatttacgcctggcgcaagggtatcaaaacgctctattacattcgcctgcgtcagatggcgctggaaggcactgaaattgaaggctgcgtctcctgtgcactttaa

SEQ ID NO: 6390 - protein, 714 aa, Escherichia coli
MATTTAERLTQETMDYHALNAMLNLYDSAGRIQFDKDSQAVDAFMTTHVRPNSVAFSSQQQRLNWLVNEGYYDESVLNRYSRDFVITLFAHAHASGFRFQTFLGAWKFYTSYTLKTFDGKRYLEDFADRVTMVALTLAQGDETLATQLTDEMLSGRFQPATPTFLNCGKQQRGELVSCFLLRIEDNMESIGRAVNSALQLSKRGGGVAFLLSNLREAGAPIKRIENQSSGVIPVMKMLEDAFSYANQLGARQGAGAVYLHAHHPDILRFLDTKRENADEKIRIKTLSLGVVIPDITFHLAKENAQMALFSPYDVERVYGKPFADVAISEHYDELVADERIRKKYLNARDFFQRLAEIQFESGYPYIMYEDTVNRANPIAGRINMSNLCSEILQVNSASEYDENLDYARTGHDISCNLGSLNIAHTMDSPDFARTVETAVRGLTAVSDMSHIRSVPSIEAGNAASHAIGLGQMNLHGYLAREGIAYGSPEALDFTNLYFYTITWHALRTSMLLARERGETFAGFKQSRYASGEYFSQYLQGNWQPKTAKVGELFARSGITLPTREMWAQLRDDVMRYGIYNQNLQAVPPTGSISYINHATSSIHPIVAKVEIRKEGKTGRVYYPAPFMTNENLALYQDAYEIGAEKIIDTYAEATRHVDQGLSLTLFFPDTATTRDINKAQIYAWRKGIKTLYYIRLRQMALEGTEIEGCVSCAL

SEQ ID NO: 6391 - DNA, 960 bp, Escherichia coli
atgaaactctcacgtatcagcgccatcaactggaacaagatatctgacgataaagatctggaggtgtggaatcgcctgaccagcaatttctggctaccagaaaaggtgccactgtcgaacgatattcctgcatggcagacattaagtgtcgtagaacaacaactaacaatgcgcgtttttactggcctgacgctgctcgacacgctgcaaaatgttatcggcgcgccctcgctgatgcccgatgcactcaccccccatgaagaggcggtattatcaaatatcagctttatggaagcggttcatgcccgctcttacagttcaattttctcgacgctgtgccagaccaaagatgtcgatgccgcctacgcctggagcgaagaaaacgcgccgttgcagcgaaaagcacagattattcagcaacattatcgcggtgatgatccgctgaaaaagaaaatcgccagtgtgtttcttgaatcttttttgttctattccggtttctggctgccgatgtattttgccagccgcggaaagctaaccaataccgcagacctgatccgtctgattatccgggatgaagcagtccacggttactacatcggctataaatatcagaaaaaccaggaaaagatctcccaggcacagcgtgaagagttgaagagtttcgccttcgatttgttgctggaactctatgacaacgagttgcaatataccgatgagctgtacgccgaaaccccgtggtctgacgatgtaaaagcgtttctctgttacaacgccaataaggcgttgatgaatctgggctacgaaccgctatttcccgcagaaatggcggaagtgaatccggcaatcctcgccgcgctttcgccgaatgccgatgaaaatcacgatttcttttccggttcaggctcttcatatgtgatgggaaaagcggtcgaaacagaagatgaagactggaatttctga

SEQ ID NO: 6392 - protein, 319 aa, Escherichia coli
MKLSRISAINWNKISDDKDLEVWNRLTSNFWLPEKVPLSNDIPAWQTLSVVEQQLTMRVFTGLTLLDTLQNVIGAPSLMPDALTPHEEAVLSNISFMEAVHARSYSSIFSTLCQTKDVDAAYAWSEENAPLQRKAQIIQQHYRGDDPLKKKIASVFLESFLFYSGFWLPMYFASRGKLTNTADLIRLIIRDEAVHGYYIGYKYQKNQEKISQAQREELKSFAFDLLLELYDNELQYTDELYAETPWSDDVKAFLCYNANKALMNLGYEPLFPAEMAEVNPAILAALSPNADENHDFFSGSGSSYVMGKAVETEDEDWNF

SEQ ID NO: 6393 - DNA, 1203 bp, Escherichia coli
atggcaattaaattagaaattaaaaatctttataaaatatttggtgagcatccacagcgagctttcaaatatatcgaacaaggactttcaaaagaacaaattctggaaaaaactgggctatcgcttggcgtaaaagacgccagtctggccattgaagaaggcgagatatttgtcatcatgggattatccggttcgggtaaatccacaatggtacgccttctcaatcgcctgattgaacccacccgcgggcaagtgctgattgatggtgtggatattgccaaaatatccgacgccgaactccgtgaggtgcgcagaaaaaagattgcgatggtcttccagtcctttgccttaatgccgcatatgaccgtgctggacaatactgcgttcggtatggaactggccggaattaatgccgaagaacgccgggaaaaggcccttgatgcactgcgtcaggtcgggctggaaaattatgcccacagctacccggatgaactctctggcgggatgcgtcaacgagtgggattagcccgcgcgttagcgattaatccggatatattattaatggacgaagccttctcggcgctcgatccattaattcgcaccgagatgcaggatgagctggtaaaattacaggcgaaacatcagcgcaccattgtctttatttcccacgatctcgatgaagctatgcgtattggtgaccgaattgccattatgcaaaatggtgaagtggtgcaggttggtacaccggatgaaattcttaataatccggcgaatgattatgtccgaaccttcttccgtggcgtcgatattagccaggtgttcagtgcgaaagatattgcccgtcgtacaccgaacggcttaattcgtaaaacccccggcttcggcccgcgttcggcactgaaattattgcaggatgaagatcgcgaatatggctacgtcatcgaacgcggtaataagtttgtcggcgctgtgtctatcgattcgcttaaagccgcgttaacgcagcagcaaggtcttgatgcggcgctgattgatgcgccgttagcggtcgatgcacaaacgcctcttagcgaattgctctctcatgtcggacaggcaccctgtgcggtgcccgtggtcgacgaggaccaacagtatgtcggcatcatttcgaaaggaatgctgctgcgcgctttagatcgtgagggggtaaataatggctga

SEQ ID NO: 6394 - protein, 400 aa, Escherichia coli
MAIKLEIKNLYKIFGEHPQRAFKYIEQGLSKEQILEKTGLSLGVKDASLAIEEGEIFVIMGLSGSGKSTMVRLLNRLIEPTRGQVLIDGVDIAKISDAELREVRRKKIAMVFQSFALMPHMTVLDNTAFGMELAGINAEERREKALDALRQVGLENYAHSYPDELSGGMRQRVGLARALAINPDILLMDEAFSALDPLIRTEMQDELVKLQAKHQRTIVFISHDLDEAMRIGDRIAIMQNGEVVQVGTPDEILNNPANDYVRTFFRGVDISQVFSAKDIARRTPNGLIRKTPGFGPRSALKLLQDEDREYGYVIERGNKFVGAVSIDSLKAALTQQQGLDAALIDAPLAVDAQTPLSELLSHVGQAPCAVPVVDEDQQYVGIISKGMLLRALDREGVNNG

SEQ ID NO: 6395 - DNA, 1065 bp, Escherichia coli
atggctgatcaaaataatccgtgggataccacgccagcggcggacagtgctgcacaatccgcagacgcctggggtacaccggcgactgcaccgactgacggcggtggcgctgactggctgaccagtacgcctgcgccaaacgtcgagcattttaatattctcgatccgttccataaaacgctgatcccgctcgacagttgggtcactgaagggatcgactgggtcgttacccattttcgtcccgtctttcagggcgtgcgcgttccggttgattacatcctcaacggtttccagcaattgctgctgggtatgcccgcgccggtggcgattatcgttttcgctctcatcgcctggcagatttccggggtcggaatgggcgtggcgacgctggtttcgctgattgccatcggcgcaatcggtgcctggtcacaggcaatggttaccctggcgctggtgttaacagccctgctgttctgtatcgtcataggtttgccgttggggatctggctggcgagaagtccgagagcggcgaaaattattcgtccactgcttgatgccatgcagaccacgcccgcgtttgtttatctggtgccaatcgtcatgctgtttggtatcggcaacgtgccgggcgtggtggtgacgatcatctttgcgctgccgccgattatccgtctgacgattctgggaattaaccaggttccggcggatctgattgaagcctcgcgctcattcggtgccagcccgagccagatgctgttcaaagttcagttaccgctggcgatgccaaccattatggcgggcgttaaccagacgctgatgctggccctttctatggtggtcatcgcctcgatgattgccgtcggcgggctgggtcagatggtacttcgcggtatcggtcgtctggatatggggcttgccaccgttggcggcgtcgggattgtgatcctcgccattatcctcgaccgcctgacgcaggccgttgggcgcgactcacgcagtcgtggcaaccgtcgctggtacaccactggccctgtcggtctgctgacccgcccattcattaagtaa

SEQ ID NO: 6396 - protein, 354 aa, Escherichia coli
MADQNNPWDTTPAADSAAQSADAWGTPATAPTDGGGADWLTSTPAPNVEHFNILDPFHKTLIPLDSWVTEGIDWVVTHFRPVFQGVRVPVDYILNGFQQLLLGMPAPVAIIVFALIAWQISGVGMGVATLVSLIAIGAIGAWSQAMVTLALVLTALLFCIVIGLPLGIWLARSPRAAKIIRPLLDAMQTTPAFVYLVPIVMLFGIGNVPGVVVTIIFALPPIIRLTILGINQVPADLIEASRSFGASPSQMLFKVQLPLAMPTIMAGVNQTLMLALSMVVIASMIAVGGLGQMVLRGIGRLDMGLATVGGVGIVILAIILDRLTQAVGRDSRSRGNRRWYTTGPVGLLTRPFIK

SEQ ID NO: 6397 - DNA, 993 bp, Escherichia coli
atgcgacatagcgtactttttgcgacagcgtttgccacgcttatctctacacaaacttttgctgccgacctgccgggcaaaggcattactgttaatccggttcagagcaccatcaccgaagaaactttccagacgctgctggtcagccgcgcgctggagaaattaggttataccgtcaataaacccagcgaagtggattacaacgttggctacacctcgcttgcttccggcgatgcaaccttcaccgcagtgaactggacgccactgcatgacaacatgtacgaagctgccggtggcgataagaaattttatcgtgaaggagtatttgttaacggcgcggcacagggttacctgatcgataagaaaaccgccgaccagtataaaattaccaacatcgcgcaacttaaagatccgaagatcgccaaactgttcgataccaacggcgacggtaaagcggatttaaccggctgtaacccaggctggggctgcgaaggtgcgatcaaccaccagcttgccgcgtatggactgaccaataccgtgacgcataatcaggggaactacgcagcgatgatggctgacaccatcagtcgttacaaagagggtaagccggtgttttactacacctggacgccgtactgggtgagtaacgaactgaaaccggggaaagatgtggtctggttgcaggtgccgttctccgcactgccgggcgataaaaatgccgataccaaactgccgaatggcgcgaattacggcttcccggtcagtaccatgcatatcgttgccaacaaagcctgggccgagaaaaacccggcagcagcgaaactgtttgccattatgcagttaccagtggctgatattaacgcccagaacgccatcatgcatgacggcaaagcctcagaagacgatattcagggccacgttgatggttggatcaaagcccaccagcagcagttcgatggctgggtgaatgaagcgctggcagcgcagaagtaa

SEQ ID NO: 6398 - protein, 330 aa, Escherichia coli
MRHSVLFATAFATLISTQTFAADLPGKGITVNPVQSTITEETFQTLLVSRALEKLGYTVNKPSEVDYNVGYTSLASGDATFTAVNWTPLHDNMYEAAGGDKKFYREGVFVNGAAQGYLIDKKTADQYKITNIAQLKDPKIAKLFDTNGDGKADLTGCNPGWGCEGAINHQLAAYGLTNTVTHNQGNYAAMMADTISRYKEGKPVFYYTWTPYWVSNELKPGKDVVWLQVPFSALPGDKNADTKLPNGANYGFPVSTMHIVANKAWAEKNPAAAKLFAIMQLPVADINAQNAIMHDGKASEDDIQGHVDGWIKAHQQQFDGWVNEALAAQK

SEQ ID NO: 6399 - DNA, 1185 bp, Escherichia coli
atgactaaacctaatcatgagcttagcccggcgctgatcgtgctgatgtctatcgccaccggtctggcggtagccagtaactattacgcccagccattgctcgacaccatcgcgcgtaacttttccctttccgccagttcggcaggctttattgttaccgccgcgcagttgggctatgccgcaggtctgctgtttcttgttcccctcggtgatatgtttgaacgccgccgcctgattgtctcgatgaccttactggcagcaggcggcatgttaatcactgccagcagtcagtcgctggcgatgatgatcctcggtacagcattaaccggtttattttcagtcgtggcacaaattctggttccactggcagcgacgctggcttcaccggacaaacgcggcaaagtggttggcaccattatgagcggtctgctattggggatcttactcgcacggaccgttgccggattgctggcgaatctcggcggctggcgcaccgtcttttgggttgcttcgatgttaatggcactgatggcgctggcattatggcgtggtctgccacaaatgaaatcagaaacccacctcaactacccacagttgttgggttccgttttcagcatgtttatcagcaataagatcctgcgcacccgcgcgttgctgggctgcctgacctttgccaacttcagcattctctggacctcaatggcctttttgcttgccgctccaccttttaactacagcgatggtgtaattggtctgtttgggcttgcgggagctgccggagcgttgggcgctcgtccggcgggcggttttgccgataagggcaaatcgcaccacaccacaactttcggtctgctgctgctgttactttcatggctggcaatctggtttggtcacacttccgtactggcgctgattatcggcatcctggtgctggacctcaccgtgcagggcgtgcatatcactaaccagacggtaatttatcgaatacaccctgatgcgcgtaatcgcctgaccgcaggttacatgaccagctactttattggcggtgccgctggttcgctaatttcagcctcagcctggcaacatggcggttgggctggcgtgtgtctggctggcgcgacgattgccctggttaacttactggtctggtggcgaggttttcatcgtcaggaagccgcaaattaa

SEQ ID NO: 6400 - protein, 394 aa, Escherichia coli
MTKPNHELSPALIVLMSIATGLAVASNYYAQPLLDTIARNFSLSASSAGFIVTAAQLGYAAGLLFLVPLGDMFERRRLIVSMTLLAAGGMLITASSQSLAMMILGTALTGLFSVVAQILVPLAATLASPDKRGKVVGTIMSGLLLGILLARTVAGLLANLGGWRTVFWVASMLMALMALALWRGLPQMKSETHLNYPQLLGSVFSMFISNKILRTRALLGCLTFANFSILWTSMAFLLAAPPFNYSDGVIGLFGLAGAAGALGARPAGGFADKGKSHHTTTFGLLLLLLSWLAIWFGHTSVLALIIGILVLDLTVQGVHITNQTVIYRIHPDARNRLTAGYMTSYFIGGAAGSLISASAWQHGGWAGVCLAGATIALVNLLVWWRGFHRQEAAN

SEQ ID NO: 6401 - DNA, 738 bp, Escherichia coli
atggaaagccctactccacagcctgctcctggttcggcgaccttcatggaaggatgcaaagacagtttaccgattgttattagttatattccggtggcctttgcgttcggtctgaatgcgacccgtctgggattctctcctctcgaaagcgtttttttctcctgcatcatttatgcaggcgcgagccagttcgtcattaccgcgatgctggcagccgggagtagtttgtggattgctgcactgaccgtcatggcaatggatgttcgccatgttttgtatggcccgtcactgcgtagccgtattattcagcgtctgcaaaaatcgaaaaccgccctgtgggcatttggcctgacggatgaggtttttgccgccgcaaccgcaaaactggtacgcaataatcgccgctggagcgagaactggatgatcggcattgccttcagttcatggtcatcgtgggtatttggtacggtaataggggcattctccggcagcggcttgctgcaaggatatcccgccgttgaagctgcattaggttttatgcttccggcactctttatgagtttcctgctcgcctctttccagcgcaaacaatctctttgcgttaccgcagcgttagttggtgcccttgcaggcgtaacgctattttctattcccgtcgccattctggcaggcattgtctgtggctgcctcactgcgttaatccaggcattctggcaaggagcgcccgatgagctatga

SEQ ID NO: 6402 - protein, 245 aa, Escherichia coli
MESPTPQPAPGSATFMEGCKDSLPIVISYIPVAFAFGLNATRLGFSPLESVFFSCIIYAGASQFVITAMLAAGSSLWIAALTVMAMDVRHVLYGPSLRSRIIQRLQKSKTALWAFGLTDEVFAAATAKLVRNNRRWSENWMIGIAFSSWSSWVFGTVIGAFSGSGLLQGYPAVEAALGFMLPALFMSFLLASFQRKQSLCVTAALVGALAGVTLFSIPVAILAGIVCGCLTALIQAFWQGAPDEL

SEQ ID NO: 6403 - DNA, 336 bp, Escherichia coli
atgagctatgaggttctgctgcttgggttactggttggcacggcgaattattgcttccgctatttgccgctgcgcctgcgtgtgggtaatgcccgcccaaccaaacgtggcgcgataggcatattgctcgacaccattggcatcgcctcgatatgcgctctgctggttgtctctaccgcaccagaagtgatgcacgatacacgccgtttcgtgcccacactggtcggcttcgcggtactgggtgccagtttctataaaacacgcagcattatcatcccaacactgcttagtgcgctggcctatgggctcgcctggaaagtgatggcgattatataa

SEQ ID NO: 6404 - protein, 111 aa, Escherichia coli
MSYEVLLLGLLVGTANYCFRYLPLRLRVGNARPTKRGAIGILLDTIGIASICALLVVSTAPEVMHDTRRFVPTLVGFAVLGASFYKTRSIIIPTLLSALAYGLAWKVMAII

SEQ ID NO: 6405 - DNA, 531 bp, Escherichia coli
atggatagttcgtttacgcccattgaacaaatgctaaaatttcgcgccagccgccacgaagattttccttatcaggagatccttctgacccgtctttgcatgcatatgcaaagcaagctgctggaaaaccgcaataaaatgctgaaggctcaggggattaacgagacgttgtttatggcgttgattacgctggagtctcaggaaaaccacagtattcagccttctgaattgagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccgccgcagcataactgcctgcatcaactctggtccgcgctcagcacaacagaaaaagaccagctcgagcaaatcacccgcaaattgctctcccgtctcgaccagatggaacaagacggtgtggttctcgaagcgatgagctaa

SEQ ID NO: 6406 - protein, 176 aa, Escherichia coli
MDSSFTPIEQMLKFRASRHEDFPYQEILLTRLCMHMQSKLLENRNKMLKAQGINETLFMALITLESQENHSIQPSELSCALGSSRTNATRIADELEKRGWIERRESDNDRRCLHLQLTEKGHEFLREVLPPQHNCLHQLWSALSTTEKDQLEQITRKLLSRLDQMEQDGVVLEAMS

SEQ ID NO: 6407 - DNA, 1173 bp, Escherichia coli
atgagcgcaaatgcggagactcaaaccccgcagcaaccggtaaagaagagcggcaaacgtaagcgtctgctcctccttctcaccttgctctttataattattgccgtagcgatagggatttattggtttttagtactgcgtcatttcgaagaaaccgatgacgcatacgtggcagggaatcagattcaaattatgtctcaggtgtctggcagcgtgacgaaagtctgggctgataacaccgattttgtaaaagaaggcgacgtgctggtcactctcgacccgacagatgctcgccaggcatttgaaaaagccaaaactgcactggcttccagcgttcgccaaacccaccagctgatgattaacagcaaacagttgcaggcgaatattgaggtgcaaaaaatcgccctcgcgaaagcacaaagcgactacaaccgccgtgtgccgctgggcaatgccaacctgattggtcgcgaagagctgcaacacgcccgcgacgccgtcaccagtgcccaggcgcaactggacgtcgctattcaacaatacaatgccaatcaggcgatgattctggggacgaaactggaagatcagcctgccgtacaacaggctgccaccgaagtacgtaacgcctggctggcgctggagcgtacccgtattgtcagtccgatgaccggttatgtctcccgccgcgcggtacagcctggggcgcaaattagcccaacgacgccgctgatggcggtcgttccagccaccaatatgtgggtggatgccaactttaaagagacgcagattgccaatatgcgtatcggtcagccggtcaccatcaccaccgatatttacggcgatgatgtgaaatacaccggtaaagtggttggtctggatatgggcacaggtagcgcgttctcactgcttccggcgcaaaacgccaccggtaactggatcaaagtcgttcagcgtctgcctgtgcgtattgaactggaccagaaacagctggagcaatacccgctgcgtatcggtttatccacgctggtgagtgtcaataccactaaccgtgacggtcaggtactggcaaataaagtacgttccacaccggtcgcggtaagcaccgcgcgtgaaatcagcctggcacctgtcaataaactgatcgacgatatcgtaaaagctaacgctggctaa

SEQ ID NO: 6408 - protein, 390 aa, Escherichia coli
MSANAETQTPQQPVKKSGKRKRLLLLLTLLFIIIAVAIGIYWFLVLRHFEETDDAYVAGNQIQIMSQVSGSVTKVWADNTDFVKEGDVLVTLDPTDARQAFEKAKTALASSVRQTHQLMINSKQLQANIEVQKIALAKAQSDYNRRVPLGNANLIGREELQHARDAVTSAQAQLDVAIQQYNANQAMILGTKLEDQPAVQQAATEVRNAWLALERTRIVSPMTGYVSRRAVQPGAQISPTTPLMAVVPATNMWVDANFKETQIANMRIGQPVTITTDIYGDDVKYTGKVVGLDMGTGSAFSLLPAQNATGNWIKVVQRLPVRIELDQKQLEQYPLRIGLSTLVSVNTTNRDGQVLANKVRSTPVAVSTAREISLAPVNKLIDDIVKANAG

SEQ ID NO: 6409 - DNA, 1539 bp, Escherichia coli
atgcaacagcaaaaaccgctggaaggcgcacaactggtcattatgacgattgcgctgtcactggcgacattcatgcaggtgctggactccaccattgctaacgtggcgatccccactatcgccgggaatctgggctcatcactcagtcagggaacgtgggtgatcacttctttcggggtggcgaatgccatctcgatcccgcttaccggctggctggcaaagcgcgtcggggaagtgaaattgttcctctggtcaaccatcgcctttgctattgcgtcgtgggcgtgtggtgtctccagcagcctgaatatgctgatcttcttccgcgtgattcaggggattgtcgccgggccgctgatcccgctttcacaaagtctattgctgaataactacccgccagccaaacgctcgatcgcgctggcgttgtggtcgatgacggtgattgttgcaccaatttgcggcccgatcctcggcggttatatcagtgataattaccactggggctggatattcttcatcaacgtgccgattggcgtggcggtggtgttgatgacactgcaaactctgcgcggacgtgaaacccgcaccgaacggcggcggattgatgccgtggggctggcactgctggttattggtatcggcagcctgcagattatgctcgaccgcggtaaagagctggactggttctcatcacaggaaattatcatcctcaccgtggtggcggtggtggctatctgcttcctgattgtctgggagctgaccgacgataacccgatagtcgatctgtcgttgtttaagtcgcgcaacttcaccatcggctgcttgtgtatcagcctcgcgtatatgctctacttcggcgcgattgttctgctgccgcagttgttgcaggaggtctacggttacacggcgacgtgggcagggctggcctctgcgccggtagggattattccggtgatcctgtcgccgattatcggccgctttgcgcataaactggatatgcgccgactggtaaccttcagctttattatgtatgccgtttgcttctactggcgtgcctatacctttgaaccgggtatggattttggcgcgtcggcctggccacagtttatccagggttttgcggtggcctgcttctttatgccgctgaccaccattacgctgtccggtttgccaccggaacgactggcggcggcatcgagcctctccaactttacgcgaacgctggcggggtctatcggcacgtcgataaccacgaccatgtggaccaaccgcgagtcactgcaccatgcacagttgactgagtcggtaaacccgttcaacccgaatgctcaggcgatgtacagtcaactggaagggcttggtatgacgcaacagcaggcatcaggctggattgcccagcagatcaccaatcaggggctgattatttccgccaatgagatcttctggatgtcagccgggatattcctcgtcttgctggggctggtgtggtttgctaaaccgccctttggcgcaggtggcggcggaggcggtgcgcactaa

SEQ ID NO: 6410 - protein, 512 aa, Escherichia coli
MQQQKPLEGAQLVIMTIALSLATFMQVLDSTIANVAIPTIAGNLGSSLSQGTWVITSFGVANAISIPLTGWLAKRVGEVKLFLWSTIAFAIASWACGVSSSLNMLIFFRVIQGIVAGPLIPLSQSLLLNNYPPAKRSIALALWSMTVIVAPICGPILGGYISDNYHWGWIFFINVPIGVAVVLMTLQTLRGRETRTERRRIDAVGLALLVIGIGSLQIMLDRGKELDWFSSQEIIILTVVAVVAICFLIVWELTDDNPIVDLSLFKSRNFTIGCLCISLAYMLYFGAIVLLPQLLQEVYGYTATWAGLASAPVGIIPVILSPIIGRFAHKLDMRRLVTFSFIMYAVCFYWRAYTFEPGMDFGASAWPQFIQGFAVACFFMPLTTITLSGLPPERLAAASSLSNFTRTLAGSIGTSITTTMWTNRESLHHAQLTESVNPFNPNAQAMYSQLEGLGMTQQQASGWIAQQITNQGLIISANEIFWMSAGIFLVLLGLVWFAKPPFGAGGGGGGAH

SEQ ID NO: 6411 - DNA, 708 bp, Escherichia coli
atgaatacccaacggaaatacgggagaacctggcattatcctttctcccctggcaccaccagcgatgaccgcattaacgccgattactggcaggatttacaggccatcacgcaactggtgcacacagaaaaactcgacggcgaaaataactgccttaaccgctacggcgtgtttgcccgttcccatgctgcgcctacgcagtcggcatggacttataaaattcgccagcgttggcaactgctgaaaaacgatctcggcgatctggaactgtttggtgaaaatctctacgccgttcattccattgaataccgcgcgctggaacaggacttttacctgtttgccgttcgctgccaggatatgtggctgagctgggaagaggtgcagttttacgccgctctgtttgatttcccctgcgttcccgaaatctccggcccgcagccggggaatgatgaaaaaagctggcaacgtgattttctggcgctgaccaatgcgcgcggcacattcgatccctgggatacgcaaacctgtcaaccctgtacgctggaaggcattgtcagccgaaatcatgatgcgttttctgtcgctgacttttcgcataacgtcttcaagtatgtgcgcaaaaatcatgtcaaaaccactgtgcactggaaacgccactggcaacgggcgcggatggcccatgagttcgtttatggagaacagtcatga

SEQ ID NO: 6412 - protein, 235 aa, Escherichia coli
MNTQRKYGRTWHYPFSPGTTSDDRINADYWQDLQAITQLVHTEKLDGENNCLNRYGVFARSHAAPTQSAWTYKIRQRWQLLKNDLGDLELFGENLYAVHSIEYRALEQDFYLFAVRCQDMWLSWEEVQFYAALFDFPCVPEISGPQPGNDEKSWQRDFLALTNARGTFDPWDTQTCQPCTLEGIVSRNHDAFSVADFSHNVFKYVRKNHVKTTVHWKRHWQRARMAHEFVYGEQS

SEQ ID NO: 6413 - DNA, 1044 bp, Escherichia coli
atgcatcacacgccacaagaccctgagcatcatggtgaaggcgacgtcggcgtacataccgaaatggtgcttaacgccctcattactctgccagaattccagcaactccccgctcaacagcaggaagttttatgggcggcggcgttattgcatgatgttgaaaagcgcagcactaccgtgcaggaaaacggacgtattcagtctcctggtcatgctcgtcggggcgaactgacggcccgacaaattttatggcgcgatatcccaacgccgttcgtgctgcgcgagcaaattgttgcactggtgcgtctgcatgggttaccgctatggttactggaacgcccggaaccggagcgtttgttgctcacggctgcaatgcgcatcgacacgcgtctgctcgctttgcttgctcgtgccgatctgcttggtcgccaaagcccggatcagcaatcaatgctggaacgcatcgatctgttcgagctgttttgccatgagcaacaatgctggggaaaaatgcgcccgttcgtttctgattccgcacgctggcattacctgacccatgagcaaagttctcctgattttgttccctgggaggctgaaccttttgaggtcattttgctgtgtggcttaccgggtatgggcaaagatcgctatatcaatgaacagtgccagggaatggacgttatcagccttgatgatatgcggcggcgaatcaatgccagtccggacgacaaaaccgctaccgggcgtattgtgcaacaggcaaaagaagaggcgcgcgtttttttacgccagaaaaagccgttcatctggaatgcaacgaacattacccgccagctacgcagccagctcatcagtctgtttacggcttacggcgcacgagtaaaaatcgtttatctggaagtgccatgggcgcaatggaagcagcaaaatgccagacgcgagtatgcagttcctgaagcggtcatgatgcggatggcctcaaggctggaagttcctcaacttgatgaagcacatagcgtggaatatcggatgactgacaggtaa

SEQ ID NO: 6414 - protein, 347 aa, Escherichia coli
MHHTPQDPEHHGEGDVGVHTEMVLNALITLPEFQQLPAQQQEVLWAAALLHDVEKRSTTVQENGRIQSPGHARRGELTARQILWRDIPTPFVLREQIVALVRLHGLPLWLLERPEPERLLLTAAMRIDTRLLALLARADLLGRQSPDQQSMLERIDLFELFCHEQQCWGKMRPFVSDSARWHYLTHEQSSPDFVPWEAEPFEVILLCGLPGMGKDRYINEQCQGMDVISLDDMRRRINASPDDKTATGRIVQQAKEEARVFLRQKKPFIWNATNITRQLRSQLISLFTAYGARVKIVYLEVPWAQWKQQNARREYAVPEAVMMRMASRLEVPQLDEAHSVEYRMTDR

SEQ ID NO: 6415 - DNA, 516 bp, Escherichia coli
atgccgttgttagatagcttcacagtcgatcatacccggatggaagcgcctgcagttcgggtggcaaaaacaatgaacaccccgcatggcgacgcaatcaccgtgttcgatctgcgcttctgcgtgccgaacaaagaagtgatgccagaaagagggatccataccctggagcacctgtttgctggttttatgcgtaaccatcttaacggtaatggcgtagagattatcgatatctcgccaatgggctgccgcaccggtttttatatgagtctgattggtacgccagatgagcagcgtgtcgctgatgcctggaaagcggcaatggaagacgtgctgaaagtgcaggatcagaatcagatcccggaactgaacgtctaccagtgtggcacttaccagatgcactcgttgcaggaagcgcaggatattgcgcgtagcattctggaacgtgacgtgcgcatcaacagcaacgaagaactggcgctgccgaaagagaagttgcaggaactgcacatttag

SEQ ID NO: 6416 - protein, 171 aa, Escherichia coli
MPLLDSFTVDHTRMEAPAVRVAKTMNTPHGDAITVFDLRFCVPNKEVMPERGIHTLEHLFAGFMRNHLNGNGVEIIDISPMGCRTGFYMSLIGTPDEQRVADAWKAAMEDVLKVQDQNQIPELNVYQCGTYQMHSLQEAQDIARSILERDVRINSNEELALPKEKLQELHI

SEQ ID NO: 6417 - DNA, 885 bp, Escherichia coli
  n 4, 5, 6, 7, 8: n is any nucleotide
atgnnnnncctgccgtatgcgacctctcttcgtttgagcgatcttggctataccaataaatcgcaaagcaatcttggtatcaccttcaatgatctctacgagtacgtggcgggccttaaacaggcaatcaaaacgccatcggaagagtacgcgaagattggtattgagaaagacggtaagcggctgcaaatcaacagcaatgtgctgcagattgaaaacgaactgtacgcgccgattcgtccaaaacgcgttacccgcagtggtgagtcgccttctgatgcgctgttacgtggcggcattgaatatattgaagtccgctcgctggatatcaacccgttctcgccgattggtgtagatgaacaacaggtgcgattcctcgacctgtttatggtctggtgtgcgctggctgacgcaccggaaatgagcagtagcgaacttgcctgtacacgcgttaactggaaccgggtgatcctcgaaggtcgcaaaccgggcctgacgctgggtatcggctgcgaaaccgcgcagttcccgttaccgcaggtgggtaaagatctgttccgcgatctgaaacgcgtcgcgcaaacgctggatagcattaacggcggcgaagcgtatcagaaagtgtgtgatgaactggtcgcctgcttcgataatcccgatctgactttctctgcccgtatcttaaggtctatgattgatactggtattggcggaacaggcaaagcgtttgctgaagcgtaccgtaatctgctgcgtgaagagccgctggaaattctgcgcgaagaggattttgtcgccgagcgcgaggcgtctgaacgccgtcagcaggaaatggaagccgctgataccgaaccgtttgcggtgtggctggaaaagcacgcctga

SEQ ID NO: 6418 - protein, 294 aa, Escherichia coli
  Xaa 2, 3: Xaa is any amino acid
MXXLPYATSLRLSDLGYTNKSQSNLGITFNDLYEYVAGLKQAIKTPSEEYAKIGIEKDGKRLQINSNVLQIENELYAPIRPKRVTRSGESPSDALLRGGIEYIEVRSLDINPFSPIGVDEQQVRFLDLFMVWCALADAPEMSSSELACTRVNWNRVILEGRKPGLTLGIGCETAQFPLPQVGKDLFRDLKRVAQTLDSINGGEAYQKVCDELVACFDNPDLTFSARILRSMIDTGIGGTGKAFAEAYRNLLREEPLEILREEDFVAEREASERRQQEMEAADTEPFAVWLEKHA

SEQ ID NO: 6419 - DNA, 336 bp, Escherichia coli
  n 318, 319, 320, 321, 322: n is any nucleotide
ttgatcccggacgtatcacaggcgctggcctggctggaaaaacatcctcaggcgttaaaggggatacagcgtgggctggagcgcgaaactttgcgtgttaatgctgatggcacactggcaacaacaggtcatcctgaagcattaggttctgcactgacccataaatggattactaccgattttgcggaagcattgctggaatttattacaccagtggatggtgatattgaacatatgctgacctttatgcgcgatctgcatcgctatacggcgcgcaatatgggcgatgagcggatgtggccgttaagtatgccatgnnnnncattcattcattaa

SEQ ID NO: 6420 - protein, 111 aa, Escherichia coli
  Xaa 106, 107, 108: Xaa is any amino acid
MIPDVSQALAWLEKHPQALKGIQRGLERETLRVNADGTLATTGHPEALGSALTHKWITTDFAEALLEFITPVDGDIEHMLTFMRDLHRYTARNMGDERMWPLSMPXXXFIH

SEQ ID NO: 6421 - DNA, 429 bp, Escherichia coli
gtgagtgaagtgttatcgcttttctcgttgtttgccagtagttttctcagcgctacactattacccggcaactccgaagtcgtgctggtggcaatgttgctttccggagtgagtcatccctgggttttagttttaacagcaacaatgggtaatagccttggagggttaactaacgttatccttgggcgtttctttccattgcgtaaaacatcgcgctggcaagagaaagctaccggctggctgaaacgctatggtgcagtcacgctattattaagctggatgcccgtggttggcgatttactgtgtctgttagcgggatggatgcgcatctcgtggggaccggtaatcttttttttgtgccttggtaaagcgttacgctatgttgcagttgcagcagctaccgttcagggcatgatgtggtggcactaa

SEQ ID NO: 6422 - protein, 142 aa, Escherichia coli
MSEVLSLFSLFASSFLSATLLPGNSEVVLVAMLLSGVSHPWVLVLTATMGNSLGGLTNVILGRFFPLRKTSRWQEKATGWLKRYGAVTLLLSWMPVVGDLLCLLAGWMRISWGPVIFFLCLGKALRYVAVAAATVQGMMWWH

SEQ ID NO: 6423 - DNA, 567 bp, Escherichia coli
atgtacgagcgttatgcaggtttaatttttgatatggatggcaccatcctggataccgagcctacgcaccgtaaagcgtggcgcgaagtattagggcactacggtcttcagtacgatgttcaggcgatgattgcgcttaatggctcgcccacctggcgtattgctcaggcgattattgagctgaatcaggccgatctcgacccgcatgcgttagcgcgtgaaaaaacagaagcagtaagaagtatgctgctggatagtgtcgagccgcttcctcttgttgaagtggtgaaaagctggcatggtcgtcgcccaatggctgtaggaacggggagtgaaagcgccatcgctgaggcattgctggcacacctgggattacgccgttattttgacgccgtcgtcgctgccgatcacgtcaaacaccataaacccgcgccagacacatttttgttgtgcgcgcagcgtatgggcgtgcaaccgacgcagtgtgtggtctttgaagatgccgatttcggtattcaggcggcccgtgcagcaggcatggacgccgtggatgttcgcttgctgtga

SEQ ID NO: 6424 - protein, 188 aa, Escherichia coli
MYERYAGLIFDMDGTILDTEPTHRKAWREVLGHYGLQYDVQAMIALNGSPTWRIAQAIIELNQADLDPHALAREKTEAVRSMLLDSVEPLPLVEVVKSWHGRRPMAVGTGSESAIAEALLAHLGLRRYFDAVVAADHVKHHKPAPDTFLLCAQRMGVQPTQCVVFEDADFGIQAARAAGMDAVDVRLL

SEQ ID NO: 6425 - DNA, 186 bp, Escherichia coli
atgctgattctgactcgtcgagttggtgagaccctcatgattggggatgaggtcaccgtgacagttttaggggtaaagggcaaccaggtacgtattggcgtaaatgccccgaaggaagtttctgttcaccgtgaagagatctaccagcgtatccaggctgaaaaatcccagcagtccagttactaa

SEQ ID NO: 6426 - protein, 61 aa, Escherichia coli
MLILTRRVGETLMIGDEVTVTVLGVKGNQVRIGVNAPKEVSVHREEIYQRIQAEKSQQSSY

SEQ ID NO: 6427 - DNA, 2631 bp, Escherichia coli
atgagcaagagcaccgctgagatccgtcaggcgtttctcgactttttccatagtaagggacatcaggtagttgccagcagctccctggtaccccataacgacccaactttgttgtttaccaacgccgggatgaaccagttcaaggatgtgttccttgggctcgacaagcgtaattattcccgcgctaccacttcccaacgctgcgtgcgtgcgggtggtaaacacaacgacctggaaaacgtcggttacaccgcgcgtcatcataccttcttcgaaatgctgggcaacttcagcttcggcgactatttcaaacacgatgccattcagtttgcatgggaactgctgaccagcgaaaaatggtttgccctgccgaaagagcgtctgtgggttaccgtctatgaaagcgacgacgaagcctacgaaatctgggagaaagaagtagggatcccgcgcgaacgtattattcgcatcggcgataacaaaggtgcgccatacgcatctgacaacttctggcagatgggtgacactggtccgtgcggcccgtgcaccgaaatcttctacgatcacggcgaccacatttggggcggccctccgggaagtccggaagaagacggcgaccgctacattgagatctggaacatcgtcttcatgcagttcaaccgccaggccgatggcacgatggaaccgctgccgaaaccgtctgtagataccggtatgggtctggagcgtattgctgcggtgctgcaacacgttaactctaactatgacatcgacctgttccgcacgttgatccaggcggtagcgaaagtcactggcgcgaccgatctgagcaataaatcgctgcgcgtaatcgcagaccacattcgttcttgtgcgttcctgatcgcggatggcgtaatgccgtccaatgaaagccgtggttatgtactgcgtcgtatcattcgtcgcgcagtgcgtcacggtaatatgctcggcgcgaaagaaaccttcttctacaaactggttggtccgctgatcgacgttatgggctctgcgggtgaagacctgaaacgacagcaggcgcaggttgagcaggtgctgaagactgaagaagagcagtttgcccgtactctggagcgcggtctggcgctgctggatgaagagctggcaaaactttctggtgatacgctggatggtgaaactgctttccgcctgtacgacacctacggcttcccggttgacctgacggctgacgtttgccgtgagcgcaacatcaaagttgacgaagctggttttgacgcagcaatggaagagcagcgtcgtcgtgcgcgcgaagccagcggctttggtgccgattacaacgcaatgatccgtgttgacagtgcatctgaatttaaaggctatgaccatctggaactgaacggcaaagtgaccgcgctgtttgttgatggtaaagcggttgatgccatcaatgcaggccaggaagctgtggtcgtgctggatcaaacgccattctatgcggaatccggcggtcaggttggtgataaaggcgaactgaaaggcgctaacttctccttcgcggtggaagatacgcagaaatacggccaggcgattggtcacatcggtaaacttgctgcgggttctctgaaagtgggcgacgctgtgcaggctgatgttgatgaggctcgtcgcgcccgtattcgtctgaatcactccgcaacgcacctgatgcacgctgcgctgcgccaggttctgggtactcatgtatcgcagaaaggttcactggttaacgacaaagtgctgcgcttcgacttctcacacaacgaagcgatgaaaccagaagagattcgtgcggtcgaagacctggtgaacgcacagattcgccgtaacttgccgatcgaaaccaacatcatggatctcgaagcggcaaaagcgaaaggtgcgatggcactgttcggcgagaagtatgatgagcgcgtacgcgtgctgagcatgggcgatttctccaccgagctgtgtggcggtactcacgccagccgcactggtgatattggtctgttccgcatcatctctgaatcgggtactgctgcaggcgttcgtcgtatcgaagcggtaaccggagaaggcgctatcgccaccgttcatgcagacagcgatcgcttaagcgaagtcgcgcatctgctgaaaggcgatagcaataatctggctgataaagtgcgttcagtactggaacgtacgcgtcagctggaaaaagagttacaacagcttaaagaacaagctgccgcacaggagagcgcaaatctttccagtaaggcaattgatgttaatggtgttaagctgttggttagcgagcttagcggtgttgagccgaaaatgttgcgtaccatggttgacgatttaaaaaatcagctggggtcgacaattatcgtgctggcaacggtagccgaaggtaaggtttctctgattgcaggcgtatctaaggacgtcacagatcgtgtgaaagcaggggaactgattggtatggtcgctcagcaggtgggcggcaagggtggtggacgtcctgacatggcgcaagccggtggtacggatgctgcggccttacctgcagcgttagccagtgtgaaaggctgggtcagcgcgaaattgcaataa

SEQ ID NO: 6428 - protein, 876 aa, Escherichia coli
MSKSTAEIRQAFLDFFHSKGHQVVASSSLVPHNDPTLLFTNAGMNQFKDVFLGLDKRNYSRATTSQRCVRAGGKHNDLENVGYTARHHTFFEMLGNFSFGDYFKHDAIQFAWELLTSEKWFALPKERLWVTVYESDDEAYEIWEKEVGIPRERIIRIGDNKGAPYASDNFWQMGDTGPCGPCTEIFYDHGDHIWGGPPGSPEEDGDRYIEIWNIVFMQFNRQADGTMEPLPKPSVDTGMGLERIAAVLQHVNSNYDIDLFRTLIQAVAKVTGATDLSNKSLRVIADHIRSCAFLIADGVMPSNESRGYVLRRIIRRAVRHGNMLGAKETFFYKLVGPLIDVMGSAGEDLKRQQAQVEQVLKTEEEQFARTLERGLALLDEELAKLSGDTLDGETAFRLYDTYGFPVDLTADVCRERNIKVDEAGFDAAMEEQRRRAREASGFGADYNAMIRVDSASEFKGYDHLELNGKVTALFVDGKAVDAINAGQEAVVVLDQTPFYAESGGQVGDKGELKGANFSFAVEDTQKYGQAIGHIGKLAAGSLKVGDAVQADVDEARRARIRLNHSATHLMHAALRQVLGTHVSQKGSLVNDKVLRFDFSHNEAMKPEEIRAVEDLVNAQIRRNLPIETNIMDLEAAKAKGAMALFGEKYDERVRVLSMGDFSTELCGGTHASRTGDIGLFRIISESGTAAGVRRIEAVTGEGAIATVHADSDRLSEVAHLLKGDSNNLADKVRSVLERTRQLEKELQQLKEQAAAQESANLSSKAIDVNGVKLLVSELSGVEPKMLRTMVDDLKNQLGSTIIVLATVAEGKVSLIAGVSKDVTDRVKAGELIGMVAQQVGGKGGGRPDMAQAGGTDAAALPAALASVKGWVSAKLQ

SEQ ID NO: 6429 - DNA, 501 bp, Escherichia coli
atgacagaatcaacatcccgtcgcccggcatatgctcgcctgttggatcgtgcggtacgcattctggcggtgcgcgatcacagtgagcaagaactgcgacgtaaactcgcggcacctattatgggcaaaaatggcccggaagagattgatgccacggcagaagattacgagcgcgttattgcctggtgccacgaacatggctatcttgatgacagccgatttgttgcgcgctttatcgccagccgtagccgcaaaggttatggacctgcgcgtattcgtcaggaactgaatcagaaaggtatttcccgcgaagcgacagaaaaagcgatgcgtgaatgtgacatcgactggtgcgcactggcgcgcgatcaggcgacgcgaaaatatggcgaacctttgccaactgtcttttcagaaaaagttaagatccagcgttttctgctctatcgtggctatctgatggaagatatccaggatatttggcgaaattttgccgactga

SEQ ID NO: 6430 - protein, 166 aa, Escherichia coli
MTESTSRRPAYARLLDRAVRILAVRDHSEQELRRKLAAPIMGKNGPEEIDATAEDYERVIAWCHEHGYLDDSRFVARFIASRSRKGYGPARIRQELNQKGISREATEKAMRECDIDWCALARDQATRKYGEPLPTVFSEKVKIQRFLLYRGYLMEDIQDIWRNFAD

SEQ ID NO: 6431 - DNA, 1062 bp, Escherichia coli
atggctatcgacgaaaacaaacagaaagcgttggcggcagcactgggccagattgagaaacaatttggtaaaggctccatcatgcgcctgggtgaagaccgttccatggatgtggaaaccatctctaccggttcgctttcactggatatcgcgcttggggcaggtggtctgccgatgggccgtatcgtcgaaatctacggaccagaatcttccggtaaaaccacgctgacgttgcaggtgatcgccgcagcgcagcgcgaaggtaaaacctgtgcgtttatcgatgctgaacacgcgctggacccaatctacgcacgtaaactgggcgttgatatcgacaacctgctgtgctcccagccggataccggcgagcaggcactggaaatctgtgacgccctggcacgttctggcgcagtagacgttatcgtcgttgactccgtggcggcactgacgccgaaagcggaaatcgaaggcgaaatcggcgactctcacatgggccttgcggcacgtatgatgagccaggcgatgcgtaagctggcgggtaacctgaagcagtccaacacgctgctgatcttcatcaaccagatccgtatgaaaattggtgtgatgttcggtaacccggaaaccactactggtggtaacgcgctgaaattctacgcctctgttcgtctcgatatccgtcgtatcggcgcggtgaaagagggcgaaaacgtggtgggtagcgaaacccgcgtgaaagtggtgaagaacaaaatcgctgcgccgtttaaacaggctgaattccagatcctctacggcgaaggtatcaacttctacggcgagctggttgacctgggcgtgaaagagaagcttatcgagaaagcaggcgcgtggtacagctacaaaggtgagaagatcggtcagggtaaagcgaatgcgactgcctggctgaaagataacccggaaaccgcgaaagagatcgagaagaaagtacgtgagttgctgctgagcaacccgaactcaacgccggatttctctgtagatgacagcgaaggcgtagcagaaactaacgaagatttttaa

SEQ ID NO: 6432 - protein, 353 aa, Escherichia coli
MAIDENKQKALAAALGQIEKQFGKGSIMRLGEDRSMDVETISTGSLSLDIALGAGGLPMGRIVEIYGPESSGKTTLTLQVIAAAQREGKTCAFIDAEHALDPIYARKLGVDIDNLLCSQPDTGEQALEICDALARSGAVDVIVVDSVAALTPKAEIEGEIGDSHMGLAARMMSQAMRKLAGNLKQSNTLLIFINQIRMKIGVMFGNPETTTGGNALKFYASVRLDIRRIGAVKEGENVVGSETRVKVVKNKIAAPFKQAEFQILYGEGINFYGELVDLGVKEKLIEKAGAWYSYKGEKIGQGKANATAWLKDNPETAKEIEKKVRELLLSNPNSTPDFSVDDSEGVAETNEDF

SEQ ID NO: 6433 - DNA, 498 bp, Escherichia coli
atgactgacagtgaactgatgcagttaagcgaacaggttgggcagtcgctgaaagcccgtggcgcaaccgtaacaactgctgagtcttgtaccggcggttgggtagcgaaagtgattaccgatattgccggcagttccgcctggtttgaacgcggatttgtcacctacagtaacgaagcaaaagcgcaaatgatcggtgtacgcgaagagacgctggcacagcatggcgcggtgagcgaacctgtcgtggtggaaatggcgataggcgcactgaaagcggctcgtgctgattacgccgtgtctattagtggtatcgccgggccggatggcggcagtgaagagaaacctgtcggcaccgtctggtttgcttttgccactgcccgtggtgaaggcattacccggcgggaatgtttcagcggtgaccgtgatgcggtgcgtcgtcaggctactgcgtatgcattgcagaccttgtggcaacaatttctacaaaacacttga

SEQ ID NO: 6434 - protein, 165 aa, Escherichia coli
MTDSELMQLSEQVGQSLKARGATVTTAESCTGGWVAKVITDIAGSSAWFERGFVTYSNEAKAQMIGVREETLAQHGAVSEPVVVEMAIGALKAARADYAVSISGIAGPDGGSEEKPVGTVWFAFATARGEGITRRECFSGDRDAVRRQATAYALQTLWQQFLQNT

SEQ ID NO: 6435 - DNA, 1191 bp, Escherichia coli
ttgagttatgtaaagtccgtatcgggcagtgactaccgcttccttgtgcggggcgggatgctttaccatacttgcccctggttgaatctgttaaatggacccctcatgttcaagcgtcgttatgtaacattgcttcccctttttgtgttgcttgccgcctgtagcagcaagccaaaacctactgagactgaaacgaccaccggaacgccgtctggcggcttcctgcttgagccgcagcacaatgtgatgcagatgggcggtgacttcgccaataacccgaatgcccagcagttcatcgacaaaatggtgaacaaacacggtttcgatcgtcagcagttgcaggaaattctctcccaggcgaaacgtctggattcggtactgcggctgatggataaccaggcaccaaccacatcggtgaaaccgccatcasgtccgaacggcgcatggctgcgttatcgcaaaaaatttattacgccggacaacgtgcagaacggtgtggttttctggaatcagtatgaagatgcgttgaatcgcgcgtggcaggtgtatggtgtaccgccggaaattatcgtcgggattatcggcgttgaaacccgctgggggcgcgtgatggggaaaactcgcatcctcgatgcgctggcaacgctgtcatttaactacccacgccgcgcggagtatttttctggcgagctggaaaccttcctgctgatggcgcgcgacgagcaggacgatccgctcaatctgaaaggttcctttgccggggcgatgggctacggacagtttatgccgtcgtcttacaaacaatatgcggtagatttcagcggcgacgggcatatcaacctgtgggatccggttgatgcgatcggtagcgtggcgaattatttcaaagcgcacggctgggtgaaaggcgatcaggtcgcggtaatggcaaacggtcaggctccaggcttgccaaatggcttcaaaaccaggtacagcatttcgcagcttgccgcggcaggtttaacgccacagcagccgctgggcaaccatcaacaagccagcctgctgcgtctggatgttggcaccggctaccagtactggtacggtctgccgaacttctacaccatcacccgttataaccacagcacccattacgcaatggcggtctggcagttaggacaagccgtggcgctggcgcgcgtacagtaa

SEQ ID NO: 6436 - protein, 396 aa, Escherichia coli
  Xaa 144: Xaa is any amino acid
MSYVKSVSGSDYRFLVRGGMLYHTCPWLNLLNGPLMFKRRYVTLLPLFVLLAACSSKPKPTETETTTGTPSGGFLLEPQHNVMQMGGDFANNPNAQQFIDKMVNKHGFDRQQLQEILSQAKRLDSVLRLMDNQAPTTSVKPPSXPNGAWLRYRKKFITPDNVQNGVVFWNQYEDALNRAWQVYGVPPEIIVGIIGVETRWGRVMGKTRILDALATLSFNYPRRAEYFSGELETFLLMARDEQDDPLNLKGSFAGAMGYGQFMPSSYKQYAVDFSGDGHINLWDPVDAIGSVANYFKAHGWVKGDQVAVMANGQAPGLPNGFKTRYSISQLAAAGLTPQQPLGNHQQASLLRLDVGTGYQYWYGLPNFYTITRYNHSTHYAMAVWQLGQAVALARVQ

SEQ ID NO: 6437 - DNA, 564 bp, Escherichia coli
atgatagaaaccattactcatggcgcagagtggttcatcgggctgttccagaaaggcggagaagtgtttaccgggatggtaaccggcattcttccgctgttaattagcctgctggttatcatgaacgcattgattaattttatcggtcagcatcgtattgaacgatttgctcaacgttgcgccggtaaccctgtttcccgttatctgctgctaccgtgcattggtacgtttgtcttttgtaacccgatgaccttaagtcttggtcgctttatgccggaaaagtacaaacccagctattacgcggcggcctcttatagctgccactcaatgaatggcctcttcccccatatcaaccctggcgaactgtttgtttatctcggcattgccagcggtctgacaacactgaatctgccacttggcccactggcggtgagctatctgctggttggtctggtcaccaacttcttccgcggctgggtaaccgatctgaccaccgccattttcgagaaaaagatgggcattcaacttgaacaaaaagttcgtctggcaggagcaacatcatga

SEQ ID NO: 6438 - protein, 187 aa, Escherichia coli
MIETITHGAEWFIGLFQKGGEVFTGMVTGILPLLISLLVIMNALINFIGQHRIERFAQRCAGNPVSRYLLLPCIGTFVFCNPMTLSLGRFMPEKYKPSYYAAASYSCHSMNGLFPHINPGELFVYLGIASGLTTLNLPLGPLAVSYLLVGLVTNFFRGWVTDLTTAIFEKKMGIQLEQKVRLAGATS

SEQ ID NO: 6439 - DNA, 960 bp, Escherichia coli
atgacacgcattcggatcgaaaaaggaacgggtggctggggcggcccgcttgagctggaagccacgccgggcaaaaaaatcgtctatatcaccgccggtacccggcctgcgattgttgacaaactggcacagcttactggctggcaagctatcgacggatttaaagaaggtgaacccgcggaggcggaaattggtgtcgcggtaatcgactgtggcggcacattacgctgcggcatctatccgaaacggcgtattcccaccattaatatccactcgacgggcaagtccggcccgctggcgcagtacattgtggaagatatttatgtctctggcgtaaaagaagaaaacatcactgtagtgggtgaggcgacaccacaaccctcttccgtgggccgtgactatgacaccagcaagaaaatcaccgaacaaagcgatggtttactggcgaaggtgggaatgggtatgggttctgccgttgccgtgctgttccagtctggccgtgacaccatcgacactgtattaaaaaccattctgccgtttatggcgttcgtctcggcgcttatcggcatcattatggcttctggccttggtgactggattgcccacggtcttgctccgctggcgagccatccactgggtctggtcatgctggcgctcatctgctccttcccgctgctttcacctttcctcggcccaggcgcagttatcgcacaggttatcggcgtattgattggcgtgcagattggtctcggcaatattccgccgcatctggctttacctgcactgtttgccatcaacgcgcaggcggcctgcgacttcatcccggtcggtttgtcgctggcggaagcccgtcaggacacggttcgcgtcggtgtcccttctgttctggtgagccgctttttaaccggcgcgccaactgtactgatcgcctggtttgtctccggttttatctatcaatag

SEQ ID NO: 6440 - protein, 319 aa, Escherichia coli
MTRIRIEKGTGGWGGPLELEATPGKKIVYITAGTRPAIVDKLAQLTGWQAIDGFKEGEPAEAEIGVAVIDCGGTLRCGIYPKRRIPTINIHSTGKSGPLAQYIVEDIYVSGVKEENITVVGEATPQPSSVGRDYDTSKKITEQSDGLLAKVGMGMGSAVAVLFQSGRDTIDTVLKTILPFMAFVSALIGIIMASGLGDWIAHGLAPLASHPLGLVMLALICSFPLLSPFLGPGAVIAQVIGVLIGVQIGLGNIPPHLALPALFAINAQAACDFIPVGLSLAEARQDTVRVGVPSVLVSRFLTGAPTVLIAWFVSGFIYQ

SEQ ID NO: 6441 - DNA, 372 bp, Escherichia coli
atgaccgttatttatcagaccaccatcacccgtattggcgcgagtgccactgacgccctcagcgaccagatgctcatcacctttcgtgaaggcgcgcctgcggatctcgaagagtattgcttcattcattgccacggcgagttgaaaggtgcactccatcccggtttgcaattttctctcgggcagcatcgctatccggtgaccgccgttggcagcgtggcggaagacaaccttcgcgaactgggtcatgtcaccctgcgcttcgatggtttaagcgaagcggaatttccgggcactgtccatgtggcaggccctgtacccgacgatatcgcgccgggatcggttttgaagtttgaatctgttaaggagtaa

SEQ ID NO: 6442 - protein, 123 aa, Escherichia coli
MTVIYQTTITRIGASATDALSDQMLITFREGAPADLEEYCFIHCHGELKGALHPGLQFSLGQHRYPVTAVGSVAEDNLRELGHVTLRFDGLSEAEFPGTVHVAGPVPDDIAPGSVLKFESVKE

SEQ ID NO: 6443 - DNA, 780 bp, Escherichia coli
atgaatcaggttgccgttgtcatcggtggtgggcaaaccttaggcgcgttcctgtgccacggtctggctgccgaggggtatcgcgtggcggttgtcgatattcagagcgacaaagccgcaaatgtggcacaagaaattaacgccgaatatggtgaaggaacagcgtacggttttggtgctgacgccaccagcgagcaaagcgttctggcgctttctcgtggggtagatgaaatctttggtcgcgtggatttgctggtctacagcgccggaatagcaaaagcagcctttatcagcgacttccagctcggcgattttgaccgttcgctacaggtgaatctggtgggttatttcctgtgtgcccgtgaattttcgcgtttgatgatccgcgacgggattcagggtcgcattattcagatcaactcgaaatccggcaaagtgggcagcaaacacaactctggctacagcgccgcgaaatttggtggtgtcgggctgactcaatcactggcgctggatctggcggagtacggcattacggtgcattcgctgatgctcggtaacctgctgaaatcgcctatgttccagtcgctgttgccacaatatgccaccaagctgggtatcaaaccggatcaagtcgagcagtattacatcgataaagtaccgctcaaacgcggctgcgattatcaggatgtgctgaatatgctgctgttctacgccagtcctaaggcgtcgtactgcactggtcagtcgatcaatgtcaccggcggtcaggtgatgttctga

SEQ ID NO: 6444 - protein, 259 aa, Escherichia coli
MNQVAVVIGGGQTLGAFLCHGLAAEGYRVAVVDIQSDKAANVAQEINAEYGEGTAYGFGADATSEQSVLALSRGVDEIFGRVDLLVYSAGIAKAAFISDFQLGDFDRSLQVNLVGYFLCAREFSRLMIRDGIQGRIIQINSKSGKVGSKHNSGYSAAKFGGVGLTQSLALDLAEYGITVHSLMLGNLLKSPMFQSLLPQYATKLGIKPDQVEQYYIDKVPLKRGCDYQDVLNMLLFYASPKASYCTGQSINVTGGQVMF

SEQ ID NO: 6445 - DNA, 360 bp, Escherichia coli
atggtatccgcactcatcaccgtcgccgttatcgcctggtgtgcgcaactggccttaggcggttggcaaatttctcgttttaaccgtgccttcgacacgctatgccagcaagggagggttggcgtgggccgttccagcgggcgctttaaaccgcgggtcgtggtcgctattgcgctggacgatcagcagcgcatcgtcgacaccttgtttatgaaaggactgaccgtcttcgcccgaccgcaaaaaattcccgcaattaccggcatgcatgtgggtgatttacagcccgatgtgatctttccccatgatccactatcacagaatgctctatcattggcgcttaaactgaaacgtggataa

SEQ ID NO: 6446 - protein, 119 aa, Escherichia coli
MVSALITVAVIAWCAQLALGGWQISRFNRAFDTLCQQGRVGVGRSSGRFKPRVVVAIALDDQQRIVDTLFMKGLTVFARPQKIPAITGMHVGDLQPDVIFPHDPLSQNALSLALKLKRG

SEQ ID NO: 6447 - DNA, 774 bp, Escherichia coli
atgaaacctcgtcagcgtcaggccgccattctggagtatctacaaaagcagggtaaatgctcggttgaagaattggcgcaatactttgacaccacaggcacaaccattcgcaaagatctggtcattctggaacatgccggaaccgtcattcgtacttatggcggcgtggtgttgaacaaagaggaatccgatccgcctatcgatcataaaacgcttatcaacacccacaaaaaagagctgattgcagaagctgccgttggttttattcatgatggcgactcaataattcttgatgctggcagtaccgtgttgcagatggtgcccctgctctcgcgctttaataacatcacggtgatgaccaacagcctgcacatcgtcaatgcgctatccgaactggataacgaacaaactatactgatgccaggcggaacatttcgcaaaaaatcggcctcatttcacgggcaactggcagagaatgccttcgagcatttcaccttcgataaattgtttatgggcaccgacggcatcgatctcaatgcgggcgtaaccacctttaacgaggtctataccgtcagtaaggcgatgtgtaatgccgcgcgcgaagtgattttgatggctgactcatcgaagtttggtcgtaaaagccccaacgtggtttgtagtcttgaaagcgtcgataagctgattaccgacgcaggtatcgatccagcgtttcgtcaggcgctggaagaaaaagggatcgacgtgatcataaccggagagagcaatgagtga

SEQ ID NO: 6448 - protein, 257 aa, Escherichia coli
MKPRQRQAAILEYLQKQGKCSVEELAQYFDTTGTTIRKDLVILEHAGTVIRTYGGVVLNKEESDPPIDHKTLINTHKKELIAEAAVGFIHDGDSIILDAGSTVLQMVPLLSRFNNITVMTNSLHIVNALSELDNEQTILMPGGTFRKKSASFHGQLAENAFEHFTFDKLFMGTDGIDLNAGVTTFNEVYTVSKAMCNAAREVILMADSSKFGRKSPNVVCSLESVDKLITDAGIDPAFRQALEEKGIDVIITGESNE

SEQ ID NO: 6449 - DNA, 966 bp, Escherichia coli
atgagtgaagcactactgaacgcgggacgtcagacgttaatgctggagttgcaggaagcaagccatttaccggaacgtctgggcgatgatttcgttcgcgccgccaatatcatcctgcactgcgaaggcaaagtggtggtttcgggaattggcaaatcgggccacattggtaagaaaatcgccgcaacgcttgccagcaccggcacaccggctttttttgtccatccggcagaagcactgcacggcgatctggggatgattgaaagccgcgatgtgatgctgtttatctcttattccggtggcgcgaaggaactggatctcattattccgcgtctggaagacaaatctatcgcgctgctggcaatgaccggaaaaccgacgtcaccgctgggcctggcggcgaaagcggtgctggatatctccgtagagcgcgaagcctgcccgatgcaccttgcgccgacctccagcaccgtgaataccctgatgatgggcgacgcgctggcgatggcggtcatgcaggcgcgcggatttaatgaagaagattttgcccgctcccacccagccggggcactgggcgctcgcttgctgaacaaagtgcatcatcttatgcgtcgtgacgatgccatcccgcaggtggcgttaaccgccagcgtgatggacgcaatgctggaacttagccgcaccggtttaggtctggtggcagtgtgcgatgatcaacgactggtgaaaggcgtctttaccgacggtgatttacgtcgctggctggttggcggcggcgcactcaccacgccagtcaatgaagcgatgacggtcggcggcaccacgttgcaatcgcaaagccgtgccatcgacgccaaagaaatcctgatgaaacgcaaaatcaccgccgcaccggtagtggatgaaaacggcaaactcaccggcgcaattaacctgcaggatttctatcaggccgggattatttaa

SEQ ID NO: 6450 - protein, 321 aa, Escherichia coli
MSEALLNAGRQTLMLELQEASHLPERLGDDFVRAANIILHCEGKVVVSGIGKSGHIGKKIAATLASTGTPAFFVHPAEALHGDLGMIESRDVMLFISYSGGAKELDLIIPRLEDKSIALLAMTGKPTSPLGLAAKAVLDISVEREACPMHLAPTSSTVNTLMMGDALAMAVMQARGFNEEDFARSHPAGALGARLLNKVHHLMRRDDAIPQVALTASVMDAMLELSRTGLGLVAVCDDQRLVKGVFTDGDLRRWLVGGGALTTPVNEAMTVGGTTLQSQSRAIDAKEILMKRKITAAPVVDENGKLTGAINLQDFYQAGII

SEQ ID NO: 6451 - DNA, 1515 bp, Escherichia coli
atgagtttttccgttgatgtgctggcgaatatcgccatcgaattgcagcgtgggattggtcatcaggatcgttttcagcgcctgatcaccacgctgcgtcaggtgctggagtgcgatgcgtctgcgttgctacgttacgactcgcggcagtttattccgcttgccatcgacgggctggcgaaggatgtactcggtagacgctttgcgctggaaggtcatccacggctggaagcgattgcccgcgcgggtgatgtggtgcgctttcccgcagacagcgaattgcccgatccttatgacggtttgattccagggcaggagagtctgaaggttcacgcctgcgttggtttgccgttgtttgccgggcaaaacctgatcggtgccttgacgctcgacgggatgcagcccgatcagttcgatgttttcagcgacgaagagctacggctgattgccgcactggcggcgggagcgttaagcaatgcattgctgattgaacaactggaaagccagaatatgctgccaggcgatgccgcgccgtttgaagcggtgaaacagacgcagatgattggtttgtcccctggcatgacgcaattgaaaaaagagattgagattgtggcggcatccgatctcaacgttttaattagcggtgagacgggaaccggtaaggagctggtggcgaaagcgattcatgaagcctcgccacgggcggtgaatccgctggtctatctcaactgtgccgcactgccggaaagtgtggcggaaagtgagttgttcgggcatgtgaaaggggcgtttactggtgctatcagtaaccgcagcgggaagtttgaaatggcggataacggcacgctgtttctcgatgagatcggcgagttgtcgttggcattgcaggccaagctgctgagggtgttgcagtatggcgatattcaacgcgttggcgatgaccgcagtttgcgggtcgatgtgcgcgtgctggcggcgactaaccgtgacttacgcgaagaggtactggcagggcgatttcgcgctgacttgttccaccgcctgagcgtgtttccactttcagtgccgccgctgcgtgagcggggcgatgatgtcattctgctggcggggtatttctgcgagcagtgtcgtttgcggctggggctctcccgcgtggtattaagtgccggagcgcgaaatttactgcaacactacaattttccgggaaacgtgcgcgaactggaacatgctattcatcgggcggtagtattgtcgagagccacccgcagcggcgatgaagtgattcttgaggcgcaacattttgcttttcctgaggtgacgttgccgccgccagaagcggcggcggtgcccgttgttaagcaaaacctgcgtgaagcgacagaagcgttccagcgtgaaaccattcgtcaggcactggcgcaaaatcatcacaactgggccgcctgtgcgcggatgctggaaaccgacgtcgccaacctgcatcggctggcgaaacgtctggggctgaaggattaa

SEQ ID NO: 6452 - protein, 504 aa, Escherichia coli
MSFSVDVLANIAIELQRGIGHQDRFQRLITTLRQVLECDASALLRYDSRQFIPLAIDGLAKDVLGRRFALEGHPRLEAIARAGDVVRFPADSELPDPYDGLIPGQESLKVHACVGLPLFAGQNLIGALTLDGMQPDQFDVFSDEELRLIAALAAGALSNALLIEQLESQNMLPGDAAPFEAVKQTQMIGLSPGMTQLKKEIEIVAASDLNVLISGETGTGKELVAKAIHEASPRAVNPLVYLNCAALPESVAESELFGHVKGAFTGAISNRSGKFEMADNGTLFLDEIGELSLALQAKLLRVLQYGDIQRVGDDRSLRVDVRVLAATNRDLREEVLAGRFRADLFHRLSVFPLSVPPLRERGDDVILLAGYFCEQCRLRLGLSRVVLSAGARNLLQHYNFPGNVRELEHAIHRAVVLSRATRSGDEVILEAQHFAFPEVTLPPPEAAAVPVVKQNLREATEAFQRETIRQALAQNHHNWAACARMLETDVANLHRLAKRLGLKD

SEQ ID NO: 6453 - DNA, 1440 bp, Escherichia coli
atgtctattgtggtgaaaaataacattcattgggttggtcaacgtgactgggaagtgcgtgattttcacggtacagaatataaaacgctgcgcggcagcagctacaacagctacctcatccgcgaagaaaaaaacgtgctgatcgacaccgtcgaccataaattcagccgcgaatttgtgcagaacctgcgtaatgaaatcgatctggcggatatcgattacatcgtaattaaccatgctgaagaggaccacgccggggcgctgaccgaactgatggcacaaattcccgatacgccgatctactgtactgccaacgctatcgactcgataaatggtcatcaccatcatccggagtggaattttaatgtagtgaaaactggcgacacgctggatatcggcaacggcaaacaactcatttttgtcgaaacgccaatgctgcactggccggacagcatgatgacttacctgacaggcgacgcggtgctgttcagtaacgatgctttcggtcagcactactgcgacgagcatctgttcaacgatgaagtggatcagactgagcttttcgagcagtgccagcgttactacgccaatatcctgacgccgttcagccgcctggtaacgccgaaaattaccgagatcctgggctttaacttgccagtcgatatgatagcgacctctcacggcgtggtatggcgcgataacccgacgcaaattgtcgagctgtacctgaaatgggcggcggattatcaggaagacagaatcaccattgtctacgacaccatgtcgaataacacccgcatgatggctgacgctatcgcccaggggattgcggaaaccgacccacgcgtggcggtgaaaattttcaacgtcgcccgaagcgataaaaacgaaatcctgaccaatgtcttccgctcaaaaggcgtactggtcggcacttctacgatgaataatgtgatgatgccgaaaatcgccgggctggtggaggagatgaccggattacgcttccgtaacaaacgcgccagcgctttcggctctcacggctggagcggcggtgcggtggatcgtctttccacgcgcctgcaggatgcgggtttcgaaatgtcgcttagcctgaaagccaaatggcgaccagaccaggacgctctggagttatgtcgtgaacacggtcgcgaaatcgcccgtcagtgggcgctcgcgccgctgccacagagcacggtgaatacggtggttgaagaagaaacctctgccgccacgacggctgacctcggcccacggatgcaatgcagcgtctgccagtggatttacgatccggcaaaaggcgagccaatgcaggacgttgcgccaggaacgccgtggagtgaagtcccggataacttcctgtgcccggaatgctctctcggcaaagacgtctttgacgaactggcatcggaggcaaaatga

SEQ ID NO: 6454 - protein, 479 aa, Escherichia coli
MSIVVKNNIHWVGQRDWEVRDFHGTEYKTLRGSSYNSYLIREEKNVLIDTVDHKFSREFVQNLRNEIDLADIDYIVINHAEEDHAGALTELMAQIPDTPIYCTANAIDSINGHHHHPEWNFNVVKTGDTLDIGNGKQLIFVETPMLHWPDSMMTYLTGDAVLFSNDAFGQHYCDEHLFNDEVDQTELFEQCQRYYANILTPFSRLVTPKITEILGFNLPVDMIATSHGVVWRDNPTQIVELYLKWAADYQEDRITIVYDTMSNNTRMMADAIAQGIAETDPRVAVKIFNVARSDKNEILTNVFRSKGVLVGTSTMNNVMMPKIAGLVEEMTGLRFRNKRASAFGSHGWSGGAVDRLSTRLQDAGFEMSLSLKAKWRPDQDALELCREHGREIARQWALAPLPQSTVNTVVEEETSAATTADLGPRMQCSVCQWIYDPAKGEPMQDVAPGTPWSEVPDNFLCPECSLGKDVFDELASEAK

SEQ ID NO: 6455 - DNA, 1134 bp, Escherichia coli
atgagcaacggcattgtgatcattggttcgggcttcgccgcccgccaactggtgaaaaatattcgcaaacaggacgccagtattccattaaccctgattgccgccgacagcatggatgagtacaacaaacctgacctcagccatgttatcagtcaggggcaacgtgccgacgaccttacccgccagacggcaggtgaatttgccgagcagtttaatctgcgcctgtttccgcacacctgggtaacggatatcgatgccgaagcccatgtggtgaaaagtcagaataatcagtggcaatacgacaagttagtgctggcaaccggtgccagcgcctttgtcccgccagtgcccgggcgtgagttaatgctgacgttaaatagtcagcaagagtatcgcgcctgtgaaacgcaactgcgggatgcccgacgcgtgttgattgtcggcggtggtttgattggtagtgaactggcgatggatttttgtcgggcaggcaaagcggtcacgctaatcgacaacgctgccagtattctggcgtcgttaatgccaccggaagtcagcagccgcttgcagcatcggttgacggagatgggcgttcatctgctgttgaaatctcagttgcagggactagaaaaaacagattctggcattctggcaacgctggaccgccagcgctgcatcgaagtggatgcggtaattgccgccaccggactgcgcccggaaaccgccctggcacgacgcgccgggctgacgattaatcgcggcgtttgcgtcgatagttatctgcaaaccagtaatgccgatatttatgcgctgggcgattgcgcggaaattaacggtcaggtattgccgttcctccagccgattcaacttagcgcgatggtgctggcaaaaaatcttctcggcaataacacgccgctgaaactcccggcgatgctggtgaaaatcaaaacgccggaattaccgctgcatctggcaggcgaaacccagcgtcaggatttacgctggcaaattaataccgaacgccagggaatggtggcgcgcggcgttgacgatgctgaccagcttcgcgcctttgtggtcagtgaggatcggatgaaagaggcatttggattgttgaaaacgttgtcgatgtag

SEQ ID NO: 6456 - protein, 377 aa, Escherichia coli
MSNGIVIIGSGFAARQLVKNIRKQDASIPLTLIAADSMDEYNKPDLSHVISQGQRADDLTRQTAGEFAEQFNLRLFPHTWVTDIDAEAHVVKSQNNQWQYDKLVLATGASAFVPPVPGRELMLTLNSQQEYRACETQLRDARRVLIVGGGLIGSELAMDFCRAGKAVTLIDNAASILASLMPPEVSSRLQHRLTEMGVHLLLKSQLQGLEKTDSGILATLDRQRCIEVDAVIAATGLRPETALARRAGLTINRGVCVDSYLQTSNADIYALGDCAEINGQVLPFLQPIQLSAMVLAKNLLGNNTPLKLPAMLVKIKTPELPLHLAGETQRQDLRWQINTERQGMVARGVDDADQLRAFVVSEDRMKEAFGLLKTLSM

SEQ ID NO: 6457 - DNA, 2325 bp, Escherichia coli
gtgactgccggatgcgacgctgtcgtgtccggctgggcgggttacgcaattcatgatggcgggaataactcaatggcaaaaaacacatcttgcggtgtccaactgcgtattcgtggcaaagtgcagggcgtcggttttcgtccgtttgtctggcaactggcacagcaattaaatcttcacggcgatgtctgtaatgacggcgatggcgtagaagtccggctgctggaagatccggaaacgtttcttgttcaattgcatcagcactgcccgccactggcgcgtattgatagcgtcgagcgtgagccgtttatctggtcacaactgcccactgagttcaccatccgccagagcgcgggtggcgtcatgaatacgcaaattgttcccgatgccgcgacttgccctgcttgtcttgccgaaatgaataccccaggcgaacgacgctggcgttatccgtttatcaactgtactcactgtggtccgcgtttcaccattattcgcgccatgccttacgaccgcccgtttaccgtgatggcggcgtttccgctgtgtccggcttgtgacaaagagtactgtgacccgctcgatcgtcgcttccacgcccagccggtggcctgcccggagtgtggcccccatcttgaatgggtaagtcatggtgaacatgcagaacaagaggcggcattacaggcagctatcgcacagttaaaaatgggcaacattgtcgccatcaaagggattggcggatttcatcttgcctgcgatgcacgtaacagtaacgcggtggcgacacttcgggcgcgcaaacatcgcccggcgaaaccgctggcggtcatgttgccagtggctgacggtttaccagacgctgcgcgccagttgcttaccacgcccgccgcgccgattgtgctggtggataaaaaatatgtacctgagctttgtgatgatatcgcccctgaccttaacgaagtcggggtaatgttgcctgcgaacccgctccagcatttgctgttacaggaactgcaatgcccgctggtgatgacctccggcaacctgagcggtaaaccaccggctatcagcaacgaacaggcgctggcggatttgcagggcattgccgacggattcttgatacataaccgcgacatcgtgcagcggatggatgattcggtggtgcgcgaaagcggcgaaatgctgcgccgttcgcgggggtatgtgccggatgcgctggctttgcctccgggctttaaaaatgttccgcctgtgctgtgtctcggcgcggatctgaaaaataccttctgcctggtgcgcggcgaacaagcggtgttgagtcagcatctgggcgatttaagtgacgatggcatccagatgcagtggcgcgaagcgttacgcctgatgcaaaacatctacgatttcactccgcaatacgttgtgcatgacgcgcatccgggctatgtctccagccagtgggcgcgtgagatgaatctgccgacgcaaacggtgctgcatcatcatgcccacgcagcggcgtgtctggcagaacacctctggcctctggatggcggagatgtcattgcgttgacgctcgacggtattggtatgggggagaacggcgctttgtggggcggcgagtgcttgcgggtgaactatcgcgaatgccagcacctgggcggcttgcccgcagtggcgcttccggggggcgatttggctgcgaagcagccgtggcgaaacctgctggcgcagtgcctgcgctttgtgccggagtggcagaattactctgaaacggcaagtgtgcaacagcaaaactggagcgtgctggcgcgggctattgagcgtggaattaacgcgccgctggcatcgtcgtgtggacgtttgttcgatgccgtagcggcggcgctgggctgtgcgccagccacgttaagttatgaaggtgaagcggcttgtgcgctggaggcgctggcggcttcgtgccacggcgtgacgcatccggtgacgatgccgctggtggacaatcaactggatctcgccactttctggcagcagtggctgagctggcaggctccggttaatcaacgcgcgtgggcgtttcatgatgcgctggcgcagggttttgccgcgttgatgcgtgagcaggccacgatgcggggtatcactacgctggtatttagcggcggagttattcataactgtttgctgcgtgcacgtctggcgcattatcttgctgattttacgttgctcttcccacaaagtttacctgcgggcgatggcgggttgtctctggggcagggggttattgttgcggcgcgttggttggcaggggaagtccagaacggataa

SEQ ID NO: 6458 - protein, 774 aa, Escherichia coli
MTAGCDAVVSGWAGYAIHDGGNNSMAKNTSCGVQLRIRGKVQGVGFRPFVWQLAQQLNLHGDVCNDGDGVEVRLLEDPETFLVQLHQHCPPLARIDSVEREPFIWSQLPTEFTIRQSAGGVMNTQIVPDAATCPACLAEMNTPGERRWRYPFINCTHCGPRFTIIRAMPYDRPFTVMAAFPLCPACDKEYCDPLDRRFHAQPVACPECGPHLEWVSHGEHAEQEAALQAAIAQLKMGNIVAIKGIGGFHLACDARNSNAVATLRARKHRPAKPLAVMLPVADGLPDAARQLLTTPAAPIVLVDKKYVPELCDDIAPDLNEVGVMLPANPLQHLLLQELQCPLVMTSGNLSGKPPAISNEQALADLQGIADGFLIHNRDIVQRMDDSVVRESGEMLRRSRGYVPDALALPPGFKNVPPVLCLGADLKNTFCLVRGEQAVLSQHLGDLSDDGIQMQWREALRLMQNIYDFTPQYVVHDAHPGYVSSQWAREMNLPTQTVLHHHAHAAACLAEHLWPLDGGDVIALTLDGIGMGENGALWGGECLRVNYRECQHLGGLPAVALPGGDLAAKQPWRNLLAQCLRFVPEWQNYSETASVQQQNWSVLARAIERGINAPLASSCGRLFDAVAAALGCAPATLSYEGEAACALEALAASCHGVTHPVTMPLVDNQLDLATFWQQWLSWQAPVNQRAWAFHDALAQGFAALMREQATMRGITTLVFSGGVIHNCLLRARLAHYLADFTLLFPQSLPAGDGGLSLGQGVIVAARWLAGEVQNG

SEQ ID NO: 6459 - DNA, 528 bp, Escherichia coli
atgaaccgtttcatcattgctgacgcgagtaaatgtattggttgccgtacctgtgaagtagcgtgcgtggtttctcatcaggaaaatcaggactgtgcatcgctgaccccggaaacatttttaccgcgtatccatgtcattaaaggtgtgaacatttccacggcgacagtttgccgtcagtgtgaagatgcaccgtgcgctaacgtctgcccgaatggtgctatcagccgtgataaagggtttgttcatgtcatgcaggaacgttgtattggttgcaaaacctgcgttgtggcttgcccgtatggtgcgatggaagtggtggtgcgtccggtgattcgcaacagcggcgcagggctgaatgtacgggctgacaaagccgaagccaataaatgcgacctgtgcaaccatcgtgaagacggcccggcgtgtatggcggcttgcccgacccatgcgctgatttgtgtcgatcgtaataaacttgaacaactgagcgcagaaaaacgccgccgcacggcgctgatgttctaa

SEQ ID NO: 6460 - protein, 175 aa, Escherichia coli
MNRFIIADASKCIGCRTCEVACVVSHQENQDCASLTPETFLPRIHVIKGVNISTATVCRQCEDAPCANVCPNGAISRDKGFVHVMQERCIGCKTCVVACPYGAMEVVVRPVIRNSGAGLNVRADKAEANKCDLCNHREDGPACMAACPTHALICVDRNKLEQLSAEKRRRTALMF

SEQ ID NO: 6461 - DNA, 168 bp, Escherichia coli
ttgtcatcacatgtcatcgtcactagtgtcgatgacatcgtttttcctgtagtacagaatttaatttccttaaataacagtaaattaaaaactggcatgatttgtgaatgtatcggcgcattaactgttattgctggagaatttgatgaaccgtttcatcattgctga

SEQ ID NO: 6462 - protein, 55 aa, Escherichia coli
MSSHVIVTSVDDIVFPVVQNLISLNNSKLKTGMICECIGALTVIAGEFDEPFHHC

SEQ ID NO: 6463 - DNA, 1077 bp, Escherichia coli
ttgcgcaaggacaatcggcaaacggtgcagtacactgcgttgattgcgtgtaaagggatgaaaatgatgacgacgatgctggaagtggcgaagcgcgccggggtttcaaaagcgaccgtttcccgcgtgctttcaggtaatggctacgtcagccaggagactaaagatcgcgtgtttcaggcggtagaagagagcggttaccgtccaaacttgctggcgcgcaatctgtcggcgaagagtactcagacgctggggctggtcgtgaccaacacgctttaccatggcatttattttagtgaattactgtttcatgccgcgcgaatggcggaagagaaagggcgacagttgctattggcagatggtaaacatagcgccgaagaagagcgccaggcgattcagtatctgctggatttgcgctgcgacgccatcatgatttacccgcgctttttaagcgtggatgagattgatgacatcattgacgcacacagtcagccgataatggtgcttaatcgccgcctgcgcaaaaacagcagccatagcgtctggtgcgatcataaacagaccagctttaacgccgtggcagagttgataaccgccggacatcaggagattgctttccttaccggctcgatggattcccccaccagcattgaacgtcttgccggatataaagacgcgctggcgcagcatggtattgcgttcaatgaaaaacttatcgctaacggtaaatggacgcccgccagcggtgccgaaggggtagaaacgttgctcgaacgtggggctaaatttagcgcgttagttgccagtaacgacgatatggcgataggtgcgatcaaagcgttacacgagcgcggcgtagcggtgccagagcaggtgtcagttatcggattcgatgatatcgctattgccccctacatcgttccggcgctctccagcgtaaaaattccggtgactgagatgattcaggaaattattggacggctgatttttatgctcgatggcggggatttctcaccgccgaaaaccttcagcggaaaactaatccgccgcggctcactcattgctctttcgcgataa

SEQ ID NO: 6464 - protein, 358 aa, Escherichia coli
MRKDNRQTVQYTALIACKGMKMMTTMLEVAKRAGVSKATVSRVLSGNGYVSQETKDRVFQAVEESGYRPNLLARNLSAKSTQTLGLVVTNTLYHGIYFSELLFHAARMAEEKGRQLLLADGKHSAEEERQAIQYLLDLRCDAIMIYPRFLSVDEIDDIIDAHSQPIMVLNRRLRKNSSHSVWCDHKQTSFNAVAELITAGHQEIAFLTGSMDSPTSIERLAGYKDALAQHGIAFNEKLIANGKWTPASGAEGVETLLERGAKFSALVASNDDMAIGAIKALHERGVAVPEQVSVIGFDDIAIAPYIVPALSSVKIPVTEMIQEIIGRLIFMLDGGDFSPPKTFSGKLIRRGSLIALSR

SEQ ID NO: 6465 - DNA, 1458 bp, Escherichia coli
atggccaaaaattatgcggcgctggcaagctcggtgataacggcactgggcggcgttgataacatctcggcggtcacgcactgtatgacgcgtttgcgctttgttatcaaagatgaccagcttatcgatagtccgacgttgaaaaccatctccggcgtgctcggcgtggtacgtagtgacaaccagtgtcaggtgattataggtaatacggtttcgcaggcctttcaggaagtcgtcagcctgctgccgggagacttgcaacccgcgcctcccgtgggtaaaccaaagctcacgctacgtcgcattggtgcgggggtcctcgatgcgctgatcggcaccatgtcaccgctgatcccggcgattatcggcggatcgatggtcaaactgctggcgatgatcctcgagatgagcggcgtgctgacaaaaggatcgccgaccttaatcattctgaatgtgattggtgacggtgctttcttcttcctgccgctgatggtcgcggcttctgccgccatcaaatttaaaaccaatatgtcgctggcgattgccattgcgggtgtgctggtacatccgagttttattgagctgatggcgaaagcggccctgggtgaacatgttgaatttgccctgattccggtcaccgcggtgaaatacacctacacagtgatcccggcgctggtgatgacctggtgcctgtcatatatcgaacgctgggtggacagcattacgccagcggtgacgaaaaacttcctcaagccgatgctgattgtgttgattgccgcaccgctggcaatcctgctgattggcccgattggtatctggatcggtagcgccatttcggcgctggtttacaccattcatggttatctgggctggctttcagtcgccattatgggcgcgctgtggcctctgctggtaatgacagggatgcaccgcgtctttacgccaaccatcattcagaccattgccgaaaccggcaaagaagggatggtcatgccgtcagagatcggcgctaacctgtcgctgggcggttcatcactggcggtggcatggaaaacgaaaaacccggaactgcgccagacggcgctggctgcggcagcatcagccattatggcggggatttccgaacccgcgttatacggcgtggcgatccgcctgaaacgtccgcttatcgccagtcttatcagcggttttatttgcggcgcggttgccggtatggcggggcttgccagccactcaatggcagcgccggggctatttaccagcgtgcagttcttcgatccggcgaatccaatgagcatcgtctgggtgttcgccgtcatggcgctggcggtcgtgctgtcgttcatcctcacactgttgctcggctttgaggatattcctgttgaggaagcgactgccgaggcgcgaaagcatcagagcgtacaaccgaccgtcgccaaagaagtaagtcttaattga

SEQ ID NO: 6466 - protein, 485 aa, Escherichia coli
MAKNYAALASSVITALGGVDNISAVTHCMTRLRFVIKDDQLIDSPTLKTISGVLGVVRSDNQCQVIIGNTVSQAFQEVVSLLPGDLQPAPPVGKPKLTLRRIGAGVLDALIGTMSPLIPAIIGGSMVKLLAMILEMSGVLTKGSPTLIILNVIGDGAFFFLPLMVAASAAIKFKTNMSLAIAIAGVLVHPSFIELMAKAALGEHVEFALIPVTAVKYTYTVIPALVMTWCLSYIERWVDSITPAVTKNFLKPMLIVLIAAPLAILLIGPIGIWIGSAISALVYTIHGYLGWLSVAIMGALWPLLVMTGMHRVFTPTIIQTIAETGKEGMVMPSEIGANLSLGGSSLAVAWKTKNPELRQTALAAAASAIMAGISEPALYGVAIRLKRPLIASLISGFICGAVAGMAGLASHSMAAPGLFTSVQFFDPANPMSIVWVFAVMALAVVLSFILTLLLGFEDIPVEEATAEARKHQSVQPTVAKEVSLN

SEQ ID NO: 6467 - DNA, 1437 bp, Escherichia coli
ttgaggatgaaaatgtcagtatttccgcaaggttttttatggggcggcgcgcttgccgccaaccagtctgaaggcgcgtaccgtgaaggcggcaaagggctgaccaccgtcgatatgatcccgcacggcgaacatcgaatggcggtgaaactggggctggaaaaacgttttcagttgcgcgatgacgagttttatcccagccatgaggcgacggatttttatcatcgttataaagaagatatcgccctgatggcagagatgggattcaaggtttttcgcacctcgattgcctggagccgcctatttccgcagggcgatgaactgacgcccaatcagcagggcattgctttttaccgcgcggtatttgaagagtgtaaaaagtacggtatcgaaccgctggtcacgttgtgtcacttcgacgtgccgatgcatctggttactgaatatggctcctggcgtaaccgcaagctggtagagcttttcagccgctacgcccggacctgctttgaagcatttgatggtctggtgaaatactggcttaccttcaatgaaatcaacattatgttgcatagcccgttctccggcgcgggtctggtgtttgaagaaggggaaaatcaggatcaggtgaaatatcaggctgcgcatcaccagctggttgccagtgcgctagccaccaaaatcgcccatgaggttaacccgcaaaatcaggtgggttgtatgctggcgggcggtaacttctacccttacagctgcaagccggaagatgtctgggcggcgctggagaaagatcgggaaaacctgttttttatcgatgtgcaggcgcggggcgcgtatccggcttactctgcccgcgtattccgcgaaaaaggggtaaccatcgacaaagcaccgagcgatgatgagatcctgaaaaacaccgtcgattttgtctctttcagctattacgcctcgcgctgcgcctcggcggagatgaacgccaacaactgcagtgcggcgaacgtggtgaaatcgctgcgtaacccgtatctgcaagtgagcgactggggctggggtattgatccactcggtctgcgtatcaccatgaatatgatgtacgaccgttatcagaagccactgtttctggtggaaaacggcctgggcgcaaaagatgaatttgctgccaatggcgaaattaacgacgactatcgcatcagctatttacgcgaacatatccgcgcaatgggcgaagcgattgcagacggcattccgctgatgggctacaccacatggggctgtattgatttagtttccgcctctacgggtgaaatgagcaaacgctacggttttgtctacgtagaccgtgacgacgcaggcaacggcacgctgacgcgcacgcgtaagaaatcgttctggtggtataaaaaagtgattgccagtaacggtgaagatttagagtaa

SEQ ID NO: 6468 - protein, 478 aa, Escherichia coli
MRMKMSVFPQGFLWGGALAANQSEGAYREGGKGLTTVDMIPHGEHRMAVKLGLEKRFQLRDDEFYPSHEATDFYHRYKEDIALMAEMGFKVFRTSIAWSRLFPQGDELTPNQQGIAFYRAVFEECKKYGIEPLVTLCHFDVPMHLVTEYGSWRNRKLVELFSRYARTCFEAFDGLVKYWLTFNEINIMLHSPFSGAGLVFEEGENQDQVKYQAAHHQLVASALATKIAHEVNPQNQVGCMLAGGNFYPYSCKPEDVWAALEKDRENLFFIDVQARGAYPAYSARVFREKGVTIDKAPSDDEILKNTVDFVSFSYYASRCASAEMNANNCSAANVVKSLRNPYLQVSDWGWGIDPLGLRITMNMMYDRYQKPLFLVENGLGAKDEFAANGEINDDYRISYLREHIRAMGEAIADGIPLMGYTTWGCIDLVSASTGEMSKRYGFVYVDRDDAGNGTLTRTRKKSFWWYKKVIASNGEDLE

SEQ ID NO: 6469 - DNA, 420 bp, Escherichia coli
atgactgctaatgctgcacgcgctgttaaagcaacaagagaactggtcaatgcagtcccctttctgggaggcagtgactcagaagatgattatcgtgaagcactggaactggtcgaatatttgattgaagaagatgataccaatccacttatcgactttctggcgagccgcattgcagaatatgaaaacaataacgaaaagtttgcagagttcgacaaagccgttgcagcaatgccggttggcgtggcgttacttcgtacgctgattgatcaacataatctgacctatgcggatttgaagaacgaaatcggctctaaatccctggtcagtcagattttatctggacaacgttccctgacgatatcccacattaaggcactttcagcccgatttggcgttaagccggaatggtttctttga

SEQ ID NO: 6470 - protein, 139 aa, Escherichia coli
MTANAARAVKATRELVNAVPFLGGSDSEDDYREALELVEYLIEEDDTNPLIDFLASRIAEYENNNEKFAEFDKAVAAMPVGVALLRTLIDQHNLTYADLKNEIGSKSLVSQILSGQRSLTISHIKALSARFGVKPEWFL

SEQ ID NO: 6471 - DNA, 186 bp, Escherichia coli
ttgaacatcagaacagggatgtgcgcttttttattgagcttagtgctgcctgcacaggccaccagctttaccgaatatctgccaatgagtgacggcgaatatgcgcaaaagcgggtgctgaaacctctcctgaccatgccttatgatgccgagcaaacatggcattttagaaaagtgagcgtctga

SEQ ID NO: 6472 - protein, 61 aa, Escherichia coli
MNIRTGMCAFLLSLVLPAQATSFTEYLPMSDGEYAQKRVLKPLLTMPYDAEQTWHFRKVSV

SEQ ID NO: 6473 - DNA, 438 bp, Escherichia coli
atgatgggtgatgatggcgcaggcccgctactggcggaaaagtgcgctgccgcgccgaaaggtaactgggtagtgattgacggcggtagcgcaccggaaaacgacattgtcgctatccgcgaactgcgcccgacacggctgcttattgtcgacgccacggatatggggctaaaccctggcgagatccgcatcatcgacccggctgacatcgccgagatgtttatgatgactacccataacatgccgctgaactatcttatcgaccagttgaaagaagatattggcgaagtgatttttctcggcatccagccggatatcgtcggcttttactacccgatgacccagccgattaaagatgcggtagaaaccgtttatcaacgactggaaggctgggaagggaatggcggcttcgcgcagttagcggtggaagaagaataa

SEQ ID NO: 6474 - protein, 145 aa, Escherichia coli
MMGDDGAGPLLAEKCAAAPKGNWVVIDGGSAPENDIVAIRELRPTRLLIVDATDMGLNPGEIRIIDPADIAEMFMMTTHNMPLNYLIDQLKEDIGEVIFLGIQPDIVGFYYPMTQPIKDAVETVYQRLEGWEGNGGFAQLAVEEE

SEQ ID NO: 6475 - DNA, 411 bp, Escherichia coli
atgagtgaaaaggtggtgttcagtcaactgagccgtaaattcattgatgagaacgatgctacgcccgccgaggcgcagcaggtggtctattacagcctggcgattggtcaccaccttggggttatcgattgcctggaagcggcgcttacctgcccgtgggatgactatctggcatggattgccactctggaggcgggcagcgaagcccgccgcaaaatggaaggcgtgccgaaatatggtgagatcgtcatcgacattaaccatgtgccgatgctggccaacgcattcgataaagcccgggcagcgcaaacttcgcagcagaaggaatggagtacaatgctgttaagtatgctgcatgatattcatcaggaaaacgccatctatttgatggtgaggagactgcgtgactga

SEQ ID NO: 6476 - protein, 136 aa, Escherichia coli
MSEKVVFSQLSRKFIDENDATPAEAQQVVYYSLAIGHHLGVIDCLEAALTCPWDDYLAWIATLEAGSEARRKMEGVPKYGEIVIDINHVPMLANAFDKARAAQTSQQKEWSTMLLSMLHDIHQENAIYLMVRRLRD

SEQ ID NO: 6477 - DNA, 768 bp, Escherichia coli
atgagcaatttattaggcccccgtgacgccaacggcattccggtcccgatgacggtggatgaatccatcgccagcatgaaggcgtcgttactgaaaaaaatcaaacgttctgcctacgtttatcgcgtggactgcggcggctgtaacggttgcgaaatcgaaattttcgccacgctttcgccgctgttcgatgcagaacgcttcggcattaaagtcgttccgtcaccgcgtcatgcggatattttactgtttaccggcgcggtcacccgtgcaatgcgatcccctgcgctgcgtgcgtggcagtccgcgccggacccgaaaatctgtatctcctacggtgcctgcggtaacagtggcgggatcttccacgatctctactgcgtgtggggcggtacggataaaatcgttccagtggatgtttatatccctggctgcccgccaacgcctgccgccacgctgtacggctttgcgatggcgctcggcctgctggagcagaaaatccacgcccgtgggccgggtgagcaggatgaacaaccggcggagattctgcatggcgatatggtgcagccgctgcgcgtgaaagtggatcgcgaagcacgccgcctggcgggttatcgttacggtcgccagattgccgatgatttcctgacgcaattagggcagggcgaagaacaggttgcacgctggctggaagcggaaaacgatccgcgtctgaacgagattgtcagccatctgaatcatgttgttgaagaggcgcgtatccgatga

SEQ ID NO: 6478 - protein, 255 aa, Escherichia coli
MSNLLGPRDANGIPVPMTVDESIASMKASLLKKIKRSAYVYRVDCGGCNGCEIEIFATLSPLFDAERFGIKVVPSPRHADILLFTGAVTRAMRSPALRAWQSAPDPKICISYGACGNSGGIFHDLYCVWGGTDKIVPVDVYIPGCPPTPAATLYGFAMALGLLEQKIHARGPGEQDEQPAEILHGDMVQPLRVKVDREARRLAGYRYGRQIADDFLTQLGQGEEQVARWLEAENDPRLNEIVSHLNHVVEEARIR

SEQ ID NO: 6479 - DNA, 543 bp, Escherichia coli
atgtttacctttatcaaaaaagtcatcaaaaccggcacggcgacttcgtcttatccgctggagccgattgcggttgataaaaacttccgtggtaagccagagcagaacccgcagcagtgcattggctgtgcggcttgcgtcaatgcctgcccgtcaaacgccttaacggttgaaaccgacctcgccactggtgagctggcgtggcagtttgaccttgggcgctgcatcttctgtgggcgctgcgaagaagtctgcccgacagcggcgatcaaactgtcgcaagagtacgaactggcggtgtggaagaaagaagatttcctgcaacagtcccgcttcgcgctgtgcaactgccgcgtctgcaatcgtcctttcgccgtccagaaagagatcgactacgccattgcgctgcttaagcacaacggtgacagccgcgcggaaaaccaccgcgaaagctttgagacttgcccggaatgtaagcgccagaaatgcctggtgccgtccgaccgtattgaactgactcgccatatgaaagaggccatctga

SEQ ID NO: 6480 - protein, 180 aa, Escherichia coli
MFTFIKKVIKTGTATSSYPLEPIAVDKNFRGKPEQNPQQCIGCAACVNACPSNALTVETDLATGELAWQFDLGRCIFCGRCEEVCPTAAIKLSQEYELAVWKKEDFLQQSRFALCNCRVCNRPFAVQKEIDYAIALLKHNGDSRAENHRESFETCPECKRQKCLVPSDRIELTRHMKEAI

SEQ ID NO: 6481 - DNA, 1710 bp, Escherichia coli
atgtctgaagaaaaattaggtcaacattatctcgccgcgctgaatgaggcatttccgggcgtcgtgctggaccacgcctggcagaccaaagatcagctaaccgtcaccgtgaaggtgaactacctgccggaagtggtggagtttctctactacaaacaagggggttggctgtcggtgctgtttggtaacgacgaacgcaaactgaatggtcattacgccgtttattacgtgctgtcgatggagaagggcaccaagtgttgggtaacggttcgcgtcgaagttgacgccaacaaaccggagtatccttccgtgacgccgcgcgttccggcggcggtgtggggcgagcgtgaagtgcgcgatatgtacggtttgattccggttggtctgccggatgaacgtcgtctggtgctgccggatgactggccggatgaactttatcctctgcgtaaagacagcatggattatcgtcagcgtccggcaccgactaccgatgctgaaacctacgagttcatcaacgaactgggcgacaagaaaaacaacgtcgtgccgattggtccactgcacgtcacttctgacgaaccgggtcacttccgtctgttcgtcgatggtgaaaacattatcgacgccgactaccgcctgttctacgtccatcgcggcatggaaaaactggcggaaacccgtatgggttacaacgaagtgaccttcctctctgaccgtgtgtgcgggatctgcggctttgctcacagcaccgcctataccacgtcggtggaaaacgcgatgggtattcaggtgccagaacgcgcgcagatgatccgcgccattctgctggaggtagaacgcctgcactcgcatctgctcaatctcggcctggcctgtcactttaccggcttcgactccggctttatgcagttcttccgcgtgcgtgaaacctccatgaaaatggcagagatccttaccggtgcacgtaaaacctacggcctgaacctgatcggcgggattcgtcgcgatctgctgaaagacgacatgatccagacccgccagctggcacaacagatgcgtcgtgaagtgcaggagctggtggatgtgctgctgagcacaccgaacatggaacaacgcaccgtcggcattggtcgtctggacccggaaatcgctcgcgacttcagtaacgttggcccgatggttcgtgccagcggtcacgcccgtgatacccgtgccgatcacccgtttgttggttatggcctgctgccaatggaagtccacagcgagcagggctgcgacgttatttcccgtctgaaagtgcgtatcaacgaagtctataccgcgctgaatatgatcgattacggtctggataacctgccgggcggcccgctgatggtggaaggctttacctacattccgcaccgtttcgcgctgggctttgccgaagcgccgcgcggcgacgatatccactggagcatgaccggcgacaaccagaagctgtaccgctggcgctgccgtgcggcgacctacgcgaactggccgaccctgcgttatatgctgcgcggcaacaccgtttccgatgcgccgctgattatcggtagcctggacccttgctactcctgtaccgaccgcatgaccgtggtcgatgtacgtaagaagaagagcaaagtggtgccgtacaaagaacttgagcgctacagcattgagcgtaaaaactcgccgctgaaataa

SEQ ID NO: 6482 - protein, 569 aa, Escherichia coli
MSEEKLGQHYLAALNEAFPGVVLDHAWQTKDQLTVTVKVNYLPEVVEFLYYKQGGWLSVLFGNDERKLNGHYAVYYVLSMEKGTKCWVTVRVEVDANKPEYPSVTPRVPAAVWGEREVRDMYGLIPVGLPDERRLVLPDDWPDELYPLRKDSMDYRQRPAPTTDAETYEFINELGDKKNNVVPIGPLHVTSDEPGHFRLFVDGENIIDADYRLFYVHRGMEKLAETRMGYNEVTFLSDRVCGICGFAHSTAYTTSVENAMGIQVPERAQMIRAILLEVERLHSHLLNLGLACHFTGFDSGFMQFFRVRETSMKMAEILTGARKTYGLNLIGGIRRDLLKDDMIQTRQLAQQMRREVQELVDVLLSTPNMEQRTVGIGRLDPEIARDFSNVGPMVRASGHARDTRADHPFVGYGLLPMEVHSEQGCDVISRLKVRINEVYTALNMIDYGLDNLPGGPLMVEGFTYIPHRFALGFAEAPRGDDIHWSMTGDNQKLYRWRCRAATYANWPTLRYMLRGNTVSDAPLIIGSLDPCYSCTDRMTVVDVRKKKSKVVPYKELERYSIERKNSPLK

SEQ ID NO: 6483 - DNA, 924 bp, Escherichia coli
atgagtgttttatatccgttaattcaggcgctggtgctatttgccgttgcgccgctgctctccggtattacccgcgtagcgcgcgcccgtctgcataaccgtcgtgggccgggtgtgttgcaggagtatcgcgacattatcaaactgctgggccgccagagcgttggcccggatgcctccggctgggtgttccgcctgacgccgtatgtgatggtgggcgtcatgctgactatcgccactgcgctgccggtggtgaccgtcggctctccgctgccgccactgggcgatttgatcaccttactgtatctcttcgccatcgcgcgtttcttctttgccatttctggtctggatactggtagcccgtttaccgctatcggcgcgagccgtgaagcgatgcttggcgtgttggttgaaccgatgctgctgcttggtctgtgggtcgccgcacaggctgccggttccaccaacatcagcaacatcaccgacaccgtttatcactggccactgagccagagcatcccgctggtgctggcgctttgtgcctgtgcgttcgccacttttatcgaaatgggcaaactgccgttcgacctggcggaagccgagcaggagttgcaggaaggtccgctctctgagtatagcggcagcggctttggcgtcatgaaatggggcatcagcctgaaacagctggtggtgttgcagatgttcgtcggggtgtttattccgtggggacaaatggaaaccttcaccgtcggtgggctgctgctggcgctggtgattgccatcgtcaaactggtggtcggcgtactggttatcgcgctgttcgaaaacagcatggcccgtttgcgtcttgatattactccacgcattacctgggctggttttggctttgcatttttagcgttcgtctccttgctggcggcgtga

SEQ ID NO: 6484 - protein, 307 aa, Escherichia coli
MSVLYPLIQALVLFAVAPLLSGITRVARARLHNRRGPGVLQEYRDIIKLLGRQSVGPDASGWVFRLTPYVMVGVMLTIATALPVVTVGSPLPPLGDLITLLYLFAIARFFFAISGLDTGSPFTAIGASREAMLGVLVEPMLLLGLWVAAQAAGSTNISNITDTVYHWPLSQSIPLVLALCACAFATFIEMGKLPFDLAEAEQELQEGPLSEYSGSGFGVMKWGISLKQLVVLQMFVGVFIPWGQMETFTVGGLLLALVIAIVKLVVGVLVIALFENSMARLRLDITPRITWAGFGFAFLAFVSLLAA

SEQ ID NO: 6485 - DNA, 1827 bp, Escherichia coli
atgagcgcaatttccctgatcaatagcggcgtggcgtggtttgtcgccgtcgctgttctggcatttctcttttcttttcaaaaagcgctaagtggctggatagccggaattggcggcgcggtgggtagcctgtatacggcagccgcgggcttcactgtgctgactggcacggttggcgtgagcggtgcgctgtcgctggtaagctacgatgtgcaaatctctccgcttaacgcgatttggctgattacactcggcctatgcggtctgtttgtcagcctctacaacattgactggcatcgccacgcgcaggtgaaatgcaacggcttgcagatcaatatgttgatggctgccgccgtctgtgccgtcatcgccagcaacctcggcatgttcgtggtaatggccgaaatcatggccctgtgtgcggtgttcctcaccagcaacagcaaagagggcaaactgtggtttgcgctggggcgtcttggcactctgctgctggcgattgcctgctggctgctgtggcagcgttacggcacgctggatctgcgcctgctggatatgcgtatgcaacagctgccgctcggttccgatatctggctgctcggtgtgattggctttggcctgctggccgggattattccgctgcacggctgggtgccacaggcacatgccaacgcctctgcgccagctgccgcgctgttttccacggtagtcatgaaaattggcctgctgggcattttaactctgtcactactgggcggtaatgcaccgctgtggtgggggatcgcgctgctggtgctcggtatgatcaccgcattcgtcggcggtctgtatgcgttgatggaacataatatccaacgtctgctggcttaccacaccctggagaatatcggcattatcctgctggggctgggcgctggcgtaacgggtatcgcgctcgaacaaccggcgctgattgcccttggtctggttggtggtctgtaccatctgcttaaccatagcctgttcaagagcgtactgttccttggtgcggggagcgtctggttccgtaccggtcatcgcgatatcgaaaaactcggtggtattggcaagaaaatgccggttatctccatcgccatgttagtcgggctgatggcaatggctgcgctgccgccgctgaacggttttgccggggaatgggttatctatcaatccttcttcaaactgagcaatagtggcgcgtttgttgcccgtcttctcgggccgctgctcgccgtggggctggcaattaccggtgcgctggcggtgatgtgtatggcgaaagtttatggcgttactttcctcggcgcgccgcgtaccaaagaggccgaaaacgccacctgtgcgccgctcctgatgagcgtaagcgtagtggcactggcgatttgctgcgtaattggcggtgttgctgcgccgtggctactgccgatgctctctgctgctgtacctctgccgctggagcctgctaacaccaccgtttctcaaccaatgatcacgttgctgctgattgcctgcccgctgctgccattcatcattatggcgatttgcaaaggcgatcgtttgccgtcgcgttcccgcggtgcggcctgggtgtgcggctacgatcatgaaaaatcaatggtgattaccgctcacggttttgccatgccggtgaaacaggcgtttgcgccggtgctgaaactacgcaaatggctgaatccggtgtctctggtgccgggctggcagtgcgaggggagtgcgttgctgttccgccggatggcgctggttgaactggcggtgctggtggtgattattgtttcacgaggagcctga

SEQ ID NO: 6486 - protein, 608 aa, Escherichia coli
MSAISLINSGVAWFVAVAVLAFLFSFQKALSGWIAGIGGAVGSLYTAAAGFTVLTGTVGVSGALSLVSYDVQISPLNAIWLITLGLCGLFVSLYNIDWHRHAQVKCNGLQINMLMAAAVCAVIASNLGMFVVMAEIMALCAVFLTSNSKEGKLWFALGRLGTLLLAIACWLLWQRYGTLDLRLLDMRMQQLPLGSDIWLLGVIGFGLLAGIIPLHGWVPQAHANASAPAAALFSTVVMKIGLLGILTLSLLGGNAPLWWGIALLVLGMITAFVGGLYALMEHNIQRLLAYHTLENIGIILLGLGAGVTGIALEQPALIALGLVGGLYHLLNHSLFKSVLFLGAGSVWFRTGHRDIEKLGGIGKKMPVISIAMLVGLMAMAALPPLNGFAGEWVIYQSFFKLSNSGAFVARLLGPLLAVGLAITGALAVMCMAKVYGVTFLGAPRTKEAENATCAPLLMSVSVVALAICCVIGGVAAPWLLPMLSAAVPLPLEPANTTVSQPMITLLLIACPLLPFIIMAICKGDRLPSRSRGAAWVCGYDHEKSMVITAHGFAMPVKQAFAPVLKLRKWLNPVSLVPGWQCEGSALLFRRMALVELAVLVVIIVSRGA

SEQ ID NO: 6487 - DNA, 612 bp, Escherichia coli
gtgaatcgttttgtaattgctgactccacgctctgtatcggctgccacacttgtgaggctacctgttcagagacgcatcgccagcacggcctgcaatcaatgccgcgcctgagagtgatgctaaatgaaaaagaatctgcgccgcagctctgtcaccactgtgaagatgcaccctgcgcaacggtctgcccggttaacgccatcactcgtgttgatggtgccgtgcagctgaatgaaagcttgtgcgtaagctgcaaactgtgtggcatcgcctgcccgtttggcgcaattgaattttccggcagccgtccgctggatattccggcaaacgccaataccccgaaagcgccaccggcaccgcctgctccggcgcgtgtcagcacattgcttgactgggtgccaggtattcgcgcgatcgccgtcaaatgtgacctttgtagctttgatgaacaaggtccggcctgcgtgcggatgtgcccgactaaagccctgcatctggtggataacaccgatatcgcccgcgtcagcaaacgtaagcgtgagctgacttttaacacggactttggcgatctcaccttgtttcagcaggctcaaagtggagaggctaaatga

SEQ ID NO: 6488 - protein, 203 aa, Escherichia coli
MNRFVIADSTLCIGCHTCEATCSETHRQHGLQSMPRLRVMLNEKESAPQLCHHCEDAPCATVCPVNAITRVDGAVQLNESLCVSCKLCGIACPFGAIEFSGSRPLDIPANANTPKAPPAPPAPARVSTLLDWVPGIRAIAVKCDLCSFDEQGPACVRMCPTKALHLVDNTDIARVSKRKRELTFNTDFGDLTLFQQAQSGEAK

SEQ ID NO: 6489 - DNA, 462 bp, Escherichia coli
atgactatttgggaaataagcgagaaagccgattacatcgcacagcggcatcgtcgcctacaggaccagtggcacatctactgcaattcgctggttcaggggatcacgttatcgaaagcgcgcctgcatcacgccatgagctgcgcgccggacaaagaactctgtttcgtcctttttgaacattttcgcatttacgtcaccctggcggatggctttaacagccacaccatcgagtattacgtcgaaacgaaagagggtgaagacaaacagcggattgcgcaggcgcaactgagcattgacggcatgattgatggcaaggtcaacatccgcgatcgcgaacaggttctggaacactatctcgaaaaaatcgctggcgtttacgacagcttatacaccgccattgaaaacaatgtgccggtgaatttaagccaactggtaaagggacaaagcccggcagcatga

SEQ ID NO: 6490 - protein, 153 aa, Escherichia coli
MTIWEISEKADYIAQRHRRLQDQWHIYCNSLVQGITLSKARLHHAMSCAPDKELCFVLFEHFRIYVTLADGFNSHTIEYYVETKEGEDKQRIAQAQLSIDGMIDGKVNIRDREQVLEHYLEKIAGVYDSLYTAIENNVPVNLSQLVKGQSPAA

SEQ ID NO: 6491 - DNA, 351 bp, Escherichia coli
atgcacgaaataaccctctgccaacgggcactggaattgatcgaacagcaggccgcaaaacacggcgcaaaacgcgtaactggggtctggctcaaaattggcgcattttcttgtgtcgaaaccagctctcttgccttttgttttgatctggtttgccgcggcagcgtggcggaaggttgtaaactgcacctcgaagaacaagaggccgaatgctggtgtgaaacatgccaacagtatgtgacgctactgacccagcgcgtccgccgctgtccacagtgtcatggtgacatgctacagattgtggcagacgacggtttacagattcggcggatagaaatagaccaggagtga

SEQ ID NO: 6492 - protein, 116 aa, Escherichia coli
MHEITLCQRALELIEQQAAKHGAKRVTGVWLKIGAFSCVETSSLAFCFDLVCRGSVAEGCKLHLEEQEAECWCETCQQYVTLLTQRVRRCPQCHGDMLQIVADDGLQIRRIEIDQE

SEQ ID NO: 6493 - DNA, 873 bp, Escherichia coli
atgtgtacaacatgcggttgcggtgaaggcaacctgtatatcgagggtgatgaacataaccctcattccgcgtttcgtagcgcgccatttgccccggcggcacgcccgaagatgaaaatcaccggcattaaagcgcctgaatttacccccagccagactgaagaaggcgacctgcattacggtcatggcgaagcgggcactcacgcgccgggcatgagccagcgtcggatgctggaagtcgaaattgacgtgctggacaaaaataaccgtctggctgaacgcaaccgcgcgcactttgctgcccgcaagcaactggtgctcaacctggtttccagccctggttccggtaaaaccaccctgctgacggaaaccttaatgcgcctgaaagacagcgttccgtgcgcagttattgaaggcgaccagcaaaccgtgaacgatgccgcgcgcattcgtgctaccggcacgccagcgattcaggtgaacaccggtaaaggctgccatcttgacgcacagatgattgccgacgccgcgccgcgcctgccactggacgataacggtattctgtttatcgaaaacgtcggcaacctcgtgtgcccggccagcttcgatctcggtgaaaaacacaaagtggcggtgctttccgttaccgaaggtgaagacaaaccgctgaaatatccgcatatgtttgccgccgcctcgctgatgctgctcaacaaagttgacctgctgccgtatctcaactttgacgttgagaagtgcatcgcctgcgcccgtgaagtcaatccagaaattgaaatcatccttatttccgccaccagcggcgaagggatggaccagtggctgaactggctggagacacagcgatgtgcatag

SEQ ID NO: 6494 - protein, 290 aa, Escherichia coli
MCTTCGCGEGNLYIEGDEHNPHSAFRSAPFAPAARPKMKITGIKAPEFTPSQTEEGDLHYGHGEAGTHAPGMSQRRMLEVEIDVLDKNNRLAERNRAHFAARKQLVLNLVSSPGSGKTTLLTETLMRLKDSVPCAVIEGDQQTVNDAARIRATGTPAIQVNTGKGCHLDAQMIADAAPRLPLDDNGILFIENVGNLVCPASFDLGEKHKVAVLSVTEGEDKPLKYPHMFAAASLMLLNKVDLLPYLNFDVEKCIACAREVNPEIEIILISATSGEGMDQWLNWLETQRCA

SEQ ID NO: 6495 - DNA, 273 bp, Escherichia coli
atgtgcataggcgttcccggccagatccgcactattgacggcaaccaggcgaaagtcgacgtctgcggcattcagcgcgatgtcgatttaacgttagtcggcagctgcgatgaaaacggtcagccacgcgtgggccagtgggtactggttcacgttggctttgccatgagcgtaattaatgaagccgaagcacgcgacactctcgacgccttacaaaacatgtttgacgttgagccagatgtcggcgcgctgttgtatggcgaggaaaaataa

SEQ ID NO: 6496 - protein, 90 aa, Escherichia coli
MCIGVPGQIRTIDGNQAKVDVCGIQRDVDLTLVGSCDENGQPRVGQWVLVHVGFAMSVINEAEARDTLDALQNMFDVEPDVGALLYGEEK

SEQ ID NO: 6497 - DNA, 1122 bp, Escherichia coli
atgcgttttgttgatgaatatcgcgcgccggaacaggtaatgcagttaattgagcatctgcgcgaacgtgcttcacatctctcttacaccgccgaacgccctctgcggattatggaagtgtgtggcggtcatacccacgccatttttaaattcggcctcgaccagttgctaccggaaaacgttgagtttatccacggtccgggttgcccggtgtgcgtactgccaatgggtagaatcgacacctgcgtggagattgccagccatccggaagtcatcttctgtacctttggcgatgccatgcgcgtaccagggaaacaggggtcgctgttgcaggcaaaagcacgcggtgccgatgtgcgcatcgtttactcgccaatggatgcgttaaaactggcgcaggagaatccaacccgcaaagtggtgttcttcggcttaggttttgaaaccaccatgccgaccaccgccatcacgttgcaacaggcaaaagcccgcgatgtgcagaatttttacttcttctgccagcacattacgctcatcccaacactgcgcagtttacttgaagagccggataacggtatcgacgcgtttcttgcgcccggtcacgttagtatggttatcggcactgatgcctataattttatcgccagcgattttcatcgtccgctggtggtcgctggtttcgaaccccttgatctacttcaaggcgtggtgatgctggtggagcagaaaatagcggcccatagcaaggtagagaatcagtatcgtcgggtggtgccggatgccggtaacctgctggcgcaacaggcaattgctgatgtgttctgtgtcaacggcgacagcgaatggcgcggcttaggcgtgattgaatcttctggcgtgcacctgacgccggattatcaacgattcgatgccgaagcacatttccgcccggcaccgcagcaggtctgcgatgacccgcgtgcgcgttgtggtgaagtattaacgggcaaatgtaagccgcatcaatgcccgctgtttggtaacacctgtaatcctcaaaccgcgtttggtgcgctgatggtttcctccgaaggagcgtgcgccgcgtggtatcagtatcgtcagcaggagagtgaagcgtga

SEQ ID NO: 6498 - protein, 373 aa, Escherichia coli
MRFVDEYRAPEQVMQLIEHLRERASHLSYTAERPLRIMEVCGGHTHAIFKFGLDQLLPENVEFIHGPGCPVCVLPMGRIDTCVEIASHPEVIFCTFGDAMRVPGKQGSLLQAKARGADVRIVYSPMDALKLAQENPTRKVVFFGLGFETTMPTTAITLQQAKARDVQNFYFFCQHITLIPTLRSLLEEPDNGIDAFLAPGHVSMVIGTDAYNFIASDFHRPLVVAGFEPLDLLQGVVMLVEQKIAAHSKVENQYRRVVPDAGNLLAQQAIADVFCVNGDSEWRGLGVIESSGVHLTPDYQRFDAEAHFRPAPQQVCDDPRARCGEVLTGKCKPHQCPLFGNTCNPQTAFGALMVSSEGACAAWYQYRQQESEA

SEQ ID NO: 6499 - DNA, 1011 bp, Escherichia coli
gtgaataatatccaactcgcccacggtagcggcggccaggcgatgcagcaattaatcaacagcctgtttatggaagcctttgccaacccgtggctggcagagcaggaagatcaggcccgtcttgatctggcgcagctggtagcggaaggcgaccgtctggcgttctccaccgacagttacgtcattgacccgctgttctttcctggcggtaatatcggcaagctggcgatttgcggcaccgccaatgacgttgcggtcagtggcgctattccgcgctatctctcctgtggctttatcctcgaagaaggattgccgatggagacactgaaagccgtagtgaccagcatggcagaaaccgcccgcgcggcaggcattgccatcgtcactggcgatactaaagtggtgcagcgcggcgcggcagataaactgtttatcaacaccgctggcatgggcgcaattccggcgaatattcactggggcgcacagacgctaaccgcaggcgatgtattgctggttagcggtacactcggggaccacggggcgactatccttaacctgcgtgagcagctggggctggacggcgaactggtcagcgactgcgcggtactaacgccgcttattcagacgctgcgtgacattcccggcgtgaaagcgctgcgtgatgccacccgtggtggtgtaaacgcggtggttcatgagttcgcggcagcctgcggttgtggtattgaactttcagaagcggcactgccagttaaacctgctgtgcgcggcgtttgcgaactgctgggactggacgcccttaactttgccaacgaaggcaaactggtgatcgccgttgaacgcaacgcagcagagcaagtgctggcggcgttacattcccatccattgggaaaagatgcggcgctgattggcgaagtagtagaacgtaaaggtgttcgtcttgccggtctgtatggcgtgaaacgaaccctcgatctaccgcacgccgaaccgcttccgcgtatatgctaa

SEQ ID NO: 6500 - protein, 336 aa, Escherichia coli
MNNIQLAHGSGGQAMQQLINSLFMEAFANPWLAEQEDQARLDLAQLVAEGDRLAFSTDSYVIDPLFFPGGNIGKLAICGTANDVAVSGAIPRYLSCGFILEEGLPMETLKAVVTSMAETARAAGIAIVTGDTKVVQRGAADKLFINTAGMGAIPANIHWGAQTLTAGDVLLVSGTLGDHGATILNLREQLGLDGELVSDCAVLTPLIQTLRDIPGVKALRDATRGGVNAVVHEFAAACGCGIELSEAALPVKPAVRGVCELLGLDALNFANEGKLVIAVERNAAEQVLAALHSHPLGKDAALIGEVVERKGVRLAGLYGVKRTLDLPHAEPLPRIC

SEQ ID NO: 6501 - DNA, 2079 bp, Escherichia coli
atgtcatatacaccgatgagtgatctcggacagcaagggttgttcgacatcactcggacactattgcagcagcccgatctggcctcgctgtgtgaggctctttcgcaactggtaaagcgttctgcgctcgccgacaacgcggcgattgtgttgtggcaagcgcagactcaacgtgcgtcttattacgcatcgcgtgaaaaagacacccccattaaatatgaagacgaaactgttctggcacacggtccggtacgcagcattttgtcgcgccctgatacgctgcattgcagttacgaagaattttgtgaaacctggccgcagctggccacaggtgggctataccccaaatttggtcactattgcctgatgccactggcggcggaagggcatatttttggtggctgtgaatttattcgttatgacgatcgcccctggagcgaaaaagagttcaatcgtctgcaaacatttacgcagatcgtttctgtcgtcaccgaacaaatccagagccgcgtcgttaacaatgtcgactatgagttgttatgccgggaacgcgataacttccgcatcctggtcgccatcactaacgcggtgctttcccgcctggatatggacgaactggtcagcgaagtcgccaaagaaatccattactatttcgacattgacgatatcagcatcgtcttacgcagccaccgtaaaaacaaactcaacatctactccactcactatcttgataaacagcatcccgctcacgaacagagcgaagtcgatgaagccggaaccctcaccgaacgcgtcttcaaaagtaaagagatgctgttgattaatctccacgagcgggacgatttagccccctatgaacgcatgttgttcaacacctggggcaaccagattcaaaccttgtgcctgttaccgctgatgtctggcgacactatgctgggcgtgctgaaactggcgcaatgcgaagagaaagtctttaccactaccaatctgaatttactgcgccagattgccgaacgtgtggcaatcgctgtcgataacgccctcgcctatcaggaaattcatcgtctgaaagaacggctggttgatgaaaacctcgccctgaccgagcagctcaacaatgttgatagtgaatttggcgagattattggccgcagcgaagccatgtacagcgtacttaaacaagtggaaatggtggcgcaaagtgacagtaccgttctgatcctcggtgaaactggtacaggtaaagagctgattgcccgcgcgatccataatctcagtgggcgtaataatcgccgcatggtcaaaatgaactgcgcggcgatgcctgccggattgctggaaagcgatctatttggtcatgagcgtggggcttttaccggtgccagcgctcagcgcattggtcgttttgaactggcggataaaagctcactattcctcgatgaagtgggcgatatgccgctggagttacagccgaagttgctgcgtgtattacaggaacaggagtttgaacgtctcggcagcaacaaaatcattcagacggacgtacgtttaattgccgcgactaaccgcgatctgaaaaaaatggtcgccgaccgagagttccgtagcgatctctattaccgcctgaacgtattcccgatccacctgccgccactacgcgagcgtccggaagatattccgctgctggcgaaagcctttaccttcaaaattgcccgtcgtctggggcgcaatatcgacagcattcctgccgagacgctgcgcatcctgagcaacatggaatggccgggcaacgtgcgtgagctggaaaacgtcatcgagcgcgcggtattgctaacacgcggcaacgtgctgcagctgtcattgccagatattgctttaccagaacctgaaacgccgcctgccgcaacggttgtcgcccaggagggcgaagatgaatatcagttgattgttcgcgtgctgaaagaaacaaacggcgtggttgccgggcctaaaggcgctgcgcaacgtctggggctgaaacgcacgactctgctgtcacgaatgaagcgactgggaattgataaatcggcattgatttaa

SEQ ID NO: 6502 - protein, 692 aa, Escherichia coli
MSYTPMSDLGQQGLFDITRTLLQQPDLASLCEALSQLVKRSALADNAAIVLWQAQTQRASYYASREKDTPIKYEDETVLAHGPVRSILSRPDTLHCSYEEFCETWPQLATGGLYPKFGHYCLMPLAAEGHIFGGCEFIRYDDRPWSEKEFNRLQTFTQIVSVVTEQIQSRVVNNVDYELLCRERDNFRILVAITNAVLSRLDMDELVSEVAKEIHYYFDIDDISIVLRSHRKNKLNIYSTHYLDKQHPAHEQSEVDEAGTLTERVFKSKEMLLINLHERDDLAPYERMLFNTWGNQIQTLCLLPLMSGDTMLGVLKLAQCEEKVFTTTNLNLLRQIAERVAIAVDNALAYQEIHRLKERLVDENLALTEQLNNVDSEFGEIIGRSEAMYSVLKQVEMVAQSDSTVLILGETGTGKELIARAIHNLSGRNNRRMVKMNCAAMPAGLLESDLFGHERGAFTGASAQRIGRFELADKSSLFLDEVGDMPLELQPKLLRVLQEQEFERLGSNKIIQTDVRLIAATNRDLKKMVADREFRSDLYYRLNVFPIHLPPLRERPEDIPLLAKAFTFKIARRLGRNIDSIPAETLRILSNMEWPGNVRELENVIERAVLLTRGNVLQLSLPDIALPEPETPPAATVVAQEGEDEYQLIVRVLKETNGVVAGPKGAAQRLGLKRTTLLSRMKRLGIDKSALI

SEQ ID NO: 6503 - DNA, 429 bp, Escherichia coli
atggcagtttcagcaagaaatcaattaaccggaacagttagcgcagtagcaatgggcgcggtgaatgatgaagtagaactgacgctggcaggtggtgcaaagctggtggcaattgtgactcacagcagccagcaagcgctgggtctggcgaaagggaaagaagcgattgccctgattaaagccccgtgggtcacgctggcaacggaagactgtggactgaaattctctgctcgcaaccagtttgctggcagcgtgtcgacaatcaccgaaggcgcagtgaacgccactgtccatatcaaaacggatgcgggttttgaaattgtggcagtggtaacaaatgaaagtcaggatgaaatgaaactcaccactggctcgcgcgttattgcattgatcaaagcatcagccatcctgattgccaccaaagcgtaa

SEQ ID NO: 6504 - protein, 142 aa, Escherichia coli
MAVSARNQLTGTVSAVAMGAVNDEVELTLAGGAKLVAIVTHSSQQALGLAKGKEAIALIKAPWVTLATEDCGLKFSARNQFAGSVSTITEGAVNATVHIKTDAGFEIVAVVTNESQDEMKLTTGSRVIALIKASAILIATKA

SEQ ID NO: 6505 - DNA, 345 bp, Escherichia coli
atgtccggcaagcgtatctctcgtgaaaaactgacgattaaaaaaatgatcgatctttatcaagcgaaatgcccgcaggcgtcagcagagccggagcattacgaggcgttgtttgcttacgcgcaaaagcggctggataaatgtgtgttcggcgaagagaaaccagcctgtaagcagtgtccggtgcactgttaccagcctgcaaagcgtgaagagatgaaacagattatgcgttgggttgggccgagaatgctgtggcgtcatccgatcttaaccgtgcgtcatctcatcgatgacaagcgtccggtgccggagttgccagaaaaatatcgtccaaagaaataa

SEQ ID NO: 6506 - protein, 114 aa, Escherichia coli
MSGKRISREKLTIKKMIDLYQAKCPQASAEPEHYEALFAYAQKRLDKCVFGEEKPACKQCPVHCYQPAKREEMKQIMRWVGPRMLWRHPILTVRHLIDDKRPVPELPEKYRPKK

SEQ ID NO: 6507 - DNA, 2562 bp, Escherichia coli
atgagtacaatagaaaatttcgacgcccatacgcccatgatgcagcagtatctcaagctgaaagcccagcatcccgagatcctgctgttttaccggatgggcgacttttatgaactgttttatgacgacgcaaaacgggcatcgcaactgctggatatttcactgaccaaacgcggtgcttcagcgggagagccaatcccgatggcggggattccctaccatgcggtggaaaactacctcgccaaactggtgaatcagggcgaatccgtcgctatttgtgaacagattggcgatccggcgaccagcaaagggccggttgagcgcaaagttgtccgtatcgttacgccgggcaccatcagcgatgaagcgctgttgcaggaacgtcaggacaacctgctggcggctatctggcaggacagtaaaggtttcggctacgcaacgctggatatcagttccggtcgttttcgcctgagcgaaccggcagaccgcgaaacgatggcggcagaactgcaacgtacgaatccagcggaattactgtatgcggaagatttcgccgagatgtcgctgattgaaggtcgccgcggcctgcgtcgtcgcccgctgtgggagtttgaaatcgacaccgctcgccagcaattgaacctgcaatttggcacccgagatctggtcggttttggtgtggagaacgcaccacgcggactttgtgctgccggttgtctgttgcagtatgcgaaagatacccaacgcacgaccctgccgcatattcgttctatcactatggaacgtcagcaggacagcatcattatggatgccgcgacgcgtcgtaacctggaaattactcagaacctggccggcggtgcggaaaatacgctggcttcagtgctcgactgcactgtaacgccgatgggcagccgtatgctgaaacgctggctgcatatgccagtgcgcgatacccgcgtgttgcttgagcgccagcaaactattggcgcattgcaggatttcaccgctgagctacagccggtactgcgtcaggtcggcgacctggaacgtattctggcgcgtctggcgttgcgtaccgctcgcccgcgcgatctggcccgtatgcgtcatgccttccagcaactgccggagttgcgtgcgcagttagaaaatgtcgatagtgcaccggtacaagcgctgcgtgagaagatgggcgagtttgccgaactgcgcgacctgctggagcgagcaatcatcgacacgccgccggtgctggtacgcgatggtggtgttattgcgactggttataacgaagaactggatgaatggcgtgcgctggccgacggcgcgaccgattatctggaacgtctggaagtccgcgagcgtgaacgtaccggcctggacacgttaaaagttggctttaatgctgtgcacggctactacattcaaatcagccgtgggcaaagccatctggcaccaatcaactacatgcgccgccagacgctgaaaaacgccgagcgttacattattccggagctgaaagagtacgaagataaagttctcacctcaaaaggcaaagcgctggcactggaaaaacagctttatgaagagctgttcgacctgttgctgccgcatctggaagcgttgcaacagagcgcgagcgcgctggcagaacttgatgtgctggttaacctggcggagcgggcctataccctgaactacacctgcccgacctttattgataaacctggcattcgtattaccgaaggtcgccatccagtggttgaacaggtactgaacgaaccgtttatcgctaacccgctaaacctgtcgccacagcgccgcatgttgatcatcaccggtccgaacatggggggtaaaagtacctatatgcgccagaccgcgttgattgcgctgatggcgtatatcggcagttacgtcccggcgcaaaaggtcgagattgggccgatcgatcgcatctttacccgcgtaggtgccgcggatgatctggcttccggacgttcaacctttatggtggagatgaccgaaaccgctaatattctgcataacgccaccgaatacagtctggtgttgatggacgagattgggcgcggaacgtccacttacgatggcctgtcgctggcatgggcgtgtgcggaaaatctggcaaataagatcaaagcgttgacgctgtttgctacccactatttcgagctgacccagttaccggagaaaatggaaggcgtcgccaacgtgcatctcgatgcactggagcacggcgacaccattgcctttatgcatagcgtgcaggatggcgcagcgagcaaaagctacggcctggcggttgcagctctggcgggtgtgccaaaagaggttattaagcgcgcacggcaaaaactgcgtgagctggaaagcatttcgccgaacgccgctgctacgcaagtggatggtacacaaatgtctttgctgtccgtaccggaagaaacttcgcctgcggtcgaggcattggaaaacctcgacccggattcactgactccgcgtcaggcgctggaatggatttatcgcttgaagagtctggtgtaa

SEQ ID NO: 6508 - protein, 853 aa, Escherichia coli
MSTIENFDAHTPMMQQYLKLKAQHPEILLFYRMGDFYELFYDDAKRASQLLDISLTKRGASAGEPIPMAGIPYHAVENYLAKLVNQGESVAICEQIGDPATSKGPVERKVVRIVTPGTISDEALLQERQDNLLAAIWQDSKGFGYATLDISSGRFRLSEPADRETMAAELQRTNPAELLYAEDFAEMSLIEGRRGLRRRPLWEFEIDTARQQLNLQFGTRDLVGFGVENAPRGLCAAGCLLQYAKDTQRTTLPHIRSITMERQQDSIIMDAATRRNLEITQNLAGGAENTLASVLDCTVTPMGSRMLKRWLHMPVRDTRVLLERQQTIGALQDFTAELQPVLRQVGDLERILARLALRTARPRDLARMRHAFQQLPELRAQLENVDSAPVQALREKMGEFAELRDLLERAIIDTPPVLVRDGGVIATGYNEELDEWRALADGATDYLERLEVRERERTGLDTLKVGFNAVHGYYIQISRGQSHLAPINYMRRQTLKNAERYIIPELKEYEDKVLTSKGKALALEKQLYEELFDLLLPHLEALQQSASALAELDVLVNLAERAYTLNYTCPTFIDKPGIRITEGRHPVVEQVLNEPFIANPLNLSPQRRMLIITGPNMGGKSTYMRQTALIALMAYIGSYVPAQKVEIGPIDRIFTRVGAADDLASGRSTFMVEMTETANILHNATEYSLVLMDEIGRGTSTYDGLSLAWACAENLANKIKALTLFATHYFELTQLPEKMEGVANVHLDALEHGDTIAFMHSVQDGAASKSYGLAVAALAGVPKEVIKRARQKLRELESISPNAAATQVDGTQMSLLSVPEETSPAVEALENLDPDSLTPRQALEWIYRLKSLV

SEQ ID NO: 6509 - DNA, 657 bp, Escherichia coli
atgccatctacacgctaccaaaaaatcaacgcccatcactatcgccatatatggaccgttggtgatattcatggtgactatcaattattacaatcccgcttacatcaactctctttttgccctgaaaccgacttacttatttcggtaggcgataacatcgatcgtgggcccgagagtcttaacgtgctgcgcctgttaaaccagccctggtttatctccgtcaaaggcaaccacgaagcgatggcgcttgatgcattcgaaactggcgatggaaatatgtggcttgccagcggtggtgactggtttttcgatttaaatgattcagagcaacaagaggcaatagatctgttgctgaaattccatcaccttccacatattattgaaatcactaacgacaccataaaatatgtcatcgcacatgcagattatccggggaaggagtatcagtttggcaaagaaatagcggagaacgaattactctggcctgttgatcgtgtgcagaaatcacttaatagcgaattacaaaaaataaacggtgccgacttctttatatttggtcatatgatgtttgataacattcagacgttcgctaaccagatttatatagataccggatcgccgaaaagcgggcggctgtcattttataaaataaagtag

SEQ ID NO: 6510 - protein, 218 aa, Escherichia coli
MPSTRYQKINAHHYRHIWTVGDIHGDYQLLQSRLHQLSFCPETDLLISVGDNIDRGPESLNVLRLLNQPWFISVKGNHEAMALDAFETGDGNMWLASGGDWFFDLNDSEQQEAIDLLLKFHHLPHIIEITNDTIKYVIAHADYPGKEYQFGKEIAENELLWPVDRVQKSLNSELQKINGADFFIFGHMMFDNIQTFANQIYIDTGSPKSGRLSFYKIK

SEQ ID NO: 6511 - DNA, 732 bp, Escherichia coli
atggtagctgaaaaaggcattgtcagtattgctgaactaacggacagaatgaatgtgtcacatatgaccattcgtcgggatttacaaaaactggagcagcagggagccgttgtgctggtgtccggaggcgtccagtctccgggacgcgtggcgcatgaaccttctcatcaggtaaaaactgcgctggcaatgacgcaaaaagcggctattggcaagctggcggcaagtcttgttcagccgggacgttgtatctatctggatgcaggaacgaccacgttagcgattgcacagcatctgattcacatggagccactcacagtggttactaacgacttcgttattgcggactacttgctcgacaacagtaattgcacaattattcacactggcggcgcagtgtgtcgggaaaaccgttcctgtgttggggaagccgctgcgaccatgctgcgtagcctgatgattgatcaggcttttatttctgcatcgtcatggagtgtgcgggggatctctacgccagcagaagataaagtcacggtgaaaagggcgattgccagtgccagccgccagcgagttttggtctgtgatgcgacgaaatatggacaggcggcgacatggctggcgttaccattaagcgagtttgatcagatcattactgacgacggtctgccggagagtgccagccgcgcgctggcgaagctggatctctctttgctggtagcgaaaaatgaataa

SEQ ID NO: 6512 - protein, 243 aa, Escherichia coli
MVAEKGIVSIAELTDRMNVSHMTIRRDLQKLEQQGAVVLVSGGVQSPGRVAHEPSHQVKTALAMTQKAAIGKLAASLVQPGRCIYLDAGTTTLAIAQHLIHMEPLTVVTNDFVIADYLLDNSNCTIIHTGGAVCRENRSCVGEAAATMLRSLMIDQAFISASSWSVRGISTPAEDKVTVKRAIASASRQRVLVCDATKYGQAATWLALPLSEFDQIITDDGLPESASRALAKLDLSLLVAKNE

SEQ ID NO: 6513 - DNA, 909 bp, Escherichia coli
atgaaaacgggatcggagtttcatgtcggtatcgttggcttagggtcaatgggaatgggagcagcactgtcatgtgtccgcgcaggtctttctacctggggcgcagacctgaacagcaatgcctgcgctacgttgaaagaggctggtgcttgcggagtttctgataacgccgcgacgtttgccgaaaaactggacgctctgctggtgctggtggtcaatgcgacccaggttaaacaggtgctgtttggtgaaaaaggcgttgcacaacatctgaaacccggtacggcagtaatggtttcttccactatcgccagtgctgatgcgcaagaaattgctaccgctctggctggattcggtctggaaatgctggatgcgccggtttctggtggtgcggtaaaagccgctaacggtgaaatgactgtcatggcctccggtagcgatattgcctttgaacgactggcacccgtgctggaagccgttgccggaaaagtttatcgcatcggtgcagaaccgggactgggttcgaccgtaaaaattatccaccagttgttagcgggcgtacatattgctgccggagccgaagcgatggcgcttgcagcccgtgcggggatcccgctggatgtgatgtatgacgtcgtgaccaatgccgccggaaattcatggatgttcgaaaaccggatgcgtcatgtggtggatggcgattacaccccgcattcagccgtcgatatttttgttaaggatcttggtctggttgccgataccgccaaagccctgcacttcccgctgccgttggcctcaacagcattgaatatgttcaccagcgccagtaacgcgggttacgggaaagaagacgatagcgcagttatcaagattttctcaggcatcactctaccgggagcgaaatcatga

SEQ ID NO: 6514 - protein, 302 aa, Escherichia coli
MKTGSEFHVGIVGLGSMGMGAALSCVRAGLSTWGADLNSNACATLKEAGACGVSDNAATFAEKLDALLVLVVNATQVKQVLFGEKGVAQHLKPGTAVMVSSTIASADAQEIATALAGFGLEMLDAPVSGGAVKAANGEMTVMASGSDIAFERLAPVLEAVAGKVYRIGAEPGLGSTVKIIHQLLAGVHIAAGAEAMALAARAGIPLDVMYDVVTNAAGNSWMFENRMRHVVDGDYTPHSAVDIFVKDLGLVADTAKALHFPLPLASTALNMFTSASNAGYGKEDDSAVIKIFSGITLPGAKS

SEQ ID NO: 6515 - DNA, 1263 bp, Escherichia coli
atgatcaagattggcgttatcgccgatgattttaccggcgcgacggatatcgccagttttctggtggaaaacggtctaccaacggtacaaattaacggtgttccaacaggtaaaatgccggaagcaatcgacgctctggtgatcagcctgaaaacgcgctcctgtccggtggttgaagccacacagcaatcgctggcggctctgagctggttgcaacagcaaggttgcaaacagatctatttcaaatactgctctactttcgacagtacggcgaaagggaatatcggtccggttaccgatgcattaatggatgctctcgacacaccgtttacggtcttctctccggccctgccagtcaacggacgtacggtttatcaggggtatttgttcgtaatgaatcaactgctggccgaatccgggatgcgccatcacccggtaaatcccatgaccgacagctatcttccccgtctggttgaatcgcaatccacagggcgctgcggcgtcgtttcagcacatgttttcgaacaaggtgtgaaagccgttcgtcaggagctggctcgcttacagcaagagggctatcgctacgcggtgcttgatgcgctgaccgaacaccatctggaaattcaggggaaagccttgcgcgatgccccactggtaacgggcggttctggtctggcgattggcctggcccggcagtgggcgcaagaaaacggtaaccaggctcgcgaagcagggcgtccgctcgctgggcgcggcgtagtgctctccggttcatgctctcaaatgaccaaccgccaggtggcacattaccgtcaaattgcaccagcccgtgaggttgatgtggcacgctgcctctcaaccgaaactctggccgcttatgcacacgagctggcagagtgggttctgggccaggaaagtgtacttgctccactggtttttgccaccgccagcactgacgcattggcagcaattcaacagcaatacggtgcacaaaaagccagtcaggcagtggaaacactgttttctcaactagcggcgcggttagcagcggaaggcgtgacacgctttattgtcgcaggcggtgagacctccggcgtagtcacacagagcctgggcataaaaggttttcatattggcccaaccatttcccccggcgtgccgtgggtaaacgcactggataagcctgtctcactcgcccttaaatctggcaacttcggtgatgaagcctttttttcacgagcccaaagagagtttttatcatga

SEQ ID NO: 6516 - protein, 420 aa, Escherichia coli
MIKIGVIADDFTGATDIASFLVENGLPTVQINGVPTGKMPEAIDALVISLKTRSCPVVEATQQSLAALSWLQQQGCKQIYFKYCSTFDSTAKGNIGPVTDALMDALDTPFTVFSPALPVNGRTVYQGYLFVMNQLLAESGMRHHPVNPMTDSYLPRLVESQSTGRCGVVSAHVFEQGVKAVRQELARLQQEGYRYAVLDALTEHHLEIQGKALRDAPLVTGGSGLAIGLARQWAQENGNQAREAGRPLAGRGVVLSGSCSQMTNRQVAHYRQIAPAREVDVARCLSTETLAAYAHELAEWVLGQESVLAPLVFATASTDALAAIQQQYGAQKASQAVETLFSQLAARLAAEGVTRFIVAGGETSGVVTQSLGIKGFHIGPTISPGVPWVNALDKPVSLALKSGNFGDEAFFSRAQREFLS

SEQ ID NO: 6517 - DNA, 597 bp, Escherichia coli
atgacgcggattgccagttcattctttcagcgcggatatgcaaccggttcggctggcaatctgtcgctgcttttacctgacgggaatttactggcgacaccgacaggttcatgcctgggcaatctcgatccgcagcggctttccaaagtcaccgcggatggcgaatggttaagtggtgacaaaccctcgaaagaggtgctctttcatctggcgctgtatcgcaacaatccgcgctgtaaagcggtagtgcatttgcacagtacgtggtcgacggcgctttcctgccaggaagggctggacagcaataacgttattcggccgttcacaccatacgtggtgatgcggatgggtaatgtcccgctggtgccctattaccgaccgggcgataaacgcatcgcacaggatctggcggaactggcagcagacaatcaggcttttttactggcaaatcatggcccagtggtttgcggtgaaagcctgcaagaagccgccaacaatatggaagagctggaggaaacggcaaagctgatttttattctcggtgaccgcccgatccgttatctgaccgcaggtgaaattgcggaattaaggagttaa

SEQ ID NO: 6518 - protein, 198 aa, Escherichia coli
MTRIASSFFQRGYATGSAGNLSLLLPDGNLLATPTGSCLGNLDPQRLSKVTADGEWLSGDKPSKEVLFHLALYRNNPRCKAVVHLHSTWSTALSCQEGLDSNNVIRPFTPYVVMRMGNVPLVPYYRPGDKRIAQDLAELAADNQAFLLANHGPVVCGESLQEAANNMEELEETAKLIFILGDRPIRYLTAGEIAELRS

SEQ ID NO: 6519 - DNA, 777 bp, Escherichia coli
atgcctcgttttgcagctaatttatccatgatgttcaccgaagtgccttttattgaacgcttcgccgcagcgcgaaaagccgggttcgatgctgtggaatttctgtttccctatgactactcccccctgcaaatccaaaagcaactggagcaaaaccatctgacgctggcgctgttcaataccgctcccggagatattaatgcgggagaatggggattatccgcccttcccggacgtgagcacgaagcacgcgcagacatcgacctggcactggaatatgcattggcgctcaattgtgaacaagtccatgtgatggcaggcgtcgtgcccgctggcgaagatgctgaacggtaccgggcagtatttattgataatctccgctacgctgccgaccgctttgcgccacacggcaagcgaatattggttgaagcactcagccccggcgttaagcctcattatctcttctccagccagtatcaggcactggctattgttgaagaggttgcgcgagataacgtttttattcaactagatactttccatgcgcaaaaagtagatggcaacctgacacatttaatccgcgactacgccgggaaatatgcgcacgtacaaattgccggactacctgatcgacatgaaccggacgatggagaaatcaactatccgtggctgttccgcctgttcgatgaagtgggatatcagggctggatcggttgtgaatacaaacctcgtggcctcaccgaagaagggcttggctggtttgacgcctggcgctaa

SEQ ID NO: 6520 - protein, 258 aa, Escherichia coli
MPRFAANLSMMFTEVPFIERFAAARKAGFDAVEFLFPYDYSPLQIQKQLEQNHLTLALFNTAPGDINAGEWGLSALPGREHEARADIDLALEYALALNCEQVHVMAGVVPAGEDAERYRAVFIDNLRYAADRFAPHGKRILVEALSPGVKPHYLFSSQYQALAIVEEVARDNVFIQLDTFHAQKVDGNLTHLIRDYAGKYAHVQIAGLPDRHEPDDGEINYPWLFRLFDEVGYQGWIGCEYKPRGLTEEGLGWFDAWR

SEQ ID NO: 6521 - DNA, 1365 bp, Escherichia coli
atgtccacaattacattgttatgcattgcgttagctggcgtaatcatgctgttgctactggtcatcaaggcaaaggtacaaccattcgttgctctgctcctcgtcagcctgttagtcgcacttgcggcgggtataccggcgggcgaagtgggtaaagtgatgatcgccgggatgggcggtgtgcttggttccgtcactattattattggtctgggcgctatgctggggcgtatgatcgaacactctggtggtgcagagtcactggctaattatttcagtcgcaagttaggtgacaaacgaactatcgctgcgctgactctggcagcgttcttcctcggtattcccgtcttctttgatgtcggctttattattcttgcgccaatcatttacggttttgccaaggttgccaaaatatcaccactcaaatttggcctgcctgtcgctgggatcatgctcactgttcacgtggcggtaccgccgcatccaggccctgtcgccgcagcggggttactccacgcagacatcggctggctaaccatcatcggtattgcgatttctattcccgtaggggttgttggctactttgcagcgaaaataatcaataagcgccaatatgcgatgtcggtcgaggtactggaacagatgcaactggctccggccagtgaggaaggcgcgacaaaattaagcgataaaataaatccaccgggcgtcgcgctggtcacctcgctaattgttattcctatcgcgattatcatggcgggtacggtttctgcaacactgatgccgccttcgcatcccctgcttggtacgctacagttgatcggctcaccaatggtagctctaatgattgcgctggtgctggcattctggttattggctttacgtcgcggctggagcttacaacacaccagcgacattatgggctctgcccttcccactgcggcggtagtgattttggttactggtgctggaggggtatttggcaaagtgctggtggaatcgggcgtcggtaaagcccttgccaacatgttacaaatgattgacctgcctctgttaccagccgcatttattatttcactggcgctgcgtgcatcgcaggggtcagcaaccgtagcaatcctgacaaccagcgggttactctcagaagcggtgatgggattaaatccgattcagtgcgtattggtgacgctggcagcctgctttggtgggcttggcgcgtcacatattaatgactcagggttctggattgtgaccaaatatctggggttgtcggtagcagacggtctgaaaacctggacagtgttaacgaccattctcggttttaccggattcttaattacctggtgcgtatggctcgtcatctaa

SEQ ID NO: 6522 - protein, 454 aa, Escherichia coli
MSTITLLCIALAGVIMLLLLVIKAKVQPFVALLLVSLLVALAAGIPAGEVGKVMIAGMGGVLGSVTIIIGLGAMLGRMIEHSGGAESLANYFSRKLGDKRTIAALTLAAFFLGIPVFFDVGFIILAPIIYGFAKVAKISPLKFGLPVAGIMLTVHVAVPPHPGPVAAAGLLHADIGWLTIIGIAISIPVGVVGYFAAKIINKRQYAMSVEVLEQMQLAPASEEGATKLSDKINPPGVALVTSLIVIPIAIIMAGTVSATLMPPSHPLLGTLQLIGSPMVALMIALVLAFWLLALRRGWSLQHTSDIMGSALPTAAVVILVTGAGGVFGKVLVESGVGKALANMLQMIDLPLLPAAFIISLALRASQGSATVAILTTSGLLSEAVMGLNPIQCVLVTLAACFGGLGASHINDSGFWIVTKYLGLSVADGLKTWTVLTTILGFTGFLITWCVWLVI

SEQ ID NO: 6523 - DNA, 1044 bp, Escherichia coli
atgcaaggtattaaaatatatacaattctagcctcttctcttatatctggtagtgtttttgctcaaacggaaatttcgactgcaaattcgtctacggttaatgcaagttatgttgaaccttcagcggaaaaaataatatcgccaagcgataaactcaataacctttttgaaagaaatatgtctcagccttatattttacaaaaaattggcgagagaacttattatgttcaacgctatttttattccactacgttttatgtcggagacaaaggggttttgctgtttgatgctccggagggtcgcggtaaatatttattacaggcaattcgtgatgtgactccattacccgtaacagcgctggtttattctcattaccatgtggatcacattggcgatagtccattttggaacgatgaggcgaagaaagaaggcgtgaatctgcgtattattgccagtaaagccactgctgaaaaaatgcaatttatgaacagtcgcttacccgtcgccactcaggttttaagtaaaaaagatgaccagtttaaatttgaaaagcagaccattgaattacaccgatttgttaaagcaggacataccgacgaccattctgtatggttgctaaaacaggaaaaagtagctcacagcccggatctcctgaatcctgaccaactgccgatgatgggcttcgccgtatcggatacgttggtttaccatgacagtaatttgcgtcaggttgaaatgcttgactggaaatattttattggcgggcatggtaatattggttcacacgatgattttaaatttcaacgccagtttcttaatgatcttcgggatacgacaattaaagtcagaaaagaagaaagttttggtaaatttatgaataaaacggcaaataatcatgctgattttgcgcgagcccagcgcgaagcaattattaagaaagtaactgaagtattacgtccgaaatatggccatatgtatggctacgacgcatctatgcctgctaatatcgaaatggcaataagattggtcggttcttattactaa

SEQ ID NO: 6524 - protein, 347 aa, Escherichia coli
MQGIKIYTILASSLISGSVFAQTEISTANSSTVNASYVEPSAEKIISPSDKLNNLFERNMSQPYILQKIGERTYYVQRYFYSTTFYVGDKGVLLFDAPEGRGKYLLQAIRDVTPLPVTALVYSHYHVDHIGDSPFWNDEAKKEGVNLRIIASKATAEKMQFMNSRLPVATQVLSKKDDQFKFEKQTIELHRFVKAGHTDDHSVWLLKQEKVAHSPDLLNPDQLPMMGFAVSDTLVYHDSNLRQVEMLDWKYFIGGHGNIGSHDDFKFQRQFLNDLRDTTIKVRKEESFGKFMNKTANNHADFARAQREAIIKKVTEVLRPKYGHMYGYDASMPANIEMAIRLVGSYY

SEQ ID NO: 6525 - DNA, 552 bp, Escherichia coli
atgcaaaacatagctgtggtttattattcaggatatggtcacactaaactggttgctgaaaaagtggcacaaggcgcccatgcagatttaatttcgattgataacgaaggaaatatcactgagcaggagtgggaaaaactggacgcagccgatgccattatcttcggtgctcccacctatatgggcggtgcgccatggcaattcaagaaatttgctgatgccagttccaaagcgtggtttacacgtaaatggcaggataaagtcttcgggggtttcaccaacagcgccagcctgaatggcgataaacaagttacgctgatctatctgcaaacgctggcttcacagcatggcggtctgtgggtgagtttaggtcaggctcctgccaatgtgcttgcgtcaaccagggaagatgtaaacaatctgggcggttcagtcggtttgctggtgcaatctccagccgatgcgggtgcagaccaaatccctacgggcgatctggatacagccgtgaaatatggtgaacgcgtagcgacaattactgcgcgcttaaaatga

SEQ ID NO: 6526 - protein, 183 aa, Escherichia coli
MQNIAVVYYSGYGHTKLVAEKVAQGAHADLISIDNEGNITEQEWEKLDAADAIIFGAPTYMGGAPWQFKKFADASSKAWFTRKWQDKVFGGFTNSASLNGDKQVTLIYLQTLASQHGGLWVSLGQAPANVLASTREDVNNLGGSVGLLVQSPADAGADQIPTGDLDTAVKYGERVATITARLK

SEQ ID NO: 6527 - DNA, 714 bp, Escherichia coli
atgatcgagagtaacttgcgtctggtggtaaaaattgcccgccgttatggcaatcgtggtctggcgttgctggacctgatcgaagagggcaacctggggctgatccgcgcggtagagaagtttgacccggaacgtggtttccgcttctcaacatacgcaacctggtggattcgccagacgatcgaacgggcgattatgaaccaaacccgtactattcgtttgccgattcacatcgtaaaggagctgaacgtttacctgcgaaccgcacgtgagttgtcccataagctggaccacgaaccaagtgcggaagagatcgcagagcaactggataagccagttgatgacgtcagccgtatgcttcgtcttaacgagcgcattacctcggtagacaccccgctgggtggtgattccgaaaaagcgttgctggacatcctggccgatgaaaaagagaatggtccggaagataccacgcaagatgacgatatgaagcagagcatcgtcaaatggctgttcgagctgaacgccaaacagcgtgaagtactggcacgtcgattcggtttgctggggtacgaagcggcaacactggaagatgtaggtcgtgaaattggcctcacccgtgaacgtgttcgccagattcaggttgaaggcctgcgccgtttgcgcgaaatcctgcaaacgcaggggctgaatatcgaagcgctgttccgcgaataa

SEQ ID NO: 6528 - protein, 237 aa, Escherichia coli
MIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 6529 - DNA, 213 bp, Escherichia coli
atgagtcagaatacgctgaaagttcatgatttaaatgaagatgcggaatttgatgagaacggagttgaggtttttgacgaaaaggccttagtagaagaggaacccagtgataacgatttggccgaagaggaactgttatcgcagggagccacacagcgtgtgctggacgcgactcagctttaccttggtgagattggttattcaccactgtga

SEQ ID NO: 6530 - protein, 70 aa, Escherichia coli
MSQNTLKVHDLNEDAEFDENGVEVFDEKALVEEEPSDNDLAEEELLSQGATQRVLDATQLYLGEIGYSPL

SEQ ID NO: 6531 - DNA, 1140 bp, Escherichia coli
atgagcgcgggaagcccaaaattcaccgttcgccgcattgcggcattgtcactggtttcgctatggctggcaggctgttctgacacttcaaatccaccggcaccggtcagctccgttaatggcaatgcgcctgcaaataccaattctggtatgttgattacgccgccgccgaaaatgggaacgacgtctacagcacagcaaccgcaaattcagccggtacagcagccacaaattcaggctactcaacaaccgcaaatccagccagtgcagccagtagctcagcagccggtacagatggaaaacggacgaatcgtctacaaccgtcagtatgggaacattccgaaaggcagttatagcggcagtacatacaccgtgaaaaaaggcgacacgcttttctatatcgcctggattactggcaacgatttccgtgaccttgctcagcgcaacaatattcaggcaccatacgcgctgaacgtcggtcagaccttacaggtgggtaatgcttccggtacgccaatcacaggcggaaatgccattacccaggccgacgcagcagagcaaggagttgtgatcaagcctgcacaaaattccaccgttgctgttgcgtcgcaaccgacaattacgtattctgagtcttcgggtgaacagagtgctaacaaaatgttgccgaacaacaagccaactgcgaccacggtcacagcgcctgtaacggtaccaacagcaagcacaaccgagccgactgtcagcagtacatcaaccagtacgcctatctccacctggcgctggccgactgagggcaaagtgatcgaaacctttggcgcttctgaggggggcaacaaggggattgatatcgcaggcagcaaaggacaggcaattatcgcgaccgcagatggccgcgttgtttatgccggtaacgcgctgcgcggctacggtaatctgattatcatcaaacataatgatgattacctgagtgcctacgcccataacgacacaatgctggtccgggaacaacaagaagtgaaggcggggcaaaaaatagcaaccatgggtagcaccggaaccagttcaacacgcttgcattttgaaattcgttacaaggggaaatccgtaaacccgctgcgttatttgccgcagcgataa

SEQ ID NO: 6532 - protein, 379 aa, Escherichia coli
MSAGSPKFTVRRIAALSLVSLWLAGCSDTSNPPAPVSSVNGNAPANTNSGMLITPPPKMGTTSTAQQPQIQPVQQPQIQATQQPQIQPVQPVAQQPVQMENGRIVYNRQYGNIPKGSYSGSTYTVKKGDTLFYIAWITGNDFRDLAQRNNIQAPYALNVGQTLQVGNASGTPITGGNAITQADAAEQGVVIKPAQNSTVAVASQPTITYSESSGEQSANKMLPNNKPTATTVTAPVTVPTASTTEPTVSSTSTSTPISTWRWPTEGKVIETFGASEGGNKGIDIAGSKGQAIIATADGRVVYAGNALRGYGNLIIIKHNDDYLSAYAHNDTMLVREQQEVKAGQKIATMGSTGTSSTRLHFEIRYKGKSVNPLRYLPQR

SEQ ID NO: 6533 - DNA, 627 bp, Escherichia coli
atggtaagcagacgcgtacaagcacttctggatcaattacgtgcgcaaggtattcaggatgagctggtgctgaatgcacttgccgccgtgccgcgtgaaaaattcgttgatgaagcgtttgaacaaaaagcctgggacaatatcgccttgccgataggtcaggggcagacaatttcgcagccgtatatggtggcgcgaatgaccgaattactcgagctgacgccgcagtcgcgggtgctggaaattggcactggttcgggatatcaaactgcaatcctggcgcatcttgtccaacatgtttgctcggttgaacggattaaaggcttgcagtggcaggcgcgtcgccgcctgaaaaatcttgatttacataatgtttcaacccgtcatggcgatggatggcaaggttggcaggcacgcgcgccgtttgacgctatcattgttacggcggcaccgcctgaaattccaactgcgctaatgacgcagctggacgaaggcgggattctcgtcttacccgtaggggaggagcaccagtatttgaaacgggtgcgtcgtcggggaggcgaatttattatcgataccgtggaggccgtgcgctttgtccctttagtgaagggtgagctggcttaa

SEQ ID NO: 6534 - protein, 208 aa, Escherichia coli
MVSRRVQALLDQLRAQGIQDELVLNALAAVPREKFVDEAFEQKAWDNIALPIGQGQTISQPYMVARMTELLELTPQSRVLEIGTGSGYQTAILAHLVQHVCSVERIKGLQWQARRRLKNLDLHNVSTRHGDGWQGWQARAPFDAIIVTAAPPEIPTALMTQLDEGGILVLPVGEEHQYLKRVRRRGGEFIIDTVEAVRFVPLVKGELA

SEQ ID NO: 6535 - DNA, 807 bp, Escherichia coli
ttgcaaccagcgttgtcagggaacttatcaacacaacaggtgattatgcgcatattgctgagtaatgatgacggggtacatgcacccggtatacaaacgctggcgaaagccttgcgtgagtttgctgacgttcaggtggtcgcccccgatcgtaaccgcagcggcgcttctaattctctgacactggaatcctccctgcgtacgtttacctttgaaaatggtgatattgctgtgcaaatgggaaccccgaccgattgcgtctatcttggcgtaaatgctctgatgcgcccgcgcccggacattgttgtgtccggaattaacgccgggccgaatctgggggatgatgttatttattccggtacggtagccgccgcgatggaaggccgccatttaggttttccggcgcttgccgtctcgcttgacgggcataaacattacgacactgccgcggcggtaacctgttcaattttgcgcgcactgtgtaaagaaccgctgcgcaccgggcgtattcttaatattaacgttccggatttacccttggatcaaatcaaaggtattcgcgtgacgcgctgcggtacacgacatccggcagatcaggtgatcccgcagcaagatccgcgcggcaatacgctgtactggattggcccgccgggcggtaaatgtgatgccggtccggggaccgattttgctgcggtagatgagggctatgtttccatcacgccgctgcatgtggatttaactgcgcatagcgcgcaagatgtggtttcagactggttaaacagcgtgggagttggcacgcaatggtaa

SEQ ID NO: 6536 - protein, 268 aa, Escherichia coli
MQPALSGNLSTQQVIMRILLSNDDGVHAPGIQTLAKALREFADVQVVAPDRNRSGASNSLTLESSLRTFTFENGDIAVQMGTPTDCVYLGVNALMRPRPDIVVSGINAGPNLGDDVIYSGTVAAAMEGRHLGFPALAVSLDGHKHYDTAAAVTCSILRALCKEPLRTGRILNINVPDLPLDQIKGIRVTRCGTRHPADQVIPQQDPRGNTLYWIGPPGGKCDAGPGTDFAAVDEGYVSITPLHVDLTAHSAQDVVSDWLNSVGVGTQW

SEQ ID NO: 6537 - DNA, 1050 bp, Escherichia coli
atgattgagtttgataatctcacttacctccacggtaaaccgcaaggcaccgggctgctgaaagccaatccggaagactttgtggtggtggaagatttgggctttgagcctgatggtgaaggtgagcatattctggttagaatcctcaaaaacggctgcaatacccgttttgtggcggatgcactggcgaaattcctgaaaattcatgcccgtgaagtcagcttcgctgggcaaaaagataaacatgctgttacggaacagtggttatgcgctcgcgtgccgggcaaagagatgcccgatctgagcgcctttcaactggaaggctgccaggtgctggagtatgcgcggcacaagcgcaagctgcgtttaggggcgctgaaaggtaacgcctttaccctggtactacgcgaagtgagcaatcgcgatgacgttgaacaacgtctgatcgacatttgcgtaaaaggtgtaccgaactacttcggtgcccaacgttttgggattggcggtagcaacttgcagggtgcgctgcgctgggcgcaaaccaatactccggtgcgcgatcgcaataaacggagtttttggttgtcggcagcccgcagtgcgttgtttaatcagattgttgctgagcgcctcaaaaaagcagacgttaatcaagttgttgacggcgatgcgctacaattagccggacgtggtagctggtttgtcgcaaccaccgaagaactggcggaattacagcgtcgcgtcaacgataaagagctgatgataaccgccgcattgccgggcagtggcgaatggggaactcagcgtgaagcgctggcattcgaacaagcagctgtcgccgaagaaactgaattacaaaccttactggtgcgcgaaaaagttgaagccgcgcgcagagcgatgctgctgtatccgcaacaattaagctggaactggtgggatgacgtcaccgtagaaatccatttctggcttccggcgggaagttttgcaaccagcgttgtcagggaacttatcaacacaacaggtgattatgcgcatattgctgagtaa

SEQ ID NO: 6538 - protein, 349 aa, Escherichia coli
MIEFDNLTYLHGKPQGTGLLKANPEDFVVVEDLGFEPDGEGEHILVRILKNGCNTRFVADALAKFLKIHAREVSFAGQKDKHAVTEQWLCARVPGKEMPDLSAFQLEGCQVLEYARHKRKLRLGALKGNAFTLVLREVSNRDDVEQRLIDICVKGVPNYFGAQRFGIGGSNLQGALRWAQTNTPVRDRNKRSFWLSAARSALFNQIVAERLKKADVNQVVDGDALQLAGRGSWFVATTEELAELQRRVNDKELMITAALPGSGEWGTQREALAFEQAAVAEETELQTLLVREKVEAARRAMLLYPQQLSWNWWDDVTVEIHFWLPAGSFATSVVRELINTTGDYAHIAE

SEQ ID NO: 6539 - DNA, 480 bp, Escherichia coli
atgcgaattggacacggttttgacgtacacgcctttggcggtgaaggcccaattatcattggtggcgtacgcattccttacgaaaaagggctgctggcgcattctgatggcgacgtggcgctccatgcgttgaccgatgcattgcttggcgcggcggcgctgggagatataggcaagctgttcccggataccgatccgacatttaaaggtgccgacagccgcgagctgttgcgcgaagcctggcgtcgtattcaggcgaaaggttatgccctcggcaacgtcgatgtcactatcatcgctcaggcaccgaggatgctgccgcatatcccacaaatgcgcgtgtttattgccgaagatctcggctgccatatggatgatgttaacgtgaaagccactactacggaaaaactgggatttaccggacgtggggaagggattgcctgtgaagcggtggcgctactcattaaggcaacaaaatga

SEQ ID NO: 6540 - protein, 159 aa, Escherichia coli
MRIGHGFDVHAFGGEGPIIIGGVRIPYEKGLLAHSDGDVALHALTDALLGAAALGDIGKLFPDTDPTFKGADSRELLREAWRRIQAKGYALGNVDVTIIAQAPRMLPHIPQMRVFIAEDLGCHMDDVNVKATTTEKLGFTGRGEGIACEAVALLIKATK

SEQ ID NO: 6541 - DNA, 711 bp, Escherichia coli
atggcaaccactcatttggatgtttgcgccgtggttccggcggccggatttggccgccgaatgcaaacggaatgtcctaagcaatatctctcaatcggtaatcaaaccattcttgaacactcggtgcatgcgctgctggcgcatcccagggtgaaacgtgtcgtcattgccataagtcctggcgatagccgctttgcacaacttcctctggcgaatcatccacgaatcacggttgttgatggtggtgaagagcgtgccgattccgtgctggcaggtctgaaagccgctggcgacgcgcagtgggtattggtgcatgacgccgctcgtccttgtctgcatcaggatgacctcgcgcgattgttggcgttgagcgaaaccagccgcacgggagggatcctcgctgcgccggtgcgcgatacgatgaaacgtgccgaaccgggcaaaaatgccattgctcataccgttgatcgcaacggcttatggcacgcgctgacgccgcaatttttccctcgtgagctgttacatgactgcctgacgcgcgctctaaatgaaggcgctaccattaccgacgaagcctcggcgctggaatattgcggttttcatccgcaacttgttgaaggccgcgcggataacatcaaggtaacgcgcccggaggatttggcgctggccgaattttacctcacccgaaccatccatcaggagaatacataa

SEQ ID NO: 6542 - protein, 236 aa, Escherichia coli
MATTHLDVCAVVPAAGFGRRMQTECPKQYLSIGNQTILEHSVHALLAHPRVKRVVIAISPGDSRFAQLPLANHPRITVVDGGEERADSVLAGLKAAGDAQWVLVHDAARPCLHQDDLARLLALSETSRTGGILAAPVRDTMKRAEPGKNAIAHTVDRNGLWHALTPQFFPRELLHDCLTRALNEGATITDEASALEYCGFHPQLVEGRADNIKVTRPEDLALAEFYLTRTIHQENT

SEQ ID NO: 6543 - DNA, 312 bp, Escherichia coli
atgggtaaactaacgctgctgttgctggctattctggtctggctacagtattcgctgtggttcggtaagaacggtatacatgactatactcgcgtcaataatgatgtggcggcacagcaagctacaaacgcgaaacttaaagcgcgaaacgatcagctttttgccgaaattgacgatctcaatggcggccaggaggcgctcgaagagcgtgcgcgtaatgaactcagcatgaccaggccgggcgaaacgttttatcgtctggtgcctgacgcgtcaaagcgcgcacagtctgcggggcaaaataatcgataa

SEQ ID NO: 6544 - protein, 103 aa, Escherichia coli
MGKLTLLLLAILVWLQYSLWFGKNGIHDYTRVNNDVAAQQATNAKLKARNDQLFAEIDDLNGGQEALEERARNELSMTRPGETFYRLVPDASKRAQSAGQNNR

SEQ ID NO: 6545 - DNA, 324 bp, Escherichia coli
atgcgtaacagccacaacattacattaacaaataacgacagccttactgaggttgaagacaccacatggtcgctgcctggcgctgtggttggttttttatcgtggctgtgcgcgttggcaattccgatgttgatttatggctctaacacgctgctcttttttatctacacctggcctttctttctggcgctgatgcccgtcgctgtagtggtggggattgcactgcattcattgatggacggaaagctacgctacagtattgttttcactctggcgacggttggcattatgtttggtgcgctgtttatgtggctactgggttaa

SEQ ID NO: 6546 - protein, 107 aa, Escherichia coli
MRNSHNITLTNNDSLTEVEDTTWSLPGAVVGFLSWLCALAIPMLIYGSNTLLFFIYTWPFFLALMPVAVVVGIALHSLMDGKLRYSIVFTLATVGIMFGALFMWLLG

SEQ ID NO: 6547 - DNA, 606 bp, Escherichia coli
atggctctgcatgacgaaaacgtcgtctggcatagccacccagtaactccgcaacaacgcgaacagcaccacggtcatcgtggtgttgtgctgtggtttaccggcctctctggttccggtaaatcaaccgtcgcgggggcgctggaggaggcgttacataaacttggcgtcagtacgtatctgctggatggcgacaacgttcgccacggattatgcagcgatctcggttttagcgatgccgaccgtaaagagaatatccgtcgcgtcggtgaagtggcgaatttgatggttgaagccggactggtggtgctgaccgcatttatctcgccacaccgcgccgaacgccagatggttcgcgaacgcgtaggagaagggcgctttatcgaagtgtttgtcgatacgccgctggcgatttgcgaagcccgcgatccaaaaggtttatataagaaagcgcgtgccggtgaactgcgcaactttacgggaatagattccgtttacgaagcgcctgaatcggcagaaattcatctcaatggtgaacaattagtaacaaatttggtacagcaattattagatctgttgagacagaacgatattatcagatcctga

SEQ ID NO: 6548 - protein, 201 aa, Escherichia coli
MALHDENVVWHSHPVTPQQREQHHGHRGVVLWFTGLSGSGKSTVAGALEEALHKLGVSTYLLDGDNVRHGLCSDLGFSDADRKENIRRVGEVANLMVEAGLVVLTAFISPHRAERQMVRERVGEGRFIEVFVDTPLAICEARDPKGLYKKARAGELRNFTGIDSVYEAPESAEIHLNGEQLVTNLVQQLLDLLRQNDIIRS

SEQ ID NO: 6549 - DNA, 1428 bp, Escherichia coli
atgaacaccgcacttgcacaacaaatcgccaatgaaggcggcgtcgaagcctggatgattgcgcaacaacataaaagcctgctgcgttttctgacctgtggtagcgtcgatgacggcaaaagtaccctgattggtcgcctgctgcacgatacccgccaaatctacgaagatcagctctcatcgctgcataacgacagtaagcgtcacggcacccagggcgaaaagctggatctggcactgctggtggacggcctgcaagctgagcgcgaacagggcatcactattgatgtggcctaccgctatttctctaccgagaagcgtaaatttattatcgccgacaccccagggcacgagcagtacacccgcaatatggcgactggcgcatcgacatgtgaactggcgatcttactgatcgatgcccgtaaaggcgtgctcgatcaaacccgtcgtcacagttttatctccacactgttggggatcaaacatctggtcgtggcgatcaacaaaatggatctggtggattacagtgaagagacgttcacccgtattcgtgaagattatctgacttttgccgggcagctgccgggtaatctggatatccgctttgtgccgctctccgcactggaaggcgacaacgtggcttcgcaaagtgaaagtatgccgtggtacagcggtccgacactgctagaagtgctggaaaccgtggagatccagcgagtggtggatgctcagccaatgcgcttcccggtgcagtacgttaaccgtccgaatctcgattttcgtggctacgccggaacgctggcatccggtcgtgtggaagtcgggcaacgtgtcaaagtgctgccctctggtgtggaatcaaacgtcgcgcggatcgtgacctttgatggcgatcgcgaagaagcctttgccggagaagcgatcaccctggtgctgacggatgagatcgacatcagccgtggcgatctgctgctggcggcagacgaagcgttaccggctgtgcagagcgcgtcggtggatgtggtatggatggcggaacagccgctttccccgggccagagttacgacatcaaaattgccggtaagaagacgcgtgctcgtgttgatggcattcattatcaggttgatatcaataaccttacccaacgcgaagttgaaaacctgccgctgaacggcatcggcctggtagatctcacctttgacgagccactggtgttagatcgttatcagcaaaacccggttaccggtgggctgatttttatcgatcgcctgagtaatgtgaccgtaggtgccggtatggtgcacgaaccagttagccaggcaactgctgcgccatctgaattcagtgcattcgaactggaattgaatgccctggttcgccgccatttcccgcattggggtgcgcgcgatttactgggagataaataa

SEQ ID NO: 6550 - protein, 475 aa, Escherichia coli
MNTALAQQIANEGGVEAWMIAQQHKSLLRFLTCGSVDDGKSTLIGRLLHDTRQIYEDQLSSLHNDSKRHGTQGEKLDLALLVDGLQAEREQGITIDVAYRYFSTEKRKFIIADTPGHEQYTRNMATGASTCELAILLIDARKGVLDQTRRHSFISTLLGIKHLVVAINKMDLVDYSEETFTRIREDYLTFAGQLPGNLDIRFVPLSALEGDNVASQSESMPWYSGPTLLEVLETVEIQRVVDAQPMRFPVQYVNRPNLDFRGYAGTLASGRVEVGQRVKVLPSGVESNVARIVTFDGDREEAFAGEAITLVLTDEIDISRGDLLLAADEALPAVQSASVDVVWMAEQPLSPGQSYDIKIAGKKTRARVDGIHYQVDINNLTQREVENLPLNGIGLVDLTFDEPLVLDRYQQNPVTGGLIFIDRLSNVTVGAGMVHEPVSQATAAPSEFSAFELELNALVRRHFPHWGARDLLGDK

SEQ ID NO: 6551 - DNA, 909 bp, Escherichia coli
atggatcaaaaacgacttacccacctgcggcaactggaggcggaaagcatccacattattcgcgaggtggctgcagaattctcaaatccggtgatgctctactctatcggtaaagattccagcgtcatgctgcatctggcgcgcaaggcgttttatccaggtacgctgcctttcccgttgctgcatgtcgataccggctggaaattccgcgagatgtatgagttccgcgatcgtacggcgaaagcctacggctgcgagctgctggtgcataaaaacccggaaggcgtggcgatggggattaatccattcgtacacggcagcgcgaaacataccgatattatgaaaactgaaggcctgaaacaggcgctgaacaaatacggttttgatgccgccttcggtggtgcgcgccgtgacgaagagaaatcccgcgctaaagagcgaatctactctttccgtgaccgcttccatcgctgggatccgaaaaatcagcgcccggagctgtggcacaactacaacgggcaaattaacaaaggcgaaagcatccgcgtcttcccgctctcaaactggaccgagcaggatatctggcaatacatctggctggaaaatatcgacattgttccgctgtatctcgctgcggaacgtccggttctggaacgcgacggtatgctgatgatgattgatgacaaccgtatcaacctgcaatcgggcgaagtgattaaaaaacggatggtgcgtttccgcacactgggctgttggccgctgaccggcgcggtggagtcaaatgcgcaaacactgccggagatcatcgaagagatgctggtttccaccaccagtgaacgtcagggccgcgtaattgaccgcgaccaggcggggtctatggagctgaaaaaacgtcaggggtatttttaa

SEQ ID NO: 6552 - protein, 302 aa, Escherichia coli
MDQKRLTHLRQLEAESIHIIREVAAEFSNPVMLYSIGKDSSVMLHLARKAFYPGTLPFPLLHVDTGWKFREMYEFRDRTAKAYGCELLVHKNPEGVAMGINPFVHGSAKHTDIMKTEGLKQALNKYGFDAAFGGARRDEEKSRAKERIYSFRDRFHRWDPKNQRPELWHNYNGQINKGESIRVFPLSNWTEQDIWQYIWLENIDIVPLYLAAERPVLERDGMLMMIDDNRINLQSGEVIKKRMVRFRTLGCWPLTGAVESNAQTLPEIIEEMLVSTTSERQGRVIDRDQAGSMELKKRQGYF

SEQ ID NO: 6553 - DNA, 111 bp, Escherichia coli
gtgtacggggagaataaagcatacgccgagcgccagggcagcggtacggtggcgcaatgcggaaaacatagtgagtccttaaataccatgcaaatttttttaccgccatag

SEQ ID NO: 6554 - protein, 36 aa, Escherichia coli
MYGENKAYAERQGSGTVAQCGKHSESLNTMQIFLPP

SEQ ID NO: 6555 - DNA, 897 bp, Escherichia coli
atgaccggaactcctgcagaaatgttatctgccgattatattcgccaacagtttcagcaaatgggttatcgcagtgatgttcggacatttaatagtcggtatatttataccgcccgcgataatcgcaagagctggcataacgtgacgggaagtacggtgattgccgctcatgaaggcaaagcgccgcagcagatcatcattatggcgcatctggatacttacgccccgctgagcgatgctgacgccgatgccaatctcggcgggctaacgttacaaggaatggatgataacgccgcaggtttaggtgtcatgctggaactggctgaacacctgaaaaatacgcctaccgagtatggtattcgatttgtggcgaccagcggcgaagaggaaggaaaattaggcgctgagaatttactcaagcggatgagtgacaccgaaaagaaaaatacgctgctggtgattaatctcgataacttaattgttggcgataagctgtatttcaacagtggcgtaaacacacctgaagcagtaaggaaattaacgcgcgaccgggcgctggcaattgcccgcagccatggaattgccgccaccacaaatccaggtttgaataaaaactatccgaaaggcaccgggtgttgtaatgacgcagaaatattcgacaaagccggtattgctgtactttcggtggaagcgactaactggaatcttggcaataaggatggttatcagcaacgcgcaaaaacagccgcattccctgcgggaaatagctggcatgacgtaagactggataatcaacagcatattgataaggcacttcctggaagaatagaacgtcgctgccgtgatgttatgcggataatgctaccgttggtgaaggagctggcgaaggcatcttaa

SEQ ID NO: 6556 - protein, 298 aa, Escherichia coli
MTGTPAEMLSADYIRQQFQQMGYRSDVRTFNSRYIYTARDNRKSWHNVTGSTVIAAHEGKAPQQIIIMAHLDTYAPLSDADADANLGGLTLQGMDDNAAGLGVMLELAEHLKNTPTEYGIRFVATSGEEEGKLGAENLLKRMSDTEKKNTLLVINLDNLIVGDKLYFNSGVNTPEAVRKLTRDRALAIARSHGIAATTNPGLNKNYPKGTGCCNDAEIFDKAGIAVLSVEATNWNLGNKDGYQQRAKTAAFPAGNSWHDVRLDNQQHIDKALPGRIERRCRDVMRIMLPLVKELAKAS

SEQ ID NO: 6557 - DNA, 153 bp, Escherichia coli
atgctgacaaaatatgcccttgtggcaatcatcgtactgtgttgtacagtactgggattcacgttgatggtaggcgactcgttgtgtgagttgagtatcagagaacgtggtatggagtttaaggcagttctcgcttacgaatcgaagaagtag

SEQ ID NO: 6558 - protein, 50 aa, Escherichia coli
MLTKYALVAIIVLCCTVLGFTLMVGDSLCELSIRERGMEFKAVLAYESKK

SEQ ID NO: 6559 - DNA, 888 bp, Escherichia coli
gtgaaggcttcggcgactttacggtgcgtgcgggcatcattcgcccggtgctcgatccggcgcgcgatttgtgggattaaccatcagcccggtcttgtaggcctgataagatgtgtaagcgttgcatcaggcaaggcaaacagtgaggaacttatgtccaaactcgatctaaacgccctgaacgaactgccaaaggtagaccggattctggcgctggcggaaactaacgcccaactggaaaaactggacgctgaaggccgcgtagcctgggcgctggataatctgcccggtgaatatgtactttcttccagctttggcattcaggcggcggtgagtctgcatctggtgaatcagattcgcccggatattccagtgatcctcaccgataccggctatctgttcccggaaacctaccgctttattgacgagttaacggataaactcaagctcaacctgaaagtgtaccgtgctaccgaaagcgccgcctggcaggaagcacgctacggcaaactgtgggagcagggcgttgaaggcattgaaaagtacaatgacatcaacaaagtcgaaccgatgaaccgggcgctgaaagaactgaatgtgcaaacctggtttgctggcctgcgccgtgaacaatccggcagccgcgccaatttaccggtgctggcaattcagcgtggcgtatttaaagtgctgccgattatcgactgggataaccgaactatttatcagtacctgcaaaaacatggcctgaaatatcacccattatgggatgaaggatatttatcggtgggcgatacccatacaacccgtaaatgggaacccggcatggcggaagaagaaacgcgtttctttggcttaaaaagggaatgtggattacacgaagggtaa

SEQ ID NO: 6560 - protein, 295 aa, Escherichia coli
MKASATLRCVRASFARCSIRRAICGINHQPGLVGLIRCVSVASGKANSEELMSKLDLNALNELPKVDRILALAETNAQLEKLDAEGRVAWALDNLPGEYVLSSSFGIQAAVSLHLVNQIRPDIPVILTDTGYLFPETYRFIDELTDKLKLNLKVYRATESAAWQEARYGKLWEQGVEGIEKYNDINKVEPMNRALKELNVQTWFAGLRREQSGSRANLPVLAIQRGVFKVLPIIDWDNRTIYQYLQKHGLKYHPLWDEGYLSVGDTHTTRKWEPGMAEEETRFFGLKRECGLHEG

SEQ ID NO: 6561 - DNA, 1686 bp, Escherichia coli
gtggtcgaaggaaaactgacagacgccgagcgcatgaagcttgaaagcaactacctgcgcggcaccattgcggaagatttaaacgacggtctgaccggcggctttaagggtgataacttcctgctgatccgcttccacggcatgtatcagcaggatgaccgcgacatccgcgccgaacgtgctgaacagaagctggaaccacgtcacgcgatgctgcttcgctgtcgtctgccgggtggggtgattaccactaaacagtggcaggcgatcgacaaatttgccggtgaaaacaccatctatggcagcattcgcctgaccaaccgccagacgtttcagttccacggcattctgaaaaagaacgtcaaaccggtgcaccagatgctgcactcggtcggtcttgatgcgctggcgaccgccaacgacatgaaccgtaacgtactctgcacctcgaacccttacgagtcgcagctgcacgcggaagcatatgaatgggcgaagaaaatttctgaacatctgctgcctcgtacccgcgcgtatgcggagatctggctcgatcaggaaaaagtcgccactactgatgaagagccgatccttggtcagacctacctgccgcgtaagttcaaaaccacggtagtgatcccgccgcagaacgatatcgatctgcacgccaacgacatgaacttcgtggcgatcgccgaaaacggcaagctggtgggctttaacctgctggtgggcggtgggctttccattgaacacggcaacaagaaaacctacgcccgcacggcgagtgagtttggttatttaccgctggaacatacgctggcggtagcggaagccgttgtgacgactcagcgcgactggggtaatcgtaccgatcgtaaaaatgccaaaaccaaatacacgctggagcgggtgggggttgagacatttaaagcggaagtcgaacgtcgcgcggggatcaaattcgagccgattcgcccgtatgagtttaccggacgcggcgatcgtattggctgggttaagggcattgatgataactggcacctgacgctgtttatcgaaaatggtcgcattcttgattatccgggacgtccgctgaaaaccggcttgctggagatcgcgaagatccacaaaggtgatttccgcattacggcgaaccagaatctgatcatcgccggcgtgccggaaagcgagaaagcgaagatcgagaagatcgccaaagaaagcgggttaatgaatgccgtcacgccgcagcgtgaaaactcaatggcctgcgtgtcattcccgacttgcccgctggcgatggcggaagcggagcgtttcctgccgtcttttatcgacaacatcgataatttaatggcgaaacatggtgtcagcgatgagcatatcgtgatgcgtgtaacaggctgcccgaacggttgtggtcgcgcgatgctggcggaagtgggtctggtggggaaagcgccgggtcgctacaacctgcatcttggcggcaaccgcattgggacacgtatcccacggatgtataaagaaaacatcaccgagccggaaatcctggcgtcgcttgatgaactgatagggcgctgggcgaaagagcgcgaagtgggtgaaggcttcggcgactttacggtgcgtgcgggcatcattcgcccggtgctcgatccggcgcgcgatttgtgggattaa

SEQ ID NO: 6562 - protein, 561 aa, Escherichia coli
MVEGKLTDAERMKLESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPGRPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREVGEGFGDFTVRAGIIRPVLDPARDLWD

SEQ ID NO: 6563 - DNA, 1800 bp, Escherichia coli
atgacgacacaggtcccaccttccgcgttgcttccgttgaacccggagcaactggcacgccttcaggcggccacgaccgatttaactcctacccagcttgcctgggtttctggctatttctggggcgtgctcaaccagcagcctgctgcgcttgcagcgacgccagcgcccgccgcagaaatgccgggtataactattatctccgcctcgcaaaccggcaatgcgcgccgggttgctgaagcattacgcgatgatttattagcggtaaaactgaacgttaagctggtgaacgcgggtgactataaattcaaacaaatcgccagcgaaaaactgcttatcgtggtgacgtcaacgcaaggggaaggggaaccgccggaagaagccgtcgcgctgcataagttcctgttctccaaaaaagcgccaaagctggaaaacaccgcgtttgccgtgtttagcctcggcgatagctcttatgaatttttctgccagtccgggaaagattttgacagtaagctggcggaactgggcggtgaacgcctgctcgaccgtgtcgatgccgacgttgaataccaggctgctgccagcgagtggcgcgcccgcgtggttgatgcgcttaaatcgcgtgcgcctgtcgcggcaccttcgcaatccgtcgctactggcacggtaaatgaaatccacaccagcccgtatagcaaagacgcgccgctggcggccagcctttcggttaaccagaaaattaccgggcgtaactctgaaaaagacgttcgtcacattgaaattgacttaggtgactctggcctgcgttaccagccgggtgacgcgttgggcgtctggtatcagaacgatccggcactggtgaaagaacttgtcgaactgctgtggctgaaaggcgatgaacctgtcaccgtcgagggcaaaacgttgcctctgaacgaagcgctacagtggcacttcgaactgaccgtcaacaccgccaacattgttgagaactatgccacgcttacccgcagcgaaacgctgctgccgctggtgggcgataaagcgaagttacagcattacgccgcgacgacgccgattgtcgacatggtgcgtttctctccggcgcaactggatgccgaagcgctgattaatctgctgcgcccgctgaccccgcgcctgtattccatcgcctcctcgcaggcggaagtcgagaacgaagtgcacgttaccgttggtgtggtgcgttacgacgtggaaggccgcgcccgtgccggtggtgcctccagcttcctcgcggatcgtgtggaagaagagggtgaagtccgcgtctttatcgaacataacgacaacttccgcctgccaaccaatccggaaaccccggtgatcatgattggccctggcaccggcatcgcgccgttccgtgcctttatgcagcagcgtgctgccgacgaagcgccgggtaaaaactggctattctttggcaacccacactttacggaagatttcctctaccaggtggaatggcagcgttacgtcaaagaaggcgtgctgacgcgcatcgatctcgcctggtcgcgcgatcaaaaagaaaaaatttacgtacaagacaaactgcgcgaacagggcgcagagctgtggcgctggatcaatgacggtgcccacatttatgtctgcggcgacgctaatcgcatggcgaaagacgttgagcaggcacttctggaagtgattgccgaatttggtggcatggacaccgaagcggcggatgaatttttaagtgagctgcgcgtagagcgccgttatcagcgagatgtctactaa

SEQ ID NO: 6564 - protein, 599 aa, Escherichia coli
MTTQVPPSALLPLNPEQLARLQAATTDLTPTQLAWVSGYFWGVLNQQPAALAATPAPAAEMPGITIISASQTGNARRVAEALRDDLLAVKLNVKLVNAGDYKFKQIASEKLLIVVTSTQGEGEPPEEAVALHKFLFSKKAPKLENTAFAVFSLGDSSYEFFCQSGKDFDSKLAELGGERLLDRVDADVEYQAAASEWRARVVDALKSRAPVAAPSQSVATGTVNEIHTSPYSKDAPLAASLSVNQKITGRNSEKDVRHIEIDLGDSGLRYQPGDALGVWYQNDPALVKELVELLWLKGDEPVTVEGKTLPLNEALQWHFELTVNTANIVENYATLTRSETLLPLVGDKAKLQHYAATTPIVDMVRFSPAQLDAEALINLLRPLTPRLYSIASSQAEVENEVHVTVGVVRYDVEGRARAGGASSFLADRVEEEGEVRVFIEHNDNFRLPTNPETPVIMIGPGTGIAPFRAFMQQRAADEAPGKNWLFFGNPHFTEDFLYQVEWQRYVKEGVLTRIDLAWSRDQKEKIYVQDKLREQGAELWRWINDGAHIYVCGDANRMAKDVEQALLEVIAEFGGMDTEAADEFLSELRVERRYQRDVY

SEQ ID NO: 6565 - DNA, 450 bp, Escherichia coli
ttgcgcaacaaagtcgttttagataatgcgaaaaaacagcctttccggtactctacggcggttttatcgtcatgtagagaaattatgatgtccaccacgttatttaaagatttcaccttcgaagccgctcaccgcttgccgcacgtcccacaagggcataaatgtggtcgcctgcacgggcattcctttatggtgcgactggaaattaccggggaagtcgatccgcatacgggctggattatcgatttcgctgaactgaaagcggcgtttaaaccaacttatgagcgcctcgatcaccattatctcaatgatattcctggtctggaaaacccaaccagcgaagttttagcaaaatggatttgggatcaggttaaacccgttgtgccgctgttaagtgcggtgatggtaaaagaaacctgcaccgcaggttgtatctatcgcggcgaatga

SEQ ID NO: 6566 - protein, 149 aa, Escherichia coli
MRNKVVLDNAKKQPFRYSTAVLSSCREIMMSTTLFKDFTFEAAHRLPHVPQGHKCGRLHGHSFMVRLEITGEVDPHTGWIIDFAELKAAFKPTYERLDHHYLNDIPGLENPTSEVLAKWIWDQVKPVVPLLSAVMVKETCTAGCIYRGE

SEQ ID NO: 6567 - DNA, 1272 bp, Escherichia coli
atggaagacgactgcgacattattattattggtgccggtattgctggcaccgcttgcgcgttacgctgcgcgcgagcgggtttatccgttctgttactggaacgagcggagattcccggcagcaaaaatctttccggcgggcggctatacacccatgcgctcgcggaactcctcccgcaatttcacctgaccgcgccccttgaacgacgcatcactcacgaaagtctttctctgttaacgccagatggcgcaacgacgttttccagcttacagcccggcggtgaatcctggagtgtattacgtgcacgattcgatccgtggctggttgccgaagccgaaaaagaaggtgtcgaatgcatccccggtgcgacggtagatgcactgtatgaagaaaacggcagggtgtgtggtgtcatttgtggtgacgatattcttcgcgcccgttatgtggtgctggcagaaggtgccaacagcgtcctcgcggaacgccacgggttagtgactcgtcctgctggcgaagcgatggcattggggatcaaagaagtgctgacgctggaaccatccgctattgaagaacgttttcatctggagaataacgaaggcgcagcgttgttgttcagcggcgggatctgtgatgacttacccggcggcgcatttctttatactaatcaacaaacgctctcgttagggattgtttgcccgctctcctcccttacgcaaagtcgtgttccggcaagcgagctgctggctcgctttaaaacgcatccggcagtgcgcccgcttatcaaaaacacggaatcactggagtatggtgcgcatctggtgccagaaggtggcctgcgcagtatgccggtgcaatacgccggtaacggctggctgctggtgggcgatgcgttgcgcagttgcgtcaataccggaatttccgtgcgcggtatggatatggcgctaactggcgcgcaggcggcggcacaaacgctgataagcgcctgccagcaccgcgagccgcaaaatctgtttccgctttatcatcacaacgtagagcgcagcctgctgtgggatgttctacagcgttatcagcatgttccggcgcttttgcaacgccctggctggtatcgggtgtggtctgggttaatgcaggatatttcccgtgatttatgggatcaggggaatacacctgttccaccgctgcgccagttgctctggcgtcatttacgtcgtcacggcttgtggcatctgacgggcgatgttatcaagagtctgcgatgtctgtag

SEQ ID NO: 6568 - protein, 423 aa, Escherichia coli
MEDDCDIIIIGAGIAGTACALRCARAGLSVLLLERAEIPGSKNLSGGRLYTHALAELLPQFHLTAPLERRITHESLSLLTPDGATTFSSLQPGGESWSVLRARFDPWLVAEAEKEGVECIPGATVDALYEENGRVCGVICGDDILRARYVVLAEGANSVLAERHGLVTRPAGEAMALGIKEVLTLEPSAIEERFHLENNEGAALLFSGGICDDLPGGAFLYTNQQTLSLGIVCPLSSLTQSRVPASELLARFKTHPAVRPLIKNTESLEYGAHLVPEGGLRSMPVQYAGNGWLLVGDALRSCVNTGISVRGMDMALTGAQAAAQTLISACQHREPQNLFPLYHHNVERSLLWDVLQRYQHVPALLQRPGWYRVWSGLMQDISRDLWDQGNTPVPPLRQLLWRHLRRHGLWHLTGDVIKSLRCL

SEQ ID NO: 6569 - DNA, 261 bp, Escherichia coli
atgtctgtagcccgtaatctctggcgcgctgccgatgcgccgcacattgttccagctgactccgttgagcgccagacggcacaacggttgattaacgcctgtccagcaggtcttttttcgctcacacctgaaggtggcttacgtgttgattatcacggctgcctggagtgtggcacctgccgtttgctgtgcgacgaatcaacactacaacagtggcgctatccgccttccggattcggcatcacctaccgctttggataa

SEQ ID NO: 6570 - protein, 86 aa, Escherichia coli
MSVARNLWRAADAPHIVPADSVERQTAQRLINACPAGLFSLTPEGGLRVDYHGCLECGTCRLLCDESTLQQWRYPPSGFGITYRFG

SEQ ID NO: 6571 - DNA, 576 bp, Escherichia coli
atgcccctcttacacctgctccgccagaatccggtgattgctgccgttaaagataatgccagcctgcaactggcaatcgactctgaatgccagtttatttccgtgttgtacggcaatatctgcaccattagtaatatcgttaaaaagattaagaacgccgggaaatatgcttttattcatgttgatttgctggaaggcgcgtcaaataaagaagtggtgattcagtttttgaaactggtaaccgaggcggacggaattatcagtaccaaagcctcaatgctgaaagcagcaagagcggaaggttttttctgtattcatcgactgtttattgttgattcgatttcgtttcacaacattgataagcaagttgcgcaatcgaatccggattgtattgagatcctgccaggctgcatgcctaaagtgctgggctgggtgacggagaaaatccgccaaccgctgattgctggcgggctggtgtgcgatgaagaagatgcgcgtaatgcgattaacgcgggtgttgtggcgctttccaccacgaatactggggtctggacgttagcgaaaaaattgctttga

SEQ ID NO: 6572 - protein, 191 aa, Escherichia coli
MPLLHLLRQNPVIAAVKDNASLQLAIDSECQFISVLYGNICTISNIVKKIKNAGKYAFIHVDLLEGASNKEVVIQFLKLVTEADGIISTKASMLKAARAEGFFCIHRLFIVDSISFHNIDKQVAQSNPDCIEILPGCMPKVLGWVTEKIRQPLIAGGLVCDEEDARNAINAGVVALSTTNTGVWTLAKKLL

SEQ ID NO: 6573 - DNA, 861 bp, Escherichia coli
atgaatatcgcaattgtgacaataaatcaggaacatgccgcaatggcgggctggctggcggcgcaggatttcagcggcagcacactaacgcattggcaaatagaaccacagccgatggttgcggaacaggtgctggatgcgctggtggaacagtggcaacgaacgcctgcggaggttgtcctttttcctccgggcgcgtttggcgatgaactgtcgacccggctggcctggcgtttacatggtgcaagcatctgccaggtgacttcgttagatattccaaccgtaagcgtgcgcaaatcccactggggaaatgcgttgacggcgacgctgcaaacagaaaaacgcccgctatgcctttcgctggcacgtcaggcgggagcagataaaaacgccacgttgccctctgggatgcagcaactgaacattgttcccggcgcgcttccagactggcttatcagcgtcgaaaacctgaaaaatgttacccgtgacccattagctgaggccagacgggtgctggtggtggggcagggcggagaggcagataaccaggaaatcgctatgctggcagaaaagatgggagccgaagtgggctacagtcgggcacgagtgatgaacggtggcgttgatgccgaaaaagtgattggtatttccggacatctgctggcacctgaggtgtgtattgttgttggcgcttccggcgcagcagcgttaatggcgggcgtacgcaatagcaagtttgtggtggcgattaatcatgacgccagtgcagcggtattttcacaggcagatgttggcgtggttgatgactggaaagtggtgctggaggcactggtgacaaacattcacgcagattgccaataa

SEQ ID NO: 6574 - protein, 286 aa, Escherichia coli
MNIAIVTINQEHAAMAGWLAAQDFSGSTLTHWQIEPQPMVAEQVLDALVEQWQRTPAEVVLFPPGAFGDELSTRLAWRLHGASICQVTSLDIPTVSVRKSHWGNALTATLQTEKRPLCLSLARQAGADKNATLPSGMQQLNIVPGALPDWLISVENLKNVTRDPLAEARRVLVVGQGGEADNQEIAMLAEKMGAEVGYSRARVMNGGVDAEKVIGISGHLLAPEVCIVVGASGAAALMAGVRNSKFVVAINHDASAAVFSQADVGVVDDWKVVLEALVTNIHADCQ

SEQ ID NO: 6575 - DNA, 780 bp, Escherichia coli
atgaacatactgttagcgtttaaagccgaaccggatgccgggatgctggcggaaaaagagtggctggcggcggctcagggtaatatcggaccggatgtttcgcttctgcgaagtttactcggtgccgatgaacaggctgccgccgcgctgctgttggcgcagagaaaaaacggtacgccgatgtctttaaccgcgttgagcatgggggatgaacgggcgttgcactggctgcgctatctcatggcacttgggtttgaggaagctgtattgctggagacggcggcagatctgcgctttgcgccggaatttgtcgctctccatattgccgaatggcagtaccagaatccgctggatctgataattactggctgccaaagcagcgaagggcagaatgggcaaacgccatttttgctggcggaaatgctggtctggccctgcttcacccaggtggagcgctttactctcgacgcaccgtttatcaccctcgaacagcgtactgaacatggggtgcgctgttgccgggttcgcttgcctgcggtgattgccgtgcgtcagtgtggtgaagtggccttgccagtaccgggaatgcgccagcgaatggcggcggggaaagcggagattacccgcgaaactgttgccgcggaagcgccagcgatacagtgcctgcaactggcaaggccagagcaacgacgcagagcggcgctgattgatgggcaaacggttgcagaaaaagcgcaaaagctatggcaggactatttacgccaaaggatgcagccatga

SEQ ID NO: 6576 - protein, 259 aa, Escherichia coli
MNILLAFKAEPDAGMLAEKEWLAAAQGNIGPDVSLLRSLLGADEQAAAALLLAQRKNGTPMSLTALSMGDERALHWLRYLMALGFEEAVLLETAADLRFAPEFVALHIAEWQYQNPLDLIITGCQSSEGQNGQTPFLLAEMLVWPCFTQVERFTLDAPFITLEQRTEHGVRCCRVRLPAVIAVRQCGEVALPVPGMRQRMAAGKAEITRETVAAEAPAIQCLQLARPEQRRRAALIDGQTVAEKAQKLWQDYLRQRMQP

SEQ ID NO: 6577 - DNA, 1338 bp, Escherichia coli
atgaacacttcaccggtgcgaatggatgatttaccgcttaaccgttttcactgtcgaattgctgcgctcactttcggcgcacacctgaccgacggttatgtcctcggcgttattggttacgccattattcagcttacgcccgccatgcaactgacgccgtttatggcggggatgatcggcggctcggcgttacttggtttgtttcttggcagcctggttttggggtggatctccgaccatatcggacggcaaaaaatcttcaccttcagttttatgctgattacgctcgcttcgttcttgcaattttttgccaccacgccagagcatcttattggattgcgcattttgatcggcattggtctgggaggcgattactcagtaggtcacactttgctggctgaattttctccgcgccgccatcgcggtgttttgctgggcgcgttcagcgtggtgtggaccgtaggctatgtgttggcaagtattgccggacatcactttattagcgaaagcccggaggcctggcgctggctgctggcatcggcagctctgcccgcgttgttgattacgttattacgctggggaacgccagaatcgccacgctggctactgcgccaggggcgttttgcagaagctcacgctatcgtgcatcgctactttggtccccatgttttactgggcgatgaagtggcaacggcgacccataaacacatcaaaaccttgttctcttcgcgctactggcggcgcacggcgtttaacagcgtcttctttgtctgcctcgtaatcccatggtttgtgatttatacctggctgccgaccatcgcccaaactattggtctggaagatgcgctgactgccagcctgatgcttaatgcgttgttaattgttggcgcgttattagggttagtgttgacccacttgttagcgcatcgcagatttttactgggaagttttttgctgctaacggcaacgctggtagtaatggcctgtttgccttccggcagttcattaacgctgctgctttttgttctcttcagcaccaccatttcggcagtcagtaatctggtgggcattttgcctgcggaaagttttcctactgacattcgctcgctgggcgtcggttttgccaccgccatgagtcggttgggggcggcggtaagtactggcctgctgccgtgggtgctggcacagtggggaatgcaagccaccttattgctcctggcggcagtgttgttggttggttttgttgtgacctggctatgggcaccagaaaccaaagcactcccgctggtggcggcgggaaatgcaggaggtgcgaatgaacatactgttagcgtttaa

SEQ ID NO: 6578 - protein, 445 aa, Escherichia coli
MNTSPVRMDDLPLNRFHCRIAALTFGAHLTDGYVLGVIGYAIIQLTPAMQLTPFMAGMIGGSALLGLFLGSLVLGWISDHIGRQKIFTFSFMLITLASFLQFFATTPEHLIGLRILIGIGLGGDYSVGHTLLAEFSPRRHRGVLLGAFSVVWTVGYVLASIAGHHFISESPEAWRWLLASAALPALLITLLRWGTPESPRWLLRQGRFAEAHAIVHRYFGPHVLLGDEVATATHKHIKTLFSSRYWRRTAFNSVFFVCLVIPWFVIYTWLPTIAQTIGLEDALTASLMLNALLIVGALLGLVLTHLLAHRRFLLGSFLLLTATLVVMACLPSGSSLTLLLFVLFSTTISAVSNLVGILPAESFPTDIRSLGVGFATAMSRLGAAVSTGLLPWVLAQWGMQATLLLLAAVLLVGFVVTWLWAPETKALPLVAAGNAGGANEHTVSV

SEQ ID NO: 6579 - DNA, 1455 bp, Escherichia coli
atgtctttatctcgcgcagcgattgtcgaccagctaaaggaaattgttggtgcagatcgcgtaattaccgatgaaacagtattaaagaaaaacagtattgaccgttttcgtaaatttccggatattcatggcatttatactttgccgattccggcagcggtcgtaaaactcggttccacagaacaagtatcccgtgtgctgaattttatgaatgcgcacaaaattaatggtgtgccgcgtaccggtgcttccgctaccgaaggtgggctggaaaccgttgtggaaaactcggtggtgctcgacggctccgccatgaatcaaatcattaatattgatattgagaatatgcaggccacggcgcaatgtggcgttccgctggaggtgctggaaaacgcgttgcgtgaaaaaggttacaccacggggcattctccgcagtcaaagccgctggcgcagatgggcggcctggtggcgacccgcagtatcgggcagttttccacactctacggcgcaatcgaggatatggtcgttggtctggaagcggtgctggcagatggcaccgtcacacgcattaaaaacgtgccacgtcgcgcggctggcccggacattcgtcatatcatcatcggcaacgaaggtgcactgtgctatatcactgaagtcacagtgaaaatcttcaaatttacgccggaaaacaatctcttctatggctatgtgctggaagacatgaaaaccggcttcaacatcctgcgtgaaatcatggtggaagggtatcgtccgtcgattgctcgtttgtatgatgctgaagatggcacccaacacttcacccattttgccgacggcaaatgcgtgctgatctttatggctgaaggtaaccctcgcattgcgaaggcgacgggtgaagggattgctgaaatcgtggcgcgctacccgcagtgccagcgcgtggacagcaagctgatcgaaacctggtttaacaacctgaactggggaccggataaagtggctgccgaacgtgtgcagatcctcaaaaccggcaacatgggctttaccaccgaagtgtccggctgctggagctgcattcacgaaatctacgaaagcgttattaaccgtattcgtaccgagttcccgcacgccgacgacatcaccatgctgggcggtcactcctctcatagctatcagaacggcaccaacatgtacttcgtctacgactacaacgtcgttgactgtaagccggaagaggaaatcgacaagtaccacaatccgctcaacaaaatcatctgcgaagaaaccattcgtctcggcggttcgatggtgcaccaccacggtatcggtaaacatcgcgttcactggagcaaactggaacacggcagcgcgtgggcgttgctggaagggctgaaaaagcagttcgatcctaatggcattatgaacacgggtactatctatccgattgaaaaataa

SEQ ID NO: 6580 - protein, 484 aa, Escherichia coli
MSLSRAAIVDQLKEIVGADRVITDETVLKKNSIDRFRKFPDIHGIYTLPIPAAVVKLGSTEQVSRVLNFMNAHKINGVPRTGASATEGGLETVVENSVVLDGSAMNQIINIDIENMQATAQCGVPLEVLENALREKGYTTGHSPQSKPLAQMGGLVATRSIGQFSTLYGAIEDMVVGLEAVLADGTVTRIKNVPRRAAGPDIRHIIIGNEGALCYITEVTVKIFKFTPENNLFYGYVLEDMKTGFNILREIMVEGYRPSIARLYDAEDGTQHFTHFADGKCVLIFMAEGNPRIAKATGEGIAEIVARYPQCQRVDSKLIETWFNNLNWGPDKVAAERVQILKTGNMGFTTEVSGCWSCIHEIYESVINRIRTEFPHADDITMLGGHSSHSYQNGTNMYFVYDYNVVDCKPEEEIDKYHNPLNKIICEETIRLGGSMVHHHGIGKHRVHWSKLEHGSAWALLEGLKKQFDPNGIMNTGTIYPIEK

SEQ ID NO: 6581 - DNA, 786 bp, Escherichia coli
atgtcaatcgaatctctcaatgcgttctcaatggattttttctccctgaaaggtaaaacagcaattgttaccggcgggaatagcggattaggccaggcatttgccatggcgctggccaaggctggcgcaaatgtctttattccaagtttcgtcaaagataacggcgaaacaaaggaaatgattgaaaaacagggtgttgaagtggacttcatgcaggtggatatcaccgcagaaggcgcaccgcagaagattatcgctgcctgctgtgagcgtttcggtaccgtcgatattctggttaacaatgccggtatatgtaagctgaataaggtgctggacttcgggcgtgccgactgggatccgatgattgacgtgaaccttaccgccgcattcgagttaagctatgaagctgcaaaaattatgatcccgcagaaaagcggtaaaatcattaatatctgttcattgttctcttacttaggtggtcaatggtcaccggcttattctgccactaaacatgctcttgccggattcaccaaagcctattgcgatgaattaggtcaatataatattcaggtgaatggtatttccccgggatattacgctaccgatatcactctggcgacccgtagtaatccagaaactaaccagcgcgttcttgattatattccggcaaaccgttggggcgatactcaggatttaatgggcgcagccgtattcctcgcaagtccggcatcgaattatgtcaacggacatttattagtggttgatggcggttatttagtgcgctaa

SEQ ID NO: 6582 - protein, 261 aa, Escherichia coli
MSIESLNAFSMDFFSLKGKTAIVTGGNSGLGQAFAMALAKAGANVFIPSFVKDNGETKEMIEKQGVEVDFMQVDITAEGAPQKIIAACCERFGTVDILVNNAGICKLNKVLDFGRADWDPMIDVNLTAAFELSYEAAKIMIPQKSGKIINICSLFSYLGGQWSPAYSATKHALAGFTKAYCDELGQYNIQVNGISPGYYATDITLATRSNPETNQRVLDYIPANRWGDTQDLMGAAVFLASPASNYVNGHLLVVDGGYLVR

SEQ ID NO: 6583 - DNA, 1278 bp, Escherichia coli
atgcaacacaactcatatcgccgttggataaccctcgcgataattagttttagcggcggcgttagtttcgacctggcttatttacgttatatttatcaaattcccatggcaaaatttatgggattcagcaataccgagataggtttaataatgagtacctttggtattgcggccattattttctatgcccctagcggcgttattgccgataaattttcacaccgcaaaatgattacttccgcgatgatcattaccggattactgggcctgataatggcaacatatccaccactgtgggtaatgctctgtattcaggtcgcctttgcgataacgacgattttaatgctgtggtcggtgtcgattaaagccgcatcgttgctgggcgatcatagcgagcaagggaaaattatgggctggatggaagggctgcgcggcgtcggtgtaatgtcgctggcggtgtttaccatgtgggtcttttctcgctttgcaccggatgacagcgccagcctgaaaacggtcattattatctatagtgtggtttacattctgctgggcattttgtgttggttttttgttagcgataacaacaatctgcgcagtgccaataacgaagaaaaacagtcattccagcttagcgacatcctggccgttttgcgcatcagcaccacctggtattgcagcatggtgatttttggtgtcttcaccatctacgccattctgagttactccaccaactatctgaccgaaatgtacggcatgtcactggtggcagcgagctacatggggattgtgatcaacaaaatcttccgcgcgttatgcggcccacttggcggcattatcaccacctacagcaaagtgaaatcccctacccgcgtggtccaaatcctttccatcatcggtttgctggcattgacagccctgctcgttacgaactctaacccgcaatcggtcgcgatggggattggcttgattttattactgggattcacctgttacgcctcacgcgggctgtattgggcctgccctggcgaagcgagaacaccgtcttacattatgggcaccacggtaggtatttgttcggtgattggattcctgccggatgtcttcgtttacccgattatcggctactggcaagacaccctgcccgctgcagaagcctaccgcaacatgtggctaatgggcatggcggcgcttggcatggtgatcatctttacctttttgctgttccaaaaaattcgtactgctgatagcgcccccgcaatggctagcagcaagtaa

SEQ ID NO: 6584 - protein, 425 aa, Escherichia coli
MQHNSYRRWITLAIISFSGGVSFDLAYLRYIYQIPMAKFMGFSNTEIGLIMSTFGIAAIIFYAPSGVIADKFSHRKMITSAMIITGLLGLIMATYPPLWVMLCIQVAFAITTILMLWSVSIKAASLLGDHSEQGKIMGWMEGLRGVGVMSLAVFTMWVFSRFAPDDSASLKTVIIIYSVVYILLGILCWFFVSDNNNLRSANNEEKQSFQLSDILAVLRISTTWYCSMVIFGVFTIYAILSYSTNYLTEMYGMSLVAASYMGIVINKIFRALCGPLGGIITTYSKVKSPTRVVQILSIIGLLALTALLVTNSNPQSVAMGIGLILLLGFTCYASRGLYWACPGEARTPSYIMGTTVGICSVIGFLPDVFVYPIIGYWQDTLPAAEAYRNMWLMGMAALGMVIIFTFLLFQKIRTADSAPAMASSK

SEQ ID NO: 6585 - DNA, 1479 bp, Escherichia coli
atgtcgaaaaaatacatcatagggattgatggcggaagtcagagcacaaaagtggtgatgtacgatctggaaggtaatgtggtttgcgaaggcaaaggcttattgcagccgatgcacacgccagatgccgataccgcagaacatcctgacgacgatttatgggcatcattatgctttgccggccacgatttgatgagccagtttgccgggaataaagaagatattgtcggcattggcctgggatccatccgttgctgccgtgcgttattgaaagccgatggcacgcctgctgcgccgttgattagctggcaggatgcacgcgtaacgcgtccctacgaacacactaatcctgacgtggcatatgtcacctctttttcgggttatctgacgcaccgtttaacgggcgaatttaaagataatatcgccaactattttggtcagtggccggtggattataagacctgggcatggagcgaagatgccgcggtaatggaaaagtttaatatcccccgccagatgctttttgacgtgcaaatgccgggcaccattcttgggcatatcacaccacaagctgcgctggcgacacatttcccggctgggctgccggttgtttgtaccaccagtgataaaccggtagaagctctgggagccgggttactggatgatgaaacggcggtaatttctcttggcacctatatcgcgttaatgatgaacggcaaagcactgccgaaagatccggtcgcgtactggccgattatgtcttctattccgcaaacattgctgtatgaaggttacggtattcgcaaaggcatgtggacggtgagctggctgcgcgacatgttaggcgagtcgttaattcaggatgccaaagcacaggatctttcaccggaagatttgctcaacaaaaaagcgtcttgcgtgccacctggttgtaatgggctgatgacggtgctggactggctgaccaatccgtgggaaccgtacaaacgcggaattatgatcggctttgattccagtatggattacgcatggatatatcgttcgatactggaaagcgtggcgctgacgctgaagaataattacgacaatatgtgtcatgaaatgaatcactttgcaaagcatgtgatcattactggcggcggttcgaacagcgatctgtttatgcagatttttgccgacgtgttcaaccttccggcacgccgtaacgccattaacggttgtgcaagtctgggggcagcgattaatacggcggtaggtctggggctatacccggattacgcaacggctgtcgacaaaatggttcgcgtgaaagatatctttatgcctgttgagaacaatgccaaacgctacgacgcgatgaataaaggcattttcaaggagttaaccaaacatactgatgtaatcctgaaaaaatcgtatgaagtgatgcatggggaattggggaatgcggattcgatccagagctggtcgaatgcgtaa

SEQ ID NO: 6586 - protein, 492 aa, Escherichia coli
MSKKYIIGIDGGSQSTKVVMYDLEGNVVCEGKGLLQPMHTPDADTAEHPDDDLWASLCFAGHDLMSQFAGNKEDIVGIGLGSIRCCRALLKADGTPAAPLISWQDARVTRPYEHTNPDVAYVTSFSGYLTHRLTGEFKDNIANYFGQWPVDYKTWAWSEDAAVMEKFNIPRQMLFDVQMPGTILGHITPQAALATHFPAGLPVVCTTSDKPVEALGAGLLDDETAVISLGTYIALMMNGKALPKDPVAYWPIMSSIPQTLLYEGYGIRKGMWTVSWLRDMLGESLIQDAKAQDLSPEDLLNKKASCVPPGCNGLMTVLDWLTNPWEPYKRGIMIGFDSSMDYAWIYRSILESVALTLKNNYDNMCHEMNHFAKHVIITGGGSNSDLFMQIFADVFNLPARRNAINGCASLGAAINTAVGLGLYPDYATAVDKMVRVKDIFMPVENNAKRYDAMNKGIFKELTKHTDVILKKSYEVMHGELGNADSIQSWSNA

SEQ ID NO: 6587 - DNA, 90 bp, Escherichia coli
  n 4, 5, 6, 7, 8: n is any nucleotide
atgnnnnntacgcgtttatgtatcgatacctgcattgcgcgcaactggcgtttgtcgatgcagacacataaatatttgaatattgcctga

SEQ ID NO: 6588 - protein, 29 aa, Escherichia coli
  Xaa 2, 3: Xaa is any amino acid
MXXTRLCIDTCIARNWRLSMQTHKYLNIA

SEQ ID NO: 6589 - DNA, 471 bp, Escherichia coli
  n 453, 454, 455, 456, 457: n is any nucleotide
atgcagtacccgattaacgagatgttccagaccctgcaaggtgagggttactttaccggcgtccccgccatttttattcgtttacagggatgtccggttggctgtgcctggtgcgacaccaaacacacctgggaaaagcttgaggatcgggaagtctcccttttcagcattctggcgaagaccaaagagagtgataagtggggggcggcgagcagtgaagatttgctggctgtcattggccgtcagggatacaccgcgcgtcacgtggtgattacgggtggtgagccttgcattcatgatttgctgccactgactgacctgctcgaaaagaacggttttagctgccagatcgaaaccagtggtactcatgaggtacgctgcacaccgaatacctgggttaccgtatcgccaaagctgaacatgcgcggcggctatgaagtattgtcgccaagnnnnncattcattcattaa

SEQ ID NO: 6590 - protein, 156 aa, Escherichia coli
  Xaa 151, 152, 153: Xaa is any amino acid
MQYPINEMFQTLQGEGYFTGVPAIFIRLQGCPVGCAWCDTKHTWEKLEDREVSLFSILAKTKESDKWGAASSEDLLAVIGRQGYTARHVVITGGEPCIHDLLPLTDLLEKNGFSCQIETSGTHEVRCTPNTWVTVSPKLNMRGGYEVLSPXXXFIH

SEQ ID NO: 6591 - DNA, 609 bp, Escherichia coli
atgtttagaatattcatcgcgtttatatttattttcaatttatcaggttgcggttataacgatattcaaacctatgatgaacaggttaatgcctcctggtcagaagtattaaatcaatatcaacgtcgcaccgatcttattcctaatcttgtcgctagtattaaaggttactccagccatgaacaagaggtactagaagccgtaacattggcacgtagtcaggctaatcgcgccagtagcgatcttcagaaaactccgggagatgaacaaaaattacaagcctggcaacaggcgcaggcgcaggcgcaggtgactcgcactctcgggcagttaacgattattagtgagcgttaccctcagttaaaggctcaagagctctatcaaaacttaatggtacagctcgaaggaagtgaaaatagaattgccgttgcgcgaggaagatatattaaagccattgaacaatataatgtcactatccgcaaattccccgctgtattaaccgcaaaggtcatggattacacaccaaagaaaaattatttgccggatgatgtcaccgcagtaagtaaagccccaacaatagattttagccagaatgctaatgctcattaa

SEQ ID NO: 6592 - protein, 202 aa, Escherichia coli
MFRIFIAFIFIFNLSGCGYNDIQTYDEQVNASWSEVLNQYQRRTDLIPNLVASIKGYSSHEQEVLEAVTLARSQANRASSDLQKTPGDEQKLQAWQQAQAQAQVTRTLGQLTIISERYPQLKAQELYQNLMVQLEGSENRIAVARGRYIKAIEQYNVTIRKFPAVLTAKVMDYTPKKNYLPDDVTAVSKAPTIDFSQNANAH

SEQ ID NO: 6593 - DNA, 894 bp, Escherichia coli
atgcgaaattttatcttccttatggctttcttctgttcatctgtgtttgctacacaaattccagtacctgaatcacccaggtatgtgaatgacttaaccggcacattaacaaacagcgaagtaaacaccctgaccaaccagattaaagccctgacgcaaaaaaaccacgcacagttggtcgtgttagtggttgatacaacaggcgatgaaaccattgagcagtacgcaacgcgggtattcgatagctggaaaccgggtgataaagaccgtgatgatggcgttctactgttagtcgcctggcaggatcataccgtgcgtattgaaatcggttacgggctggaaggtattattacggatgcacagtccgggaaaattattcgcaacagtattattccggcatttaaaaaaggcgacctggctggtggtttacaaaaggggatcaacgatattgaaagtcgcctgacggggaataattcagcaacgataacaccgaccgatcaccctttgtcctttagcggttggtgggctttattagtctgggcgataatactgacgtttatttctgccagaggatatatcaaaacgttgggagtaatttgcttcgcagccattgtactggcctttgttttacctatagcaggtttcagcggaagctggggagtactcacaacattactctgcttcgccacaccgtttctggcagttgccatcgcttttacccccttcggcaaaaaggttcgggattcgatgcgtgatgccaaccagccatcacgccatacaagaagcaattcttcctcccactattcatcatcgtcatcctcttcattcgacaatgacaattttagcggtggtggcggttcatctggtggcggtggcgcttccgggcgctggtaa

SEQ ID NO: 6594 - protein, 297 aa, Escherichia coli
MRNFIFLMAFFCSSVFATQIPVPESPRYVNDLTGTLTNSEVNTLTNQIKALTQKNHAQLVVLVVDTTGDETIEQYATRVFDSWKPGDKDRDDGVLLLVAWQDHTVRIEIGYGLEGIITDAQSGKIIRNSIIPAFKKGDLAGGLQKGINDIESRLTGNNSATITPTDHPLSFSGWWALLVWAIILTFISARGYIKTLGVICFAAIVLAFVLPIAGFSGSWGVLTTLLCFATPFLAVAIAFTPFGKKVRDSMRDANQPSRHTRSNSSSHYSSSSSSSFDNDNFSGGGGSSGGGGASGRW

SEQ ID NO: 6595 - DNA, 168 bp, Escherichia coli
atgccttgcctggacagtgctgatgatcgttgccatcattgtcctctggcgatttaccagccgtccaggacctggcatatggatgatatcaatgattacacctacggtctggtttttctgctttcaggacgatgtcatcattcggcgggtgtcggtcgtttgttttag

SEQ ID NO: 6596 - protein, 55 aa, Escherichia coli
MPCLDSADDRCHHCPLAIYQPSRTWHMDDINDYTYGLVFLLSGRCHHSAGVGRLF

SEQ ID NO: 6597 - DNA, 1149 bp, Escherichia coli
atgcgtatttttctcttacttctgatgctatgcggttttcaggtattcgctgaacgattgccttcagtgactgacttaaccgggacattaacgacagaagaacaaagtgctttaaatcaacaattacagactctcgagcagcaaaaccacttccaggtggccgtgttggttacgccgacaacagggggcaaaaacattaaacttgcagcctcgcagagatacggggtatatcactggaaacccgttggagagaagcgatatggcgaaggtatcttaattctcgtcgtttggccggaagggctggcgtcaatgaagattggacatggactggaacagatgttgccgccggaacaagctgcgcaaattgttcgttaccatatgcagccagaattcgaaaaaaacaatctctttgctggattaacgggcggaattgaaagcatcgcacagtttacccatatcaaagcgaaccttagccctttggatgctttagccaatcatctgtttgctaatccgcaactttcgctgccatgccttgcctggacagtgctgatgatcgttgccatcattgtcctctggcgatttaccagccgtccaggacctggcatatggatgatatcaatgattacacctacggtctggtttttctgctttcaggacgatgtcatcattcggcgggtgtcggtcgtttgttttagtttatttttcgcagcaatctgctggcagcgtctcgcagtagtttttaatatgtgccgcgtatttcctatgatgctggccccaaaaaataaaaacgcgaaagtgaaaaaacaaaagaagactccgcaagttcgtgaatcaggacgaaattcattgtttgtcgtgatgctgataattattgtgggatggtgcctggtgttcgccagtaataaagatattgcattcatctcaacaattattgggttaattgatcattttatcggcccaataaccattgctggcatcgttctgctgatcattgtggccaaatttactggcaatcttaagctggggtcaggagaaaaaagcaacaggaaaacggggaatcgtaatgctcattctcgctcttcgtcgagaaattctttccgcggtggtggcggttcttcaggaggcggcggttcatccggccgttggtga

SEQ ID NO: 6598 - protein, 382 aa, Escherichia coli
MRIFLLLLMLCGFQVFAERLPSVTDLTGTLTTEEQSALNQQLQTLEQQNHFQVAVLVTPTTGGKNIKLAASQRYGVYHWKPVGEKRYGEGILILVVWPEGLASMKIGHGLEQMLPPEQAAQIVRYHMQPEFEKNNLFAGLTGGIESIAQFTHIKANLSPLDALANHLFANPQLSLPCLAWTVLMIVAIIVLWRFTSRPGPGIWMISMITPTVWFFCFQDDVIIRRVSVVCFSLFFAAICWQRLAVVFNMCRVFPMMLAPKNKNAKVKKQKKTPQVRESGRNSLFVVMLIIIVGWCLVFASNKDIAFISTIIGLIDHFIGPITIAGIVLLIIVAKFTGNLKLGSGEKSNRKTGNRNAHSRSSSRNSFRGGGGSSGGGGSSGRW

SEQ ID NO: 6599 - DNA, 894 bp, Escherichia coli
atgcgcttaatctttattctattcactttgtggtgccttcctgggcttgcccagcaaattgctgtgccggaactgcgccaacaggtgaccgatattactggtacgttaagcacttctgaacaacaatcactgacacagcaactgcaggatattacacataaaacacgggcgcaggtcgctgtattagtagtgccgtccaccggagacgattccattgaacaatatgctacaagggtttttgatagctggaaactgggagataagcagagaaacgatggtattttacttctggttgcctgggaggatcatgctgttcgtattgaggttggctacgggctggaaggggtggttaccgacctgcaagcggcgaagattatcagggatatattgatccctgccttcaaaagtgatgacctgatgggtggattaacactggcaagcgaaaatatcggcgcgcttctgttgaatggtgaattaccggaagacaggggggattattacagtatcaatccccctattccattatcgcttgctgtaattatattgctggcggtactttcatattttattgtttttaccgatccgtcgaatttaccctggatcactctcactggcgccatttacgggatggtattcctctatgttgccgagccaggaccatggaccaatttaatcgttgcctgcggtatgttaacgccttttgcgatcgtaccactggttgttttttggcttatcgtcaataaaaagctacgcgccaaatacaaaaaactcagtaaagaaagagcttcaagaaaaggttcttcttcatcctcttccggtggaggctcaagtggcggcggatttagcggcgggggcggttcttctggcggtggcggcgcgtccggtcgctggtaa

SEQ ID NO: 6600 - protein, 297 aa, Escherichia coli
MRLIFILFTLWCLPGLAQQIAVPELRQQVTDITGTLSTSEQQSLTQQLQDITHKTRAQVAVLVVPSTGDDSIEQYATRVFDSWKLGDKQRNDGILLLVAWEDHAVRIEVGYGLEGVVTDLQAAKIIRDILIPAFKSDDLMGGLTLASENIGALLLNGELPEDRGDYYSINPPIPLSLAVIILLAVLSYFIVFTDPSNLPWITLTGAIYGMVFLYVAEPGPWTNLIVACGMLTPFAIVPLVVFWLIVNKKLRAKYKKLSKERASRKGSSSSSSGGGSSGGGFSGGGGSSGGGGASGRW

SEQ ID NO: 6601 - DNA, 1299 bp, Escherichia coli
atgtccaaaatcgtaaaaatcatcggtcgtgaaatcatcgactcccgtggtaacccgactgttgaagccgaagtacatctggagggtggtttcgtcggtatggcagctgctccgtcaggtgcttctactggttcccgtgaagctctggaactgcgcgatggcgacaaatcccgtttcctgggtaaaggcgtaaccaaagctgttgctgcggtaaacggcccgatcgctcaggcgctgattggcaaagatgctaaagatcaggctggcattgacaagatcatgatcgacctggacggcaccgaaaacaaatccaaattcggcgcgaacgcaatcctggctgtatctctggctaacgccaaagctgctgcagctgctaaaggtatgccgctgtacgagcacatcgctgaactgaacggcactccgggcaaatactctatgccggttccgatgatgaacatcatcaacggtggtgagcacgctgacaacaacgttgatatccaggaattcatgattcagccggttggcgcgaaaactgtgaaagaagccatccgtatgggttctgaagttttccatcacctggcaaaagttctgaaagcgaaaggcatgaacactgctgttggtgacgaaggtggctatgcgccgaacctgggttccaacgctgaagctctggctgttatcgctgaagctgttaaagctgctggttatgagctgggcaaagacatcactctggcgatggactgcgcagcttctgaattctacaaagacggtaaatacgttctggctggcgaaggcaacaaagcgttcacctctgaagaattcactcacttcctggaagaactgaccaaacagtatccgatcgtttccatcgaagacggtctggacgaatctgactgggatggtttcgcataccagaccaaagttctgggcgacaaaatccagctggttggtgacgacctgttcgtaaccaacaccaagatcctgaaagaaggtatcgaaaaaggtatcgctaactccatcctgatcaaattcaaccagatcggttctctgaccgaaactctggctgcaatcaagatggcgaaagacgctggctacactgcagttatctctcaccgttcaggcgaaactgaagacgctaccatcgctgacctggctgttggtactgctgcaggccagatcaaaactggttctatgagccgttctgaccgtgttgctaaatacaaccagctgattcgtatcgaagaagctctgggcgaaaaagcaccgtacaacggtcgtaaagagatcaaaggccaggcataa

SEQ ID NO: 6602 - protein, 432 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 6603 - DNA, 1638 bp, Escherichia coli
atgacaacgaactatatttttgtgaccggcggggtcgtatcctctctgggtaaaggcattgccgcagcctccctcgcagccattcttgaagcccgtggcctcaatgtgaccatcatgaaactggatccgtacatcaacgtcgatccaggtactatgagcccaatccaacacggggaagtgttcgttactgaagacggcgctgaaaccgacctggacctggggcactacgagcgtttcattcgtaccaaaatgagccgccgcaacaacttcaccacgggtcgtatctactctgacgttctgcgtaaagaacgccgcggtgactatctcggcgcaaccgtacaggttattccgcacatcactaacgctatcaaagagcgcgtgctggaaggcggcgaaggtcatgacgtagtactggtcgaaatcggcggtactgtaggtgatatcgaatccctgccgttcctcgaagcgattcgccagatggctgttgaaattggccgtgagcacaccctgtttatgcacctgacgctggtgccgtacatggcagcgtctggtgaagtcaaaaccaaaccgactcagcactctgtaaaagagctgctttcaatcggtatccagcctgatatcctgatttgtcgttcagatcgcgccgttccggcgaacgaacgtgcgaagattgcattgttctgtaatgttccggaaaaagcggttatttctctgaaagacgtcgattccatctataaaattccgggcctgttgaaatctcaggggctggacgattatatttgtaaacgattcagcttaaactgcccggaagcgaatctgtccgaatgggaacaggttatcttcgaagaagcgaatccggtaagtgaagtcaccattggtatggtcggcaaatacattgagctgccggatgcatacaaatccgtgatcgaagcactgaaacacggtgggctgaagaatcgtgtcagcgtcaacatcaaactgatcgattcacaagatgttgaaacgcgcggcgttgaaatccttaaaggtctggacgcaatcctcgtacctggcggtttcggctatcgtggcgtagaaggcatgattacgaccgcgcgttttgcgcgtgagaacaatattccttatctgggcatttgcctgggtatgcaggtggcgttaattgattacgctcgccatgttgccaacatggagaacgccaactcaacggaatttgtgccagactgtaagtacccggttgtggcgctgattaccgagtggcgcgatgaaaacggcaacgttgaagttcgtagcgagaagagcgatctcggcggtaccatgcgtctcggcgcacagcagtgccagttggttgacgatagcctggttcgccagctgtacaatgcgccgacaattgttgagcgtcatcgtcaccgttacgaagtcaacaacatgctgttgaaacagattgaagatgcaggtctgcgcgttgcgggccgttccggggatgatcagttggtcgagatcatcgaagttccgaatcatccgtggttcgtggcttgccagttccatccggagtttacttctactccacgtgatggtcacccgctgtttgcaggctttgtgaaagccgccagcgagttccagaaacgtcaggcgaagtaa

SEQ ID NO: 6604 - protein, 545 aa, Escherichia coli
MTTNYIFVTGGVVSSLGKGIAAASLAAILEARGLNVTIMKLDPYINVDPGTMSPIQHGEVFVTEDGAETDLDLGHYERFIRTKMSRRNNFTTGRIYSDVLRKERRGDYLGATVQVIPHITNAIKERVLEGGEGHDVVLVEIGGTVGDIESLPFLEAIRQMAVEIGREHTLFMHLTLVPYMAASGEVKTKPTQHSVKELLSIGIQPDILICRSDRAVPANERAKIALFCNVPEKAVISLKDVDSIYKIPGLLKSQGLDDYICKRFSLNCPEANLSEWEQVIFEEANPVSEVTIGMVGKYIELPDAYKSVIEALKHGGLKNRVSVNIKLIDSQDVETRGVEILKGLDAILVPGGFGYRGVEGMITTARFARENNIPYLGICLGMQVALIDYARHVANMENANSTEFVPDCKYPVVALITEWRDENGNVEVRSEKSDLGGTMRLGAQQCQLVDDSLVRQLYNAPTIVERHRHRYEVNNMLLKQIEDAGLRVAGRSGDDQLVEIIEVPNHPWFVACQFHPEFTSTPRDGHPLFAGFVKAASEFQKRQAK

SEQ ID NO: 6605 - DNA, 792 bp, Escherichia coli
atgaatcaaatcgaccgtttgctcaccatcatgcagcgcctgcgcgacccggaaaacggctgcccgtgggataaagagcagacatttgccaccattgcgccttacacccttgaagaaacctacgaggtgctggacgccatcgcccgtgaagattttgacgatctgcgcggtgaactgggcgatctgctgttccaggtggtgttttacgcacaaatggctcaggaagaagggcgctttgactttaatgatatttgcgctgctattagcgataaattagagcgtcgccatccgcatgtttttgctgacagttctgccgaaaatagtagtgaagtgcttgcccgttgggagcaaatcaaaaccgaagagcgcgcgcagaaagcgcagcattcggcgctggacgatattcctcgtagtttaccggctttaatgcgtgcgcaaaaaatccagaaacgttgcgccaacgttggtttcgactggacgacgcttggtccggtagtagataaagtctacgaagagatcgacgaggtgatgtacgaggcgcggcaggctgttgtcgaccaggctaaactggaggaggaaatgggtgacctgctgtttgccacggtcaatctggctcgtcatttagggacaaaagcggaaatcgcattgcaaaaagcgaacgaaaaattcgagcgtcgttttcgcgaagtggagcgtattgttgccgcgcgtggactggaaatgacaggtgttgacctcgaaacaatggaagaagtctggcaacaggtaaaacggcaggaaattgatctctaa

SEQ ID NO: 6606 - protein, 263 aa, Escherichia coli
MNQIDRLLTIMQRLRDPENGCPWDKEQTFATIAPYTLEETYEVLDAIAREDFDDLRGELGDLLFQVVFYAQMAQEEGRFDFNDICAAISDKLERRHPHVFADSSAENSSEVLARWEQIKTEERAQKAQHSALDDIPRSLPALMRAQKIQKRCANVGFDWTTLGPVVDKVYEEIDEVMYEARQAVVDQAKLEEEMGDLLFATVNLARHLGTKAEIALQKANEKFERRFREVERIVAARGLEMTGVDLETMEEVWQQVKRQEIDL

SEQ ID NO: 6607 - DNA, 336 bp, Escherichia coli
atggtaagccgatacgtacccgatacgggcgatctgatttgggttgattttgacccgacaaaaggtagcgagcaagccggacatcgtccggctgttgtcctgagtccgttcatgtacaacaacaaaacaggtatgtgtctgtgtgttccttgtacaacgcaatcaaaaggatatccgttcgaagttgttctatccggtcaggaacgtgatggcgtagcgttagctgatcaggtaaaaagtatcgcctggcgggcaagaggagcaacgaagaaaggaacagttgccccagaggaattacaactcattaaagccaaaattaacgtgctgattgggtag

SEQ ID NO: 6608 - protein, 111 aa, Escherichia coli
MVSRYVPDTGDLIWVDFDPTKGSEQAGHRPAVVLSPFMYNNKTGMCLCVPCTTQSKGYPFEVVLSGQERDGVALADQVKSIAWRARGATKKGTVAPEELQLIKAKINVLIG

SEQ ID NO: 6609 - DNA, 249 bp, Escherichia coli
atgatccacagtagcgtaaagcgttggggaaattcaccggcggtgcggatcccggctacgttaatgcaggcgctcaatctgaatattgatgatgaagtgaagattgacctggtggatggcaaattaattattgagccagtgcgtaaagagcccgtatttacgcttgctgaactggtcaacgacatcacgccggaaaacctccacgagaatatcgactggggggagccgaaagataaggaagtctggtaa

SEQ ID NO: 6610 - protein, 82 aa, Escherichia coli
MIHSSVKRWGNSPAVRIPATLMQALNLNIDDEVKIDLVDGKLIIEPVRKEPVFTLAELVNDITPENLHENIDWGEPKDKEVW

SEQ ID NO: 6611 - DNA, 2235 bp, Escherichia coli
atggttgcggtaagaagtgcacatatcaataaggctggtgaatttgatccggaaaaatggatcgcaagtctgggtattaccagccagaagtcgtgtgagtgcttagccgaaacctgggcgtattgtctgcaacagacgcaggggcatccggatgccagtctgttattgtggcgtggtgttgagatggtggagatcctctcgacattaagtatggacattgacacgctgcgggcggcgctgctgttccctctggctgatgccaacgtagtcagcgaagatgtgctgcgtgagagcgtcggtaagtcggtcgttaaccttattcacggcgtgcgtgatatggcggcgatccgccagctgaaagcgacgcacactgattctgtttcctccgaacaggtcgataacgttcgccggatgttattggcgatggtcgatgattttcgctgcgtggtcatcaaactggcggagcgtattgctcacctgcgcgaagtaaaagatgcgccggaagatgaacgcgtactggcggcaaaagagtgcaccaatatctacgcgccgttggcgaaccgtcttgggattgggcaactgaaatgggagctggaagattactgcttccgttatctccacccgaccgaatacaaacgcatcgcaaaactgctgcatgaacgccgtctcgaccgcgaacactatatcgaagagtttgtcggccatctgcgcgctgagatgaaagctgaaggcgttaaagctgaagtgtatggccgtccgaaacacatctacagtatctggcgcaaaatgcagaaaaagaacctcgccttcgatgagctgtttgatgtgcgtgcggtacgtattgtcgccgagcgtttacaggattgttatgccgcactggggatagtgcacactcactatcgccacctgccggatgagtttgacgattacgtcgctaacccgaaaccaaacggttatcagtccattcataccgtggttctggggccgggtggcaaaaccgttgagatccaaatccgcaccaaacagatgcatgaagatgcagagttgggtgttgctgcgcactggaaatataaagagggcgcggctgctggcggcgcacgttcgggacatgaagaccggattgcctggctgcgtaaactgattgcgtggcaggaagagatggctgattccggcgaaatgctcgacgaagtacgtagtcaggtctttgacgaccgagtgtacgtctttacgccgaaaggtgatgtcgttgatttgcctgcgggatcaacgccgctggacttcgcttaccacatccacagtgatgtcggacaccgctgcatcggggcaaaaattggcgggcgcattgtgccgttcacctaccagctgcagatgggcgaccagattgaaattatcacccagaaacagccgaaccccagccgtgactggttaaacccaaacctcggttacgtcacaaccagccgtgggcgttcgaaaattcacgcctggttccgtaaacaggaccgtgacaaaaacattctggctgggcggcaaattcttgacgacgagctggaacatctggggatcagcctgaaagaagcagaaaaacatctgctgccgcgttacaacttcaatgatgtcgacgagttgctggcggcgattggtggcggggatatccgtctcaatcagatggtgaacttcctgcaatcgcaatttaataagccgagtgccgaagagcaggacgccgccgcgctgaaacagcttcagcaaaaaagctacacgccgcaaaaccgcagtaaagataacggtcgtgtggtggtagaaggggtcggtaacctgatgcaccacatcgcgcgctgctgccagccgattcctggagatgagattgtcggcttcattacccaggggcgcggtatttcagtacaccgcgccgattgcgaacaattggcggaactgcgctcccatgcgccagaacgcattgttgacgcggtatggggcgagagctactccgccggatattcgctggtggtccgcgtggtggctaatgatcgtagtgggttgttacgtgatatcacgaccattctcgccaacgagaaggtgaacgtacttggcgttgccagccgtagcgacaccaaacagcaactggcgaccatcgacatgaccattgagatttacaacctgcaagtgctggggcgcgtgctgggtaaactcaaccaggtaccggatgttatcgacgcgcgtcggttgcacgggagttag

SEQ ID NO: 6612 - protein, 744 aa, Escherichia coli
MVAVRSAHINKAGEFDPEKWIASLGITSQKSCECLAETWAYCLQQTQGHPDASLLLWRGVEMVEILSTLSMDIDTLRAALLFPLADANVVSEDVLRESVGKSVVNLIHGVRDMAAIRQLKATHTDSVSSEQVDNVRRMLLAMVDDFRCVVIKLAERIAHLREVKDAPEDERVLAAKECTNIYAPLANRLGIGQLKWELEDYCFRYLHPTEYKRIAKLLHERRLDREHYIEEFVGHLRAEMKAEGVKAEVYGRPKHIYSIWRKMQKKNLAFDELFDVRAVRIVAERLQDCYAALGIVHTHYRHLPDEFDDYVANPKPNGYQSIHTVVLGPGGKTVEIQIRTKQMHEDAELGVAAHWKYKEGAAAGGARSGHEDRIAWLRKLIAWQEEMADSGEMLDEVRSQVFDDRVYVFTPKGDVVDLPAGSTPLDFAYHIHSDVGHRCIGAKIGGRIVPFTYQLQMGDQIEIITQKQPNPSRDWLNPNLGYVTTSRGRSKIHAWFRKQDRDKNILAGRQILDDELEHLGISLKEAEKHLLPRYNFNDVDELLAAIGGGDIRLNQMVNFLQSQFNKPSAEEQDAAALKQLQQKSYTPQNRSKDNGRVVVEGVGNLMHHIARCCQPIPGDEIVGFITQGRGISVHRADCEQLAELRSHAPERIVDAVWGESYSAGYSLVVRVVANDRSGLLRDITTILANEKVNVLGVASRSDTKQQLATIDMTIEIYNLQVLGRVLGKLNQVPDVIDARRLHGS

SEQ ID NO: 6613 - DNA, 1302 bp, Escherichia coli
atggcgcaattctactctgcaaaacgacgcacgacgacgcgtcagatcataaccgtttcagtcaacgacctcgactcttttggtcagggtgtggcgcgacataacggcaaaacattatttatccccggattattgccgcaggaaaacgcggaagttactgttactgaagataaaaaacagtatgcccgcgctaaagtcgtacgccgattaagcgatagcccggaacgcgaaacgccacgctgtcctcattttggcgtatgcggcggctgtcagcaacaacacgccagtgtggatttacagcagcgaagcaaaagtgcggcactcgcccgattaatgaaacacgaagtctctgaagtgatcgccgatgttccctggggctatcgccgtcgcgcgcgtttaagtctgaactacttaccgaaaacacagcaacttcagatggggtttcgcaaagcgggctccagtgacattgtcgacgttaaacaatgccccattttagtgccccaacttgaagcattgctgcccaaagtcagggcatgcctgggcagcttacaagctatgcgccatcttggtcatgttgaactggtacaggcaaccagcggcacgctaatgattttgcgccataccgcaccgctaagttcggcagatcgcgaaaaactggaatgcttttcgcattctgaaggcctggatctgtatctcgcccccgatagtgagatactcgaaaccgtctctggtgagatgccctggtatgactcaaatgggttgcgcttaacttttagcccgcgcgattttattcaggtcaatgcgggtgtgaaccagaaaatggtagcgcgtgcgttggaatggctggatgtggaacctgaagattgcgtactggatctgttctgcggtatgggcaactttacactgccattggcgacacaagctgccagtgtggtgggtgtagaaggtgttccggcgctggtggaaaaaggccagcagaatgcgcgtcttaatggcttacagaatgtgacgttttatcacgaaaatcttgaagaagatgtcacaaagcagccgtgggcgaaaaacggcttcgataaagtgttgctggacccggcgcgagcaggtgccgcaggtgttatgcagcaaattataaaactggaacctattcgtatagtttatgtatcctgtaaccctgcaacgctggctcgggatagcgaagcgttattaaaagcaggatataccattgcgcgactggcgatgctggatatgttcccacacacgggacatctggaatcgatggtacttttctcgcgcgttaaatag

SEQ ID NO: 6614 - protein, 433 aa, Escherichia coli
MAQFYSAKRRTTTRQIITVSVNDLDSFGQGVARHNGKTLFIPGLLPQENAEVTVTEDKKQYARAKVVRRLSDSPERETPRCPHFGVCGGCQQQHASVDLQQRSKSAALARLMKHEVSEVIADVPWGYRRRARLSLNYLPKTQQLQMGFRKAGSSDIVDVKQCPILVPQLEALLPKVRACLGSLQAMRHLGHVELVQATSGTLMILRHTAPLSSADREKLECFSHSEGLDLYLAPDSEILETVSGEMPWYDSNGLRLTFSPRDFIQVNAGVNQKMVARALEWLDVEPEDCVLDLFCGMGNFTLPLATQAASVVGVEGVPALVEKGQQNARLNGLQNVTFYHENLEEDVTKQPWAKNGFDKVLLDPARAGAAGVMQQIIKLEPIRIVYVSCNPATLARDSEALLKAGYTIARLAMLDMFPHTGHLESMVLFSRVK

SEQ ID NO: 6615 - DNA, 2757 bp, Escherichia coli
atgaccaactacagcctgcgcgcacgcatgatgattctgatcctggcaccgaccgtccttattggtttattgctgagtatctttttcgtcgtgcatcgctataacgacttgcagcgtcaactggaagatgccggtgccagcattattgagccgcttgcagtttctactgaatatggcatgagtctgcaaaatcgcgaatctatcggtcagttaataagcgtactgcatcgtcgccattctgatattgttcgcgcgatttcggtttatgatgaaaataaccgactctttgtcacctccaattttcatcttgatccctcatcaatgcagctcggcagcaacgtgccgtttcctcgccagctcactgtcactcgtgacggcgatataatgatcctccgcacgccgattatttctgaaagttactcccccgacgaatcgcccagtagcgatgccaaaaatagtcaaaatatgctgggatatattgcgctggagctggatcttaaatcggttcgcttgcagcaatataaagagatctttatttccagcgtgatgatgctgttttgtatcggtattgcgcttatttttggctggcgcttaatgcgcgatgtaaccggtccgattcgcaacatggtgaataccgtcgaccgcatccgtcgcgggcaactcgacagccgggtggaaggttttatgctcggcgaactggatatgctgaaaaacggtatcaactcgatggcaatgtcgctggcggcttatcacgaagagatgcaacacaatatcgaccaggcgacgtccgatctgcgtgagacgctggagcaaatggagattcagaacgttgagttggatctggcgaaaaagcgcgcccaggaagcggcgcgtattaaatccgagtttctggcaaatatgtcacacgagctgcgtacaccactgaatggtgttattggctttacccgcctgacgctgaaaacagaattaacaccaacgcagcgcgatcacctgaatacgattgaacgttcggcaaataatttgctggcaattattaatgatgttctcgacttctcgaaactggaagccggtaagctgattctggaaagtattccattcccactacgcagcacgctggatgaagtcgttaccctgctggcacattcttctcacgataaagggctggaactgacgctcaatattaaaagcgacgtgcctgataacgtgatcggcgacccactacgattacagcaaatcatcactaacctggtagggaatgcaattaaattcaccgagaatggcaacattgatattctggtagaaaaacgtgcgctgagtaataccaaagtgcaaattgaagtgcagattcgggataccggcattggtattcctgaacgcgatcaatcgcgcttattccaggccttcagacaggctgatgccagtatttcccgccgtcatggtggcaccgggctggggctggtgattacacaaaaactggttaatgaaatgggcggcgatatttcgttccatagcctgccgaatcgtggttcaactttctggttccacattaatctcgatctgaacccgaacattattatcgaagggccatccacccagtgcctcgctggtaagcgcctggcctatgtcgaaccaaactccgcagcagcacaatgcacgctggatattttaagtgaaacgccgctggaagtggtttatagcccaacgttctccgcgctgcctcccgcgcattacgacatgatgttattaggcatagcggtgaccttccgcgagccgctaacaatgcaacatgagcgattagcgaaagcagtatcgatgaccgatttcctgatgctggcacttccttgccatgcacaagtcaatgctgaaaaacttaagcaagatggtatcggcgcgtgtctgctgaaaccattaacacctacgcgcctgttgcctgccctgacggaattttgtcatcacaaacaaaacacgcttttgcctgtaaccgatgaaagtaagctggcaatgacagtcatggcggttgatgacaaccccgctaacctgaaacttatcggcgcattgctggaagatatggtgcaacatgtggaactttgcgatagcgggcatcaggcggttgaacgggcgaaacagatgccgttcgatttaatcttaatggatattcaaatgccggacatggacggcattcgggcatgtgagctcatccaccagctcccgcatcagcagcaaacgccggttatcgcggtaacggcgcatgcgatggccgggcaaaaagagaaactgcttggcgcggggatgagtgattatctggccaaaccgatcgaagaagagcgattgcataatttgctgttgcgctacaagcctggcagcggtatttcctctcgcgtcgtgacgcccgaagtcaacgaaattgtggtcaacccgaatgcgaccctcgactggcaactggcactacgccaggcagcaggaaaaaccgatttagcgcgcgatatgctgcaaatgttactcgatttcctgcctgaagttcgcaacaaagttgaggaacagctggttggagaaaacccggaaggcctggttgatttgattcataaactgcatggcagttgcggctatagcggtgtaccgcgtatgaagaatctctgccaactgatcgaacaacagctacgtagcggtactaaagaagaagatttagagccggagctgctggaactgttggacgagatggataatgtagcgcgcgaagccagcaaaattctcgggtaa

SEQ ID NO: 6616 - protein, 918 aa, Escherichia coli
MTNYSLRARMMILILAPTVLIGLLLSIFFVVHRYNDLQRQLEDAGASIIEPLAVSTEYGMSLQNRESIGQLISVLHRRHSDIVRAISVYDENNRLFVTSNFHLDPSSMQLGSNVPFPRQLTVTRDGDIMILRTPIISESYSPDESPSSDAKNSQNMLGYIALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSLPNRGSTFWFHINLDLNPNIIIEGPSTQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTPTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQQQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLVGENPEGLVDLIHKLHGSCGYSGVPRMKNLCQLIEQQLRSGTKEEDLEPELLELLDEMDNVAREASKILG

SEQ ID NO: 6617 - DNA, 117 bp, Escherichia coli
gtgcatggtgcgttaagacagaaaaccaaaaccggctctatctggagccggtttgagactgatgccaaacgcaaaattgcctgttgcgctacgtatcagggctacatcattttttaa

SEQ ID NO: 6618 - protein, 38 aa, Escherichia coli
MHGALRQKTKTGSIWSRFETDAKRKIACCATYQGYIIF

SEQ ID NO: 6619 - DNA, 1341 bp, Escherichia coli
atgagttctcaatttacgacgcctgttgttactgaaatgcaggtcatcccggtggcgggtcatgacagtatgctgatgaatctgagtggtgcacatgcaccgttcttcacgcgtaatattgtgattatcaaagataattccggtcacactggcgtaggggaaattcccggcggcgagaaaatccgtaaaacgctggaagatgcgattccgctggtggtgggtaaaacgctgggtgaatacaaaaacgttctgacgctggtgcgtaatacttttgccgatcgtgatgccggtgggcgcggtttgcagacatttgatttgcgtaccactattcatgtagttaccgggatagaagcggcaatgctggatctgctggggcagcatctgggggtaaacgtggcatcgctgctgggcgatggtcaacagcgtagcgaagtcgaaatgctcggttatctgttcttcgtcggcaatcgcaaagctacaccgctgccgtatcaaagccagccggatgactcatgcgactggtatcgcctgcgtcatgaagaagcgatgacgccggatgcggtggtgcgcctggcggaagcggcgtatgaaaaatatggcttcaacgatttcaaactgaaaggcggtgtactggccggggaagaagaagccgaatctattgtggcactggcgcaacgtttcccgcaggcgcgtattacgctcgatcctaacggtgcctggtcgctgaaagaagcgattaaaatcggtacatacctgaaaggttcgctggcttatgcagaagatccgtgtggtgcggagcaaggtttctccgggcgtgaagtgatggcagagttccgtcgcgcaactggcctgccgaccgcaaccaatatgatcgccaccgactggcggcagatgggccatacgctctcgttgcaatccgttgatatcccgcttgcggatccgcatttctggacgatgcaaggttcggtacgtgtggcgcaaatgtgtcatgaatttggcctgacctggggttcacactccaacaaccacttcgatatttccctggcgatgtttacccatgttgccgctgccgcaccgggtaaaatcaccgcgattgatacgcactggatctggcaggaaggtaatcagcgcctgaccaaagaaccgttagagatcaaaggcggtctggttcaggtgccagaaaaaccggggctgggtgtagaaatcgatatggatcaagtgatgaaagcgcacgagctgtatcagaaacacgggcttggcgcgcgtgacgatgcgatgggaatgcagtacctgatccccggctggacgttcgataacaagcgtccgtgcatggtgcgttaa

SEQ ID NO: 6620 - protein, 446 aa, Escherichia coli
MSSQFTTPVVTEMQVIPVAGHDSMLMNLSGAHAPFFTRNIVIIKDNSGHTGVGEIPGGEKIRKTLEDAIPLVVGKTLGEYKNVLTLVRNTFADRDAGGRGLQTFDLRTTIHVVTGIEAAMLDLLGQHLGVNVASLLGDGQQRSEVEMLGYLFFVGNRKATPLPYQSQPDDSCDWYRLRHEEAMTPDAVVRLAEAAYEKYGFNDFKLKGGVLAGEEEAESIVALAQRFPQARITLDPNGAWSLKEAIKIGTYLKGSLAYAEDPCGAEQGFSGREVMAEFRRATGLPTATNMIATDWRQMGHTLSLQSVDIPLADPHFWTMQGSVRVAQMCHEFGLTWGSHSNNHFDISLAMFTHVAAAAPGKITAIDTHWIWQEGNQRLTKEPLEIKGGLVQVPEKPGLGVEIDMDQVMKAHELYQKHGLGARDDAMGMQYLIPGWTFDNKRPCMVR

SEQ ID NO: 6621 - DNA, 1341 bp, Escherichia coli
atgacgacacaatccagtcctgttattactgatatgaaagtcattccggtcgccggacatgacagcatgttgcttaatattggtggtgcacataacgcatatttcacccgcaatattgtggtactcaccgataatgccgggcataccggcattggtgaagcgccgggcggagaggtgatttatcaaacactggtcaaggctattccgatggtgctgggccaggaagttgcgcgcctgaataaagtggttcagcaggtgcataaaggtaatcaggcagccgattttgataccttcggcaaaggtgcctggacttttgaattgcgcgttaatgccgtggcggcgctggaagccgccttgcttgacctgttaggtcaggcgctgaatgttccggtctgcgaactgttagggccaggcaagcaacgtgatgctattaccgttctcggttatctgttttatatcggtgatcggaccaaaaccgatcttccttatctggaaaatacgccgggcaaccatgagtggtatcagttgcggcatcagaaagcgatgaacagcgaagccgttgtgcgtctggcggaagcctcacaggatcgctatggctttaaagatttcaaacttaagggtggcgtgttacctggcgagcaagaaatcgacactgttcgtgcattgaagaaacgcttccctgatgcgcggattaccgttgatcccaatggtgcctggctgcttgatgaagccatttctctgtgcaaagggctgaatgatgtccttacctatgcggaagacccgtgcggcgctgagcagggtttctccggtcgtgaagtgatggcggagtttcgacgggcgaccggcttgcccgtcgcgaccaacatgatcgccaccaactggcgcgaaatgggtcatgcggtgatgctcaatgcggtagatattccacttgccgatccgcacttctggacgctttccggtgcagtccgcgtggcgcaactttgcgacgactgggggctgacctggggctgccattctaataaccactttgatatctctctggcgatgtttacccatgtgggcgcggcggcaccgggtaatcctaccgctatcgatacccactggatttggcaggagggcgattgtcgtctgaccaaaaatccgctggagattaaaaacggaaaaattgccgttcctgatgcgcccggtctgggcgtggaactggactgggaacaggtacaaaaggcacatgaggcctataaacgtctgcctggcggtgcgcgtaacgacgcaggcccgatgcagtacctgatccccggctggacctttgaccgtaaacgtcccgttttcggccgtcattga

SEQ ID NO: 6622 - protein, 446 aa, Escherichia coli
MTTQSSPVITDMKVIPVAGHDSMLLNIGGAHNAYFTRNIVVLTDNAGHTGIGEAPGGEVIYQTLVKAIPMVLGQEVARLNKVVQQVHKGNQAADFDTFGKGAWTFELRVNAVAALEAALLDLLGQALNVPVCELLGPGKQRDAITVLGYLFYIGDRTKTDLPYLENTPGNHEWYQLRHQKAMNSEAVVRLAEASQDRYGFKDFKLKGGVLPGEQEIDTVRALKKRFPDARITVDPNGAWLLDEAISLCKGLNDVLTYAEDPCGAEQGFSGREVMAEFRRATGLPVATNMIATNWREMGHAVMLNAVDIPLADPHFWTLSGAVRVAQLCDDWGLTWGCHSNNHFDISLAMFTHVGAAAPGNPTAIDTHWIWQEGDCRLTKNPLEIKNGKIAVPDAPGLGVELDWEQVQKAHEAYKRLPGGARNDAGPMQYLIPGWTFDRKRPVFGRH

SEQ ID NO: 6623 - DNA, 1353 bp, Escherichia coli
atgagttctttaagtcaggctgcgagcagtgtggaaaaacgcacgaatgctcgttactggatagtggtgatgttgtttatcgtcacatccttcaactacggcgaccgcgctacgctttctattgccggttcggaaatggccaaagatatcggccttgatcccgtgggaatgggctatgtgttctctgccttctcatgggcgtatgttatcgggcagatccctggtggctggttgctggatcgttttggttcaaaacgcgtctacttctggtcgatctttatctggtcgatgtttaccttgctgcaaggcttcgtcgatatctttagtggattcggcattatcgttgccctgtttacgctgcgcttcctggtcgggcttgctgaagcgccctctttccccggcaacagtcgcattgttgcggcctggtttccggcgcaggaaaggggaacggcggtgtcgatttttaactccgctcaatacttcgcaacggttatcttcgcgccgattatgggctggctgacgcatgaagtgggctggtcacacgtctttttctttatgggcggtctgggcattgtcatcagctttatctggttgaaagtcatccacgagccaaatcaacatccgggcgtaaatcagaaagagctggagtacatcgccgcgggtggcgcgctgatcaatatggatcagcaaaacaccaaagttaaagtgccgtttagcgtgaagtgggggcagatcaaacagctgctcgggtcacggatgatgatcggcgtttatatcggtcagtactgtatcaacgccctgacttacttttttattacctggttcccggtttatctggtgcaggcgcgcgggatgtcgattctgaaagcgggctttgtggcttccgttccggcggtttgcggttttatcggcggtgtgctgggtgggattatttccgactggctgatgcgtcgcacgggttcactgaacattgcgcgtaaaacaccgatcgtgatgggcatgttgttgtcgatggtgatggtgttctgcaactacgtcaacgttgagtggatgatcatcggctttatggcgctggccttcttcggtaaggggatcggtgcgctggattgggctgtaatggctgatactgcgccaaaagagatcagcggtctttccggtggcctgtttaacatgtttggtaacatttctggcatcgtcacgccaatcgcaattggttatatcgttggcacgactggctcctttaatggggcgctgatttatgttggtgttcatgccttaatcgcggtactcagctacctggtgctggtgggcgatatcaagcgtattgagctgaaacctgtcgcggggcaataa

SEQ ID NO: 6624 - protein, 450 aa, Escherichia coli
MSSLSQAASSVEKRTNARYWIVVMLFIVTSFNYGDRATLSIAGSEMAKDIGLDPVGMGYVFSAFSWAYVIGQIPGGWLLDRFGSKRVYFWSIFIWSMFTLLQGFVDIFSGFGIIVALFTLRFLVGLAEAPSFPGNSRIVAAWFPAQERGTAVSIFNSAQYFATVIFAPIMGWLTHEVGWSHVFFFMGGLGIVISFIWLKVIHEPNQHPGVNQKELEYIAAGGALINMDQQNTKVKVPFSVKWGQIKQLLGSRMMIGVYIGQYCINALTYFFITWFPVYLVQARGMSILKAGFVASVPAVCGFIGGVLGGIISDWLMRRTGSLNIARKTPIVMGMLLSMVMVFCNYVNVEWMIIGFMALAFFGKGIGALDWAVMADTAPKEISGLSGGLFNMFGNISGIVTPIAIGYIVGTTGSFNGALIYVGVHALIAVLSYLVLVGDIKRIELKPVAGQ

SEQ ID NO: 6625 - DNA, 450 bp, Escherichia coli
atggcggaaattggtatttttgtcggcaccatgtacgggaattcactgttagtggccgaagaagcggaagcgattctgaccgcgcagggccacaaagcaacggtatttgaagatcctgaattaagcgactggctgccctatcaggataagtatgttctggtggttacgtccacgaccgggcagggcgaccttcctgatagcattgtgccactctttcagggaatcaaagatagtctgggcttccagccgaatctgcgttatggcgtgattgcgctcggcgacagtagttatgtgaatttctgcaatggcggcaaacagttcgatgccttgttgcaggaacagagcgctcagcgggttggcgaaatgctgttgattgacgccagtgagaacccggaaccggaaacggaatcaaatccgtgggttgaacattggggcacgatgttgtcctga

SEQ ID NO: 6626 - protein, 149 aa, Escherichia coli
MAEIGIFVGTMYGNSLLVAEEAEAILTAQGHKATVFEDPELSDWLPYQDKYVLVVTSTTGQGDLPDSIVPLFQGIKDSLGFQPNLRYGVIALGDSSYVNFCNGGKQFDALLQEQSAQRVGEMLLIDASENPEPETESNPWVEHWGTMLS

SEQ ID NO: 6627 - DNA, 783 bp, Escherichia coli
atgctggaaatactctatcaggatgaatggctggttgcggtaaataaaccctccggctggctggttcaccgcagctggctggatcgcgacgagaaagtagtggtcatgcaaaccgtgcgtgacctgataggccagcatgtgtttactgctcatcgtctggaccgacccacttctggtgtgttgttgatgggattatccagcgaggccggacggctgctggcacaacagtttgaacagcaccaaatccagaaacgttaccatgcgattgtgcgcggctggttgatggaagaagcggtgctggattatccactggtggaagaactggacaaaatcgctgataaatttgcccgcgaagataaaggcccgcagccagcagtgacgcattatcgcggtctggcgaccgtagaaatgccggtagcgaccggacgttacccgaccacgcgctacggcctggtagaactggagccgaaaaccggacgtaagcaccagctccgtcgccatcttgcccatttgcgccacccgattattggcgacagcaaacatggtgatttacgccagaatcgcagcggtgctgaacattttggccttcagcggttaatgctgcatgctagtcagttgtcattgacgcatccttttactggcgagccgctgactattcacgcgggcctggacgacacctggatgcaggcgttatcacaatttggctggcggggtctgcttcctgaaaatgaaagggttgagttcagtgcgccatcgggtcaggatggagagataagttcctaa

SEQ ID NO: 6628 - protein, 260 aa, Escherichia coli
MLEILYQDEWLVAVNKPSGWLVHRSWLDRDEKVVVMQTVRDLIGQHVFTAHRLDRPTSGVLLMGLSSEAGRLLAQQFEQHQIQKRYHAIVRGWLMEEAVLDYPLVEELDKIADKFAREDKGPQPAVTHYRGLATVEMPVATGRYPTTRYGLVELEPKTGRKHQLRRHLAHLRHPIIGDSKHGDLRQNRSGAEHFGLQRLMLHASQLSLTHPFTGEPLTIHAGLDDTWMQALSQFGWRGLLPENERVEFSAPSGQDGEISS

SEQ ID NO: 6629 - DNA, 330 bp, Escherichia coli
atgaccactcatgaccgcgttcgtctccagttgcaggcgcttgaagcgttactgcgtgaacatcagcactggcgaaacgatgaacccctgccgcatcaatttgcgagtacccagccgttctttatggacaccatggaaccactggagtggttgcaatgggtactgattccgcggatgcacgatttgttagataacaaccagccgttaccgggcgcttttgctgttgcgccctattatgaaatggcgctggcgactgatcatccgcaacgcgcgcttattctggctgagctggaaaaactggatgctctttttgcggatgatgcgagctaa

SEQ ID NO: 6630 - protein, 109 aa, Escherichia coli
MTTHDRVRLQLQALEALLREHQHWRNDEPLPHQFASTQPFFMDTMEPLEWLQWVLIPRMHDLLDNNQPLPGAFAVAPYYEMALATDHPQRALILAELEKLDALFADDAS

SEQ ID NO: 6631 - DNA, 546 bp, Escherichia coli
gtggacgatttgaccgcacaagccctgaaagattttactgcacgctactgcgatgcgtggcatgaagagcataaaagctggccgttaagtgaggaactgtacggcgttccttcaccgtgcattatttcaactaccgaagatgccgtatactggcaaccccagccgtttaccggggaacaaaatgtaaacgcggttgaacgcgcttttgatattgtgatacaacccacgattcataccttttatacgactcagtttgccggggatatgcacgcgcagtttggcgatatcaaactgacattgctgcaaacctggagtgaagacgacttccgtcgggtgcaggaaaatctgattggtcatctggtgactcagaaaaggctaaaactgccgcccacgctatttatcgcgacgctggaagaagagttagaggtcatctcggtgtgtaatctctccggtgaagtgtgcaaagagacgctgggaacacgtaaacggacgcatttagcctcaaatcttgcggaattccttaatcaacttaagcctcttctgtaa

SEQ ID NO: 6632 - protein, 181 aa, Escherichia coli
MDDLTAQALKDFTARYCDAWHEEHKSWPLSEELYGVPSPCIISTTEDAVYWQPQPFTGEQNVNAVERAFDIVIQPTIHTFYTTQFAGDMHAQFGDIKLTLLQTWSEDDFRRVQENLIGHLVTQKRLKLPPTLFIATLEEELEVISVCNLSGEVCKETLGTRKRTHLASNLAEFLNQLKPLL

SEQ ID NO: 6633 - DNA, 93 bp, Escherichia coli
gtgaatccagcacgcaaaattgagaaaaaatttattgccgaaccagtcttgtggtcgatgggacaaaatcgctattactgcgccacgggttaa

SEQ ID NO: 6634 - protein, 30 aa, Escherichia coli
MNPARKIEKKFIAEPVLWSMGQNRYYCATG

SEQ ID NO: 6635 - DNA, 849 bp, Escherichia coli
atgtcttcttatgcaaaccatcaggcacttgcgggcctgacacttggaaaatcaaccgattaccgggatacctatgacgccagcctactgcaaggcgttccacgcagcctgaatcgcgacccgctgggtctgaaagcggataacctgccttttcacggtacggatatctggacgctgtatgaactttcctggctgaatgcgaaaggtttgccgcaggtcgctgtcggtcatgttgaacttgattacaccagcgtaaatctgattgagtcgaagagttttaagctctatctcaacagttttaaccagacgcgttttaataactgggatgaggtgcgccagacgctggagcgcgacttaagcacttgcgcccagggtaaggttagcgtggcgttatatcgtcttgatgaactggaaggccagccgataggtcatttcaatggcacctgcattgatgaccaggatatcactatcgataactatgaattcactactgactatctggagaatgccaccagcggtgaaaaagtagtggaagagacgcttgtcagccacctgctgaaatcaaattgcctgatcacccatcaaccagattggggatcgatccaaattcagtatcgtggacgccaaattgacagagaaaaactgctgcgttacctggtttctttccgtcatcacaacgagttccacgaacagtgcgtggaacgcatctttaatgacctgttacgcttctgccagccagagaaattgagcgtttacgcacgttatacccgtcgtggcggtctggacattaacccgtggcgcagtaatagcgattttgtcccatcgaccacaagactggttcggcaataa

SEQ ID NO: 6636 - protein, 282 aa, Escherichia coli
MSSYANHQALAGLTLGKSTDYRDTYDASLLQGVPRSLNRDPLGLKADNLPFHGTDIWTLYELSWLNAKGLPQVAVGHVELDYTSVNLIESKSFKLYLNSFNQTRFNNWDEVRQTLERDLSTCAQGKVSVALYRLDELEGQPIGHFNGTCIDDQDITIDNYEFTTDYLENATSGEKVVEETLVSHLLKSNCLITHQPDWGSIQIQYRGRQIDREKLLRYLVSFRHHNEFHEQCVERIFNDLLRFCQPEKLSVYARYTRRGGLDINPWRSNSDFVPSTTRLVRQ

SEQ ID NO: 6637 - DNA, 1329 bp, Escherichia coli
atgttgtcgcagctggaagtggatatgcttaaacgcaccgccagcagcgacctctatcaactgtttcgcaactgttcacttgccgtactgaactccggtagtttgaccgataacagcaaagaattgctgtctcgttttgaaaatttcgatattaacgtcctgcgccgtgaacgcggcgtaaagctggaactgataaatcccccggaagaggcttttgtcgatgggcgaattattcgcgctttgcaggccaacttgttcgcggttctgcgtgacattctcttcgtttatgggcaaattcataacaccgttcgttttcccaacctgaatctcgacaactccgtccacatcactaacctggtcttttccatcttgcgtaacgctcgcgcgctgcatgtcggtgaagcgccaaatatggtggtctgctggggcggtcactcaattaacgaaaacgagtatttgtatgcccgtcgcgtcgggaatcagctgggcctgcgtgagctgaatatctgcaccggctgtggtccgggagcgatggaagcgccgatgaaaggtgctgcggtcggacacgcgcagcagcgttacaaagacagtcgctttattggtatgacagagccgtcgattatcgccgctgaaccgcctaacccgctggtcaacgaattgatcatcatgccagatatcgaaaaacgtctggaagcgtttgtccgtatcgctcacggtatcattatcttccctggcggtgtgggtacagcagaagagttgctgtatttgctgggaattttaatgaacccggccaacaaagatcaggttttaccattgatcctcaccggcccgaaagagagcgccgactacttccgcgtactggacgagtttgtcgtgcatacgctgggtgaaaacgcgcgccgccattaccgcatcatcattgatgacgccgctgaagtcgctcgtcagatgaaaaaatcgatgccgctggtgaaagaaaatcgccgcgacactggtgacgcttacagctttaactggtcaatgcgcattgcgccagatttgcaaatgccgtttgagccgtctcacgagaatatggctaatctgaagctttacccggatcaacccgttgaagtgctggctgccgacctgcgccgtgcgttctccggtattgtggcgggtaatgtaaaagaagtcggtattcgcgccattgaagagtttggtccttacaaaatcaacggcgataaagagattatgcgtcgtatggacgacctgctacagggttttgttgcccagcatcgtatgaagttgccaggctcagcctacatcccttgctacgaaatctgcacataa

SEQ ID NO: 6638 - protein, 442 aa, Escherichia coli
MLSQLEVDMLKRTASSDLYQLFRNCSLAVLNSGSLTDNSKELLSRFENFDINVLRRERGVKLELINPPEEAFVDGRIIRALQANLFAVLRDILFVYGQIHNTVRFPNLNLDNSVHITNLVFSILRNARALHVGEAPNMVVCWGGHSINENEYLYARRVGNQLGLRELNICTGCGPGAMEAPMKGAAVGHAQQRYKDSRFIGMTEPSIIAAEPPNPLVNELIIMPDIEKRLEAFVRIAHGIIIFPGGVGTAEELLYLLGILMNPANKDQVLPLILTGPKESADYFRVLDEFVVHTLGENARRHYRIIIDDAAEVARQMKKSMPLVKENRRDTGDAYSFNWSMRIAPDLQMPFEPSHENMANLKLYPDQPVEVLAADLRRAFSGIVAGNVKEVGIRAIEEFGPYKINGDKEIMRRMDDLLQGFVAQHRMKLPGSAYIPCYEICT

SEQ ID NO: 6639 - DNA, 1290 bp, Escherichia coli
atggaaacgactcaaaccagcacgattgcgtcgaaagactctcgtagtgcctggcgcaagacagacaccatgtggatgctgggcctttacggcacggcaatcggcgcgggcgtgctgttcctgccaatcaacgctggtgttggcggtatgatcccgctgatcatcatggctatccttgcgttcccgatgacgttttttgctcaccgcggcctgactcgcttcgtactgtctggtaaaaacccgggcgaagacatcaccgaggttgtagaagaacactttggtattggcgcaggtaaactgattactctgctctacttcttcgctatctacccgatcctgctggtttatagcgtggcaatcaccaatacagttgaaagcttcatgtctcaccagctgggtatgacgccaccgccgcgtgcgattctgtcgctgatcctgatcgtgggtatgatgaccatcgttcgcttcggtgagcagatgatcgttaaagcgatgagtattctggtattcccgtttgttggcgtactgatgctgctggctctgtacctgatcccgcagtggaacggcgcagcactggaaacgctgtctctggacactgcatctgcaaccggaaacggtctgtggatgacactgtggctggcaattccggtaatggtgttctcgttcaaccactctccgatcatctcttctttcgccgttgcgaagcgtgaagagtacggcgatatggcagaacagaaatgctcgaagatcctggcattcgcacacatcatgatggtgctgaccgtaatgttcttcgtcttcagctgcgtactgagcctgactccggcagacctggctgcggctaaagagcagaacatctcgattctgtcttacctggctaaccactttaacgcgccgatcatcgcgtggatggctccgattatcgcgattatcgctatcaccaaatccttcctcggccactacctgggcgcacgtgaaggcttcaacggtatggtaattaaatctctgcgtggtaaaggtaagtctatcgaaatcaacaagctgaaccgtatcactgcgctgttcatgctggtaacgacctggattgttgccaccctgaacccgagcatcctgggtatgattgaaaccctgggcggcccaatcatcgcgatgatcctgttcctgatgccgatgtacgcaattcagaaagtaccggcaatgcgtaaatacagcggtcacatcagcaacgtattcgttgtcgtgatgggtctgattgcaatctccgcaatcttctactctctgttcagctaa

SEQ ID NO: 6640 - protein, 429 aa, Escherichia coli
METTQTSTIASKDSRSAWRKTDTMWMLGLYGTAIGAGVLFLPINAGVGGMIPLIIMAILAFPMTFFAHRGLTRFVLSGKNPGEDITEVVEEHFGIGAGKLITLLYFFAIYPILLVYSVAITNTVESFMSHQLGMTPPPRAILSLILIVGMMTIVRFGEQMIVKAMSILVFPFVGVLMLLALYLIPQWNGAALETLSLDTASATGNGLWMTLWLAIPVMVFSFNHSPIISSFAVAKREEYGDMAEQKCSKILAFAHIMMVLTVMFFVFSCVLSLTPADLAAAKEQNISILSYLANHFNAPIIAWMAPIIAIIAITKSFLGHYLGAREGFNGMVIKSLRGKGKSIEINKLNRITALFMLVTTWIVATLNPSILGMIETLGGPIIAMILFLMPMYAIQKVPAMRKYSGHISNVFVVVMGLIAISAIFYSLFS

SEQ ID NO: 6641 - DNA, 1368 bp, Escherichia coli
atgattagcgtattcgatattttcaaaatcggcattggcccttccagttctcataccgttggaccaatgaaagcgggtaaacaatttaccgacgatctgattgcccgtaacctgcttaaagacgtgacccgcgtggtggttgacgtgtacggctcgctctctctgaccggtaaaggccaccacacagatatcgccataattatgggtctggcgggtaacctgccggataccgtggatatcgattccatccctggttttattcaggatgtgaatactcatggtcgcctgatgctggcaaacggtcagcatgaagtggagttcccggttgatcagtgcatgaacttccatgccgacaacctttctctgcatgaaaacggtatgcgcattaccgcgctggcgggcgataaagtcgtttacagccagacttattactctatcggcggtggctttattgttgatgaagaacattttggtcagcaggatagcgcaccggttgaagttccttatccgtacagttcagcagccgatctgcaaaaacattgtcaggaaaccgggctgtcactctctggcctgatgatgaaaaacgagctggcgctgcacagcaaagaagagctggaacagcacctggcgaacgtctgggaagtcatgcgtggcggtattgagcgcggtatttctaccgaaggcgtgttacctggcaaactgcgcgttccacgccgtgctgcggcactacgccggatgctggtcagccaggataaaaccaccactgacccgatggcggttgttgactggatcaacatgtttgcactggcagtgaacgaagagaatgctgctggcggtcgcgtggtgactgcgccgactaacggtgcgtgcgggattattccggccgtgctggcgtactacgacaagtttatccgcgaagtgaacgctaactcactggctcgttacctgctggtagccagcgccattggttctctttataagatgaacgcctcgatttctggtgccgaagtcggctgccagggtgaagtcggcgtggcgtgctcaatggcggcagctggtctggcagaactgttaggcgcaagcccagcgcaggtatgcatcgcggcggaaatcgccatggagcacaacctcggtctgacgtgtgacccggtcgccgggcaggtacaggtgccgtgcatcgagcgtaacgccattgcggcagtgaaagcagtaaacgctgcacgtatggcgctgcgccgtaccagcgagccacgcgtctgcctcgacaaagttatcgaaaccatgtacgaaacaggtaaagatatgaacgccaagtaccgtgaaacgtctcgcggcggcctggcaatgaaaatcgttgcctgcgattaa

SEQ ID NO: 6642 - protein, 455 aa, Escherichia coli
MISVFDIFKIGIGPSSSHTVGPMKAGKQFTDDLIARNLLKDVTRVVVDVYGSLSLTGKGHHTDIAIIMGLAGNLPDTVDIDSIPGFIQDVNTHGRLMLANGQHEVEFPVDQCMNFHADNLSLHENGMRITALAGDKVVYSQTYYSIGGGFIVDEEHFGQQDSAPVEVPYPYSSAADLQKHCQETGLSLSGLMMKNELALHSKEELEQHLANVWEVMRGGIERGISTEGVLPGKLRVPRRAAALRRMLVSQDKTTTDPMAVVDWINMFALAVNEENAAGGRVVTAPTNGACGIIPAVLAYYDKFIREVNANSLARYLLVASAIGSLYKMNASISGAEVGCQGEVGVACSMAAAGLAELLGASPAQVCIAAEIAMEHNLGLTCDPVAGQVQVPCIERNAIAAVKAVNAARMALRRTSEPRVCLDKVIETMYETGKDMNAKYRETSRGGLAMKIVACD

SEQ ID NO: 6643 - DNA, 756 bp, Escherichia coli
gtggctgttcatttgcttattgtcgatgcactgaatcttattcgtcgcattcatgccgttcagggttcgccctgtgtcgaaacctgccagcacgcgctcgatcagctcattatgcacagccagccaacccacgcggtcgccgtttttgatgatgaaaaccgcagtagcggctggcgtcatcagcgtttaccagattacaaagcgggtcgaccgccaatgccggaagagttgcacaacgagatgcctgcattacgcgccgcctttgagcaacgcggcgtcccgtgctggtccgccagcggcaacgaagccgatgacttagccgccacgctggcggtcaaagtgacacaggccgggcatcaggcaacgattgtttcgacagataaaggctactgtcagttactttcaccgacattacgtattcgtgattacttccagaaacgttggctggatgcgccatttatcgataaagaatttggcgttcaaccgcagcagttgcccgattactgggggcttgcggggatcagcagttcaaaggtaccgggtgttgcagggatcggaccaaaaagcgccacacagctactggtcgagtttcagagtctggaagggatatatgagaatctggatgcggttgccgaaaagtggcgcaaaaaattagaaacccataaagagatggcgtttctgtgccgcgatattgcccgcttacaaaccgatttgcatatcgacggcaatttacagcaattgcggttggtaaggtaa

SEQ ID NO: 6644 - protein, 251 aa, Escherichia coli
MAVHLLIVDALNLIRRIHAVQGSPCVETCQHALDQLIMHSQPTHAVAVFDDENRSSGWRHQRLPDYKAGRPPMPEELHNEMPALRAAFEQRGVPCWSASGNEADDLAATLAVKVTQAGHQATIVSTDKGYCQLLSPTLRIRDYFQKRWLDAPFIDKEFGVQPQQLPDYWGLAGISSSKVPGVAGIGPKSATQLLVEFQSLEGIYENLDAVAEKWRKKLETHKEMAFLCRDIARLQTDLHIDGNLQQLRLVR

SEQ ID NO: 6645 - DNA, 1149 bp, Escherichia coli
atggctaacagaatgattctgaacgaaacggcatggtttggtcgaggtgctgttggagctttaaccgatgaagtgaaacgccgtggttatcagaaggcgctgatcgtcaccgataaaacgctggtgcaatgcggcgtggtggcgaaagtgatcgataagatggatgcggcaggactggcatgggcgatttacgacggcgtagtacctaacccaacaattactgtcgtcaaagaagggctcgatgtattccagaatagcggcgcggattacctgatcgctattggtggtggttctccacaggatacgtgtaaagcgattggcattatcagcaacaacccggagtttgccgatgtgcgtagcctggaagggctttccccgaccaataaacccagtgtaccgattctggcaatccccaccacagcaggcactgcggcagaagtgaccattaactacgtgatcactgacgaagagaaacggcgcaagtttgtttgcgttgatccgcatgatatcccgcaggtggcgtttattgacgctgacatgatggatggtatgcctccagcgctgaaagccgcgacgggtgtcgatgcgctcactcatgctattgaggggtatattacccgtggcgcgtgggcgctaaccgatgcgctgcacattaaagcgattgaaatcattgctggggcgctgcgaggaacggttgctggtgataaggatgccggagaagaaatggcgctcgggcagtatgttgcgggtatgggattctcgaatgttgggttagggttggtgcatggtatggcgcatccactgggcgcgttttacaacacgccacacggtgttgcaaatgccatcctgttaccgcatgtcatgcgctataacgctgactttaccggtgagaagtaccgcgatatcgcgcgcgttatgggcgtgaaagtggaaggtatgagcctggaagaggcgcgtaatgccgctgttgaagcggtgtttgctctcaaccgtgatgtcggtattccgccacatttacgtgatgttggtgtacgcaaggaagacattccggcactggcgcaggcggcactggatgatgtttgtaccggtggcaacccgcgtgaagcaacgcttgaggatattgtagagctttaccataccgcctggtaa

SEQ ID NO: 6646 - protein, 382 aa, Escherichia coli
MANRMILNETAWFGRGAVGALTDEVKRRGYQKALIVTDKTLVQCGVVAKVIDKMDAAGLAWAIYDGVVPNPTITVVKEGLDVFQNSGADYLIAIGGGSPQDTCKAIGIISNNPEFADVRSLEGLSPTNKPSVPILAIPTTAGTAAEVTINYVITDEEKRRKFVCVDPHDIPQVAFIDADMMDGMPPALKAATGVDALTHAIEGYITRGAWALTDALHIKAIEIIAGALRGTVAGDKDAGEEMALGQYVAGMGFSNVGLGLVHGMAHPLGAFYNTPHGVANAILLPHVMRYNADFTGEKYRDIARVMGVKVEGMSLEEARNAAVEAVFALNRDVGIPPHLRDVGVRKEDIPALAQAALDDVCTGGNPREATLEDIVELYHTAW

SEQ ID NO: 6647 - DNA, 648 bp, Escherichia coli
atggaacgaaataaacttgctcgtcagattattgacacttgcctggaaatgactcgcctggggctgaaccaggggacagcgggtaacgtcagtgtacgttatcaggatgggatgctgattacgcctacaggtattccatatgaaaaactgacggagtcgcatattgtctttattgatggcaacggcaaacatgaggaaggaaagctcccctcaagcgagtggcgtttccatatggcggcctatcaaagcagaccggatgccaacgcggttgttcacaatcatgccgttcattgtacggcagtttccattcttaaccgaccgatccccgcgattcactacatgattgcggcggctggcggtaattctattccttgcgcgccttatgcgacctttggaacacgcgaactttctgaacatgttgcgctggctctcaaaaatcgtaaggcaactttgttacaacatcatgggcttatcgcttgtgaggcgaatctggagaaagcgttatggctggcgcatgaagttgaagtgctggcacaactttacctgacgaccctggcgattacggacccggtgccagtgctgagcgatgaagagattgccgtagtgctggagaaattcaaaacctacgggttacggattgaagagtaa

SEQ ID NO: 6648 - protein, 215 aa, Escherichia coli
MERNKLARQIIDTCLEMTRLGLNQGTAGNVSVRYQDGMLITPTGIPYEKLTESHIVFIDGNGKHEEGKLPSSEWRFHMAAYQSRPDANAVVHNHAVHCTAVSILNRPIPAIHYMIAAAGGNSIPCAPYATFGTRELSEHVALALKNRKATLLQHHGLIACEANLEKALWLAHEVEVLAQLYLTTLAITDPVPVLSDEEIAVVLEKFKTYGLRIEE

SEQ ID NO: 6649 - DNA, 138 bp, Escherichia coli
atgaccgctcttaagaatatttatcaaaacggtcatttttctactcctccctgccaggaatgcccgttttcggcacaaacaattaatacggtcatctggtttgtgttttttatgatttattttctgaaacgggcatga

SEQ ID NO: 6650 - protein, 45 aa, Escherichia coli
MTALKNIYQNGHFSTPPCQECPFSAQTINTVIWFVFFMIYFLKRA

SEQ ID NO: 6651 - DNA, 1317 bp, Escherichia coli
atgggaaacacatcaatacaaacgcagagttaccgtgcggtagataaagatgcagggcaaagcagaagttacattattccattcgcgctgctgtgctcactgttttttctttgggcggtagccaataaccttaacgacattttattgcctcaattccagcaggcttttacgctgacaaatttccaggctggcctgatccaatcggccttttactttggttatttcattatcccaatccctgccgggatattgatgaaaaaactcagttataaagcagggattattaccggattgtttttatatgccttcggcgctgcattattctggcccgccgcagaaataatgaactacaccttgtttttagttggcctatttattattgcagccggattaggttgtctggaaactgccgcaaacccttttgttacggtattagggccggaaagcagtggtcacttccgcttaaatcttgcgcaaacatttaactcatttggcgcaattatcgcggttgtctttgggcaaagtcttattttgtctaacgtgccacatcaatcgcaagacgttctcgataaaatgtctccagagcaattgagtgcgtataaacacagcctggtattatcggtacagacaccttatatgatcatcgtggctatcgtgttactggtcgccctgctgatcatgctgacgaaattcccggcattgcagagtgataatcacagtgacgccaaacaaggatcgttctccgcatcgctttctcgcctggcgcgtattcgccactggcgctgggcagtattagcgcaattctgctacgtcggcgcacaaacagcctgctggagctatttgattcgctacgctgtagaagaaattccaggtatgacagcaggttttgccgctaactatttaaccggaaccatggtgtgcttctttattggtcgtttcaccggtacctggctcatcagtcgcttcgcaccacacaaagtcctggcagcctacgcattaatcgctatggcactgtgcctgatctcagccttcgctggcggtcatgtgggtttaatagccctgactttatgcagtgcctttatgtcgattcagtacccaacaatcttctcgctgggcattaagaatctcggccaggacaccaaatacggttcgtccttcatcgttatgaccattattggcggcggtattgtcactccggtcatggggtttgtcagtgacgcagcgggcaacatccccactgccgaactgctcccggcactctgcttcgcagtcatctttatctttgcccgtttccgttctcaaacggcaactaactga

SEQ ID NO: 6652 - protein, 438 aa, Escherichia coli
MGNTSIQTQSYRAVDKDAGQSRSYIIPFALLCSLFFLWAVANNLNDILLPQFQQAFTLTNFQAGLIQSAFYFGYFIIPIPAGILMKKLSYKAGIITGLFLYAFGAALFWPAAEIMNYTLFLVGLFIIAAGLGCLETAANPFVTVLGPESSGHFRLNLAQTFNSFGAIIAVVFGQSLILSNVPHQSQDVLDKMSPEQLSAYKHSLVLSVQTPYMIIVAIVLLVALLIMLTKFPALQSDNHSDAKQGSFSASLSRLARIRHWRWAVLAQFCYVGAQTACWSYLIRYAVEEIPGMTAGFAANYLTGTMVCFFIGRFTGTWLISRFAPHKVLAAYALIAMALCLISAFAGGHVGLIALTLCSAFMSIQYPTIFSLGIKNLGQDTKYGSSFIVMTIIGGGIVTPVMGFVSDAAGNIPTAELLPALCFAVIFIFARFRSQTATN

SEQ ID NO: 6653 - DNA, 1776 bp, Escherichia coli
atgaaaaaaatcagcttaccgaaaattggtatccgcccggttattgacggtcgtcgcatgggtgttcgtgagtcgcttgaagaacaaacaatgaatatggcgaaagccacggctgcactgctgaccgagaaactgcgccatgcctgcggagctgccgtcgagtgtgtcatttccgatacctgtatcgcgggtatggctgaagccgctgcttgcgaagaaaaattcagcagtcagaatgtaggcctcaccattacggtaaccccttgctggtgctatggcagtgaaaccatcgacatggatccaacccgcccgaaagccatttggggctttaacggcactgaacgtcccggcgctgtttacctggcagcggctctggcagctcacagccagaaaggcatcccggcattctccatttacggtcatgacgttcaggatgccgatgacacatcgattcctgccgatgttgaagaaaaactgctgcgctttgcccgcgccggtttagcagtcgccagcatgaaaggtaaaagctatctgtcgctgggcggcgtttcgatgggtatcgccggttccatcgttgatcataacttctttgaatcctggctgggaatgaaagtccaggcggtggatatgaccgaactgcgtcgccgtatcgatcagaagatttacgacgaagccgaactggaaatggcgctggcctgggctgataaaaacttccgctatggcgaagatgaaaataacaaacagtatcaacgcaatgccgagcaaagccgcgcagttctgcgcgaaagtttactgatggcgatgtgtatccgcgacatgatgcaaggcaacagcaaactggccgatattggtcgcgtggaagaatcacttggctacaacgccatcgctgcaggcttccaggggcaacgtcactggaccgatcaatatcccaatggcgataccgctgaagcgatcctcaacagttcatttgactggaatggcgtgcgcaaaccgtttgtcgtggcgaccgaaaacgacagtcttaacggcgtggcaatgttaatgggccaccagctcaccggcaccgctcaggtatttgccgatgtccgtacctactggtcaccagaagcaattgagcgtgtaacggggcataaactggacgggctggcagaacacggcatcatccatttgatcaactccggttctgctgcgctggacggttcctgtaaacaacgcgacagcgaaggtaaaccgacgatgaagccgcactgggaaatctctcagcaagaggctgacgcttgcctcgccgctaccgaatggtgcccggcgatccacgaatacttccgtggcggcggttactcttcccgctttcttaccgaaggcggcgtcccgttcaccatgactcgtgtcaacatcatcaaaggcctgggaccggtactgcaaatcgcggaaggctggagcgtggaattgccgaaggatgtgcatgacatcctcaacaaacgcaccaactcaacctggccaaccacctggtttgcaccgcgcctcaccggtaaagggccgtttacggatgtgtactcggtaatggcgaactggggcgctaaccacggggttctgaccatcggccacgttggcgcagactttatcactcttgcctccatgctgcgtatcccggtatgtatgcacaacgttgaagagaccaaagtgtatcgtccttctgcctgggccgcgcacggcatggatattgaaggccaggattaccgcgcttgccagaactacggcccgttgtacaagcgttaa

SEQ ID NO: 6654 - protein, 591 aa, Escherichia coli
MKKISLPKIGIRPVIDGRRMGVRESLEEQTMNMAKATAALLTEKLRHACGAAVECVISDTCIAGMAEAAACEEKFSSQNVGLTITVTPCWCYGSETIDMDPTRPKAIWGFNGTERPGAVYLAAALAAHSQKGIPAFSIYGHDVQDADDTSIPADVEEKLLRFARAGLAVASMKGKSYLSLGGVSMGIAGSIVDHNFFESWLGMKVQAVDMTELRRRIDQKIYDEAELEMALAWADKNFRYGEDENNKQYQRNAEQSRAVLRESLLMAMCIRDMMQGNSKLADIGRVEESLGYNAIAAGFQGQRHWTDQYPNGDTAEAILNSSFDWNGVRKPFVVATENDSLNGVAMLMGHQLTGTAQVFADVRTYWSPEAIERVTGHKLDGLAEHGIIHLINSGSAALDGSCKQRDSEGKPTMKPHWEISQQEADACLAATEWCPAIHEYFRGGGYSSRFLTEGGVPFTMTRVNIIKGLGPVLQIAEGWSVELPKDVHDILNKRTNSTWPTTWFAPRLTGKGPFTDVYSVMANWGANHGVLTIGHVGADFITLASMLRIPVCMHNVEETKVYRPSAWAAHGMDIEGQDYRACQNYGPLYKR

SEQ ID NO: 6655 - DNA, 1419 bp, Escherichia coli
atgaaacaagaagttatcctggtactcgactgtggcgcgaccaatgtcagggccatcgcggttaatcggcagggaaaaattgttgcccgcgcctcaacgcctaatgccagcgatatcgcgatggaaaacaacacctggcaccagtggtctttagacgccattttgcaacgctttgctgattgctgtcggcaaatcaatagtgaactgactgattgccacatccgcggtatcgccgtcaccacctttggtgtggatggcgctctggtagataagcaaggcaatctgctctatccgatcattagctggaaatgtccgcgaacagccgcggtaatggaccatattgaacggttgatctccgcacagcagttgcaggctatttctggagtcggagcctttagtttcaatacgttatataagttggtgtggttgaaagaaaatcatccacaactgctggaacgcgcgcacgcctggctctttatttcgtcgctgattaaccaccgtttaaccggcgaattcactactgatattacgatggccggaaccagccagatgctggatatccagcaacgcgatttcagtccgcaaattttacaagccaccggtattccacgccgactcttccctcgtctggtggaagcgggtgaacagattggtacgctacagaacagcgccgcagcaatgctcggcttacccgttggcataccggtgatttccgcaggtcacgatacccagttcgccctttttggcgctggtgccgaacaaaatgaacccgtgctctcttccggtacatgggaaattttaatggtccgcagcgcccaggttgatacttcgctgttaagtcagtacgccggttctacctgcgaactggatagccaggcagggttgtataacccaggtatgcaatggctggcatccggcgtgctggaatgggtgagaaaactgttctggacggctgaaactccctggcaaatattgattgaagaagctcgcctgatcgcgcctggcgcagatggagtgaaaatgcagtgtgatttattgtcgtgccagaacgctggctggcaaggcgtaacgcttaataccacgcgggggcatttctatcgcgcggcgctggaagggttaaccacgcaattacagcgcaatctacagatgctggaaaaaatcgggcactttaaagcctctgaattattgttagtcggcggaggaagtcgcaacacattgtggaatcagattaaagccaatatgcttgatattccggtaaaagttctcgacgatgccgaaacgaccgtcgcaggagctgcgctgtttggttggtatggcgtaggggaatttaacagcccggaagaagcccgtgcacagattcattatcagtaccgttatttctacccgcaaactgaacctgaatttatagaggaggtgtga

SEQ ID NO: 6656 - protein, 472 aa, Escherichia coli
MKQEVILVLDCGATNVRAIAVNRQGKIVARASTPNASDIAMENNTWHQWSLDAILQRFADCCRQINSELTDCHIRGIAVTTFGVDGALVDKQGNLLYPIISWKCPRTAAVMDHIERLISAQQLQAISGVGAFSFNTLYKLVWLKENHPQLLERAHAWLFISSLINHRLTGEFTTDITMAGTSQMLDIQQRDFSPQILQATGIPRRLFPRLVEAGEQIGTLQNSAAAMLGLPVGIPVISAGHDTQFALFGAGAEQNEPVLSSGTWEILMVRSAQVDTSLLSQYAGSTCELDSQAGLYNPGMQWLASGVLEWVRKLFWTAETPWQILIEEARLIAPGADGVKMQCDLLSCQNAGWQGVTLNTTRGHFYRAALEGLTTQLQRNLQMLEKIGHFKASELLLVGGGSRNTLWNQIKANMLDIPVKVLDDAETTVAGAALFGWYGVGEFNSPEEARAQIHYQYRYFYPQTEPEFIEEV

SEQ ID NO: 6657 - DNA, 423 bp, Escherichia coli
atgctgaaaacaatttcgccgttaatttctcccgaactattgaaagtgctggcagagatggggcatggagatgaaattattttttccgatgctcactttcccgcccattcgatgggaccgcaggtgatccgcgctgatggcctgttggtgagcgacttgctccaggcgattatcccgttatttgagctggacagttatgcaccaccgctggtgatgatggcggcggtagaaggtgacactctcgatcctgaagtagaacgacgttatcgtaatgcgctttcactacaagccccctgtcctgacatcatccgcatcaatcgttttgcgttttatgaacgggcgcaaaaagcctttgcgatcgttatcacaggcgaacgagcgaagtacgggaatattcttttaaaaaaaggggtaacaccgtaa

SEQ ID NO: 6658 - protein, 140 aa, Escherichia coli
MLKTISPLISPELLKVLAEMGHGDEIIFSDAHFPAHSMGPQVIRADGLLVSDLLQAIIPLFELDSYAPPLVMMAAVEGDTLDPEVERRYRNALSLQAPCPDIIRINRFAFYERAQKAFAIVITGERAKYGNILLKKGVTP

SEQ ID NO: 6659 - DNA, 114 bp, Escherichia coli
atgcgcataatggcttttcagccggatgtgaaagggatcgccactgtcttgattttgacggtggatatatttagcgcgcccatgattgcgcagaattttaccctgcgtctgtaa

SEQ ID NO: 6660 - protein, 37 aa, Escherichia coli
MRIMAFQPDVKGIATVLILTVDIFSAPMIAQNFTLRL

SEQ ID NO: 6661 - DNA, 732 bp, Escherichia coli
atgaaagcggcacgccagcaagcgatagtcgacctgctgctgaaccataccagcctgaccacggaagctctctctgaacagctaaaggtcagtaaagaaaccattcgtcgcgatctcaatgaattacagacgcagggtaaaattctgcgcaatcatgggcgcgctaaatatatccaccgtcaaaatcaagacagtggcgatccctttcacatccggctgaaaagccattatgcgcataaagcagatatcgcgcgcgaggcgctcgcgtggattgaagaagggatggtgatagccttagacgccagttcaacctgctggtatctggcacgccagttgcctgacatcaacatccaggtcttcaccaatagccatccgatttgccatgaactcggtaaacgcgaacgcattaaactgatcagttccggcggcacacttgagcgcaaatatggctgttacgtcaatccctcgctgatttcccaacttaaatcgctggaaatcgatctgtttattttttcttgtgaagggatcgatagcagcggcgcactgtgggactccaatgccatcaacgctgattacaaatcaatgttattaaaacgtgccgcgcaatcgttgttattgattgataaaagtaaatttaatcgttcaggggaagcccgcatcgggcatctggatgaggtaacgcacattatttctgatgagcgccaggttacaacttctttggtaacagcctga

SEQ ID NO: 6662 - protein, 243 aa, Escherichia coli
MKAARQQAIVDLLLNHTSLTTEALSEQLKVSKETIRRDLNELQTQGKILRNHGRAKYIHRQNQDSGDPFHIRLKSHYAHKADIAREALAWIEEGMVIALDASSTCWYLARQLPDINIQVFTNSHPICHELGKRERIKLISSGGTLERKYGCYVNPSLISQLKSLEIDLFIFSCEGIDSSGALWDSNAINADYKSMLLKRAAQSLLLIDKSKFNRSGEARIGHLDEVTHIISDERQVTTSLVTA

SEQ ID NO: 6663 - DNA, 1101 bp, Escherichia coli
atgaataaggttgtattgctgtgccgtccgggctttgaaaaagagtgcgccgcagaaattaccgataaagccggtcagcgggaaattttcggttttgcccgcgtgaaagagaatgcgggttatgtcatttatgaatgttatcaacctgatgatggcgataagttaatccgtgagctgccgttcagttcattaatttttgcccgccagtggtttgtggtgggggaactcctgcagcatttgccgccagaagatcgtattacccccattgtcggcatgttacagggtgtagtagagaagggcggtgaactgcgtgttgaagttgccgataccaacgaaagcaaagagttgctgaaattctgccgtaaattcaccgtgccgctacgcgctgccttgcgtgatgcgggggtgctggcgaactatgaaacgccgaagcgtccggttgtgcatgtattctttattgcaccaggctgttgctatactggttactcatacagcagcaataattcgccgttctatatgggcattccgcgcctgaaatttccggcagatgcgccgagtcgttccacgctcaaactggaagaggcatttcatgtgtttattcccgcggatgagtgggatgaacgcctggcgaacgggatgtgggcggtggatttaggtgcttgcccaggcggctggacctaccaactggtgaagcgcaacatgtgggtttattccgtcgacaacggcccgatggcgcaaagtctgatggataccgggcaggtgacgtggctgcgggaagacggtttcaaattccgtccgacatgcagcaatatctcctggatggtatgcgatatggttgaaaaaccggcgaaagttgcggcattaatggcgcagtggctggttaatggctggtgccgtgaaactatcttcaatctcaaactgccgatgaaaaaacgctacgaagaagtgtcacacaatctggcgtatattcaggcacagcttgatgaacatggcataaatgctcagattcaggcgcggcagttgtatcacgatcgcgaagaagtgacggtgcacgtccgccgtatctgggctgcggtgggtggtcgtcgcgacgagcgataa

SEQ ID NO: 6664 - protein, 366 aa, Escherichia coli
MNKVVLLCRPGFEKECAAEITDKAGQREIFGFARVKENAGYVIYECYQPDDGDKLIRELPFSSLIFARQWFVVGELLQHLPPEDRITPIVGMLQGVVEKGGELRVEVADTNESKELLKFCRKFTVPLRAALRDAGVLANYETPKRPVVHVFFIAPGCCYTGYSYSSNNSPFYMGIPRLKFPADAPSRSTLKLEEAFHVFIPADEWDERLANGMWAVDLGACPGGWTYQLVKRNMWVYSVDNGPMAQSLMDTGQVTWLREDGFKFRPTCSNISWMVCDMVEKPAKVAALMAQWLVNGWCRETIFNLKLPMKKRYEEVSHNLAYIQAQLDEHGINAQIQARQLYHDREEVTVHVRRIWAAVGGRRDER

SEQ ID NO: 6665 - DNA, 396 bp, Escherichia coli
atgaccagccgttttatgctgattttcgccgccattagcggcttcatttttgtagctctgggcgcttttggcgcgcatgtgttaagtaaaaccatgggagccgttgagatgggctggatccagaccggcctcgaataccaggcgtttcatacgctggcgatcttaggtctggcggtggcaatgcagcgtcgcatcagtatctggttttactggagtagcgttttcctcgcgttaggcacggtgctgttcagcggcagcctttattgcctggcgctgtcccatctgcgtttgtgggcatttgtcacaccggttggcggcgtgagcttccttgcgggctgggcgttaatgttaattggtgctatccgtttaaagcgcaagggcgtaagtcatgaataa

SEQ ID NO: 6666 - protein, 131 aa, Escherichia coli
MTSRFMLIFAAISGFIFVALGAFGAHVLSKTMGAVEMGWIQTGLEYQAFHTLAILGLAVAMQRRISIWFYWSSVFLALGTVLFSGSLYCLALSHLRLWAFVTPVGGVSFLAGWALMLIGAIRLKRKGVSHE

SEQ ID NO: 6667 - DNA, 714 bp, Escherichia coli
  n 696, 697, 698, 699, 700: n is any nucleotide
atgtctaaacgattaccaccgctaaatgccttacgagtttttgatgccgcagcacgccatttaagtttcactcgcgcagcagaagagctttttgtgacccaggccgcagtaagtcatcaaatcaagtctcttgaggattttctggggctaaaactgttccgccgccgtaatcgttcactcctgctgaccgaggaagggcaaagctatttcctcgatatcaaagagatattttcgcaattaaccgaagcgacgcgtaaactccaggcccgtagcgctaagggggcgttgacggtcagtttactccccagtttcgcgattcattggttggttccgcgactttccagctttaattcagcttatccgggaattgacgttcgaatccaggcggttgatcgtcaggaagataagctggcggatgatgttgatgtggcgatattttatggtcggggcaactggccggggctacgggtggaaaaactgtacgccgaatatttattgccggtgtgctcgccgctactgctgactggcgaaaaacccttgaagaccccggaagatctggctaaacatacgttattacatgatgcatcacgccgtgactggcagacatatacccgacagttggggttaaatcatatcaacgttcagcaagggccaatttttagccatagcgccatggtgctgcaagcggctatccannnnncattcattcattaa

SEQ ID NO: 6668 - protein, 237 aa, Escherichia coli
  Xaa 232, 233, 234: Xaa is any amino acid
MSKRLPPLNALRVFDAAARHLSFTRAAEELFVTQAAVSHQIKSLEDFLGLKLFRRRNRSLLLTEEGQSYFLDIKEIFSQLTEATRKLQARSAKGALTVSLLPSFAIHWLVPRLSSFNSAYPGIDVRIQAVDRQEDKLADDVDVAIFYGRGNWPGLRVEKLYAEYLLPVCSPLLLTGEKPLKTPEDLAKHTLLHDASRRDWQTYTRQLGLNHINVQQGPIFSHSAMVLQAAIXXXFIH

SEQ ID NO: 6669 - DNA, 228 bp, Escherichia coli
atgaaaaagactgccgcaattatttctgcctgtatgctgacttttgccctgagcgcctgttccggttcgaactatgtgatgcacaccaatgacggacgtaccatcgtctctgacggcaaaccacagactgataacgataccggtatgatttcgtataaagacgctaatggcaacaaacagcagatcaaccgtactgacgtgaaagagatggtcgaactggatcagtaa

SEQ ID NO: 6670 - protein, 75 aa, Escherichia coli
MKKTAAIISACMLTFALSACSGSNYVMHTNDGRTIVSDGKPQTDNDTGMISYKDANGNKQQINRTDVKEMVELDQ

SEQ ID NO: 6671 - DNA, 1206 bp, Escherichia coli
atgaacgtttttaatcccgcgcagtttcgcgcccagtttcccgcgctacaggatgcgggcgtctatctcgacagcgccgcgaccgcgcttaaacctgaagccgtggttgaagctacccgacagttttatagcctgagcgccggaaacgtccatcgcagccagtttgccgaagcccaacgcctgaccgcgcgttacgaagctgcgcgggaaaaagtggcacaattactgaatgcatcggatgacaaaaatatcgtctggacgcgcggcaccactgaatccatcaacatggtggcgcaatgctatgcccgtccgcgtctgcaaccgggcgatgaaattattgtcagtgtggcagaacaccacgccaacctcgtcccctggctgatggtcgcccaacaaacgggggccaaagtggtgaaattgccgcttaatgcgcagcgactgccggatgtcgatttgttgccagaactgattactccccgtagtcggattctggcgttgggccagatgtcgaacgtcactggcggttgcccggatctggcgagagcgattacttttgctcattcagccgggatagtggtgatggttgatggtgctcagggggcggtgcatttccccgcggatgttcagcaactggatattgatttctatgctttttcaggtcacaaactgtatggtccgacaggcatcggcgtgctgtatggcaaaccagaactgctggaagcgatgtcgccctggctgggcggcggcaaaatggttcacgaagtgagttttgacgacttcacgactcaatctgcgccgtggaaactggaagcaggaacgccaaatgtcgctggcgtcataggattaagcgcggcgctggaatggctgacagattacgatatcaaccaggccgaaagctggagccgtagcttagcaacgcttgcagaagaagcgctggcgaaacgtccaggctttcgttcattccgctgcctggattccagcctgctggcctttgattttgcgggtgttcatcacagcgatatggtgacactgctggcggagtacggtattgccctgcgcgccgggcagcattgcgctcagccgctactggcagaattaggcgtaaccggcacactgcgcgcctcatttgcgccatataatacaaagagtgatgtggatgcgctggtgaatgccgttgaccgcgcgctggaattattggtggattaa

SEQ ID NO: 6672 - protein, 401 aa, Escherichia coli
MNVFNPAQFRAQFPALQDAGVYLDSAATALKPEAVVEATRQFYSLSAGNVHRSQFAEAQRLTARYEAAREKVAQLLNASDDKNIVWTRGTTESINMVAQCYARPRLQPGDEIIVSVAEHHANLVPWLMVAQQTGAKVVKLPLNAQRLPDVDLLPELITPRSRILALGQMSNVTGGCPDLARAITFAHSAGIVVMVDGAQGAVHFPADVQQLDIDFYAFSGHKLYGPTGIGVLYGKPELLEAMSPWLGGGKMVHEVSFDDFTTQSAPWKLEAGTPNVAGVIGLSAALEWLTDYDINQAESWSRSLATLAEEALAKRPGFRSFRCLDSSLLAFDFAGVHHSDMVTLLAEYGIALRAGQHCAQPLLAELGVTGTLRASFAPYNTKSDVDALVNAVDRALELLVD

SEQ ID NO: 6673 - DNA, 444 bp, Escherichia coli
atgacaaacccgcaattcgccggacatccgttcggcacaaccgtaaccgcagaaacgttacgcaataccttcgcaccgttgacgcaatgggaagataaatatcgccagttgatcatgctgggaaaacagcttccggctttgccagaggagttaaaagcgcaggctaaagagattgccggatgcgaaaaccgcgtctggctgggatataccgtggctgaaaacggcaagatgcatttctttggcgacagcgaagggcgcattgtgcgcggcctgttggcggtgttgttgactgccgttgaggggaaaaccgccgccgaattgcaggcacagtcgccgctggcattgtttgatgagctgggattacgtgcgcaacttagcgcctcacgcagccaggggttgaatgcgttaagcgaggcgattatcgctgcggcgaagcaggtttaa

SEQ ID NO: 6674 - protein, 147 aa, Escherichia coli
MTNPQFAGHPFGTTVTAETLRNTFAPLTQWEDKYRQLIMLGKQLPALPEELKAQAKEIAGCENRVWLGYTVAENGKMHFFGDSEGRIVRGLLAVLLTAVEGKTAAELQAQSPLALFDELGLRAQLSASRSQGLNALSEAIIAAAKQV

SEQ ID NO: 6675 - DNA, 807 bp, Escherichia coli
atgtctgtggtaattagtgatgcatggcgtcagcgttttggtggcacagcgcgactgtatggtgaaaaagcattgcaactgtttgctgacgcgcatatttgtgtggttggtatcggtggtgtcggttcctgggcggcggaagcgctagcgcgcacggggattggcgcaatcacgcttatcgatatggatgatgtgtgcgtcaccaataccaatcggcaaattcacgctctgcgcgataacgtcgggctggcaaaagcggaagtcatggcggagcgtattcgccagattaacccggagtgccgtgtaacggtggtggatgacttcgtgacgccggataacgtagcgcaatatatgaatgccggttattcgtacgtgattgatgctattgatagtgtacggcccaaagcggcgctgattgcttattgtcggcgcaataaaatcccgctggtcacgaccggtggcgcgggtgggcagattgacccgacgcagattcaggttaccgatctggcgaaaacgattcaggacccgttggcggcgaagttgcgcgagcgcctgaaaagcgattttggcgtagtgaaaaacagtaaaggtaagctcggcgtggattgcgtgttctctaccgaagcgctggtgtacccgcagtcagacggcaccgtctgtgcgatgaaagccacggcggaagggccaaagcggatggattgtgcctcaggatttggcgcggcgacgatggtgaccgccacttttggctttgttgcggtttctcatgcgctgaagaagatgatggcgaaagcggcgcgtcaggggtaa

SEQ ID NO: 6676 - protein, 268 aa, Escherichia coli
MSVVISDAWRQRFGGTARLYGEKALQLFADAHICVVGIGGVGSWAAEALARTGIGAITLIDMDDVCVTNTNRQIHALRDNVGLAKAEVMAERIRQINPECRVTVVDDFVTPDNVAQYMNAGYSYVIDAIDSVRPKAALIAYCRRNKIPLVTTGGAGGQIDPTQIQVTDLAKTIQDPLAAKLRERLKSDFGVVKNSKGKLGVDCVFSTEALVYPQSDGTVCAMKATAEGPKRMDCASGFGAATMVTATFGFVAVSHALKKMMAKAARQG

SEQ ID NO: 6677 - DNA, 1365 bp, Escherichia coli
ttgaaccgacgaccttcgggttatgagcccgacgagctaccaggctgctccaccccgcgtccgtggatgcgcactatactctgctcgcgttttcatgcaaccttttttttaccccgatcacggattcggcatgattttgaacaaaaacaaatcactaaagcctattttttgtgcaaaatttgcgtcagggagaggctgctcatttcattaaacgcggtggtttgttatcttcgttgcgccttattttttaacctgaagaagagaacaatgaaaggacgttgggtaaagtaccttcttatgggcacggttgtggcaatgcttgccgcctgctcttccaaaccaaccgatcgcggacagcaatataaagacgggaaatttacccagcctttctctctggtgaaccagccagatgccgttggcgcgccgattaatgccggtgattttgccgggcaaattaaccatatccgtaattcgtcaccgcgtctgtatggcaaccagagtaatgtttataacgcggtgcaagagtggctgcgcgcaggcggtgatacccgcaatatgcgccagttcggcattgatgcctggcagatggaaggtgtcgacaactatggtaacgtgcagtttacaggctattacacgccggtaattcaggcgcgccatacccgtcagggcgagttccagtatccgatttaccgtatgccgccaaaacgtggtcgtctgccgtctcgtgcggagatctacgcaggagcgctgagtgataaatatattctcgcttacagtaactccctgatggataacttcattatggatgtgcagggtagcgggtatatcgactttggtgatggcagtccgcttaactttttcagctatgcagggaaaaacggtcatgcctatcgcagcattggtaaggtgttgatcgaccgtggcgaagtgaaaaaagaagatatgtcgatgcaggcgattcgtcactggggcgaaacacacagtgaagctgaggttcgcgagctgctggaacagaacccgtctttcgtcttctttaaaccgcaatcttttgcaccggtgaaaggggcaagtgcggtgccgctggttggccgtgcttctgttgcctccgatcgttcaattattccgccaggtactaccttgctggcagaagtgccgctgctggataataacggcaaatttaacggtcagtacgaattgcgtctgatggtggcgctggatgtcggtggcgcaatcaaaggccaacacttcgatatctatcaagggatcgggccggaagccggacaccgcgcaggttggtacaaccactatggacgtgtctgggtgctgaaaaccgccccgggcgcaggtaacgtctttagcggctga

SEQ ID NO: 6678 - protein, 454 aa, Escherichia coli
MNRRPSGYEPDELPGCSTPRPWMRTILCSRFHATFFLPRSRIRHDFEQKQITKAYFLCKICVRERLLISLNAVVCYLRCALFFNLKKRTMKGRWVKYLLMGTVVAMLAACSSKPTDRGQQYKDGKFTQPFSLVNQPDAVGAPINAGDFAGQINHIRNSSPRLYGNQSNVYNAVQEWLRAGGDTRNMRQFGIDAWQMEGVDNYGNVQFTGYYTPVIQARHTRQGEFQYPIYRMPPKRGRLPSRAEIYAGALSDKYILAYSNSLMDNFIMDVQGSGYIDFGDGSPLNFFSYAGKNGHAYRSIGKVLIDRGEVKKEDMSMQAIRHWGETHSEAEVRELLEQNPSFVFFKPQSFAPVKGASAVPLVGRASVASDRSIIPPGTTLLAEVPLLDNNGKFNGQYELRLMVALDVGGAIKGQHFDIYQGIGPEAGHRAGWYNHYGRVWVLKTAPGAGNVFSG

SEQ ID NO: 6679 - DNA, 501 bp, Escherichia coli
atggctgacagtttccagaatgaagttcccaccgctcgtgtaaatatcaagcttgatctgcatacaggcaatgctaaaaagaaagttgaactccccctcaagcttcttgccgtaggcgattacagtaacggaaaagagcaacgtccgctgtccgaacgggacaaggttgatatcaataaaaacaacttcaacagcgtcatggctgagttttcgcctgcggttaatttaacagtagaagatacgctaaacggaaacggtaatgaacaaaatatcgcgcttgaatttaaaagcctgaaggattttgaacccgaacaggtagcaaaaaatattccgcaacttcgtgtattactcgctatgcgcaatttactacgtgacctgaaatccaatctgctggataacgcaacgtttcgccgtgaactggaaaatattctgaaagacccgacgctcagttcagaactgcgtgatgaactggcgaaaattgcgccgcaggagaacgtttaa

SEQ ID NO: 6680 - protein, 166 aa, Escherichia coli
MADSFQNEVPTARVNIKLDLHTGNAKKKVELPLKLLAVGDYSNGKEQRPLSERDKVDINKNNFNSVMAEFSPAVNLTVEDTLNGNGNEQNIALEFKSLKDFEPEQVAKNIPQLRVLLAMRNLLRDLKSNLLDNATFRRELENILKDPTLSSELRDELAKIAPQENV

SEQ ID NO: 6681 - DNA, 1539 bp, Escherichia coli
atgtctgtacaacaagaacattccacctctgaaactgcaacactcaccaccactgagtccggcggcgtttatcagtccctgttcgataaaattaatttaaccccggtctcttccattcaggaaatagatttatggcaaaacagcgaaacgctggctgatgcctcacccgatgagcgcgtgacagcagcgattcacgttctgctttcctgtctggcgaaatcaggcgaggacgtggttaagctcgacaagagcctgctggattttcatatcgacgatctggatcagaaaatcagtaaacagcttgatgcggtcatgcaccaccctgaattccagaaagtcgagtcgctgtggcgtggtacatggttcgtcgtacagcgcactgattttcgcaaaaatgtcagaattgaattgctggatatcagcaaagagcatctgcgtcaggatttcgacgactccccggaaatcattcagagcggtttatatcgtcatacatacattcaggagtacgatacgccgggtggcgaacctgttgcctcattaatttccagctatgaatttgataacagcccgcaggatattgccctgctgcgcaatatttccagagtgtctgccgcttcccatatgccttttatcggttccgtcggaccgaaattcttccttaaaaattcgatggaagaagtcgccgcgattaaagatatcggcaactactttgaccgcgcagaatatattaaatggaagtcgttccgcgatacggatgacagccgctatgtgggattagtgatgccgcgagtgctgggccgtctgccctatgggccggacacggtgccggtacgcagctttaactatgtggaagaagtcaaaggcccggatcacgaaaagtacctgtggacaaacgcctcgttcgcctttgccgccaatatggtgaagagctttgtgaataatggctggtgtgtgcagatccgtggtccacaggcaggtggcgcagtagccgatctgcccatccatctttacgatctcggcaccggcaatcaggtcaaaattccgtccgaagtgatgatcccggaaacccgcgaatttgaatttgccaaccttggctttattccgctctcttattataagaatcgcgattacgcctgcttcttctcggcaaactccgcccagaaaccggcgttgtatgataccgctgacgccaccgccaacagccgtattaacgcccgtctgccttacatcttcctgctgtcccgcattgcgcattacctgaaaatcattcagcgcgagaatatcggtaccaccaaagaccgccgcgtactggaactggaactgaacacctggatccgcacactggtgacggagatgaccgatccgggtgatgaactgcaggcgtctcacccgctgcgcgacggcaaggttatcgtggaagatattgaggacaatccgggcttcttccgcgtcagactctttgccgtgccgcatttccagattgaagggatggatatcaacctttctctggtttcccagatgccgaaagcgaaagcctga

SEQ ID NO: 6682 - protein, 512 aa, Escherichia coli
MSVQQEHSTSETATLTTTESGGVYQSLFDKINLTPVSSIQEIDLWQNSETLADASPDERVTAAIHVLLSCLAKSGEDVVKLDKSLLDFHIDDLDQKISKQLDAVMHHPEFQKVESLWRGTWFVVQRTDFRKNVRIELLDISKEHLRQDFDDSPEIIQSGLYRHTYIQEYDTPGGEPVASLISSYEFDNSPQDIALLRNISRVSAASHMPFIGSVGPKFFLKNSMEEVAAIKDIGNYFDRAEYIKWKSFRDTDDSRYVGLVMPRVLGRLPYGPDTVPVRSFNYVEEVKGPDHEKYLWTNASFAFAANMVKSFVNNGWCVQIRGPQAGGAVADLPIHLYDLGTGNQVKIPSEVMIPETREFEFANLGFIPLSYYKNRDYACFFSANSAQKPALYDTADATANSRINARLPYIFLLSRIAHYLKIIQRENIGTTKDRRVLELELNTWIRTLVTEMTDPGDELQASHPLRDGKVIVEDIEDNPGFFRVRLFAVPHFQIEGMDINLSLVSQMPKAKA

SEQ ID NO: 6683 - DNA, 1338 bp, Escherichia coli
atgaaaattcatcgaccactgtgggctgaggggacattcctgtcctctcagcagtttcagcagcaggcccgctgggaagcgttcagcaatgactgtattgcgcagctttgtattcgccatccgtgggggatcgcaaacgtgctctttgaccgggatgccctgacgcccggaaagctgaaaacgcaggcagtacgcctgcgttttgctgatggcacgctgatcgattcagacgtgagtgacgttctgccgctcgcctgcgatctgcgcgcgctgaagaacgacagcgcgattgttttgctggcgctgccgcttgcacatggtaacggcggtaatctcggtcagggtgagcagactgaaagaccgctgcgctatcgtcaggaatggcaaaaggtgcaggatatctacggcagtgacagtgaagatatggccgttgagcgtcatgcgctgtccctgcgctttgctcatgataacaatcaggattacatcacctgcccactggcgcgtctggtgcgggatgttcagggcaactggacacaggatgagagctatattccgccgttactggcgtttaacgcccatgacgggctggtacagcgtctggacacattgctgttgcagctacgggcgaagtgccagcgtctgatggcgatgcgccgggaaagcaaccagcgtatggcggactttgccgtcgccgatgtctccctgttctggctgcttaacgcgctgaattccgccgagccggtgctgagcgatttcctgcgctacccggctgtccaccccgaactggtctggcgggagctggcgaggcttgccggtgcgctgctgacgttttcccttgagcataacgtcagcgccgttccgccctatgtccacgaatcgccgtccaccgtctttccgcccctgttctccctgctcagcgagctgctggaagccagcctgccgtcgcgggtgatcgcgctggatctggcgtccctgccgggcaaccgctggaaagccgacctgcacgatccgcgactgcgggaagaggccgatttttatctgtccgttcgttcctcactgcctgcgcatcaggtactgcatcagctaccgctggtctgcaaaatcggtgcgcccgatgatgtcacgctgcttatcaacgtggcgctgaacggtgttcaactggtgccgcttacctcggttccggcggcgctgccgctgcggctggagaaccagtattttgcgctggatatgcacagtgacgcggctaaatcgatgctggagtccgggagctgcatgatttatgcgccgggaaccatgggcgacctgaaacctgaactgtttgcggtgctgcgcacatga

SEQ ID NO: 6684 - protein, 445 aa, Escherichia coli
MKIHRPLWAEGTFLSSQQFQQQARWEAFSNDCIAQLCIRHPWGIANVLFDRDALTPGKLKTQAVRLRFADGTLIDSDVSDVLPLACDLRALKNDSAIVLLALPLAHGNGGNLGQGEQTERPLRYRQEWQKVQDIYGSDSEDMAVERHALSLRFAHDNNQDYITCPLARLVRDVQGNWTQDESYIPPLLAFNAHDGLVQRLDTLLLQLRAKCQRLMAMRRESNQRMADFAVADVSLFWLLNALNSAEPVLSDFLRYPAVHPELVWRELARLAGALLTFSLEHNVSAVPPYVHESPSTVFPPLFSLLSELLEASLPSRVIALDLASLPGNRWKADLHDPRLREEADFYLSVRSSLPAHQVLHQLPLVCKIGAPDDVTLLINVALNGVQLVPLTSVPAALPLRLENQYFALDMHSDAAKSMLESGSCMIYAPGTMGDLKPELFAVLRT

SEQ ID NO: 6685 - DNA, 666 bp, Escherichia coli
atgaaaaaagatatggatatcaatatcgatgcgctgctgcgcgacacgtttctgacggtggtggaactgcgtcagggaaccaccgtgcgtcacggtatcgagctgtatcgccactgtcagcggcaggtggaactggtccgcgaacgtctgaaagatgccggattcagtcgggagaacgtggagcacataacttacgcgcagtgcgccctgctggacgaaacggtgctcagccgtagtggcatggacgacggtcaggccatctggatgaaaaacccactccagtcgcatttcttcaacaccctgcaggccggtgagctgctgtacgagcggatgaagcaggtgctacaggaacccgcccccgcgcaggccgtgctgacctgctttcaccgtgtcctgctgctgggatttcgcgggcgttatcaggatccggcagccccggagcgcgaccagcttatttcgacgctcaacgggcaggtcgcgccatttggtgtgctgccggaaacggcggtactgaacgtgccgttatccacccgtcagcaccctttgctgcattcgccatttttctggctggtaacactggcgctgctactggcgggcgtctggtgggggctacaccactggctgaatgtactggtggatgaactgctgccgcaaagcctgcgttaa

SEQ ID NO: 6686 - protein, 221 aa, Escherichia coli
MKKDMDINIDALLRDTFLTVVELRQGTTVRHGIELYRHCQRQVELVRERLKDAGFSRENVEHITYAQCALLDETVLSRSGMDDGQAIWMKNPLQSHFFNTLQAGELLYERMKQVLQEPAPAQAVLTCFHRVLLLGFRGRYQDPAAPERDQLISTLNGQVAPFGVLPETAVLNVPLSTRQHPLLHSPFFWLVTLALLLAGVWWGLHHWLNVLVDELLPQSLR

SEQ ID NO: 6687 - DNA, 1614 bp, Escherichia coli
atggtgttactgctggtgctgtggtcagtgtttatcagtccgtctggcgtgctgagatgggccggtgcggcggctatcgttctggcggttgctgcgttgttgatttatcggcgcaggcaggcgtggacggagatgaccggcgatgccgggttgtcatcgctgccgccggaaacctaccgacagccggtagtgctggtctgtggcggtctgtcggcgcacctgttcactgacagcccggtccgccaggtttcagaagggctgtatctgcatgttcctgatgaagaacagcttgtggcgcaggtggagcgattgctgacccttcgcccggcgtgggcatcgcagcttgccgtggcgtataccatcatgcccggcatacaccgggatgtggcggttctggccggacggctgcgacggttcgcccacagtatggcgacggtgcgtcgtcgggcaggcgtaaacgtcccctggcttctctggagcgggctgtccggctcgccgttgccggaaagagcgagttcaccgtggtttatctgtaccggcggcgaagttcaggtagcaacatccacagagaacgcgatgcccgcgcagtggattgcacaatccggcgtacaggaacgcagtcagcgactctcttatctgctgaaagccgaaagcctgatgcagtggctggatcttaatgtgctggcggaactgaacggcccggaggcgaaatgtccaccactggcgatggccgtggggctggtcccctcgttgcctgcggtggataacaacctgtggcagttgtggatcaccgccagaaccggcctgacgccggatatcgcggacaccggcacagacgatgcgctgccattcccggatgccctgttacggcggttgccgcgtcagtcgggctttaccccgctgcgacgggcctgcgtgaccatgctgggcgtcaccaccgtggcgggtatcgccgcgctgtgcctgtcagccacggcaaatcgccagttattacggcaggtcggtgacgatctgcaccggttttatgccgtcccggtggaggaatttatcaccaaagcccgtcacctgtcggtgctgaaagacgatgcgaccatgctcgatgggtattaccgggaaggagaaccactgcgcctcggtctggggttataccccggcgaacgcatccgccagccggtattacgcgccattcgcgactggcgtccgcctgaacaaaaaatggaggtgacggcttcgcttcaggttcagaccgtgcgtcttgacagtatgtcgctgtttgacgtcggacaggcccgcctgaaagacggctcgacaaaagtgctggtggacgcactggtgaacatccgggcaaaaccgggctggctgatcctcgtggccggatataccgatgccaccggcgatgaaaaaagcaatcagcagttatcgctgcggcgtgccgaagcggtgcgcaactggatgctgcagaccagcgacatcccggccacctgttttgccgtacagggactgggcgagagccagcctgcggcgaccaacgacacgccacagggccgggcagtcaaccggcgtgtcgaaatcagtcttgttccgcgttctgacgcctgtcaggacgtgaaataa

SEQ ID NO: 6688 - protein, 537 aa, Escherichia coli
MVLLLVLWSVFISPSGVLRWAGAAAIVLAVAALLIYRRRQAWTEMTGDAGLSSLPPETYRQPVVLVCGGLSAHLFTDSPVRQVSEGLYLHVPDEEQLVAQVERLLTLRPAWASQLAVAYTIMPGIHRDVAVLAGRLRRFAHSMATVRRRAGVNVPWLLWSGLSGSPLPERASSPWFICTGGEVQVATSTENAMPAQWIAQSGVQERSQRLSYLLKAESLMQWLDLNVLAELNGPEAKCPPLAMAVGLVPSLPAVDNNLWQLWITARTGLTPDIADTGTDDALPFPDALLRRLPRQSGFTPLRRACVTMLGVTTVAGIAALCLSATANRQLLRQVGDDLHRFYAVPVEEFITKARHLSVLKDDATMLDGYYREGEPLRLGLGLYPGERIRQPVLRAIRDWRPPEQKMEVTASLQVQTVRLDSMSLFDVGQARLKDGSTKVLVDALVNIRAKPGWLILVAGYTDATGDEKSNQQLSLRRAEAVRNWMLQTSDIPATCFAVQGLGESQPAATNDTPQGRAVNRRVEISLVPRSDACQDVK

SEQ ID NO: 6689 - DNA, 492 bp, Escherichia coli
atggctattcctgcttatctctggctgaaagatgacggcggcgcggatatcaaaggttccgtggacgttcaggggcgcgaaggtagcatcgaagtggtggcgctggatcacgatgtgtacatcccgaccgacaataacaccggcaaactgaccggtacccgtactcacaagccttttacgtttaccaaagaaatcgatgcctccagcccgtatctctacaaagctgtgaccaccggacagaccctgaaaacggcggagtttaaattctaccgcatcaacgatgccggtcaggaagtggagtatttcaataccacgctggataacgtcaagctggtcagagtagctccgctgatgcacgacatcaaagatccgggtaaagagaagcataaccacctggaacgcattgagttccgctacgagaaaatcacctggacttacaaagacggcaacatcattcattccgactcgtggaatgagcgtccttccgcctga

SEQ ID NO: 6690 - protein, 163 aa, Escherichia coli
MAIPAYLWLKDDGGADIKGSVDVQGREGSIEVVALDHDVYIPTDNNTGKLTGTRTHKPFTFTKEIDASSPYLYKAVTTGQTLKTAEFKFYRINDAGQEVEYFNTTLDNVKLVRVAPLMHDIKDPGKEKHNHLERIEFRYEKITWTYKDGNIIHSDSWNERPSA

SEQ ID NO: 6691 - DNA, 2646 bp, Escherichia coli
atgacaggaaatcaccccgccgcgctgctgcgtcgccttaacccatactgtgcacgggcgctggacgctgccgcctcactgtgtcagacccgcgcccatgcggagataaccattgaacactggctgctgaaactgctggagcagggagaaggcgatatcacggtgattgcccgccgctatgaatgggatatcgacacgctctggcagtctctgctggcacatctggacaccttaccccgctcggtccgcgaacgtccgcagctttctgaacccctgacggcgcttatcaggcaggcgtggctgattgcctcgctggaaggcgacgacccgcaaatccgcagtcagcacctgctgatggcgctgacagaaaaatcgatgctgcccgcctgtaatgacctgtgggtattgctgagtctgagccgcgtgcagcttgagcggctgcgtcccctgctggatgcgcagtcggatgaatgtccggcacgtcagccacaggtcaccgaaccgctgacctctgcactgccggagacggcaacggcggacgcaccggcaaaaacgctgacggagaaacaggatgacgccctgctggcggtgcttaaccgctttaccgaagacgtgacggaaaaagcccgcagcgggcgaatcgacccggtattcgggcgcgacacggaaattcgccagatggtcgatatcctctcccgtcgccgcaaaaacaacccgattctggtgggagaaccgggggtgggcaaaaccgcgctggtggaagggctggcgctgcgtatcaccgaaggcaacgtgccggacagcctgaaaacggtgcatatccgcacactggacctcggtctgttacaggctggcgcgggcgttaaaggtgaatttgaacagcggctgaaaaatgtcatcgatgcagtgcagaaatcaccggagccggtactgctgtttattgatgaagcccataccattatcggtgcgggtaatcaggcaggcggcgcggatgcggcgaacctgctgaaaccggcactggcaaggggcgaactgcgcaccatcgcggcgaccacgtggagcgaatacaaacagtattttgagcgcgacgccgcgctggagcgccgcttccagatggttaaggttgacgagccggatgatgacaccgcctgtctgatgctgcggggactgaaggctcgctatgcacagcaccacggcgtgcatatgctggacagcgccattcagaccgccgtgcgcctgtcgcgccgctatctgaccggacgccagctgccggacaaggcggttgatttgctggataccgccggggcaagagtccgcatgagccttgacaccctgccggaaccgttgacgcagcttcatgcgcgactggcggcactggatattgagcgggaagcgattgagcaggacagcgtattttatcccgaagccagcccggagcggctggcggaactgaccgatttgcgtgatgagctacaggcagaagccgggcatctggaagcgcagtatcagcaggaaaaggcactggcgcagcagattatgacgttgcgtcaggaaggaacagacagcactgaactgcaacagcaactgcgaacgcatcagggctttgcaccgctgctggcgctggatgtggacgcccgcgccgtcgctacggtggtggcggactggaccggcatcccgctctcatccctgctcagggacgagcagagcgatctgctcagtatggaacagagccttgaaaaccgcgtggtcgggcaacgcccggcgctctgcgccatcgcacagcggctgcgggcggctaaaaccggcctcacgccggagaacggcccacagggggtattcctgctgaccggccccagcggcaccggcaaaaccgaaactgcgctcacactggccgacaccctgtttggtggtgaaaaatcccttatcaccattaatctttcggaataccaggaaccgcataccgtttcccagttgaaaggttcgcctccgggctatgtcggctacggtcagggcggcgtacttaccgaagccgttcgcaaacgcccttacagcgtggtgctgctcgacgaagtggaaaaggcgcatcgcgacgtgatgaacctgttctatcaggtgttcgaccggggctttatgcgcgacggcgaagggcgggaaatcgacttccgcaacaccgtcattctgatgaccgccaatctgggcagcgaccacatcatgcagctgctggaggaaaaaccggacgccacggacgcagacctgcatgaactgctgtatccccttctgcgagaccattttcagcctgcactgatggcgcgttttcagacggtgatttaccgcccgctgggacaggaagcgatgcgcaccattgtggaaatgaaactggcgcaggtggtccgccgtcttcaccagcactacggactggaaacggaaatcaacgacagcctgtatgaccagcttaccgccgcctgcctgctgccggacaccggtgcgcgtaatatcgacagcctgctgaaccagcaaatcctgccggtcttaagccagcagttgctggcacagcaggccgcgcaccgtaaaccagcccaactacggcttggctgggatgaggaggacgggattgtactggagttcgctacggaagagatgcaataa

SEQ ID NO: 6692 - protein, 881 aa, Escherichia coli
MTGNHPAALLRRLNPYCARALDAAASLCQTRAHAEITIEHWLLKLLEQGEGDITVIARRYEWDIDTLWQSLLAHLDTLPRSVRERPQLSEPLTALIRQAWLIASLEGDDPQIRSQHLLMALTEKSMLPACNDLWVLLSLSRVQLERLRPLLDAQSDECPARQPQVTEPLTSALPETATADAPAKTLTEKQDDALLAVLNRFTEDVTEKARSGRIDPVFGRDTEIRQMVDILSRRRKNNPILVGEPGVGKTALVEGLALRITEGNVPDSLKTVHIRTLDLGLLQAGAGVKGEFEQRLKNVIDAVQKSPEPVLLFIDEAHTIIGAGNQAGGADAANLLKPALARGELRTIAATTWSEYKQYFERDAALERRFQMVKVDEPDDDTACLMLRGLKARYAQHHGVHMLDSAIQTAVRLSRRYLTGRQLPDKAVDLLDTAGARVRMSLDTLPEPLTQLHARLAALDIEREAIEQDSVFYPEASPERLAELTDLRDELQAEAGHLEAQYQQEKALAQQIMTLRQEGTDSTELQQQLRTHQGFAPLLALDVDARAVATVVADWTGIPLSSLLRDEQSDLLSMEQSLENRVVGQRPALCAIAQRLRAAKTGLTPENGPQGVFLLTGPSGTGKTETALTLADTLFGGEKSLITINLSEYQEPHTVSQLKGSPPGYVGYGQGGVLTEAVRKRPYSVVLLDEVEKAHRDVMNLFYQVFDRGFMRDGEGREIDFRNTVILMTANLGSDHIMQLLEEKPDATDADLHELLYPLLRDHFQPALMARFQTVIYRPLGQEAMRTIVEMKLAQVVRRLHQHYGLETEINDSLYDQLTAACLLPDTGARNIDSLLNQQILPVLSQQLLAQQAAHRKPAQLRLGWDEEDGIVLEFATEEMQ

SEQ ID NO: 6693 - DNA, 2481 bp, Escherichia coli
atgggtattcagaatttcgaccactcacaccacaagctcaaaattcgcggcctgaaaagcccggtggacgtgctgacttttacaggccacgaacagctcagctcacccttccgctacgacattcagtttaccagcagcgataaagccatcgcgccggaatcggtgctgatgcaggacggcgcattcagcctgacggcaccgcccgtacagggaatgccggtacagactgccctgcgcaccctgcacggcgtcattaccggctttaaacatctctcatcgtcacaggacgaagcccgttacgaagtgcgccttgaaccccgtatggcgctgcttacccgcagccgccagaacgccatctaccagaaccagacggtgccgcaaatcgtcgaaaaaatcctgcgcgagcgacaccagatgcgcggtcaggacttcgtgtttaacctcaaaagcgaatacccggcccgcgaacaggtgatgcagtatggcgaggacgacctgacgtttgtctcacgcctgctgtcggaagtgggtatctggttccgcttcgccaccgacgcccggctgaaaatcgaagttatcgaattttacgacgaccagagcggctatgagcgcgggctgacgctgccgcttcgccatccttctgggctgtttgatggtgaaacggaagccgtatgggggctgaacacggcatacagcgtggtggagaaaaacgtcaccacgcgggactacaactaccgcaccgccacagcggagatgatgacagagcagcatgacgccaccgggggcgataacaccacctacggcgaagcctaccactatgctgacaacttcctgcaaaaaggcgataaagaggcagcggaaagcggcgcgttttatgcccgtatccgccacgaacgctacctgaatgaacaggccattctcaaaggccagagcaccagttcactgctgatgccggggctggaaatcagggttcagggcgacgacgcgccagcggtgttccgcaagggtgtgctgattaccggcgtgacggccagcgcggcgcgtgaccgcagctatgaactgacgttcacggcgataccctactcagaacgctacggctaccgcccggcgcttatcccccgcccggtaatggccggcacgctcccggcgcgggtcaccagcacggtgaagaacgatatttatgcccatatcgacaaggacgggcgctaccgggtcaatctcgactttgaccgcgacgcatggaaaccgggttatgaaagcctgtgggtacgccagtcgcgcccgtatgcgggagacacctacggcctgcacctgccgctgctggcgggaacggaggtcagcatcgcctttgaggaaggcaacccggaccgaccttatattgcaggcgtaaaacacgactcggcgcacaccgaccatgtgaccattcagaactacaagcgcaacgtactgcgtaccccggccaacaacaaaatccggctggatgacgaacgcgggaaggagcatatcaaggtcagcaccgaatacggcggcaagagccagctaaacctcggtcatctggtggatgccgggaaacagcagcgcggggaaggctttgaactgcgtaccgatatgtggggcgcagtgcgggcgaagaaagggatttttatcagcgccgatgcgcaggacaaggcgcagggtcaggttctggatatgactgatgcactagctcaacttcgcgaggcacagtctttggtagaggcactatgtagtgctactgaagtggcaaaggctgaacttgcagatttgcagactcagaaagtaatgatgtcagaggctctggaggaactcaaaaaatcagcgatgttgctttcggctccggaaggaatagctcaggttacgccaaaaagcctgcagctgtccgcaggagaaaacatcattagcaccagtggaaaaaattcagatttcagcgtgttgaagaagtttaccgttgctgctggagaaacggtaagtctgtttgcccaaaagctggggataaaaatttttgccggtaagggaaaagtagagattcaggcgcagggagatgaaatgttgctagatgcgctgaaagatatccgcatcagcagcagtgaggggcgaatccttattagcgcaaaaaacgaaatcattctgaccagcggcggcggatatattcgtattggtgatggtacggtggaatgcgcagccccagacaagatcatagagcgtggggccgtatggcagaagttcagcggccagagcatcagtcaggcgatgcaacagtgggattctgctgattttgctgtcacaccagaaatactctggcaacaaactggcaaacctgcaaaaaatcaaaaggtacaggtcacacggggtgatggctcagtggtggaaatgaccaccgatgaacaaggacgattgcccatacagtcagggcttttcgttgagtcaataaaaattgatctgccggatagtcaggaaaactga

SEQ ID NO: 6694 - protein, 826 aa, Escherichia coli
MGIQNFDHSHHKLKIRGLKSPVDVLTFTGHEQLSSPFRYDIQFTSSDKAIAPESVLMQDGAFSLTAPPVQGMPVQTALRTLHGVITGFKHLSSSQDEARYEVRLEPRMALLTRSRQNAIYQNQTVPQIVEKILRERHQMRGQDFVFNLKSEYPAREQVMQYGEDDLTFVSRLLSEVGIWFRFATDARLKIEVIEFYDDQSGYERGLTLPLRHPSGLFDGETEAVWGLNTAYSVVEKNVTTRDYNYRTATAEMMTEQHDATGGDNTTYGEAYHYADNFLQKGDKEAAESGAFYARIRHERYLNEQAILKGQSTSSLLMPGLEIRVQGDDAPAVFRKGVLITGVTASAARDRSYELTFTAIPYSERYGYRPALIPRPVMAGTLPARVTSTVKNDIYAHIDKDGRYRVNLDFDRDAWKPGYESLWVRQSRPYAGDTYGLHLPLLAGTEVSIAFEEGNPDRPYIAGVKHDSAHTDHVTIQNYKRNVLRTPANNKIRLDDERGKEHIKVSTEYGGKSQLNLGHLVDAGKQQRGEGFELRTDMWGAVRAKKGIFISADAQDKAQGQVLDMTDALAQLREAQSLVEALCSATEVAKAELADLQTQKVMMSEALEELKKSAMLLSAPEGIAQVTPKSLQLSAGENIISTSGKNSDFSVLKKFTVAAGETVSLFAQKLGIKIFAGKGKVEIQAQGDEMLLDALKDIRISSSEGRILISAKNEIILTSGGGYIRIGDGTVECAAPDKIIERGAVWQKFSGQSISQAMQQWDSADFAVTPEILWQQTGKPAKNQKVQVTRGDGSVVEMTTDEQGRLPIQSGLFVESIKIDLPDSQEN

SEQ ID NO: 6695 - DNA, 1770 bp, Escherichia coli
atgacatcgacgatgcatatggacagggccgataagaataaagttggcaccgttgaaattgaggatctacgggttattccggttatttttctgcccggagtcatgggttcaaaccttatggataagaaaggaaaatccatctggcgatatgatgactctatgagtctgatgggctggtcactacctacatcaggaccaaaagagaggaaaagattattgcatcctgacagggtggaggtcgataatcgtgggagaattcccgcacctccggatgcccaagaaaaacttattcagttaggtcaacaatatccggaggacccatccgataaagaagcaatggataattacactcaggcagtacgtgacattttggataatatagagccagaagcgaaattatttggttcaagaaaagatcgcggctggggagaggttgcaaatgctagctacggttcctttctcgatgtattacaaacagcattgtaccgggacaaacctacaaagaaaggtgagacgttaagtgcgacctaccagcaactactcgatgtacctttgggtttggagtatggtcctgactcacttgatgaagagtatcttgaagtcataaggttgtatcaatttccggtccatgtcgttggctataactggcttggttctaatatgctctcagcaatcagactacaagaacagatcaagaaaattgttggaggctatcaaaaacgaggaatgaaatgccataaagttattctggttacgcattcaatgggaggactagtggcaaggtacttttcagagtgtctttcggggaatacggatgtctacggtattgttcatggcgtattaccatcaattggtgctgcggcgacatatacccgaatgaaacgtggaactgaaaacccagagtcaaatccggaagggtatgttatcagtcatatcttaggtcgtaatgcagctgaaatggtagctgttttttcccagtcgccaggaccaatggaattactacccatgaatgattatggtgaagagtggcttaatattgtcgatcgtgatggtagtacattaacgctccctaaaaatcttcccattaaagaaggtattgcccccgaagaacgcacctacgctgaactttatctaaatagagaaaattggtggaaattggtggatgagaatctattgaatccttttaatacttcattaaatcaaaagcaaattgatactgattggaatatatatgaaaatttaattactgagagtgtcaatccatttcataagcaaattgctggaaaatatcatatcaatacttactctttctatgggagagcgaaattgggagatattcctgaagcgcatttaacgcaggaaaatgttctttggaaaggctcattatcaatgggaaaaaaaagtgatatatctttagaaccaaaattcattgatggtcgtcttgatttaaatgaagttggtaacattagaactattaaggatgaattttctcctgaagaacaggcgtgggaaataaatactgacgacggtgatacatatgttaagataggacagcgttttacattacgagactcttgtgaaaacggggatggtacagtacctcttcgtgcaggacaaatcgtacacaagaacatcctagagcgtttggctgtacaggtttctcacgaggctgcttatcgaaatcccgttagtcaggcatttgcattacgttctattataaaaatagctcaggaggtaaaaaaggatggtaaaatgtcatactctgattaa

SEQ ID NO: 6696 - protein, 589 aa, Escherichia coli
MTSTMHMDRADKNKVGTVEIEDLRVIPVIFLPGVMGSNLMDKKGKSIWRYDDSMSLMGWSLPTSGPKERKRLLHPDRVEVDNRGRIPAPPDAQEKLIQLGQQYPEDPSDKEAMDNYTQAVRDILDNIEPEAKLFGSRKDRGWGEVANASYGSFLDVLQTALYRDKPTKKGETLSATYQQLLDVPLGLEYGPDSLDEEYLEVIRLYQFPVHVVGYNWLGSNMLSAIRLQEQIKKIVGGYQKRGMKCHKVILVTHSMGGLVARYFSECLSGNTDVYGIVHGVLPSIGAAATYTRMKRGTENPESNPEGYVISHILGRNAAEMVAVFSQSPGPMELLPMNDYGEEWLNIVDRDGSTLTLPKNLPIKEGIAPEERTYAELYLNRENWWKLVDENLLNPFNTSLNQKQIDTDWNIYENLITESVNPFHKQIAGKYHINTYSFYGRAKLGDIPEAHLTQENVLWKGSLSMGKKSDISLEPKFIDGRLDLNEVGNIRTIKDEFSPEEQAWEINTDDGDTYVKIGQRFTLRDSCENGDGTVPLRAGQIVHKNILERLAVQVSHEAAYRNPVSQAFALRSIIKIAQEVKKDGKMSYSD

SEQ ID NO: 6697 - DNA, 834 bp, Escherichia coli
atggtaaaatgtcatactctgattaaccgtagaaataaatgtctgctgattgtttttatagtccttattggatggattatattcagacctaaagcatatacttattcactaaatgataaagaaaaagagatgctcataatgttatcacaacatcctgaaactcggtactttggattttattccatagaacttccggctgattacaaaccaacaggaatggttatgttcatacaaggatcggcgatgatccctgtagaaacaaagctacaatattatcctccttttctgcaatatatgacacgatatgaggcagaactaaaaaacacctcagcattagatccactggatacgccttatttgaagcaagttcacccactaagtccacctatgaatggagtcatttttgaacgaatgaaagcgaaatacaccccagattttgcacgagtattggatgcatggaaatgggaaaatggcgttacgttttcagtaaaaatagaagctaaagatggtagagcaacccgctatgatggaattagtaagattgccgaatacagttatggatataatattccagaaaaaaaagtacagttacttactattctttcaggactacaacctcgtgcagataaccaacccccatcagaaaataaattggcgatacaatatgcacaggttgacgcttcactacttggagagtatgaattatctgtagattataaaaatagcaataatattaaaataagtttgcagacggataataatagttatattgactcattattagatataagatatccgagtaatggaaacagagcatggtataactctatataa

SEQ ID NO: 6698 - protein, 277 aa, Escherichia coli
MVKCHTLINRRNKCLLIVFIVLIGWIIFRPKAYTYSLNDKEKEMLIMLSQHPETRYFGFYSIELPADYKPTGMVMFIQGSAMIPVETKLQYYPPFLQYMTRYEAELKNTSALDPLDTPYLKQVHPLSPPMNGVIFERMKAKYTPDFARVLDAWKWENGVTFSVKIEAKDGRATRYDGISKIAEYSYGYNIPEKKVQLLTILSGLQPRADNQPPSENKLAIQYAQVDASLLGEYELSVDYKNSNNIKISLQTDNNSYIDSLLDIRYPSNGNRAWYNSI

SEQ ID NO: 6699 - DNA, 1248 bp, Escherichia coli
gtgacccgacagcgacggaaaaaggtcgtaatgtcgttgttaatcattgccaatgtgcatgtggctgtagggttatcagttctcaaccagaaaatagtatcgagtcataatatgggatggcctgtacccgatattccagaaagaaaaatgctacctgagcctgtttatcgacgctggattatattattaatatctatgttaacagttggtactctgtttattttatcggtctggaattctgcgacatactgggatatttttatttatggcgttctgccaatgctgtttctttggctatgtttgtttggtattgcgctgaacaaatatgaacaatccgttgcagcctgtataagttgggagtctgaaagacaacaagttaaacaactctggcaacactggagccaaaaacaactggcaatagttgggaatgttctttttacaccggaagaaaaaggcatgagtgttttactggggccacaggaagagatccctgcatatcctaaaaaggcacgaccgttattctctgcatcccgttattctctttcgtctatattccatgatattcaccagcaactgacacaacaatttcctgattatcgtcattatctacatactatctacgtattacagcctgagaaatggcgtggagaaaccgtgagacaggctattttccatcaatgggacttagtacctgaacggaccaatactcttaatcaaatccagtctctttatgatgaaagatttgacggtctaattctggttgtttgtttacaaaactggccggagaataaacctgaagatacgagtgaactggtatcagcacagcttatctcctcatcgtcatttgtacggcagcaccagatacccgttattgctggtctggggcgtgtaatgccattagaacccgaggagttggagcataatctggatgtgttatttgaatataaccaattggataacaaacaactacagcatgtctgggtctctggtttagatgagggaacgatagaaaaccttatgcagtatgctgaacaacatcaatggtcacttcctaaaaaacggcccctacacatgattgatcattcctttggccctacaggagagtttatttttcctgtctctctggcaatgctgtcagaggctgccaaagaaactgaacaaaatcatttaattatctatcagtcagcacagtatgctcagaaaaagagcctttgcctgattacccggaagctttatttaaggacatga

SEQ ID NO: 6700 - protein, 415 aa, Escherichia coli
MTRQRRKKVVMSLLIIANVHVAVGLSVLNQKIVSSHNMGWPVPDIPERKMLPEPVYRRWIILLISMLTVGTLFILSVWNSATYWDIFIYGVLPMLFLWLCLFGIALNKYEQSVAACISWESERQQVKQLWQHWSQKQLAIVGNVLFTPEEKGMSVLLGPQEEIPAYPKKARPLFSASRYSLSSIFHDIHQQLTQQFPDYRHYLHTIYVLQPEKWRGETVRQAIFHQWDLVPERTNTLNQIQSLYDERFDGLILVVCLQNWPENKPEDTSELVSAQLISSSSFVRQHQIPVIAGLGRVMPLEPEELEHNLDVLFEYNQLDNKQLQHVWVSGLDEGTIENLMQYAEQHQWSLPKKRPLHMIDHSFGPTGEFIFPVSLAMLSEAAKETEQNHLIIYQSAQYAQKKSLCLITRKLYLRT

SEQ ID NO: 6701 - DNA, 3354 bp, Escherichia coli
atgcatactcagcgttacggtttctggggatatttaattctgattattggtttggcagggatttgcgctctgttaattattattaatcaggatgttctgataaagagcggagtgtctgctcgtctgatatggggaatatgggcgggattattttctctttttttacttggggttgtgtgttcgccgttctggtggatccggaagcaaaggaaagcgcaatttatttacagaccaaaaaattcggcagaaaacgaccaacccgtatcttctccatcagaggatattttaaccgatctcagctcaaatattcggttacgctatggtccgttctggcggcgtaaagtccgcctgctgctggtgaccggcgagcctgaagaggcagaggccatcgcgccggggctgaccgggcaacactggctggagggcgaccacaccgtgctgatatatggcggcaggccaacagcggagcctgatgtcacactgctgaccgccttaaaaaaactgcgccgcagccgtccgctggacggcatcatctggccgctgacagaagaacaaagccgccagaccgcacaactcgacaaaggctggcgcgaactgataaacggcggtaagcgactcggttttcaggctccactctatttgtggcaggtctgtgacgacggtgattatcagaccggacgccccctgcaaagcgtcggctgcctgctgccggaacgctgtaccccggaacaactggctgtaatgctggaagcacaaaccctgccgctgacggaacagggcatgtcgcaactgctggcggataaccgccatgatttcctgctgcgtctggcccatacccttgcagagcggggtatcgctcactggcaaagcgttctgaaaccgctgctggcaggcggcgcattttcttccctgcgcctgcgtggcctgatgttcagcccgccgcttgccgccgtgccggaggccgcacctcatgcgtggctgccgtcaccggtctgggcgggcgtgacgggtgataacgcgcgcgggcgcacggtgggttttccgtggctgcgtaccgcactgatgtccgctgtctgcgtgctggtgatatggggggccggaatgacgacctcgttcttcgccaaccgcgctcttgttcaggaaaccggtatccagacggcgcgtgcgctcgatacccgcctgccgctggcagaacaactggtggcgctgcataccctgcagggcgaactggaacgcctgcaataccgtatccgcgaaggtgcgccgtggtatcagcgttttggccttgaacgtaaccaacaactgctcgccgccgcttttcccggctatgcgcaggcggcaaaccggctggtgcgcgacgtggccgttgaccatctgcaacagcaacttaatgcctttgtcgcgctgccgcccaacagtcctcagcgtaccgccaccggtgaacaacgctataagcagcttaaggcattgctgatgacttcccgcccggaaaaggccgacgctgcctttttcagtaccacgctgatggcggacggtctgcgctacgagaatatcccggaaggtgtgcggcagagcgtgttgccgtcactgctgaccttctggacggcgaacctgccggaacacccgcagtggaaaacatcgccgccaccggaactgaccggcgcagtgcgtaaaatcctgctgcgccagattggtgtgcgtaatgccgaaaacaccctctaccagaacgtgctgcaacaggtgtcccgcaactacgccgatatgacgctggcggacatgaccggggataccctcaccgaatctcttttcagtacggaacagacggtgccggggatgttcacccgtcaggcgtgggaaggacaggtcagggaagccatcgagcaggtggtgacggcgcggcgcgaggaaatcgactgggtactcagcgaccgccagcaggatacctctgcggatatctcgccggatacgctgcgtaaccgtctcacctcacgctactttaccgactttgccggaagctggctggcgtttctcaacagcattcgctggaaaaaggaagactcgctctccggcattctcgaccagctgacactgatggccgatgcccgtcagtcgccactgattgcgctgacggacaccctcgcgtggcaggcggcggcaggcagggaaaaccgtggcctgtcagactcgctggcgaaatcggcacaggaactgtttaacggcaaggagaaaacgccgcagcaatcccgtgaaggcaacgagcctgtcgggccgctggataaaaccttcgcgccgctactgcggttgctgggcgataaggcaggaggcggtggtggtgatacgcaactcagcctgcaaacgtatctgacccgcgtcacccgcgtgcgtctcaaactgcaacaggtgaccaacgcccccgacccgcaggagatgacccagcaactggcgcagacggttttacagggcaaaaccgttgacctcaccgacacccgcgactacggacggttaatcgccgccagtctgggcgaggaatggagtggcttcggtcaggcgctgttcgtccgcccggtggagcagtcgtggcggcaggtgctgacgcctgcggcggacagcctgaaccgtcagtggcagcgggcgatagtcagccactggaatcaggacttcgccgggcgctatccgttcaaagcctcacaaaacgatgcctctcttcccctgctggcacagtatctgcgcgatgacgggcgcatcaaccagtttatcgccgccaacctttccggtgttctgaaacgtgaaggccgctactgggtggctgacgccatgaacacgcaggggctgacggttaacccggactttatccgcgccctgaaccgcctgcgtgacgtggccgacaccgcctttgccagcggcgatgcgggaatacatttcgaactgcgggcaaaaccggcgtgtgacgtgatgaaaacgcatctggtgattgacgggcaggagctggaatatttcaaccagaaggaacgctggcagcgtttcaactggccggatgaacagtggcaacccggcgcatcgctgagctggaccagcacgcaggcgatggaacgcattctggcggattaccggggaagctggagccttattcgcctgctggaacaggcgcaggtgacaccggtggacagcagcacctttaaggtggtgtggaaagcgcaggatggcctgccgctgaattacctgctgcgggttgaacagggtaaagggccgctggcgctgctggagctgaaaaacttccgcctgccgggacaggtatttctgaccggcaggagtatgaaggatgcggaagagtatggggaagacgccgatgagtga

SEQ ID NO: 6702 - protein, 1117 aa, Escherichia coli
MHTQRYGFWGYLILIIGLAGICALLIIINQDVLIKSGVSARLIWGIWAGLFSLFLLGVVCSPFWWIRKQRKAQFIYRPKNSAENDQPVSSPSEDILTDLSSNIRLRYGPFWRRKVRLLLVTGEPEEAEAIAPGLTGQHWLEGDHTVLIYGGRPTAEPDVTLLTALKKLRRSRPLDGIIWPLTEEQSRQTAQLDKGWRELINGGKRLGFQAPLYLWQVCDDGDYQTGRPLQSVGCLLPERCTPEQLAVMLEAQTLPLTEQGMSQLLADNRHDFLLRLAHTLAERGIAHWQSVLKPLLAGGAFSSLRLRGLMFSPPLAAVPEAAPHAWLPSPVWAGVTGDNARGRTVGFPWLRTALMSAVCVLVIWGAGMTTSFFANRALVQETGIQTARALDTRLPLAEQLVALHTLQGELERLQYRIREGAPWYQRFGLERNQQLLAAAFPGYAQAANRLVRDVAVDHLQQQLNAFVALPPNSPQRTATGEQRYKQLKALLMTSRPEKADAAFFSTTLMADGLRYENIPEGVRQSVLPSLLTFWTANLPEHPQWKTSPPPELTGAVRKILLRQIGVRNAENTLYQNVLQQVSRNYADMTLADMTGDTLTESLFSTEQTVPGMFTRQAWEGQVREAIEQVVTARREEIDWVLSDRQQDTSADISPDTLRNRLTSRYFTDFAGSWLAFLNSIRWKKEDSLSGILDQLTLMADARQSPLIALTDTLAWQAAAGRENRGLSDSLAKSAQELFNGKEKTPQQSREGNEPVGPLDKTFAPLLRLLGDKAGGGGGDTQLSLQTYLTRVTRVRLKLQQVTNAPDPQEMTQQLAQTVLQGKTVDLTDTRDYGRLIAASLGEEWSGFGQALFVRPVEQSWRQVLTPAADSLNRQWQRAIVSHWNQDFAGRYPFKASQNDASLPLLAQYLRDDGRINQFIAANLSGVLKREGRYWVADAMNTQGLTVNPDFIRALNRLRDVADTAFASGDAGIHFELRAKPACDVMKTHLVIDGQELEYFNQKERWQRFNWPDEQWQPGASLSWTSTQAMERILADYRGSWSLIRLLEQAQVTPVDSSTFKVVWKAQDGLPLNYLLRVEQGKGPLALLELKNFRLPGQVFLTGRSMKDAEEYGEDADE

SEQ ID NO: 6703 - DNA, 1638 bp, Escherichia coli
atgcggaagagtatggggaagacgccgatgagtgaactgttgcaaaagctgacccgtagctgttttgccgaccgggatgcactggatgtggcgcgaacacaggcggcgctgtggcagacatggctgctgccggtgacggcagacacgccggtcggggaagaccccggctaccacgacgatttcctgcgtatacgcgacgaaatgaacaaactttccggcacagataccggccttatctgccagcttgccgaatccctgctgctgacgcaggccaaagacgtgcgcatcgccacttactacatctgggcgcgactgcaccgcgacggtgagcgcggactggcggaaggactggcgctgctgaccggactggtggaacgcttcggtacgcaactgctgccctcgcgtccggccagccggaaaatggcgctggagtggctggcaggggaaaagatgctcgacagccttgcccgctacccggaagtggcaaaagaggattttgcgaacattgttgccgctcttaatcaactgacggtttccttcactgcatggcccgaagaccagcattccccctccctgatgccactgattaacgcgctggaatcacgtctggcgcagtcgggcgggatgaacgcggtggtgccgcaaaacagcagcagcgttactgcaccgtcatccccggtggatgcgccacaggtacagaccatcacctccgggcgtgacctgctcgaccaggcgaaagtgctggcccgttatctgaacgaacagccgcagggctggctttcggcgcaccggctgatgaaaaccctgcgctgggacacggtgcatgaactgccgccggatgtggacggcaaaacccggctggccccgccgcgcaccgagtcacgcaaccagcttaagcggctgtatgcccagcagaactggacggaactgctggagcaggccgacctgatgttcagcaccggcgtcagccatttctggctggatatccagtggtatctgcatcaggcgctgactaaggcgggcgtaccgtgggacaggtggacagctgttatccgtcaggacctggcgttactgctggaacgcctgccagggctggaaaatctggcatggaacgacggcacgccgttcgccgatgaggtgacgcgcaactggatagcgcagcaggtcatgatgcgggaagacggcgcatggcttgcggggaaagccgctgtaccgacagacgacgccacaaatgacgtactggcgctggagccggaagcactggcgatggcagacagtcagggcgtggaagcggcgctgggctggatacagacccgtccgggcatcaccacggcacgacagcgcctgttattgcgactgctgatggcgcgggtggcggaacagtacggtaaaaacgagatggcgctcctgctgctggaagaactggataccgccgcacagggaataacgctgacgcagtgggagccagaactgctgtttgaagtaaaagcccggcaactgaaactgctgcgtctgcgggcgcaccgctatgcggataaagccctgctgaaccgaaaaatggaaatcctgctgggaacgctggtggcaatcgatccggcacgggcagcggtactgtgtgatacgcaacataaggactga

SEQ ID NO: 6704 - protein, 545 aa, Escherichia coli
MRKSMGKTPMSELLQKLTRSCFADRDALDVARTQAALWQTWLLPVTADTPVGEDPGYHDDFLRIRDEMNKLSGTDTGLICQLAESLLLTQAKDVRIATYYIWARLHRDGERGLAEGLALLTGLVERFGTQLLPSRPASRKMALEWLAGEKMLDSLARYPEVAKEDFANIVAALNQLTVSFTAWPEDQHSPSLMPLINALESRLAQSGGMNAVVPQNSSSVTAPSSPVDAPQVQTITSGRDLLDQAKVLARYLNEQPQGWLSAHRLMKTLRWDTVHELPPDVDGKTRLAPPRTESRNQLKRLYAQQNWTELLEQADLMFSTGVSHFWLDIQWYLHQALTKAGVPWDRWTAVIRQDLALLLERLPGLENLAWNDGTPFADEVTRNWIAQQVMMREDGAWLAGKAAVPTDDATNDVLALEPEALAMADSQGVEAALGWIQTRPGITTARQRLLLRLLMARVAEQYGKNEMALLLLEELDTAAQGITLTQWEPELLFEVKARQLKLLRLRAHRYADKALLNRKMEILLGTLVAIDPARAAVLCDTQHKD

SEQ ID NO: 6705 - DNA, 1578 bp, Escherichia coli
atgggaacaggctactttctggtcaggggggacaaaaccacctgcggcgggaagattattgaaggcgcggacgaccatacgatcatgggtatcccacaggcacgggatatggatcgggtcacctgcggcagatatccgggaatgtttattattgtgggcggcgtgccggaaacggatattcacggcaggctgatggcgggatctctggacagccagagcagttgcccgtgcaaggcgcggtttattgcgtcaatgatggatgatacctatgaaacggatgacgggggaagcgagccggaacaacatgcgcagtcggcgaggaaaaatctgacttccggtaatccagataaaaaatacagtcatcagataaaacttcaacatggcgaaaataatgttagtgtacaggacataccttatgtctttatcctaaataataacatgtctctcagtggcaagactaatcaggatggcgagactgagagaatatatacagatactgctcaaaaggtaattgcacttacaggaaaactggctgattcctggctgaaaagagggaaaaattttggttcattaaaagaaattgacaatagaaagatcgaattaacaactgaagagaatgaacctgtaaaatatgtcaactggattaatgggcgtgattatattgtgattgtggcggccagaacagccgtaacaaactggataggaatggaggactcaaaaggaaatcagtatcgatttataaattgtggattagaacaattacaacagtttcctccagccagtaaacaggattccagttcgcagcgaattatggtggttttttcgcttgggtatacgcaaaaagatattgatagaattaatgattatactaaagcgcacgatggaagaattatctatgtcaagaataaggatgaattagtttcattcctgaatcaacgcaaagaaaaaggaagagtgattaaggaactggttattctgtgccacggtgttattaaaacagcttcatatcattatcatcatgaagacaaggatattgaaaaaaatggaatgtttaaacatgaagatattgcagcagttcacgagtcagtttttgattatgatgcccatgtgacaacatatgcctgtcgggccggtatctcagatggtgataaagatttttccgggaaggatgatgcagggcaaaaggacagcccggcacagaaaatggctgataactgggatgtcatggttaaagcgtttgagatgagatcggactacagtctggcttatgggacaggcaaggaaattaaagaagctcaggaatatggtagtgtggtagaaaaatataaaaaagatatagatatgtataataaagaaaaagcaaaggggaatactgaagtttcccctccagtgaaaccagagggatatgatgagaaatcaaaacgccatgcagatgttactaccagagacaaaaatgaaaagtctggcggaggaccaatagctcctaatggtgcatggcatatgccaagaacaggggattcgccgaaagggctgaaaagcgggttacaggattatcagcctgaggagtgggttcaataa

SEQ ID NO: 6706 - protein, 525 aa, Escherichia coli
MGTGYFLVRGDKTTCGGKIIEGADDHTIMGIPQARDMDRVTCGRYPGMFIIVGGVPETDIHGRLMAGSLDSQSSCPCKARFIASMMDDTYETDDGGSEPEQHAQSARKNLTSGNPDKKYSHQIKLQHGENNVSVQDIPYVFILNNNMSLSGKTNQDGETERIYTDTAQKVIALTGKLADSWLKRGKNFGSLKEIDNRKIELTTEENEPVKYVNWINGRDYIVIVAARTAVTNWIGMEDSKGNQYRFINCGLEQLQQFPPASKQDSSSQRIMVVFSLGYTQKDIDRINDYTKAHDGRIIYVKNKDELVSFLNQRKEKGRVIKELVILCHGVIKTASYHYHHEDKDIEKNGMFKHEDIAAVHESVFDYDAHVTTYACRAGISDGDKDFSGKDDAGQKDSPAQKMADNWDVMVKAFEMRSDYSLAYGTGKEIKEAQEYGSVVEKYKKDIDMYNKEKAKGNTEVSPPVKPEGYDEKSKRHADVTTRDKNEKSGGGPIAPNGAWHMPRTGDSPKGLKSGLQDYQPEEWVQ

SEQ ID NO: 6707 - DNA, 141 bp, Escherichia coli
gtggcctatattgaagcagctcagcaggaatttgttgagaaagccagagagactgcagatgatatctgggacttgggaactatgtgggcaaaaaatgtgctaattaaaggaagggaggtactggagcatgaggtgaagtaa

SEQ ID NO: 6708 - protein, 46 aa, Escherichia coli
MAYIEAAQQEFVEKARETADDIWDLGTMWAKNVLIKGREVLEHEVK

SEQ ID NO: 6709 - DNA, 1761 bp, Escherichia coli
atggacgacctgacccaacgctactatgaagccgaaatgcgctacctgcgtgaagcgggtaaagaattcgcacaggcgtatcccgaccgtgctgcgatgcttaatcttgataaacccggcgcacgcgatccctatgtggagcgcctgttcgagggcttcgcttttttaatgggccgcctgcgcgaaaagctggacgacgatctgccggaactgactgaagggctggtcagcctgctgtggccccactacctgcgaaccatcccgtcactttccgtggttgaactgtcgacagatcaccggcagatgaagcagagcgaaacgctgagcgattttcaggtattgtcgcgccctgttggcgagcgcagaacccgctgcgtctacagtgccacgcgtgatatcacgctgcatccgctggcgttgccggacgtgtcattgcaatatgaaccggacggacgctcggttatccgtctgcgctttgcgtgcggcccgctggttggtgactggtcgcagatcgatttatcccgcctgccgctctatctcaatgccgacagcccggtagcctgtgcgttgcaccgggctttaacgcttggcacgcagcagttctggctgcgtctgccggggcaggatcgccggatgcttggcgcacacttttccccgatgggctttgaggatgatgacaggctctggccaaaaggtgagtcagccttcagcggttaccagttgctgctggagtatttcaccttccgcgagaagtttatgttcgtggcgctgaacgggctggagcaggttgcatggccggaggggataaccggctttgagattgacgtggtgctgaacgagaactggcctcacgacctgccgtttgacagcgataatatccgtctgcactgcgtgccggtcatcaacctgttcccgctcgaagccgatccgttacacctttcgccactggaaaacgaatttctgctacgcccgatgcgcattcaggacgggcataccgagatttattccgtcgacaacattatttcttcgcgccataccggcagtcaggcatatgtccccttttccagctttcgtcaccggggcgggatgctgcgccacgatgcgccggaacgctattaccacacgcgggtaaagcgcggcccttccggcttgcacgacacatggctgattctgggcggcgatgcgtttgattccgaccggatgctggaggatgaaaccctgtccttaagtctgaccggcaccaacgggcagcttccccgtaaagccttacagagcaccctgctcgatacgccagttcatgcctcacagaacgtcctgcgggtgcgcaacctgtgcgccccgacgcagccctgctatcccccggcgcgtgaccgcttccactggcgggtgctcagccacctcggttctaactttttatcgatgatggataacgccgaaattctgcgcggcacgctggcgctgtacgactggaccgaaagcgagatgaaccgccgtcgtctggaggcgattgtcgacgttcagcacagcctgatacagcgttttgaaagaggctttctgctgcgtggcgtggatattcaggtgacgctggacagtaacggctttgccggagaaggtgatatcacgctgtttggtgaactgctgcaccgcttcttcgcactgtatgccgatatccacttattcactcaactgaccttaattctgcaacccacaggaaagtgcctgcaatggacagagcatcacagccagcgcgtaccgggctga

SEQ ID NO: 6710 - protein, 586 aa, Escherichia coli
MDDLTQRYYEAEMRYLREAGKEFAQAYPDRAAMLNLDKPGARDPYVERLFEGFAFLMGRLREKLDDDLPELTEGLVSLLWPHYLRTIPSLSVVELSTDHRQMKQSETLSDFQVLSRPVGERRTRCVYSATRDITLHPLALPDVSLQYEPDGRSVIRLRFACGPLVGDWSQIDLSRLPLYLNADSPVACALHRALTLGTQQFWLRLPGQDRRMLGAHFSPMGFEDDDRLWPKGESAFSGYQLLLEYFTFREKFMFVALNGLEQVAWPEGITGFEIDVVLNENWPHDLPFDSDNIRLHCVPVINLFPLEADPLHLSPLENEFLLRPMRIQDGHTEIYSVDNIISSRHTGSQAYVPFSSFRHRGGMLRHDAPERYYHTRVKRGPSGLHDTWLILGGDAFDSDRMLEDETLSLSLTGTNGQLPRKALQSTLLDTPVHASQNVLRVRNLCAPTQPCYPPARDRFHWRVLSHLGSNFLSMMDNAEILRGTLALYDWTESEMNRRRLEAIVDVQHSLIQRFERGFLLRGVDIQVTLDSNGFAGEGDITLFGELLHRFFALYADIHLFTQLTLILQPTGKCLQWTEHHSQRVPG

SEQ ID NO: 6711 - DNA, 1080 bp, Escherichia coli
atggacagagcatcacagccagcgcgtaccgggctgaccgaccggctggccccggatattgcgcggatcaatttttaccgtttttgccagttgctggaacagagccagcagaaagcgccgctgggcagtaccgacaaccccgccgccgatgcggtgcgttttcgcccccatcccggaatgggctttccggtcagcgagttaaagaacgttgaacgtgacgtggacaatcccgacgcgccacccacggtgcgcaccacctttctcggcctgtacggcgtggattcaccgctgcccaccgcctatctggactacattacccagcgtcatgacggacatgacgcagtgatggcgtttctcgatatttttaaccatcgctttatcacccagtattaccgcatctggcgcaaatataactacccggcgtcgtttgaagcaggtgccgtggatgacatttcccgttgtctgctggggttaatcgggctgggtattcccggcagcgagaaccatatcgccacgcctgtatcccgttttctggccctgctcagcgtgatgcgcctgcccacccgcacggctgaaggcgtcacggcactggtggggctgcttgccccgctgacgaaagccacggtggtgcctcacgatccgcagcctgtaattctcccggcccctgcgggtctgtcaaaaaattcacgcatcagcctgaaaacgcgaacgctgctggggcgtaccggtaccgacgtcaacagccagttgctgctgaaactgtataccgaagatgccgcagaagcacgtggctggctgcccggcgggcaactgcacagcgatttgctggtgctgctgcgcgtttatctgggctggcgctgtcaggcccgtctgcaactgacgctgcccgtcagcctgttgcctgctgcccggctgggaaaacagcgtgtacagattagccgtaccggcatccttcgcgcctcctttgccgcgcccgcgaccggaacagtgacggtcagtctggggcgttatcagggattaatacccgctttttccattcgtaacagggagagtatgactcatgtttcctattcgttttaa

SEQ ID NO: 6712 - protein, 359 aa, Escherichia coli
MDRASQPARTGLTDRLAPDIARINFYRFCQLLEQSQQKAPLGSTDNPAADAVRFRPHPGMGFPVSELKNVERDVDNPDAPPTVRTTFLGLYGVDSPLPTAYLDYITQRHDGHDAVMAFLDIFNHRFITQYYRIWRKYNYPASFEAGAVDDISRCLLGLIGLGIPGSENHIATPVSRFLALLSVMRLPTRTAEGVTALVGLLAPLTKATVVPHDPQPVILPAPAGLSKNSRISLKTRTLLGRTGTDVNSQLLLKLYTEDAAEARGWLPGGQLHSDLLVLLRVYLGWRCQARLQLTLPVSLLPAARLGKQRVQISRTGILRASFAAPATGTVTVSLGRYQGLIPAFSIRNRESMTHVSYSF

SEQ ID NO: 6713 - DNA, 537 bp, Escherichia coli
atgtttcctattcgttttaaacgtccggcgttgctctgtatggcgatgctgacggttgttctgagtggctgcgggctgattcagaaagtggtggatgaatcgaaaagcgtggcctcagccgttttctacaaacaaatcaaaatactgcatctcgatttcttctcccgcagcgccctgaatacggatgcggaagatacgccgctttccacgatggtgcatgtctggcaactgaaaacccgcgaagattttgacaaggcggattacgacaccctgtttatgcaggaagagaagacgctggagaaggacgtactggcaaaacacaccgtctgggtaaaaccggaaggcacggcatccctgaatgtgccgctggataaagagacgcagtttgtcgccattattgggcagttttatcaccctgatgaaaaaagcgacagctggcgtctggtgatcaaaagggacgaactggaggccgacaagccgcgctcgattgaactgatgagaagcgacctgcgactgctgcctctcaaggataaataa

SEQ ID NO: 6714 - protein, 178 aa, Escherichia coli
MFPIRFKRPALLCMAMLTVVLSGCGLIQKVVDESKSVASAVFYKQIKILHLDFFSRSALNTDAEDTPLSTMVHVWQLKTREDFDKADYDTLFMQEEKTLEKDVLAKHTVWVKPEGTASLNVPLDKETQFVAIIGQFYHPDEKSDSWRLVIKRDELEADKPRSIELMRSDLRLLPLKDK

SEQ ID NO: 6715 - DNA, 429 bp, Escherichia coli
atgtcgacaccttccttatatgaaatgctgacgttcagtttcagcggcgagttaccgctggaacagatcagcgagcgggatcagcttatcctttccgtgatggacaatatgcaacgcattatcaactgccgggcaggcacgctggcgcatttgccggattacggtctgccggatctcagtctgatccatcaggggatggctgcgggtattcatggcctgatgcgtcagattgaagaaacactgctgcgttatgaaccacgcctgagtcagatacaggtggaattactcccccagccccgtccggggcatcttaattacctgatccacgcgcagcttcccgataccggctggatacgctttgatggcgtattttctccggaaggacgaattgttctgcgtcatctcaaacagcaggagcgggcgtactga

SEQ ID NO: 6716 - protein, 142 aa, Escherichia coli
MSTPSLYEMLTFSFSGELPLEQISERDQLILSVMDNMQRIINCRAGTLAHLPDYGLPDLSLIHQGMAAGIHGLMRQIEETLLRYEPRLSQIQVELLPQPRPGHLNYLIHAQLPDTGWIRFDGVFSPEGRIVLRHLKQQERAY

SEQ ID NO: 6717 - DNA, 153 bp, Escherichia coli
atgtccgctgccgggagatttcaggggatggaacgggtggactggcatccttatcgttttgctgaacggatctggttgcaaaaaccggctgtggactttcctctgactttttcggttgattcatttcccggcggggtaattcagggggagtga

SEQ ID NO: 6718 - protein, 50 aa, Escherichia coli
MSAAGRFQGMERVDWHPYRFAERIWLQKPAVDFPLTFSVDSFPGGVIQGE

SEQ ID NO: 6719 - DNA, 1377 bp, Escherichia coli
atggcaagtaacgcgaattttatcagccagttcgtcatgggcggcgatccctgtacgtataaggaatccggtgaactgcaggctgaaatgagtaaactgactcacccggcccggccagacgtggactggcgccaagtggaaaaactcagcctcgcgctgttccggcaaaatggcgtggaactacagacgctggtctgttacgtactggcgataaccagacggcaggggctggcagggatggcagacggactcggttcactggatatactgctccagcgctgggctgacttctggccggtacaggtacattccagaatatcactgctcagctgggtcacagaaaaaatgcagcaggcactgagaacgctggatattcagtatcaggatctgccgcagatctaccgttgtgtacagcatctttctaccatagaaaccacgctgcaacagtgtgaactgtggcatatgacgaagctggacgtattgtccgggcagtttcgcaataccgcattgcgtctggaacggctggcgcctcagggagcggaaaccactatcactccccctgaattaccccgccgggaaatgaatcaaccgaaaaagtcagaggaaagtccacagccggtttttgcaaccagatccgttcagcaaaacgataaggatgccagtccacccgttccatcccctgaaatctcccggcagcggacatggccgatatttatggccggaatggttgtgatggccggtctcggcggaacaggattatggggctggtcgcagcttaatcagccggacgcgctaatccagcgaatacaactgtctgtcatgccgttgccgcagtcgctggagagcggcgaactggcaaagctggatgtaaaggataaggcgctgctggctcaggacagaacaattgcggcaagtcagatgcaactggagcagttaaacaaattgcctgcccgctggccactggagcaaggatatcgccagctacgccagcttgatgccctgtggccggataatcctcaggtcagggcgctgaacgcgcagtggcgcaaacagcgggagctgagcgccctgtctgctgaggcactgaatggctatgctcaggcgcagagccagctacagcgcctgtcggcgcagctggatgcactggatgaacgtaaggggagatatctgaccggttcggaactaaaaacggcggtgtacggcatccggcagtcgttaaaggagccgccgctggaagaactgcttcggcaactggaagagcaaaaacagaccggagaggtttcgccaacgctgttgacgcaaattgatacccggttaaatcagttgttgaatcgctatgtcattttactggatacgaaggtggaacaaagtcagtaa

SEQ ID NO: 6720 - protein, 458 aa, Escherichia coli
MASNANFISQFVMGGDPCTYKESGELQAEMSKLTHPARPDVDWRQVEKLSLALFRQNGVELQTLVCYVLAITRRQGLAGMADGLGSLDILLQRWADFWPVQVHSRISLLSWVTEKMQQALRTLDIQYQDLPQIYRCVQHLSTIETTLQQCELWHMTKLDVLSGQFRNTALRLERLAPQGAETTITPPELPRREMNQPKKSEESPQPVFATRSVQQNDKDASPPVPSPEISRQRTWPIFMAGMVVMAGLGGTGLWGWSQLNQPDALIQRIQLSVMPLPQSLESGELAKLDVKDKALLAQDRTIAASQMQLEQLNKLPARWPLEQGYRQLRQLDALWPDNPQVRALNAQWRKQRELSALSAEALNGYAQAQSQLQRLSAQLDALDERKGRYLTGSELKTAVYGIRQSLKEPPLEELLRQLEEQKQTGEVSPTLLTQIDTRLNQLLNRYVILLDTKVEQSQ

SEQ ID NO: 6721 - DNA, 948 bp, Escherichia coli
atgaaaaatgttctggtcaccttccccagcttttcagcacgctgtgtttccgccagcaagttgctaagagagaataattttaatcttattattaagaataatgtggagcatctgcttaaatcagaatccactgcattacgagaatctatttgcgcggtcatcgccggaaaagatggttatcaggcggacacgctatcattgctgcctggtgtgagaataatatcgagattcgggacggggatagacaatattgatcttcgtgcggcacagcaatccggtattgttgtcaataatgcggttgggattaattcaaatgcggttgcggaatttatcattggacttatcttcgcgagcatgagaaatatccctggcagctatcatgcgatgcaaaatggctactggggggagtcgcatggctgtgaattacaagggaaacggattggcctggttggctacggtaatataggtaaaactctggcgaaaaggttatccggttttgatgttgagcttttagcttttgacaaacaacccgactatcaggttgctgacaaagctggagttcagtttgtatcaattgaagatatctttatgcagtcgcatgtcatcattgttcttttgcctttttcttctgagctggagaacttcattagtcataaatatttgtcgatgatgcgcaatggtgctctgatcatcaatgccgcaaggggaaagttgctggatgagggcgctttacttcaggtgattgaagaacgaaatgtgtttgcggcgctggatgtgtttagctctgaaccgttggcgcaatttagcccactgctacatgccaaaaatatcattacaacgccgcatatcgcggccgccaccgttgagtcataccagcaaaccgggatacacgttgcccagtcgataattgattacttcgcaggaagggagataaaaaacgtgttgtga

SEQ ID NO: 6722 - protein, 315 aa, Escherichia coli
MKNVLVTFPSFSARCVSASKLLRENNFNLIIKNNVEHLLKSESTALRESICAVIAGKDGYQADTLSLLPGVRIISRFGTGIDNIDLRAAQQSGIVVNNAVGINSNAVAEFIIGLIFASMRNIPGSYHAMQNGYWGESHGCELQGKRIGLVGYGNIGKTLAKRLSGFDVELLAFDKQPDYQVADKAGVQFVSIEDIFMQSHVIIVLLPFSSELENFISHKYLSMMRNGALIINAARGKLLDEGALLQVIEERNVFAALDVFSSEPLAQFSPLLHAKNIITTPHIAAATVESYQQTGIHVAQSIIDYFAGREIKNVL

SEQ ID NO: 6723 - DNA, 597 bp, Escherichia coli
atgaataacacggatcttatctatctcattaaacattttatgcataacgaacttaaagcagtagaagaggttatttattccccactttctgaattcgctaatttaattaaagtattacaatcttgtcagggaaaagttgtttttattggtgttggtaagtccggtattattgccagaaaactcgcagcaacttttgccagtaccggaactccctcgttttttgttcacggtacggaagcggtacacggcgaccttggaatggtggcgaaagacgatgttgttattcttatttcaaacagtggtgagacggcggaaatcctggcgacactgcctagtttgaaaaaaatgggtaattatttgatctcttttacccgcagtcatcactcatcgcttgcgataagttgtgatttatctgttgaaatccccgtcaaaagtgaggcggataatttaggtttagcaccgtcatgctcgtcgactgttgttctggttgttggtgatgcggtggcgcttgcactctctgaattgaaaaagtttactcgtgctgatttcggcttatatcatccaggaggtgcactcggcattaaagcaaattcataa

SEQ ID NO: 6724 - protein, 198 aa, Escherichia coli
MNNTDLIYLIKHFMHNELKAVEEVIYSPLSEFANLIKVLQSCQGKVVFIGVGKSGIIARKLAATFASTGTPSFFVHGTEAVHGDLGMVAKDDVVILISNSGETAEILATLPSLKKMGNYLISFTRSHHSSLAISCDLSVEIPVKSEADNLGLAPSCSSTVVLVVGDAVALALSELKKFTRADFGLYHPGGALGIKANS

SEQ ID NO: 6725 - DNA, 1176 bp, Escherichia coli
atggatgtttttaatactcctgtttcccgcaaaggaacatattgtacccaatgggacttttgcgaggacagatttggtgtaaaagatgtactaccattctctatttcagatatggatcttccgataccagacgctatcaccagagcattaaaaaaacgcctggaacacccgattttagggtacagtcgttggcaacatggtgaatatctgaatgcgatagtaaactggtattatcaacaatatcaaacagatattaaacctgaatggataacctatagccccagtgtgatgtactctattgcaaaagcaatagagttattgacatcgcatggtgataatattctcgtttttacacctgtctataatgcattttttgatgtaattaaacatagcgagcgaaatattctgacagcctctttgattataaaaaatgaggggggctacgctatcaactggcaagattttgatcttaagattaaaagcgcaaagatggtgttattatgtaatcctcataacccgacaggaacagtctggtcggaagaagaactgcataaaatcgctgcaagctgtacaaggcataatgtctggttatgttcagatgaaatccatagtgattttgtttttaatcgtagctttacatccgcgcttaaaataaaaaaagaaaaagtagtagtatttaactcgatatcgaaaacatttaatgttcctgcactaacaggatcgtatatgatttcaactgacgataattttaatcataagttcagaacgatatcgaggtatcgcgattttgtaaactccccatcagtactgaatataattgcaactattattgcctataacgaatgtgagggatggttaaagtcattaaaggcacatattgcctctaacattcaattcacccagcagtatctgaatgaaaatattccagaattgatcgtaaggccagctgatggttgctatttttcctggatagattgttctgctattggttatccttttgatgaattctacagtcgattaattcatgaaggcaaagtgggcattatggcggggcatgtctatggaacggagggggagggctaccttcgtctgaacctggcctgcggtcgagaaaaattatatatggggcttacgcgtcttgtgagtgtaattaaaaatattaatcagggagaataa

SEQ ID NO: 6726 - protein, 391 aa, Escherichia coli
MDVFNTPVSRKGTYCTQWDFCEDRFGVKDVLPFSISDMDLPIPDAITRALKKRLEHPILGYSRWQHGEYLNAIVNWYYQQYQTDIKPEWITYSPSVMYSIAKAIELLTSHGDNILVFTPVYNAFFDVIKHSERNILTASLIIKNEGGYAINWQDFDLKIKSAKMVLLCNPHNPTGTVWSEEELHKIAASCTRHNVWLCSDEIHSDFVFNRSFTSALKIKKEKVVVFNSISKTFNVPALTGSYMISTDDNFNHKFRTISRYRDFVNSPSVLNIIATIIAYNECEGWLKSLKAHIASNIQFTQQYLNENIPELIVRPADGCYFSWIDCSAIGYPFDEFYSRLIHEGKVGIMAGHVYGTEGEGYLRLNLACGREKLYMGLTRLVSVIKNINQGE

SEQ ID NO: 6727 - DNA, 1581 bp, Escherichia coli
atgaaacaaaagaaagcctggagtttttttcagagcctggggaaggcatttatgtatcccattgctctgctaagtgtatgtggcatgatgctagggctgggaagtggtttagccagtgatgatatggcaaagttaattccatttctggctattccaataattaaaaccatacttgatttcattgttagtcttggtttgtttgcctttgttaatttacctgtattgtttgcgatagcgattcccttaggattattaaaagataaagaggataaagcctatggtgctttttctggcttaattggttttatggcgatgcatctgggaacgaacttttatcttaaacagcacgacttattggtcgttgctgaccaaatgtcgacacatgggcaaaccatcattctggggatccagtcctacaataccagcgtgttggggggaattgttgctgggttattagtcgccagcatgtataaaaagatcgttaatttacgcattccagaatcattaggtttttatagcggcccacgtctggtgcctatcattacactgattgtgatgagtggatttggtctgatcattccttttatctggccgccgtttttcaatcttttcatgctcattggacactggatttcaacttccggtcctgttggttatttcttctatgcagttgccgaacgtgtgacgattccttttggcttaaaccatctggtgacgtcagttttccgctttacgccaatcggcggttcggctgtgattggcggcgaagaatattacggcaccctgaacatgtttatggcatacgttaaagagaatgcggtcattccgctggatttggcggggaaaatggagcagggcaaactgatgattcagtatggtctggctggtgccgcgctggcgatgtatcgcactgctcatgctcaaaacagaaaggctatcaaagcattgcttatttccggggtgcttacggtgattattggcggcgtcagcgaaccgattgagtttctgttcttatttgtcagtccactgctgtttgtcttccatgcctttatgaatggattcgctaacatggttctgccatatatgggcgtgaagatgggatttactggcgatctgattcaatttattagttttggcgtattgcgtggcacaagaacaggttggccgatcgcggtgtgtgtcgaagtggcctatttcttcatttattactttgtgttccgttggaccattcttaaatttaacctgatgaccgtaggccgtgaagagtccaatcctgtcacgctgaacgttcacgaagatacggctatagcggatatcccaactcctgataaatcagagctgcaagcggcggagcagatggttaaggcacttggtggtaaagagaatattaagtcactggataattgcgtaactcgtttacgtttaacaatcgcagatatgggattgattgacgaagttgcaataaaaagagctggcgggattgcggttgttaaacttgatcaaaataccctacaagtcattatcggcactaaagtcatcgccctgcgtcgggatatggataactatatggggatatactga

SEQ ID NO: 6728 - protein, 526 aa, Escherichia coli
MKQKKAWSFFQSLGKAFMYPIALLSVCGMMLGLGSGLASDDMAKLIPFLAIPIIKTILDFIVSLGLFAFVNLPVLFAIAIPLGLLKDKEDKAYGAFSGLIGFMAMHLGTNFYLKQHDLLVVADQMSTHGQTIILGIQSYNTSVLGGIVAGLLVASMYKKIVNLRIPESLGFYSGPRLVPIITLIVMSGFGLIIPFIWPPFFNLFMLIGHWISTSGPVGYFFYAVAERVTIPFGLNHLVTSVFRFTPIGGSAVIGGEEYYGTLNMFMAYVKENAVIPLDLAGKMEQGKLMIQYGLAGAALAMYRTAHAQNRKAIKALLISGVLTVIIGGVSEPIEFLFLFVSPLLFVFHAFMNGFANMVLPYMGVKMGFTGDLIQFISFGVLRGTRTGWPIAVCVEVAYFFIYYFVFRWTILKFNLMTVGREESNPVTLNVHEDTAIADIPTPDKSELQAAEQMVKALGGKENIKSLDNCVTRLRLTIADMGLIDEVAIKRAGGIAVVKLDQNTLQVIIGTKVIALRRDMDNYMGIY

SEQ ID NO: 6729 - DNA, 825 bp, Escherichia coli
atgatcatcgaaaaagtcatgaacaataattgtgtacaggcatcgatgaatggacaggaggttatcatttctgggcctggcgtcggttacaacaaaaaatatggaatgtcggtccctgagcatccggctaaccggattttttatgtcagaaatgaacaaaaaaacaaactttataaattgattgaacatgtagatattgagtatgtgtttgttgccgaaaaaatagtgcaatatgcggagaaaaatctcgaaaaaaatctcaatccatcgctactattgattcttgcggatcacatttcgaatgcaatatcccgagtcgtttcaggtatacaaattaataatgttttccttgatgaaatcaaagcgttgtacaaagcagagtatgcgataagtcgcgatgcattaactatcattaatgagcaattcagcgttcaacttcctgatgatgagattggttttatagcattgcatattttaaataattatgaaaattcagttgattatgaatcagtacggattattgagttgtcgcaaataatcacggagcttattgaagttgtttataacagaaaggtggacagaagttcatttaactattccagatttatgatgcaccttaaatatttttcaagtcgcgtgttatgcaatgaaaaaataaaacagaaagatattggtgatatctatgaacagtttcttgaaaaggacatcctgttacagcgcgcaattcatgaaattgaacggtatctgtatgccacttttaaatatgaattaattttagaagaaaaattatatctctctattcgtaccaaagtattaatggactaa

SEQ ID NO: 6730 - protein, 274 aa, Escherichia coli
MIIEKVMNNNCVQASMNGQEVIISGPGVGYNKKYGMSVPEHPANRIFYVRNEQKNKLYKLIEHVDIEYVFVAEKIVQYAEKNLEKNLNPSLLLILADHISNAISRVVSGIQINNVFLDEIKALYKAEYAISRDALTIINEQFSVQLPDDEIGFIALHILNNYENSVDYESVRIIELSQIITELIEVVYNRKVDRSSFNYSRFMMHLKYFSSRVLCNEKIKQKDIGDIYEQFLEKDILLQRAIHEIERYLYATFKYELILEEKLYLSIRTKVLMD

SEQ ID NO: 6731 - DNA, 1254 bp, Escherichia coli
atgtcaggatccaacactgcaatcagccgtcgtcgtttactgcaaggcgcgggtgccatgtggctattgagcgtaagtcaggtcagcctggctgcggtcagccaggtcgtggcggtgcgcgtctggcctgcgtccagctacacccgcgtgacggtagaatcaaatcgtcagctgaaatataagcagttcgcgttgagtaatcctgaacgcgtggtggtggatatcgaagatgtaaacctgaactcggtgctcaaggggatggctgcgcaaatccgcgctgacgacccgttcatcaagtcggcgcgcgtcgggcaatttgacccgcaaaccgtacgtatggtttttgaattaaagcaaaacgtaaaaccgcagctgtttgcccttgcgccggtcgccgggtttaaagagcgtctggtgatggacctctatccggccaatgcacaggatatgcaggacccgctgctggcgctgctggaggattacaacaaaggcgacctcgaaaagcaggtgccgccagcacaaagtggtccacaaccgggtaaagctgggcgggatcgtccgattgtcattatgcttgaccctggccacggtggcgaagactccggtgcggtggggaaatacaaaacgcgcgaaaaagacgtggtattgcaaatagctcgccgtctgcgctctctgatcgagaaagagggcaatatgaaggtgtacatgacgcgcaatgaagacatcttcattccgttgcaagtgcgcgtagcaaaagcccagaaacagcgcgctgacttgtttgtttctatccatgccgacgcctttaccagtcgccagccgagcggttcctcggtgtttgcgctctcaaccaaaggcgcaaccagtactgcggcaaaatatctggcacaaacccagaacgcctcggacttgattggtggcgtaagcaaaagcggtgaccgctatgtcgaccacaccatgttcgatatggtgcagtcgctgaccattgccgacagccttaagtttggtaaagcggtgctgaataagctcggtaaaatcaacaagctgcataaaaatcaagttgaacaggccgggtttgccgtactaaaggcaccagatattccctccattctggtcgaaacggcgtttatcagtaacgttgaggaagagcgtaaactgaaaacggcgactttccagcaggaagttgcggagtctattcttgcgggaattaaagcgtattttgccgatggggcgacgctggcgagaaggggataa

SEQ ID NO: 6732 - protein, 417 aa, Escherichia coli
MSGSNTAISRRRLLQGAGAMWLLSVSQVSLAAVSQVVAVRVWPASSYTRVTVESNRQLKYKQFALSNPERVVVDIEDVNLNSVLKGMAAQIRADDPFIKSARVGQFDPQTVRMVFELKQNVKPQLFALAPVAGFKERLVMDLYPANAQDMQDPLLALLEDYNKGDLEKQVPPAQSGPQPGKAGRDRPIVIMLDPGHGGEDSGAVGKYKTREKDVVLQIARRLRSLIEKEGNMKVYMTRNEDIFIPLQVRVAKAQKQRADLFVSIHADAFTSRQPSGSSVFALSTKGATSTAAKYLAQTQNASDLIGGVSKSGDRYVDHTMFDMVQSLTIADSLKFGKAVLNKLGKINKLHKNQVEQAGFAVLKAPDIPSILVETAFISNVEEERKLKTATFQQEVAESILAGIKAYFADGATLARRG

SEQ ID NO: 6733 - DNA, 1332 bp, Escherichia coli
gtggtaaaggaacgtaaaaccgagctggtcgagggattccgccattcggttccctatatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcacatcaccacgaaccgctgtatcacaagaatatacgtgtgaccgacgccaaaacactggaactggtgaagcaggcagcgggaacattgcaactggatattactgctcgcctgtcgatgagtctcaataacacaccgctgcagggcgcgcatatcaacgtcgtcagtggtaattttattattgcccagccgctgggcgtcgatgacggcgtggattactgtcatagcgggcgtatccggcggattgatgaagacgcgatccatcgtcaactggacagcggtgcaatagtgctaatggggccggtcgctgtttcggtcactggcgagagctttaatctgacctcggaagagattgccactcaactggccatcaaactgaaagctgaaaaaatgattggtttttgctcttcccagggcgtcactaatgacgacggtgatattgtctccgaacttttccctaacgaagcgcaagcacgggtagaagcccaggaagagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatattggcggtattctggagttgattcgcccgctggagcaacaaggtattctggtacgccgttctcgcgagcagctggagatggaaatcgacaaattcaccattattcagcgcgataacacgactattgcctgcgccgcgctctatccgttcccggaagagaagattggggaaatggcctgtgtggcagttcacccggattaccgcagttcatcacggggcgaggttctgctggaacgcattgccgctcaggcgaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagttttgatggcggatttagggtaa

SEQ ID NO: 6734 - protein, 443 aa, Escherichia coli
MVKERKTELVEGFRHSVPYINTHRGKTFVIMLGGEAIEHENFSSIVNDIGLLHSLGIRLVVVYGARPQIDANLAAHHHEPLYHKNIRVTDAKTLELVKQAAGTLQLDITARLSMSLNNTPLQGAHINVVSGNFIIAQPLGVDDGVDYCHSGRIRRIDEDAIHRQLDSGAIVLMGPVAVSVTGESFNLTSEEIATQLAIKLKAEKMIGFCSSQGVTNDDGDIVSELFPNEAQARVEAQEEKGDYNSGTVRFLRGAVKACRSGVRRCHLISYQEDGALLQELFSRDGIGTQIVMESAEQIRRATINDIGGILELIRPLEQQGILVRRSREQLEMEIDKFTIIQRDNTTIACAALYPFPEEKIGEMACVAVHPDYRSSSRGEVLLERIAAQAKQSGLSKLFVLTTRSIHWFQERGFTPVDIDLLPESKKQLYNYQRKSKVLMADLG

SEQ ID NO: 6735 - DNA, 1827 bp, Escherichia coli
atgaaattgcaaaagcaattactggaagctgtggagcacaaacagctacgcccgctggacgtgcagtttgccctgaccgtggcgggagatgaacatcctgccgtcaccctcgcggcggcactattaagtcatgatgccggagagggacacgtttgtttgccgctttcacgactggaaaataacgaggcatcgcatccgctgttggcgacctgtgtcagtgaaatcggtgaactacaaaattgggaagaatgcttgctggcttcacaagcggtcagccggggagatgaaccaacgccgatgatcctctgtggcgatcgtctttatttgaatcgcatgtggtgtaacgagcgcacagtggcacgctttttcaacgaagtgaatcatgccattgaggttgatgaagctctactggcgcaaaccctggacaaactttttccagtaagcgatgaaattaactggcaaaaagttgcggcggcagtggcgctgacgcggcggatttcggtgatttccggcggtcctggcaccggtaaaacgaccaccgtagcgaagttgctggcagccttaattcagatggccgacggcgaacgctgccgtatccgtctggctgcaccaacgggtaaagctgccgcgcgcttaaccgaatctctcggcaaggctttgcgacaattaccgctgaccgatgaacaaaagaaacgcattccggaagatgccagcactttgcaccgattgctgggtgcgcagccgggtagccagcgtttacgtcatcatgccggtaacccgctgcatcttgatgtgctggtggtagatgaagcgtcaatgatcgatcttcctatgatgtcgagactgatcgacgccttgcccgatcatgcgcgagtgatctttctcggcgatcgtgatcaactggcctcggttgaggctggggctgtgctgggcgatatctgcgcttatgccaacgcgggctttaccgccgagcgtgccgggcagttgagccgcctgacgggaagccacgttccagcaggaactggcacagaagcggcatctttgcgcgacagcctctgcctgctgcaaaaaagctatcgtttcggcagcgattctggcattggtcagttagctgcggcgattaaccgtggtgataaaacggcagtgaaaaccgtttttcagcaggattttactgatatcgaaaaacgacttttacagagcggcgaagattatattgcgatgcttgaggaagctcttgcgggttacggacgttatctggatctgctgcaagcgcgtgccgagccggatttaatcattcaggcgttcaatgagtaccagcttttgtgcgccctgcgggaagggccgtttggcgtggctggactgaatgagcgaattgagcagtttatgcaacagaagcgcaaaattcatcgtcatccgcactctcgttggtacgaaggccgaccggtgatgattgcccgtaatgacagcgcgcttgggttgtttaatggcgatattggtattgcgctggatcgcgggcaggggacgcgcgtctggtttgcgatgccggacggcaatattaagtctgtgcaaccgagtcgcctgccagagcacgaaacgacgtgggcgatgacggtacataaatcgcagggatcggagttcgaccatgcggcgttgattttaccgagtcaacgcacgccggtagtaacgcgagagctggtttacaccgcggtgacccgcgcgcgtcgccgtctgtcgctgtatgccgatgagcgcatattaagtgcggcaatcgccactcgtactgagcggcgcagtggtctggcggcgttgtttagttcacggggataa

SEQ ID NO: 6736 - protein, 608 aa, Escherichia coli
MKLQKQLLEAVEHKQLRPLDVQFALTVAGDEHPAVTLAAALLSHDAGEGHVCLPLSRLENNEASHPLLATCVSEIGELQNWEECLLASQAVSRGDEPTPMILCGDRLYLNRMWCNERTVARFFNEVNHAIEVDEALLAQTLDKLFPVSDEINWQKVAAAVALTRRISVISGGPGTGKTTTVAKLLAALIQMADGERCRIRLAAPTGKAAARLTESLGKALRQLPLTDEQKKRIPEDASTLHRLLGAQPGSQRLRHHAGNPLHLDVLVVDEASMIDLPMMSRLIDALPDHARVIFLGDRDQLASVEAGAVLGDICAYANAGFTAERAGQLSRLTGSHVPAGTGTEAASLRDSLCLLQKSYRFGSDSGIGQLAAAINRGDKTAVKTVFQQDFTDIEKRLLQSGEDYIAMLEEALAGYGRYLDLLQARAEPDLIIQAFNEYQLLCALREGPFGVAGLNERIEQFMQQKRKIHRHPHSRWYEGRPVMIARNDSALGLFNGDIGIALDRGQGTRVWFAMPDGNIKSVQPSRLPEHETTWAMTVHKSQGSEFDHAALILPSQRTPVVTRELVYTAVTRARRRLSLYADERILSAAIATRTERRSGLAALFSSRG

SEQ ID NO: 6737 - DNA, 3543 bp, Escherichia coli
atgagtgatgtcgccgagacactagatcctttgcgcttgcccttacagggcgagcgcctgattgaagcctctgccggcacaggcaaaacctttacgattgcggcgctctatttgcgcctgttacttggactaggcggttctgccgcctttccccgcccgctgaccgttgaagaactgctggtggtgacctttaccgaggctgctacggcagaattgcgtggtcgtatccgtagcaatatccacgagttgcgcatcgcctgtctgcgtgaaaccaccgacaatccactgtacaaacgcctgctggaagagatcgacgataaagcgcaagccgcgcagtggttgttgttagccgagcggcagatggatgaagcggcagtctttactattcacggcttttgccagcgcatgctcaacctgaatgcctttgaatccggcatgctgtttgagcagcagctgattgaagatgagtctctgctacgctaccaggcctgcgccgatttctggcgtcgccactgctacccgctgccgcgtgaaattgcccaggtcgtctttgaaacctggaaagggccgcaggcgttgctgcgcgatattaatcgttatctgcaaggcgaagcgccggttatcaaagcaccgccccccgatgatgaaacgctggcttcccgccacgcgcaaattgtggcgcgtattgatgccgtaaaacagcagtggcgcgacgcagtgggtgaactggatgcgctgatcgaatcttctggtattgatcgacgcaagtttaaccgtagcaatcaggctaaatggatcgagaagatcagcgcctgggcagaagaagagaccaacagctatcagttgccggagtcgctggaaaaattctctcagcgtttcttagaagatcgcacgaaagccgggggggaaaccccgcgacatccactgtttgaggcgatcgatcaactgcttgcagaaccattgtcgatccgcgatctggtgatcactcgcgcattggctgagatccgcgaaacagtagcgcgtgaaaaacgccgccgtggcgaattgggttttgatgacatgttaagtcggctcgattccgcgctgcgtagtgaaagcggcgaggtattggcagcggcgatccgtacgcgattcccggtggcaatgatcgatgaatttcaggataccgacccccaacagtatcgaatttttcgccgtatctggcaccatcagccggaaaccgcattgttgctgattggcgacccgaaacaggccatatatgcattccggggtgcggatatcttcacttatatgaaggcgcgtagcgaagttcatgctcactacaccttagataccaactggcgttccgcaccgggaatggtgaacagcgttaacaaacttttcagccagactgatgacgcgttcatgtttcgtgaaataccgtttattcctgtgaaatctgccggcaaaaatcaggcgttacgttttgtatttaaaggtgaaacgcagcctgcgatgaaaatgtggctgatggaaggcgaaagctgcggcgttggcgactatcaaagtaccatggcgcaggtatgtgctgcgcaaatctgcgactggctacaagccgggcaacgcggcgaagcgttgctgatgaacggcgacgatgcgcgtccggtgcgtgcttcggacatcagtgtgctggtgcgcagccgccaggaggccgctcaggtgcgcgatgccttaacgctgctggaaatcccttccgtttacctttcgaaccgcgacagtgtttttgaaactctggaagcacaggagatgctttggctgttgcaggcggtgatgacgcccgaacgtgagaacaccctgcgcagtgcgctggcaacgtcaatgatggggctgaatgcgctggatattgaaacgctgaataatgacgaacatgcgtgggatgcggtcgtcgaagagttcgatggttatcggcaaatctggcgcaaacgtggcgttatgccgatgctgcgggcgctgatgtcggcgcgtaacattgcagaaaacttgctggcaacggcaggcggtgagcggcgtcttaccgatatcttgcatatcagcgaactgctacaagaagccggaacgcagctggaaagtgaacatgcgctggtacgctggttatcgcaacatatcctcgagccagacagtaatgcctccagccaacaaatgcgcctcgaaagtgataaacatctggtgcagattgtcacgatacacaaatcaaaagggctggaatatccgctggtctggttgccatttattaccaatttccgcgtccaggatcaggcgttttatcacgatcgccactcgtttgaggccgttctggatcttaatgctgcgccagaaagcgtcgacctcgcggaggccgaacgtctggcggaagatctgcgtttgctttacgtggcgctgacgcgttcggtttggcattgcagtctcggcgttgcaccgctggtgcgccgtcgtggcgataaaaaaggtgataccgacgtccaccaaagtgcgctcgggcgtttgctgcaaaaaggagaaccgcaagatgcggcagggcttcgtacctgtattgaagcgttgtgcaatgatgatattgcctggcaaacggcacaaattggtgataaccagccctggcaggttaatgatgcattaactgcagaactgaatgcgaggacgctacaacgattgcccggcgataactggcgtgtcaccagctactccggtttgcagcagcgtggtcacggtatcgctcaggatctgatgccacggctggatgttgatgccgcaggcgtggtcagcgtcgttgaagaaccgacgttaacaccgcatcagttcccgcgcggtgcgtcaccggggacattcttgcacagtttgtttgaagacctcgattttacccagccgattgacccgaactgggtacaggaaaaactggagctcggtggctttgaaccgcagtgggaactggtgttgactgagtggatcacggctgtcctccaggcacctctcaatgaaacgggtgttagcctgaatcagctttccgatcgcgataaacaggtggagatggagttttacctgccgattagtgaaccgcttatcgccagccagcttgatgcactaattcgccagtttgacccgctatccgctggctgcccgccgctggagttcatgcaggtacgtggcatgttaaaaggctttatcgatctggtgttccgccacgaagggcgttattacctgctcgactataaatccaactggttgggtgaagacagttcggcttacacccaacaggctatggcagcggcaatgcaggcacaccgctatgatctgcaatatcagctttataccctggcgctgcaccgttatctgcgccatcgtattgctgattacgactatgagcgccactttggcggcgttatttatctgttcctgcgtggcgttgataaagaacatccgcaacaagggatctacgcgacccgacccaacgccgggttgattgacctgatggatgagatgtttgccagtatgaccctggaggaggcgtaa

SEQ ID NO: 6738 - protein, 1180 aa, Escherichia coli
MSDVAETLDPLRLPLQGERLIEASAGTGKTFTIAALYLRLLLGLGGSAAFPRPLTVEELLVVTFTEAATAELRGRIRSNIHELRIACLRETTDNPLYKRLLEEIDDKAQAAQWLLLAERQMDEAAVFTIHGFCQRMLNLNAFESGMLFEQQLIEDESLLRYQACADFWRRHCYPLPREIAQVVFETWKGPQALLRDINRYLQGEAPVIKAPPPDDETLASRHAQIVARIDAVKQQWRDAVGELDALIESSGIDRRKFNRSNQAKWIEKISAWAEEETNSYQLPESLEKFSQRFLEDRTKAGGETPRHPLFEAIDQLLAEPLSIRDLVITRALAEIRETVAREKRRRGELGFDDMLSRLDSALRSESGEVLAAAIRTRFPVAMIDEFQDTDPQQYRIFRRIWHHQPETALLLIGDPKQAIYAFRGADIFTYMKARSEVHAHYTLDTNWRSAPGMVNSVNKLFSQTDDAFMFREIPFIPVKSAGKNQALRFVFKGETQPAMKMWLMEGESCGVGDYQSTMAQVCAAQICDWLQAGQRGEALLMNGDDARPVRASDISVLVRSRQEAAQVRDALTLLEIPSVYLSNRDSVFETLEAQEMLWLLQAVMTPERENTLRSALATSMMGLNALDIETLNNDEHAWDAVVEEFDGYRQIWRKRGVMPMLRALMSARNIAENLLATAGGERRLTDILHISELLQEAGTQLESEHALVRWLSQHILEPDSNASSQQMRLESDKHLVQIVTIHKSKGLEYPLVWLPFITNFRVQDQAFYHDRHSFEAVLDLNAAPESVDLAEAERLAEDLRLLYVALTRSVWHCSLGVAPLVRRRGDKKGDTDVHQSALGRLLQKGEPQDAAGLRTCIEALCNDDIAWQTAQIGDNQPWQVNDALTAELNARTLQRLPGDNWRVTSYSGLQQRGHGIAQDLMPRLDVDAAGVVSVVEEPTLTPHQFPRGASPGTFLHSLFEDLDFTQPIDPNWVQEKLELGGFEPQWELVLTEWITAVLQAPLNETGVSLNQLSDRDKQVEMEFYLPISEPLIASQLDALIRQFDPLSAGCPPLEFMQVRGMLKGFIDLVFRHEGRYYLLDYKSNWLGEDSSAYTQQAMAAAMQAHRYDLQYQLYTLALHRYLRHRIADYDYERHFGGVIYLFLRGVDKEHPQQGIYATRPNAGLIDLMDEMFASMTLEEA

SEQ ID NO: 6739 - DNA, 2889 bp, Escherichia coli
atgccccgcagcatctggttcaaagcattattgttgtttgttgccctctgggcacccttaagtcaggcagaaacgggatggcagccgattcaggaaaccatccgtaaaagtgataaagataaccgccagtatcaggctatacgtctggataacggtatggtggtcttactggtttctgatccgcaggcagttaaatcgctctcggcgctggtggtgcccgttgggtcgctggaagatcctgaggcgtaccaggggctggcacattaccttgaacatatgagtctgatggggtcgaaaaagtacccgcaggctgacagtctggccgaatatctcaaaatgcacggcggcagtcacaatgccagcacggcaccgtatcgcacggctttctatctggaagttgagaacgacgccttgcccggtgcggtagaccgcctggcggacgctattgcagaacccttgctcgacaagaaatacgccgaacgtgaacgtaatgcagtgaatgccgaattaaccatggcgcgtacgcgtgacgggatgcgcatggcacaggtcagcgcagaaaccattaacccggcacaccccggttcaaagttttctggtggtaacctcgaaactttaagcgacaaaccaggtaatccggtacagcaggcgctgaaagatttccacgagaagtactattccgccaatctgatgaaggcggttatttacagcaataaaccgttgccggagttggcgaaaatggcggcggacacctttggtcgcgtgccgaacaaagagagcaaaaaaccggaaatcaccgtgccggtagtcaccgacgcgcaaaagggcattatcattcattacgtcccggcgttgccgcgtaaagttctgcgcgttgagtttcgcatcgataacaattcagcgaagttccgtagtaaaacggatgaattgattacctatctgattggtaatcgcagccctggtacactttctgactggctgcaaaagcagggattagttgagggtattagcgccaattccgatcctatcgtcaacggcaacagcggcgtattagcgatctttgcgtctttaaccgataaaggtctggcgaatcgcgatcaggttgtggcggccatttttagctatctcaatctgttacgtgaaaaagggatcgataaacaatacttcgatgaactggcgaatgtgctggatatcgacttccgttatccgtcaatcacccgtgatatggattacgtcgaatggctggcagataccatgattcgcgttcctgttgagcatacactggatgcagtcaatattgccgatcggtacgatgctaaagcagtaaaagaacgtctggcgatgatgacgccgcagaatgcgcgtatctggtatatcagcccgaaagagccgcacaataaaacggcttattttgtcgatgcgccgtatcaagtcgataaaatcagcgaacaaactttcgcggactggcagaaaaaagccgccaatattgcgctctccttaccggagcttaacccctatattcctgacgatttctcgctgattaagtcagagaagaaatacgaccatccagagttgattgttgatgagtcgaatctgcgcgtggtgtatgcgccaagccgttattttgccagcgagcccaaagctgatgtcagcctgattttgcgtaatccgaaagccatggacagcgcccgcaatcaggtgatgtttgcgctcaatgattatctcgcagggctggcgcttgatcagttaagcaaccaggcgtcggttggtggcataagtttttccaccaatgctaacaacggccttatggttaatgccaatggttacactcagcgcctgccgcagctgttccaggctctgctggagggctactttagctataccgctacggaagatcagcttgagcaggcgaagtcctggtataaccagatgatggattccgcagaaaagggcaaagcgtttgagcaggcgattatgcccgcgcagatgctctcgcaagtgccgtacttctcgcgagatgaacggcgcaaaattttgccctccattacgttgaaagaggtgctggcctatcgcgacaccttaaaatcaggggctagaccagagtttatggttatcggcaacatgactgaagcccaggcaacaacgctggcacgccatgtgcaaaaacagttgggcgctgatggttcagagtggtgtcgtaacaaagatgtcgtggtcgataaaaaacaatccgtcatctttgaaaaagctggtaacagcaccgactccgcactggcagcggtatttgtaccgactggctacgatgaatacaccagctcagcgtatagttctctgttggggcagatcgtacagccgtggttctacaatcagttgcgtaccgaagaacagttgggctatgccgtgtttgcgtttccaatgagcgtggggcgtcagtggggcatgggcttccttttgcaaagcaatgataaacagccttcattcttgtgggagcgttacaaggcgtttttcccaaccgcagaggcaaaattgcgggcgatgaagccagaggagtttgcgcaaatccagcaggcggtaattactcagatgctgcaggcaccgcaaacgctcggcgaagaagcatcgaagttaagtaaagatttcgatcgcggcaatatgcgcttcgattcgcgtgataaaatcgtggcccagataaaactgctgacgccgcaaaaacttgctgatttcttccatcaggcggtggtcgagccgcaaggtatggctattctgtcgcagatttccggcagccagaacgggaaagccgaatatgtgcatcctgaaggctggaaagtgtgggagaacgtcagcgcgttgcagcaaacaatgcccctgatgagtgaaaagaatgagtga

SEQ ID NO: 6740 - protein, 962 aa, Escherichia coli
MPRSIWFKALLLFVALWAPLSQAETGWQPIQETIRKSDKDNRQYQAIRLDNGMVVLLVSDPQAVKSLSALVVPVGSLEDPEAYQGLAHYLEHMSLMGSKKYPQADSLAEYLKMHGGSHNASTAPYRTAFYLEVENDALPGAVDRLADAIAEPLLDKKYAERERNAVNAELTMARTRDGMRMAQVSAETINPAHPGSKFSGGNLETLSDKPGNPVQQALKDFHEKYYSANLMKAVIYSNKPLPELAKMAADTFGRVPNKESKKPEITVPVVTDAQKGIIIHYVPALPRKVLRVEFRIDNNSAKFRSKTDELITYLIGNRSPGTLSDWLQKQGLVEGISANSDPIVNGNSGVLAIFASLTDKGLANRDQVVAAIFSYLNLLREKGIDKQYFDELANVLDIDFRYPSITRDMDYVEWLADTMIRVPVEHTLDAVNIADRYDAKAVKERLAMMTPQNARIWYISPKEPHNKTAYFVDAPYQVDKISEQTFADWQKKAANIALSLPELNPYIPDDFSLIKSEKKYDHPELIVDESNLRVVYAPSRYFASEPKADVSLILRNPKAMDSARNQVMFALNDYLAGLALDQLSNQASVGGISFSTNANNGLMVNANGYTQRLPQLFQALLEGYFSYTATEDQLEQAKSWYNQMMDSAEKGKAFEQAIMPAQMLSQVPYFSRDERRKILPSITLKEVLAYRDTLKSGARPEFMVIGNMTEAQATTLARHVQKQLGADGSEWCRNKDVVVDKKQSVIFEKAGNSTDSALAAVFVPTGYDEYTSSAYSSLLGQIVQPWFYNQLRTEEQLGYAVFAFPMSVGRQWGMGFLLQSNDKQPSFLWERYKAFFPTAEAKLRAMKPEEFAQIQQAVITQMLQAPQTLGEEASKLSKDFDRGNMRFDSRDKIVAQIKLLTPQKLADFFHQAVVEPQGMAILSQISGSQNGKAEYVHPEGWKVWENVSALQQTMPLMSEKNE

SEQ ID NO: 6741 - DNA, 3369 bp, Escherichia coli
atgttaagggtctaccattccaatcgtctggacgtgctggaagcgttgatggagtttattgtcgaacgcgaacggctggacgatcctttcgaaccagagatgattctggtgcaaagtaccggtatggcacagtggctgcaaatgaccctgtcgcaaaagtttggtattgcggcaaacattgattttccgctgccagcgagctttatctgggatatgttcgtccgggtgttaccggagatccccaaagagagcgcctttaacaaacagagcatgagctggaaactgatgactctgctgccgcaactgttggagcgcgaagactttaccctgttgcggcattatctgactgacgatagtgacaagcgaaaactgttccagctttcttcaaaagcggcggacctgtttgaccagtatctggtctatcgtccggactggctggcacagtgggaaacaggacatctggtagaagggttgggagaagcacaggcctggcaagcgccgttgtggaaggcgttggtggaatataccgacgaacttgggcaaccgcgctggcaccgcgccaatctctatcagcgctttatcgaaacgctggagtccgcgacgacctgcccgccggggttaccttcgcgcgtctttatatgcggtatttccgcgttaccgcctgtttatctccaggcgctacaggcgctgggtaaacatattgaaatccatctcctgtttaccaacccctgccgttattactggggcgacattaaagatcccgcttatctggcgaaactactgactcgccagcgccgacacagttttgaagatcgcgaattaccgctatttcgcgacagcgaaaatgccgggcagctctttaacagcgatggtgaacaggatgtcggcaacccgctgctggcttcatggggcaagcttgggcgcgactacatttatctcctttctgacctggagagcagccaggagctggacgcttttgtcgatgtgacgccagataacctgctgcataatattcagtctgacattctggaactggaaaaccgcgccgttgctggtgtgaacatcgaagagttttcccgtagcgataacaaacgcccgcttgatccactggatagcagtatcaccttccacgtttgccatagcccgcagcgtgaagttgaagttttacacgatcgcctgctggcgatgctggaggaagacccgacacttactccgcgcgacatcatcgtgatggtggctgatatcgacagctacagtccgtttattcaggctgtgtttggtagtgcacctgcggatcgttacctgccttacgccatttccgaccgtcgggcgcggcagtcgcatcctgtacttgaagcgtttatcagcctgttatcgctgccagacagccgctttgtgtcggaagacgtgctggcattactggatgtgccggtgctggcagcgcggtttgacatcaccgaagaagggctgcgttatttacgtcagtgggtcaacgaatccggcattcgttgggggatagatgacgacaacgttcgcgagctggaacttcccgctaccggtcaacacacctggcggtttggcctgacgcgcatgttgctgggctacgcgatggagagcgcgcagggcgagtggcaatcggttctaccttatgatgaatcgagcggcttaattgcagaactggtggggcatctggcttcactgctaatgcagctaaatatctggcgtcgcgggctggcgcaggagcgtccgctggaagagtggttgccggtttgtcgcgatatgctcaacgcctttttcctgccggatgcggaaaccgaagcggcgatgacgctgatcgaacaacaatggcaggcgattatctccgaaggtttaggcgcgcagtatggcgacgcggtgccgctgtcactattgcgtgatgaactggcactgcgcctggatcaagaacgtatcagccagcgttttctcgccggaccggttaacatttgtactctgatgccaatgcgttcaattccgttcaaagtggtttgcctgctgggaatgaacgacggcgtttatccacgtcagcttgcgccattgggctttgatctgatgagccagaaaccgaagcgtggcgaccgtagccgtcgcgatgacgaccgctatctgttcctggaagcgttaatttccgcgcagcaaaaactctatatcagctatatcgggcgttccattcaggataacagtgaacgtttcccgtcggtactggtgcaggaactgatcgactacatcgggcaaagccattatctaccgggcgatgaagcgcttaactgtgatgaaagcgaggcaagggtaaaagcgcatcttacttgccaccatacccggatgccgtttgacccgcaaaactaccagcccggtaacttacaaagctatgcgcgcgagtggctacctgcggccagccaggctggtaaagcacattctgaatttgttcagccgctgccgtttaccttaccggaaaccgtgccgctggaaacgctacaacgattctgggcacatccggtgcgggcgtttttccagatgcgtttgcaggtgaacttccgtaccgaagacagcgaaattcccgacactgaaccttttattcttgaagggcttagtcgttatcaaatcaaccagcagttattaaatgtactggttgagcaggatgatgccgaacgcttgttccgccgattccgggcggcaggtgatttgccgtatggtgcctttggtgaaattttctgggaaacgcagtgtcaggagatgcagcaacttgccgacagagtcattgcctgtcgccagccagggcagagtatggagattgatctcgcctgcaacggtgtgcagataactggctggttgccgcaggtgcagccggatggcctgttgcgctggcgtccctctttattaagtgtggcgcagggaatgcaactttggctggaacaccttgtctactgtgccagcggtggtaatggtgaaagtcgcctttttctacgcaaagacggcgagtggcgttttccgccgcttgcagccgaacaggctttgcattacctctcacaactgattgaggggtatcgtgaaggaatgtccgcgccattgctggtgttacctgaaagtggcggcgcgtggctaaaaacctgttatgacgcgcaaaacgatgccatgctggatgacgattccacgttgcaaaaagcccgtacgaaattccttcaggcttacgaaggcaacatgatggtgcgtggcgaaggtgatgatatctggtatcaacggctctggcggcaattaacaccagagacaatggaggctatcgttgaacagtcgcaacgtttcctgttaccgctgtttcgctttaatcagtcatga

SEQ ID NO: 6742 - protein, 1122 aa, Escherichia coli
MLRVYHSNRLDVLEALMEFIVERERLDDPFEPEMILVQSTGMAQWLQMTLSQKFGIAANIDFPLPASFIWDMFVRVLPEIPKESAFNKQSMSWKLMTLLPQLLEREDFTLLRHYLTDDSDKRKLFQLSSKAADLFDQYLVYRPDWLAQWETGHLVEGLGEAQAWQAPLWKALVEYTDELGQPRWHRANLYQRFIETLESATTCPPGLPSRVFICGISALPPVYLQALQALGKHIEIHLLFTNPCRYYWGDIKDPAYLAKLLTRQRRHSFEDRELPLFRDSENAGQLFNSDGEQDVGNPLLASWGKLGRDYIYLLSDLESSQELDAFVDVTPDNLLHNIQSDILELENRAVAGVNIEEFSRSDNKRPLDPLDSSITFHVCHSPQREVEVLHDRLLAMLEEDPTLTPRDIIVMVADIDSYSPFIQAVFGSAPADRYLPYAISDRRARQSHPVLEAFISLLSLPDSRFVSEDVLALLDVPVLAARFDITEEGLRYLRQWVNESGIRWGIDDDNVRELELPATGQHTWRFGLTRMLLGYAMESAQGEWQSVLPYDESSGLIAELVGHLASLLMQLNIWRRGLAQERPLEEWLPVCRDMLNAFFLPDAETEAAMTLIEQQWQAIISEGLGAQYGDAVPLSLLRDELALRLDQERISQRFLAGPVNICTLMPMRSIPFKVVCLLGMNDGVYPRQLAPLGFDLMSQKPKRGDRSRRDDDRYLFLEALISAQQKLYISYIGRSIQDNSERFPSVLVQELIDYIGQSHYLPGDEALNCDESEARVKAHLTCHHTRMPFDPQNYQPGNLQSYAREWLPAASQAGKAHSEFVQPLPFTLPETVPLETLQRFWAHPVRAFFQMRLQVNFRTEDSEIPDTEPFILEGLSRYQINQQLLNVLVEQDDAERLFRRFRAAGDLPYGAFGEIFWETQCQEMQQLADRVIACRQPGQSMEIDLACNGVQITGWLPQVQPDGLLRWRPSLLSVAQGMQLWLEHLVYCASGGNGESRLFLRKDGEWRFPPLAAEQALHYLSQLIEGYREGMSAPLLVLPESGGAWLKTCYDAQNDAMLDDDSTLQKARTKFLQAYEGNMMVRGEGDDIWYQRLWRQLTPETMEAIVEQSQRFLLPLFRFNQS

SEQ ID NO: 6743 - DNA, 324 bp, Escherichia coli
atgtcagcttccctgaggaatcaacaaggctttagtctgccggaggtaatgttggcgatggtgttgatggtgatgattgtcactgcgttatcgggtttccagcgaacattaatgaacagtcttgccagcagaaaccagtaccaacagctctggcggcatggctggcagcaaacgcaactgcgcgcgatttcgccacctgctaactggcaggtcaaccgaatgcagacatcgcaggcgggatgtgtcagcatcagcgttacgctagtttcacccgggggcagagaaggcgagatgacccgcctgcattgcccgaatcgtcagtag

SEQ ID NO: 6744 - protein, 107 aa, Escherichia coli
MSASLRNQQGFSLPEVMLAMVLMVMIVTALSGFQRTLMNSLASRNQYQQLWRHGWQQTQLRAISPPANWQVNRMQTSQAGCVSISVTLVSPGGREGEMTRLHCPNRQ

SEQ ID NO: 6745 - DNA, 408 bp, Escherichia coli
gtgaaccgcgaaaagggtgtttcgtcactggctctggtcctgatgctgctgattttgggtagcttgctattgcaaggaatgagtcagcaggatcgcagttttgcttctcgcgtgagcatggaaagtcagtcattgcgccgccaggccatcgttcagtcggcgctggagtggggaaaaatgcactcctggcagacgcagcccgcagttcagtgcttactgtatgctgccaccggtgcccgggtttgtctgcgtttactggcagataatgaagccttattgattgctggttatgaaggcgtttcgttgtggcgaacaggcgaagtcatcgatggaaacattgttttttcgccacgcggctggagcgatttttgtccgctgaaagagagggcgttatgtcagcttccctga

SEQ ID NO: 6746 - protein, 135 aa, Escherichia coli
MNREKGVSSLALVLMLLILGSLLLQGMSQQDRSFASRVSMESQSLRRQAIVQSALEWGKMHSWQTQPAVQCLLYAATGARVCLRLLADNEALLIAGYEGVSLWRTGEVIDGNIVFSPRGWSDFCPLKERALCQLP

SEQ ID NO: 6747 - DNA, 564 bp, Escherichia coli
atgcctgtaaaagagcaaggtttttctctgctggaagtgttgattgctatggcgatcagtagcgtattgttgctgggggctgcacgctttctgcctgcgttacagcgtgaaagtttaacgaacacccgtaagctggcgctggaagatgaaatctggctgcgggtatttaccgtcgcgaagcatctccagagggcgggttattgccatggcagctgtacgggcgaagggctggaaattgtcggacagggtgactgtgtcattgtgcagtgggatgcgaacagtaatggtatctgggatcgcgaaccggtaaaagagtccgaccagattggatttcgtctgaaggagcatgtgctggaaacgctacgcggtgcgacatcctgtgaaggtaagggctgggataaagtcactaatccggatgccatcattatcgacacttttcaggtcgtacgtcaggatgtcagcggcttctcgccggtgttgacggttaatatgcacgctgccagcaaggctgatccgcaaaccgtggtggatgccagctatagcgtgacaggatccaacctgtga

SEQ ID NO: 6748 - protein, 187 aa, Escherichia coli
MPVKEQGFSLLEVLIAMAISSVLLLGAARFLPALQRESLTNTRKLALEDEIWLRVFTVAKHLQRAGYCHGSCTGEGLEIVGQGDCVIVQWDANSNGIWDREPVKESDQIGFRLKEHVLETLRGATSCEGKGWDKVTNPDAIIIDTFQVVRQDVSGFSPVLTVNMHAASKADPQTVVDASYSVTGSNL

SEQ ID NO: 6749 - DNA, 471 bp, Escherichia coli
atgaaaacacaacgtggttatacgctgattgaaacgctggtcgcgatgctgattctggtcatgctaagcgcaagtgggctttatggctggcaatactggcagcagtcgcaacggctttggcaaaccgccagccaggcgcgggactatttgctctatttacgtgaagatgccaactggcataaccgcgaccacagtatcagtcttatcagggaggggacgttatggtgccttgtgagttccgttgctggggcgaatacctgtcatggcagttcaccattggtctttgtgccgcgctggcccgaagtcgaaatgagcgacctgacaccttcgcttgctttctttggcctgcgcaataccgcatgggccgggcatattcgcttcaaaaactcaacgggcgagtggtggctggtggtttcgccgtggggaagactccggctttgtcagcaaggagaaacagaaggatgcctgtaa

SEQ ID NO: 6750 - protein, 156 aa, Escherichia coli
MKTQRGYTLIETLVAMLILVMLSASGLYGWQYWQQSQRLWQTASQARDYLLYLREDANWHNRDHSISLIREGTLWCLVSSVAGANTCHGSSPLVFVPRWPEVEMSDLTPSLAFFGLRNTAWAGHIRFKNSTGEWWLVVSPWGRLRLCQQGETEGCL

SEQ ID NO: 6751 - DNA, 795 bp, Escherichia coli
atgaaacagtatttagaactgatgcaaaaagtgctcgacgaaggcacacagaaaaacgaccgtaccggaaccggaacgctttccatttttggtcatcagatgcgttttaacctgcaggatggattcccgctggtgacaactaaacgttgccacctgcgttccatcatccacgaactgctgtggttcctgcagggcgacactaacattgcttatctacacgaaaacaatgtcaccatctgggacgaatgggccgatgaaaacggcgacctcgggccagtgtatggtaaacagtggcgcgcctggccaacgccggatggtcgtcatattgaccagatcactactgtactgaaccagctgaaaaacgacccggattcccgtcgcattattgtttcagcgtggaacgtaggcgaactggataaaatggcgctggcaccgtgccatgcattcttccagttctatgtggcagacggcaaactctcttgccagctttatcagcgctcctgtgacgtcttcctcggcctgccgttcaacattgccagctacgcgttactggtgcatatgatggcgcagcagtgcgatctggaagtgggtgattttgtctggaccggtggcgacacgcatctctacagcaaccatatggatcaaactcatctgcaattaagccgcgaaccgcgtccgctgccgaagttgattatcaaacgtaaacccgaatccatcttcgactaccgtttcgaagactttgagattgaaggatacgatccacatccgggcattaaagcgccggtggctatctaa

SEQ ID NO: 6752 - protein, 264 aa, Escherichia coli
MKQYLELMQKVLDEGTQKNDRTGTGTLSIFGHQMRFNLQDGFPLVTTKRCHLRSIIHELLWFLQGDTNIAYLHENNVTIWDEWADENGDLGPVYGKQWRAWPTPDGRHIDQITTVLNQLKNDPDSRRIIVSAWNVGELDKMALAPCHAFFQFYVADGKLSCQLYQRSCDVFLGLPFNIASYALLVHMMAQQCDLEVGDFVWTGGDTHLYSNHMDQTHLQLSREPRPLPKLIIKRKPESIFDYRFEDFEIEGYDPHPGIKAPVAI

SEQ ID NO: 6753 - DNA, 876 bp, Escherichia coli
atgaccagtagctatctgcattttccggagtttgatccggtcattttctcaataggacccgtggcgcttcactggtacggcctgatgtatctggtgggtttcatttttgcaatgtggctggcaacacgacgggcgaatcgtccgggcagtggctggaccaaaaatgaagttgaaaacttactctatgcgggcttcctcggcgtcttcctcggtggacgtattggttatgttctgttctacaatttcccgcagtttatggccgatccgctgtatcttttccgtgtctgggacggcggcatgtccttccacggaggcctgattggcgttatcgtggtgatgattatcttcgcccgccgtactaaacgttccttcttccaggtctctgattttattgccccactcattccgtttggtcttggtgctgggcgcctgggcaactttattaacggtgaattgtggggccgcgttgacccgaacttcccgtttgccatgctgttccctggctcccgtacagaagatattttgctgctgcaaaccaacccgcagtggcaatccattttcgacacttacggtgtgctgccgcgccacccatcacagctttacgagctgctgctggaaggtgtggtgctgtttattatcctcaacctgtatattcgtaaaccgcgcccaatgggagctgtctcaggcttgttcctgattggttacggcgcgtttcgcatcattgttgagtttttccgccagcccgacgcgcagtttactggtgcctgggtgcagtacatcagcatggggcaaattctttccatcccgatgattgtcgcgggtgtgatcatgatggtctgggcatatcgtcgcagcccacagcaacacgtttcctga

SEQ ID NO: 6754 - protein, 291 aa, Escherichia coli
MTSSYLHFPEFDPVIFSIGPVALHWYGLMYLVGFIFAMWLATRRANRPGSGWTKNEVENLLYAGFLGVFLGGRIGYVLFYNFPQFMADPLYLFRVWDGGMSFHGGLIGVIVVMIIFARRTKRSFFQVSDFIAPLIPFGLGAGRLGNFINGELWGRVDPNFPFAMLFPGSRTEDILLLQTNPQWQSIFDTYGVLPRHPSQLYELLLEGVVLFIILNLYIRKPRPMGAVSGLFLIGYGAFRIIVEFFRQPDAQFTGAWVQYISMGQILSIPMIVAGVIMMVWAYRRSPQQHVS

SEQ ID NO: 6755 - DNA, 2247 bp, Escherichia coli
atgctcactcgcctgcgcgaaatagtcgaaaaggtagccagcgcaccacgcctgaatgaggcgttaaatattctggttaccgacatctgtcttgcgatggataccgaggtctgttcggtctacctggccgatcatgatcgacgttgttactacctgatggcgacccggggactgaaaaaaccacgcggtcgcactgtaacgctcgcgtttgatgaagggatcgtcggcctggttggcaggctggcggaaccgataaaccttgcagatgcgcaaaagcaccccagcttcaaatacatcccctccgtaaaagaagaacgtttccgcgcgtttttaggcgtaccaattattcaacgtcgccagttgcttggtgtactggtggtacagcaacgagagttgcgccagtatgacgaaagtgaagaatccttcctggtgacgcttgccacccagatggcagctattctttctcagtcgcagttgactgccttgtttgggcaatatcgccagacgcgaatccgtgcattaccggcagcacctggtgtggcgattgccgaaggctggcaggatgccacgttacctttaatggaacaggtgtatcaggcatcaacgctggatccggctctggaacgcgaacgactgaccggggcgttggaagaggcggctaacgagtttcgccgctatagcaaacgctttgctgccggtgcacaaaaagaaacggcggctattttcgatctttactcacacctgctttcggatacccggctgcgtcgcgaattgtttgccgaggttgataaaggctcggtggcagagtgggcggtaaaaacggtcattgaaaaatttgccgaacagtttgccgcgctaagcgataactatctcaaagagcgggctggcgatttacgtgcgctgggtcagcgattgctgtttcatcttgatgacgctaatcaagggccgaacgcctggccggaacgtttcattctggtggcagatgaactgtcagcgacaacgcttgctgagctgccccaggatcgcttagtcggtgttgtcgtgcgcgatggcgctgccaactcccatgctgcgatcatggtacgtgcgctggggatacctaccgtgatgggcgcggatattcagccttcggtactgcatcgtcggacgctgatcgtcgatggttatcgcggtgaattgctggtcgatccggaaccggtactgctgcaagaatatcagcggctaattagtgaagagatcgagcttagccgtctggcggaagatgacgtcaatttacccgcccagttaaaaagcggcgaacgcattaaagtcatgctcaatgccggtttaagcccggaacatgaagaaaaactgggcagccgtattgatggcataggactttatcgcactgaaatcccattcatgctgcaaagtggttttccgtcggaagaagaacaggtggcgcagtatcaggggatgctgcaaatgtttaatgataaacccgtcaccttgcgtacgctggatgtcggagcagataagcagctgccttacatgccgattagcgaagagaatccatgcctgggttggcgtgggattcgcattacgctcgatcagccggagatcttcttgatccaggtgcgggcgatgctgcgtgctaatgccgctacgggcaacctgaatattctgttgccgatggtcacaagcctcgatgaagttgacgaagcacgccgcctgattgaacgtgccggacgtgaagtcgaggagatgatcggttacgaaattcccaaaccacgtatcggcatcatgctggaagtgccgtcaatggtatttatgctgccgcatctggcaaagcgggtcgatttcatctctgttggcaccaacgatctgactcaatacatcctggccgttgatcgcaacaatacccgggtggcgaacatttatgacagtcttcatcctgcaatgttacgagctctggcgatgatcgcccgggaagcggaaatacatggaatcgatctccgtttgtgcggtgaaatggcgggcgatcccatgtgcgtggcaatcctcattgggcttgggtatcgccatctgtctatgaacggacgttctgtagcgcgcgtaaaatacctgctgcggcgcattgattttgctgaagcagaaaatcttgcgcagcgtagtctggaagcgcaactggcgaccgaagttcgccatcaggttgctgcctttatggagcgtcgcggcatgggcgggctgattcgcggggggttatag

SEQ ID NO: 6756 - protein, 748 aa, Escherichia coli
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARVKYLLRRIDFAEAENLAQRSLEAQLATEVRHQVAAFMERRGMGGLIRGGL

SEQ ID NO: 6757 - DNA, 465 bp, Escherichia coli
atgtgggcccggcgatttggtcagcactcctggcaatttccgcaaggcggaatcaaccccggagaatccgcagagcaggcgatgtaccgtgaattgtttgaagaagtaggattaagccgcaaagacgttcgaatccttgcttcaacgcgtaactggttgcgctacaaattaccgaaacgtttggtgcgttgggacacgaagccggtttgtatcggccaaaaacaaaaatggtttctcttgcagctggtgagcggcgatgcagaaatcaatatgcaaaccagcagtacaccagagtttgacggctggcgatgggtaagttactggtatccagtcagacaggtggtgtcatttaaacgtgatgtctaccgtagggtaatgaaagagttcgcgagtgtggtgatgtcactgcaggaaaatacgccaaaaccacaaaacgcatctgcttatcgacgtaaaagaggttaa

SEQ ID NO: 6758 - protein, 154 aa, Escherichia coli
MWARRFGQHSWQFPQGGINPGESAEQAMYRELFEEVGLSRKDVRILASTRNWLRYKLPKRLVRWDTKPVCIGQKQKWFLLQLVSGDAEINMQTSSTPEFDGWRWVSYWYPVRQVVSFKRDVYRRVMKEFASVVMSLQENTPKPQNASAYRRKRG

SEQ ID NO: 6759 - DNA, 690 bp, Escherichia coli
atgtcccaacctcgcccactgctctctcctcccgaaactgaagaacaattgttagcgcaagcacaacaactttctggttatacattgggagaactggcggcacttgccgggctggttacgccggagaatttaaaacgcgataagggctggattggcgtgttactggagatctggctaggtgccagcgcagggagtaaacctgagcaagattttgctgctctgggcgtggaacttaaaactatccctgtggatagtcttggtcgtccactggaaacaacattcgtttgtgttgccccgttaacgggcaatagcggggtgacctgggaaaccagccacgtgcgccacaagctcaaacgcgtgctgtggataccggttgaaggcgagcgcagcatcccgctggcaaagcgtcgcgtaggatcaccgttgctgtggagcccgaatgaagaggaagaccggcagctacgcgaagactgggaagaattaatggatatgattgttctcggtcagattgagcggatcaccgctcgtcacggggaatatttacagatacgaccgaaagcagcgaatgcgaaagcgctgaccgaagctattggtgcccggggcgaacggattctgacgctgccgcgcggattttatttgaagaagaatttcaccagtgcgctactggcccgtcattttctgatccagtag

SEQ ID NO: 6760 - protein, 229 aa, Escherichia coli
MSQPRPLLSPPETEEQLLAQAQQLSGYTLGELAALAGLVTPENLKRDKGWIGVLLEIWLGASAGSKPEQDFAALGVELKTIPVDSLGRPLETTFVCVAPLTGNSGVTWETSHVRHKLKRVLWIPVEGERSIPLAKRRVGSPLLWSPNEEEDRQLREDWEELMDMIVLGQIERITARHGEYLQIRPKAANAKALTEAIGARGERILTLPRGFYLKKNFTSALLARHFLIQ

SEQ ID NO: 6761 - DNA, 714 bp, Escherichia coli
atgttatttgcatggataaccgatcctaacgcctggcttgcgctcggtacactgacgctgctggagatcgttcttgggatcgacaatattattttcctttctctggtggtggcaaagcttcccacagcacaacgtgctcatgcgcgccgtctggggttggcgggagccatggtcatgcgtctggcgctgctggcatccatcgcctgggttacgcgcctgacgaatccgctttttacaatattcagtcaggaaatttccgcccgtgatttgatcctgcttctgggtggcttgttccttatctggaaagccagcaaggaaatccacgaatccatcgaaggtgaagaagaagggctgaaaacacgcgtttcatcattcctcggcgctatcgtgcagattatgctgctggatattatcttcagcctcgactcggtgattaccgctgtgggtctgtcagatcacctgtttattatgatggctgccgtggtgattgccgtaggcgtgatgatgttcgccgcgcgctcgattggtgattttgtcgagcgccatccttcggtaaaaatgctggcgctctctttcctgattctggtgggctttaccctgattctggaaagtttcgacatccacgtaccgaaaggttacatctacttcgcgatgttcttctctattgcggttgaaagcctcaacctgattcgcaacaaaaagaatccgctctga

SEQ ID NO: 6762 - protein, 237 aa, Escherichia coli
MLFAWITDPNAWLALGTLTLLEIVLGIDNIIFLSLVVAKLPTAQRAHARRLGLAGAMVMRLALLASIAWVTRLTNPLFTIFSQEISARDLILLLGGLFLIWKASKEIHESIEGEEEGLKTRVSSFLGAIVQIMLLDIIFSLDSVITAVGLSDHLFIMMAAVVIAVGVMMFAARSIGDFVERHPSVKMLALSFLILVGFTLILESFDIHVPKGYIYFAMFFSIAVESLNLIRNKKNPL

SEQ ID NO: 6763 - DNA, 219 bp, Escherichia coli
atgaaaaaatgggcagtaataatttctgcagtcggactggcgtttgctgtttccgggtgttccagtgattacgtcatggcgaccaaagatggccgtatgattttgaccgatggaaaacctgaaattgatgatgataccgggctggtgagttatcacgatcagcaaggtaacgcgatgcaaattaaccgtgatgatgtttcgcaaattattgaacgttaa

SEQ ID NO: 6764 - protein, 72 aa, Escherichia coli
MKKWAVIISAVGLAFAVSGCSSDYVMATKDGRMILTDGKPEIDDDTGLVSYHDQQGNAMQINRDDVSQIIER

SEQ ID NO: 6765 - DNA, 1041 bp, Escherichia coli
atgcaatatcaccgtataccccacagttcgctggaagtcagcacgctggggcttggcacgatgacgtttggtgaacagaacagcgaagccgacgcccacgcacaactcgactatgccgtcgctcagggcattaaccttatcgacgttgccgaaatgtacccagtacctccgcgccccgaaactcaagggctaaccgaaacctacgtcggcaactggctggcgaaacatggcagccgcgaaaagttaattatcgcctccaaagtgagcggaccgtcgcgcaataatgacaaaggcatccgcccggatcaggcgctggatcggaagaatatccgcgaagcgctgcatgacagcctcaagcgtctgcagactgattacctcgatctctatcaggtgcactggccgcagcgcccaaccaactgcttcggcaaactcggttatagctggacagattctgcgcctgcggtttcgctgctggatacgctggacgcactggcagagtaccaacgcgcgggaaaaattcgttatatcggcgtgtcgaacgaaactgcatttggcgtaatgcgctacctgcatctggcggacaaacacgatctgccgcgtattgtcaccattcagaacccctacagcctgttaaaccgcagttttgaagtaggtctggcagaagtcagccagtatgaaggggtcgaactgctggcctattcgtgcctgggtttcggcacactgaccgggaaatatctcaatggtgcaaaacccgctggcgcacgtaatacgctctttagtcggttcacccgctatagcggtgagcaaacgcaaaaagccgtcgcggcgtatgttgatatcgccagacgtcatggcctggaccctgctcagatggcgctcgcatttgtacgccgtcaaccgtttgttgccagcactctgctgggcgcaaccacgatggagcagctgaaaactaacgtcgaaagtttgcatctggagttgagcgaagacgtattagctgaaattgaagcggtgcatcaggtttatacgtatcctgcaccataa

SEQ ID NO: 6766 - protein, 346 aa, Escherichia coli
MQYHRIPHSSLEVSTLGLGTMTFGEQNSEADAHAQLDYAVAQGINLIDVAEMYPVPPRPETQGLTETYVGNWLAKHGSREKLIIASKVSGPSRNNDKGIRPDQALDRKNIREALHDSLKRLQTDYLDLYQVHWPQRPTNCFGKLGYSWTDSAPAVSLLDTLDALAEYQRAGKIRYIGVSNETAFGVMRYLHLADKHDLPRIVTIQNPYSLLNRSFEVGLAEVSQYEGVELLAYSCLGFGTLTGKYLNGAKPAGARNTLFSRFTRYSGEQTQKAVAAYVDIARRHGLDPAQMALAFVRRQPFVASTLLGATTMEQLKTNVESLHLELSEDVLAEIEAVHQVYTYPAP

SEQ ID NO: 6767 - DNA, 1149 bp, Escherichia coli
atgaaagcggttatcgtggcgcagtttctctctgcgtttggcgataatgcgctactgtttgccactctggcgttactgaaagcgcagttctatccggagtggagccaacccatcctgcaaatggtgtttgtaggtgcttacattctttttgcgccgtttgtcgggcaggtggcggatagcttcgccaaaggccgggtgatgatgtttgccaacggcctgaagctactgggcgcagccagtatctgctttggtatcaatccgtttctcggctatacgttggtgggtgttggtgctgcagcctattcaccggcgaaatacggtattctcggcgaattaaccacgggtagtaagttagtaaaagctaacggtttaatggaagcgtctaccatagcggcgattttgctcggttccgtagctggtggtgttctggctgactggcatattctggttgccctggtcgcatgcgcactggcctacggtggcgcggtcgttgccaatatctacattcccaaactggcggcggcgcgtccggggcagtcctggaatctcatcagcatgacccgcagtttcctgaatgcctgcacctcgctatggcgcaatggtgaaacgcgtttttcgctggtgggcaccagtttattctggggagcgggtgtcacgctgcgtttcctgttggtgctgtgggtaccggtggcgctaggtattaccgataacgctacgccgacctatctcaacgcgatggtagcgattggtatcgtggttggtgcaggtgcggcagcgaagttagttacgctggaaaccgtgtcacgctgtatgccagccgggattttgattggcgtggtggtactgattttctccctgcaacacgagctgctgccagcctatgctttgttgatgctgattggcgtgctggggggcttttttgtcgttccgctcaatgcgttgctacaggagcggggtaaaaaaagcgtcggggcggggaatgcgattgcagtacaaaaccttggcgaaaacagcgccatgttgttgatgctgggcatttactcgctggcggtaatggtaggcatcccggtcgtgcccattggcattggcttcggtgcgctgtttgcgctggcaataacggcgctgtggatctggcagcgccgtcattaa

SEQ ID NO: 6768 - protein, 382 aa, Escherichia coli
MKAVIVAQFLSAFGDNALLFATLALLKAQFYPEWSQPILQMVFVGAYILFAPFVGQVADSFAKGRVMMFANGLKLLGAASICFGINPFLGYTLVGVGAAAYSPAKYGILGELTTGSKLVKANGLMEASTIAAILLGSVAGGVLADWHILVALVACALAYGGAVVANIYIPKLAAARPGQSWNLISMTRSFLNACTSLWRNGETRFSLVGTSLFWGAGVTLRFLLVLWVPVALGITDNATPTYLNAMVAIGIVVGAGAAAKLVTLETVSRCMPAGILIGVVVLIFSLQHELLPAYALLMLIGVLGGFFVVPLNALLQERGKKSVGAGNAIAVQNLGENSAMLLMLGIYSLAVMVGIPVVPIGIGFGALFALAITALWIWQRRH

SEQ ID NO: 6769 - DNA, 2160 bp, Escherichia coli
atgctttttagcttttttcgaaatttgtgccgtgttttgtatcgcgttcgcgttacgggtgacaccaaggcactgaagggcgagcgcgttctaattacgcctaatcacgtctcttttattgatggcatactgctggcattgtttttacccgtacgtccggtatttgccgtttacacctcaataagccaacagtggtatatgcgttggctgaaatcatttatcgactttgttcctctcgacccgacgcaacctatggcgattaaacatctggtacgtctggtggaacagggacgaccagtggtgattttccctgaaggacgcatcaccaccactggctcgctgatgaaaatctacgatggcgcgggatttgtcgcggcgaagtctggtgcaacggttattcctgtgcgtattgaaggggcggaacttacgcacttcagccgcctgaaaggtctggttaaacgtcgcttgttcccgcaaattactctgcatattttgccaccaacgcaggtggagatgccggatgcgccgcgtgcccgtgaccgtcgcaaaatcgctggcgaaatgctgcatcaaataatgatggaagcgcgtatggcggtgcgcccgcgtgaaacgctgtacgaatctttactgagcgcaatgtaccgcttcggagccgggaagaaatgtgtcgaagacgttaactttaccccggactcctatcgcaaattgcttacgaaaacgctgtttgttggacgcatccttgaaaaatacagtgttgaaggcgaacgcatcggcttaatgctgcccaatgcaggcatcagtgcggcagtgatttttggggccatcgcccgtcgccgcattcccgcaatgatgaactacactgctggggtaaaagggctgaccagtgctattacggcggctgaaatcaaaaccatcttcacttcccgccagtttctcgataaaggcaaactctggcatctgccggagcaacttactcaggtgcgctgggtctatctggaagatttaaaagcagatgtcaccactgccgacaaagtatggatcttcgctcatttgctgatgccgcgtctggcacaggttaaacagcagccggaagaagaggcgctgatcctttttacctccggttctgaaggccatccgaaaggcgtcgtccatagccataaaagcattctggcgaatgtcgagcagattaaaacgattgccgacttcaccaccaacgatcgctttatgtcggcgttaccgctgtttcactcctttgggctgacggtaggcctgtttacgccactgctcacaggtgcagaagtgttcctttatccaagcccgctgcattaccgtattgtgccggagttggtgtatgaccgcagttgcaccgtgttgttcggtacctccactttcctcggtcactacgcgcgtttcgccaacccgtatgacttctatcgtctacgctatgtggtggcaggcgcagaaaaactacaagaaagtactaaacagctttggcaggataaatttggcctgcgcatccttgaaggctacggtgtgaccgaatgcgcgcctgtcgtttctatcaacgtaccgatggcggcgaaacccggtacggtagggcgtattctaccaggaatggatgcgcgcctgttgtcggttcctggtatcgaagagggcggacgcctgcaactgaaagggccgaacataatgaacggctatctgcgggtggagaagcctggtgtactggaagtgcccaccgccgagaatattcgcggcgaaatggagcgcgactggtatgacactggcgatattgtgcgttttgacgagcagggctttgtgcagattcagggccgcgcaaaacgctttgccaaaattgcaggcgaaatggtgtcgctggaaatggtggaacaactggcacttggtgtttcgccagataaagtccatgccactgcgattaagagcgatgccagcaaaggcgaggcactggtgcttttcaccacagataacgaactgacgcgcgataagttacaacagtatgcccgcgagcacggcgtgccggagcttgctgtaccgcgcgatattcgctatctgaaacagatgccattacttggcagcggcaaacctgactttgtcactttgaaaagctgggtagacgaagcggaacaacacgatgagtga

SEQ ID NO: 6770 - protein, 719 aa, Escherichia coli [sequence omitted]

SEQ ID NO: 6771 - DNA, 1032 bp, Escherichia coli
atggcgaccataaaggatgtagcccgactggcaggcgtttcagtcgccaccgtttcccgcgtcattaataattcacccaaagccagcgaagcttcccggcttgctgtgcatagtgcaatggagtctcttagctatcacccgaacgccaacgcccgtgctctggcgcagcagaccactgaaacgatcggtctggtcgttggtgatgtttccgatccgtttttcggcgcaatggtgaaagcggtcgaacaggtggcttatcacactggtaattttttattgattggcaacggttaccacaacgaacaaaaagagcgtcaggccattgagcaactgatccgccatcgctgtgctgcgctggttgtccatgccaaaatgatcccggatgccgatttagcctcattaatgaaacaaatgcccggtatggtgctgatcaaccgtatcctgcctggctttgaaaaccgttgtattgctctggacgatcgttacggtgcctggctggcaacgcgtcatttaattcagcaaggtcatacccgcattggttatctgtgctctaaccactctatttctgacgccgaagatcgtctgcaagggtattacgatgcccttgctgaaagtggtattccggccaatgaccggctggtgacatttggcgaaccagacgaaagcggcggcgaacaggcaatgaccgagcttttgggacgaggcagaaatttcactgcggtagcctgttataacgattcaatggcggcgggcgcgatgggcgtgctcaatgataatggtattgatgtaccgggtgagatttcgttaattggctttgatgatgtgctggtgtcacgctatgtgcgtccgcgcctgaccaccgtgcgttacccaatcgtgacgatggcgacgcaggctgccgaactggctttggcgctggcggataatcgccctctcccggaaatcactaatgtctttagtccgacgctggtacgtcgccattcagtgtcaactccgtcgctggaggcaagtcatcatgcaaccagcgactaa

SEQ ID NO: 6772 - protein, 343 aa, Escherichia coli
MATIKDVARLAGVSVATVSRVINNSPKASEASRLAVHSAMESLSYHPNANARALAQQTTETIGLVVGDVSDPFFGAMVKAVEQVAYHTGNFLLIGNGYHNEQKERQAIEQLIRHRCAALVVHAKMIPDADLASLMKQMPGMVLINRILPGFENRCIALDDRYGAWLATRHLIQQGHTRIGYLCSNHSISDAEDRLQGYYDALAESGIPANDRLVTFGEPDESGGEQAMTELLGRGRNFTAVACYNDSMAAGAMGVLNDNGIDVPGEISLIGFDDVLVSRYVRPRLTTVRYPIVTMATQAAELALALADNRPLPEITNVFSPTLVRRHSVSTPSLEASHHATSD

SEQ ID NO: 6773 - DNA, 1263 bp, Escherichia coli
atgccacattcactgttcagcactgataccgatctcaccgccgaaaatctgctgcgtttgcccgcagaatttggctgcccggtgtgggtctacgatgcgcaaattattcgtcggcagattgcagcgctgaaacagtttgatgtggtgcgctttgcacagaaagcctgttccaatattcatattttgcgcttaatgcgtgagcagggcgtaaaagtggattccgtctcgttaggcgaaatagagcgtgcactggcggcgggttacaatccgcaaacgcaccccgatgatattgtttttacggcagatgttatcgatcaggcgacgcttgaacgcgtcagtgaattgcaaattccggtgaatgcgggttctgttgatatgctcgaccaactgggtcaggtttcgccagggcatcgggtatggctgcgtgttaatccggggtttggtcacgggcatagccaaaaaaccaataccggtggcgaaaacagcaagcacggtatctggtacaccgatctgcccgccgcactggacgtgatacaacgtcatcatctacagctggtcggcattcacatgcacattggttctggcgtcgattatgcccatctggaacaggtatgtggtgctatggtgcgtcaggtcctcgaattcggtcaggatttacaggctatttctgcgggcggtgggctttctattccttatcaacagggtgaagaggcggttgataccgaacattattatggtctgtggaatgccgcgcgtgagcaaatcgcccgccatttgggccatcctgtgaaactggaaattgaaccgggtcgctttctggtagcgcaggctggcgtattaattactcaagtgcggagcgtcaaacaaatgggtagccgccactttgtgctggttgatgccgggttcaacgatctgatgcgcccggcaatgtacggtagttaccaccatatcagtgccctggcagctgatggtcgttctctggaacacgcaccaacggtggaaaccgtcgtcgccgggccgttatgtgaatcgggcgatgtctttacccagcaggaagggggaaatgttgaaacccgcgccttgccggaagtgaaggcgtgtgattatctggtactgcatgatacaggggcatatggcgcatcaatgtcatccaactacaacagccgtccgctgttaccagaagttctgtttgataatggtcaggcgcggttgattcgccgtcgccagaccattgaagaattactggcgctggaattgctttaa

SEQ ID NO: 6774 - protein, 420 aa, Escherichia coli
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVLEFGQDLQAISAGGGLSIPYQQGEEAVDTEHYYGLWNAAREQIARHLGHPVKLEIEPGRFLVAQAGVLITQVRSVKQMGSRHFVLVDAGFNDLMRPAMYGSYHHISALAADGRSLEHAPTVETVVAGPLCESGDVFTQQEGGNVETRALPEVKACDYLVLHDTGAYGASMSSNYNSRPLLPEVLFDNGQARLIRRRQTIEELLALELL

SEQ ID NO: 6775 - DNA, 693 bp, Escherichia coli
atgaaaacaattggtttgctgggaggaatgagctgggaatccactattccttactatcgtctgataaatgaaggcattaaacagcggcttggtgggcttcactctgcgcaagtgctgctacatagcgtcgattttcatgaaatagaagagtgccagcgtcgcggtgagtgggacaaaaccggggatattctggctgaggcggcgcttggcttacagcgggcgggcgcagaaggtattgtgttatgcaccaatacgatgcataaagtggcggatgccattgagtctcgttgctctctgcctttcttacacatagcggatgccactggacgtgcaattaccggggcaggaatgactcgtgtggcgctgctgggtacacgttacaccatggaacaggatttttatcgcgggcggctgacggaacaattttccatcaactgtcttattcctgaagcggatgaacgggcgaaaattaatcagattatttttgaagaactgtgtctggggcaatttaccgaagcgtcacgcgcttattatgcgcaagtgattgctcgccttgcagaacagggcgcacagggcgtcatttttggctgcacagaaattggtttactggtgccagaagagcgcagtgttctgcctgtgtttgataccgcggcgatccatgccgaggatgctgtcgcttttatgctgtcgtag

SEQ ID NO: 6776 - protein, 230 aa, Escherichia coli
MKTIGLLGGMSWESTIPYYRLINEGIKQRLGGLHSAQVLLHSVDFHEIEECQRRGEWDKTGDILAEAALGLQRAGAEGIVLCTNTMHKVADAIESRCSLPFLHIADATGRAITGAGMTRVALLGTRYTMEQDFYRGRLTEQFSINCLIPEADERAKINQIIFEELCLGQFTEASRAYYAQVIARLAEQGAQGVIFGCTEIGLLVPEERSVLPVFDTAAIHAEDAVAFMLS

SEQ ID NO: 6777 - DNA, 936 bp, Escherichia coli
atggccgcagttaacttacgtcatattgaaatttttcatgcggtaatgaccgccggaagcctgactgaggcggcacacctgctacacacctcacagccaaccgtcagccgcgaactggcgcgctttgagaaggtgatcgggctgaaattgtttgagcgcatacgtggacgattacatcctaccgtgcaaggactgcgtctgtttgaagaagtgcaacgatcctggtacggactggatcgcattgtcagtgccgcagaaagtctgcgcgagtttcgccagggagaactgtctattgcctgcctgccggtcttttcgcaatcttttttaccgcagctcctgcaaccctttctggcacgttatcccgatgtcagcttaaatatcgtgccccaggaatcaccgctacttgaagagtggctctcggcccagcgtcatgatttaggactcactgaaacgctccatacgcctgcgggaacagaacgtaccgaattactctctttagatgaagtgtgtgtgttacctccgggccatccgctggcggtaaaaaaggtattaacgccggatgattttcacagtgagaactacatcagcctttcccgtactgacagctatcgccagttgctggatcaattgtttactgagaatcaggttaaacgacgcatgatcgtagaaacccacagcgccgcgtcagtctgcgcaatggtacgggcgggggtaggcgtttcggtggttaacccgctcaccgcactggattatgcggcaagcggtttagtggtgcggcggttcagcattgcggttccattcaccgtcagcctgatccgccccctgcaccgcccgtcatcagcgctggtgcaggcgtttagtgagcatttacaagcgggattaccgaaactggtcacttctcttgacgctattttgtcgtcagctacgacagcataa

SEQ ID NO: 6778 - protein, 311 aa, Escherichia coli
MAAVNLRHIEIFHAVMTAGSLTEAAHLLHTSQPTVSRELARFEKVIGLKLFERIRGRLHPTVQGLRLFEEVQRSWYGLDRIVSAAESLREFRQGELSIACLPVFSQSFLPQLLQPFLARYPDVSLNIVPQESPLLEEWLSAQRHDLGLTETLHTPAGTERTELLSLDEVCVLPPGHPLAVKKVLTPDDFHSENYISLSRTDSYRQLLDQLFTENQVKRRMIVETHSAASVCAMVRAGVGVSVVNPLTALDYAASGLVVRRFSIAVPFTVSLIRPLHRPSSALVQAFSEHLQAGLPKLVTSLDAILSSATTA

SEQ ID NO: 6779 - DNA, 1419 bp, Escherichia coli
atggttactatcaatacggaatctgctttaacgccacgtcctctgcgggatacgcggcgtatgaatatgtttgtttcggtagctgctgcggtcgcaggattgttatttggtcttgatatcggcgtaatcgccggagcgttgccgttcattaccgatcactttgtgctgaccagccgtttgcaggaatgggtggtcagtagcatgatgctcggcgcagcaattggtgcgctgtttaatgggtggctgtcgttccgcctggggcgtaaatacagcctgatggcgggggccatcctgtttgtactcggttcgatagggtccgcttttgcgaccagcgtagagatgttaatcgccgctcgtgtggtgttgggcattgctgttgggatcgcgtcttacaccgctcctctatatctttctgaaatggcaagtgaaaacgttcgcggtaagatgatcagcatgtaccagttgatggtcacactcggcatcgtgctggcgtttttatccgatacagcgttcagttatagcggtaactggcgcgcaatgttgggggttcttgctttaccagcagtcctgctgattattctggtggtcttcctgccaaatagcccgcgctggctggcggaaaaggggcgtcatattgaggcggaagaagtgttgcgtatgctgcgcgatacgtcggaaaaagcgcgagaagaactcaacgaaattcgtgaaagcctgaagttaaaacagggcggttgggcactgtttaagatcaaccgtaacgtccgtcgtgctgtatttctcggtatgttgttgcaggcgatgcagcagtttaccggtatgaacatcatcatgtactacgcgccacgtatcttcaaaatggcgggctttacgaccacagaacaacagatgattgcgactctggtcgtggggctgacctttatgttcgctaccttcattgcggtctttacggtagataaagcagggcgtaagccggctctgaaaattggtttcagcgtgatggcgttaggcactctggtgctgggttactgcctgatgcagtttgataacggtacggcttccagtggcttgtcctggctctctgttggcatgacgatgatgtgtattgccggttatgcgatgagcgccgcgccagtggtgtggatcttgtgctctgaaattcagccgctgaaatgccgcgattttggcatcacctgctcaacgacgacaaactgggtgtcgaatatgattatcggcgcgaccttcctgacactgcttgatagcattggcgctgccggtacgttctggctctacactgcgctgaacattgcgtttgtgggcatcactttctggctcattccggaaaccaaaaatgtcacgctggaacatatcgagcgcaaactgatggcaggcgaaaagttgagaaatatcggcgtctga

SEQ ID NO: 6780 - protein, 472 aa, Escherichia coli
MVTINTESALTPRPLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 6781 - DNA, 681 bp, Escherichia coli
ttggggctggcgcaagcgggctgtgacattgttggcattaacatcgttgaaccgactgaaaccatcaagcaggtcacggcgctggggcgtcgttttttaagcctgaccgccgatctgcgaaagattgatggcattccagcactgctggatcgcgcggtagctgagtttggtcatattgatatcctggtgaataacgccggattgattcgccgcgaagacgctctcgaattcagcgaaaaagactgggacgatgtcatgaacctgaatatcaagagcgtattcttcatgtctcaggcagcggcgaaacactttatcgcgcaaggcaatggcggcaagattatcaatatcgcgtcaatgctctccttccagggcgggatccgtgtgccttcttataccgcatcaaaaagcggcgtgatgggcgtgacgcgattgatggcgaatgaatgggctaaacacaacattaatgttaatgcgatagctccgggttacatggcgaccaacaatactcaacaactgcgggcagatgaacaacgtagcgcggaaattctcgaccgcattccagctggccgttggggactgccgagtgacctgatggggccggtagtgtttcttgcctccagcgcttcagattatgtaaatggttataccattgctgtggatggcggttggctggcgcgttaa

SEQ ID NO: 6782 - protein, 226 aa, Escherichia coli
MGLAQAGCDIVGINIVEPTETIKQVTALGRRFLSLTADLRKIDGIPALLDRAVAEFGHIDILVNNAGLIRREDALEFSEKDWDDVMNLNIKSVFFMSQAAAKHFIAQGNGGKIINIASMLSFQGGIRVPSYTASKSGVMGVTRLMANEWAKHNINVNAIAPGYMATNNTQQLRADEQRSAEILDRIPAGRWGLPSDLMGPVVFLASSASDYVNGYTIAVDGGWLAR

SEQ ID NO: 6783 - DNA, 837 bp, Escherichia coli
gtggacgtaagacagagcatccacagtgcgcacgcaaaaacgctggatacccaggggctgcgcaatgaatttttggttgaaaaggtatttgtcgccgatgagtacaccatggtttacagccacattgaccgtattattgttggcggcattatgccggtaactaaaacggtttccgttggcggggaagttggtaaacaactcggcgtaagctatttccttgaacgtcgcgagttaggtgttatcaatattggcggtgccggtacgattactgtcgatggtcaatgctatgaaatcggtcaccgcgacgccctgtatgttggtaaaggtgcaaaagaagttgtctttgccagtattgataccgccactccggcgaagttttattacaattgcgcacccgcgcatacgacgtatcccaccaaaaaagtcacaccggacgaagtatctccagtcacgttaggcgataacctcaccagtaaccgtcgcacgattaacaaatattttgtcccggatgtgctggaaacctgccaattgagtatggggctgacggagctggctccaggtaacttgtggaacaccatgccgtgtcacacccacgagcgccggatggaagtttatttctatttcaatatggatgatgacgcctgcgttttccacatgatggggcaaccgcaagaaacgcgtcacattgtgatgcataacgagcaggcggtgatctccccgagctggtcgatccattccggcgtcggaaccaaagcttatacctttatctggggcatggtcggtgaaaaccaggtttttgatgatatggaccatgtggccgttaaagatttgcgctag

SEQ ID NO: 6784 - protein, 278 aa, Escherichia coli
MDVRQSIHSAHAKTLDTQGLRNEFLVEKVFVADEYTMVYSHIDRIIVGGIMPVTKTVSVGGEVGKQLGVSYFLERRELGVINIGGAGTITVDGQCYEIGHRDALYVGKGAKEVVFASIDTATPAKFYYNCAPAHTTYPTKKVTPDEVSPVTLGDNLTSNRRTINKYFVPDVLETCQLSMGLTELAPGNLWNTMPCHTHERRMEVYFYFNMDDDACVFHMMGQPQETRHIVMHNEQAVISPSWSIHSGVGTKAYTFIWGMVGENQVFDDMDHVAVKDLR

SEQ ID NO: 6785 - DNA, 1182 bp, Escherichia coli
atgaaagacgttgtgattgtcggggcgttacggacacctatcggctgctttcgtggtgcgttagcgggtcattccgccgtggaacttggcagcctggtcgtcaaagcgttaatagaacgtaccggggttcctgcatatgcggtggatgaagtgattcttggtcaggtgttgactgcaggggcagggcagaatccggcaagacaatcggctattaaaggtggtcttcctaatagcgtttctgcaatcactattaatgacgtttgtggttccgggcttaaagcactgcatctggctactcaggcgatacagtgtggcgaggctgatattgtcatcgccggtggccaggaaaacatgagccgcgcaccacatgttctgactgatagccgcaccggcgcacagcttggcaatagccagttggttgatagtcttgtgcatgatgggttgtgggatgccttcaatgattatcatattggtgtcaccgccgaaaatctggctcgcgaatatggcatcagccgtcagttgcaggatgcttacgcacttagctcgcaacaaaaagcgcgagcggcgattgacgccggacgatttaaagatgagatcgtcccggtaataacccaaagtaacggtcagacgttggttgttgataccgatgaacagccacgcactgacaccagcgcagaaggcttagcccgtttaaatccttcatttgatagtctcggttctgtgacagcgggtaatgcatcatccataaacgatggggcagctgcagtaatgatgatgagcgaagccaaagcacgagcgttgaatttacccgtgctggcccgcatccgcgcatttgccagcgttggtgtggatccggcattgatgggaattgctccggtgtatgcgacccgccgttgcctggagcgtgttggctggcagttggctgatgtcgatcttatcgaggctaatgaagcgtttgctgcacaggcgctttcggttggcaagatgcttgaatgggatgagcgtcgggtcaatgttaatggtggtgcgatcgcactcggtcacccgataggcgcttccggttgccgaatcctggtttctcttgttcatgaaatggtgaaacgtaatgcccgcaaaggactggcaacgctttgtatcggcggaggccagggtgtggcattgaccattgaacgtgacgagtag

SEQ ID NO: 6786 - protein, 393 aa, Escherichia coli
MKDVVIVGALRTPIGCFRGALAGHSAVELGSLVVKALIERTGVPAYAVDEVILGQVLTAGAGQNPARQSAIKGGLPNSVSAITINDVCGSGLKALHLATQAIQCGEADIVIAGGQENMSRAPHVLTDSRTGAQLGNSQLVDSLVHDGLWDAFNDYHIGVTAENLAREYGISRQLQDAYALSSQQKARAAIDAGRFKDEIVPVITQSNGQTLVVDTDEQPRTDTSAEGLARLNPSFDSLGSVTAGNASSINDGAAAVMMMSEAKARALNLPVLARIRAFASVGVDPALMGIAPVYATRRCLERVGWQLADVDLIEANEAFAAQALSVGKMLEWDERRVNVNGGAIALGHPIGASGCRILVSLVHEMVKRNARKGLATLCIGGGQGVALTIERDE

SEQ ID NO: 6787 - DNA, 1230 bp, Escherichia coli
atgtctaatatttggtcaaaagaagaaactctgtggagtttcgcgctctacggcacagccgttggtgcaggcacgctcttccttcctattcagttaggttcggcgggggctgtggtcctgtttattactgctctggtcgcctggcctttaacatattggccacataaagccttatgccagttcatcctctcatcgaaaacatcagcaggtgaagggataacgggcgcggtaacacactactatggcaagaagattggtaatctgattaccacgctgtacttcatcgccttttttgtcgtcgtgttgatatatgcagtggcaattaccaactcacttacagaacagctggcaaagcatatggttattgatcttcgcatccgtatgttggtgagtctgggggttgtattaatcctgaatctcatttttctgatgggacgccatgccactattcgggtaatgggatttttggtattcccattgattgcctatttcttatttctttctatttacctggtcggtagttggcaacctgatctattaacaacccaggtagagttcaatcagaatacccttcaccagatatggatatcgattcccgtgatggttttcgcttttagccatacgcccattatttctacgtttgccatagacagacgtgaaaaatatggcgaacacgctatggataaatgcaaaaaaattatgaaagtcgcttatctcatcatctgcataagtgtattgttctttgtctttagctgcctgctttctattccaccttcgtatattgaagcggctaaagaagaaggggttaccattttatcggcgctttctatgctgccgaacgccccagcatggttgtcaatttccgggattattgtcgcagtagttgcgatgtcgaaatcattcctgggtacgtactttggcgttattgaaggtgccacagaggttgtcaaaacaacattacagcaggttggtgtaaagaaaagtcgtgcatttaaccgcgcactatcaattatgttggtatcgctgattaccttcattgtttgttgcattaacccgaacgcgatttcgatgatttacgcgatcagcggcccactcattgccatgatacttttcatcatgcctacgctgtcaacgtatctcatcccggcgcttaaaccctggcgttccatcggaaatctgattacgctgatcgtgggtatcctgtgcgtatcggtaatgttctttagctaa

SEQ ID NO: 6788 - protein, 409 aa, Escherichia coli
MSNIWSKEETLWSFALYGTAVGAGTLFLPIQLGSAGAVVLFITALVAWPLTYWPHKALCQFILSSKTSAGEGITGAVTHYYGKKIGNLITTLYFIAFFVVVLIYAVAITNSLTEQLAKHMVIDLRIRMLVSLGVVLILNLIFLMGRHATIRVMGFLVFPLIAYFLFLSIYLVGSWQPDLLTTQVEFNQNTLHQIWISIPVMVFAFSHTPIISTFAIDRREKYGEHAMDKCKKIMKVAYLIICISVLFFVFSCLLSIPPSYIEAAKEEGVTILSALSMLPNAPAWLSISGIIVAVVAMSKSFLGTYFGVIEGATEVVKTTLQQVGVKKSRAFNRALSIMLVSLITFIVCCINPNAISMIYAISGPLIAMILFIMPTLSTYLIPALKPWRSIGNLITLIVGILCVSVMFFS

SEQ ID NO: 6789 - DNA, 756 bp, Escherichia coli
ttgagtgcgggacgcctgaataaaaaatctctgggtatcgtgatgttgttatcggttggactgcttttggcgggctgttcgggtagcaaatcatccgatacaggaacgtattccggctccgtttacaccgtgaaacggggggatacgctatatcgtatttcgcgcaccacgggaaccagcgtaaaagaactggcgcgactgaacggcatttcccccccttacaccattgaagtaggtcagaaactaaaactgggtggggcgaaaagtagcagtagtacacgtaaatcaaccgccaaatcaacgaccaaaaccgcatcggttacaccgtcatcagcggtaccgaaatcttcctggccgccagtagggcaacgttgttggttatggccaacgacagggaaagttatcatgccgtattcgacagcagatggcggcaataaagggattgatatctcagctccacggggtacacctatttacgccgcgggtgcaggaaaggtggtgtatgtgggcaaccagctgcgtggctacggtaatctcatcatgattaaacacagtgaagattacattacggcttacgctcataatgacacgatgctggtaaataatgggcaaagcgtgaaggctgggcaaaaaatcgctaccatggggagcactgatgcggcatctgttcgcttgcatttccagattcgttaccgtgcaacggcaattgatccgctacgttacttgccgcctcagggcagcaagccaaaatgctga

SEQ ID NO: 6790 - protein, 251 aa, Escherichia coli
MSAGRLNKKSLGIVMLLSVGLLLAGCSGSKSSDTGTYSGSVYTVKRGDTLYRISRTTGTSVKELARLNGISPPYTIEVGQKLKLGGAKSSSSTRKSTAKSTTKTASVTPSSAVPKSSWPPVGQRCWLWPTTGKVIMPYSTADGGNKGIDISAPRGTPIYAAGAGKVVYVGNQLRGYGNLIMIKHSEDYITAYAHNDTMLVNNGQSVKAGQKIATMGSTDAASVRLHFQIRYRATAIDPLRYLPPQGSKPKC

SEQ ID NO: 6791 - DNA, 2259 bp, Escherichia coli
atgcgcgtcgatgccattgctaaggtcaccgggcgagcacgatatactgacgattatgttatggcgggcatgtgttacgcgaaatatgtacgtagccctatcgcacatggttatgccgtaagtattaatgatgaacaagccaggagtttgccgggcgtcctggcgatttttacctgggaagatgtgccagaaatcccattcgccacggcagggcatgcctggacacttgacgaaaacaagcgcgatactgccgatcgtgccctgctaacgcgccatgttcgtcatcatggcgacgccgttgccatcgtcgtggcccgcgatgaactcacggcagaaaaagcggcgcaattggtcagcattgagtggcaagaattacccgttatcacctcgccagaagcggcgctggcagaagacgctgcaccaatccataacggtggcaatttactgaaacaaagcacgatgtcgacgggtaatgtccaacaaacaatcgatgccgccgactaccaggtacaggggcactatcagactcccgttattcaacattgtcatatggaaagcgtgacatcgctggcatggatggaggatgactcgcgaattaccatcgtttccagcacccagatcccgcacattgttcgccgcgtggttggtcaggcgctggatattccctggtcatgcgtacgagtcatcaaaccgtttatcggtggcggttttggtaataaacaggatgtactggaagagccaatggcagcattcctgaccagcaaacttggcggcattccggtgaaagtttcccttagccgtgaagagtgtttcctcgcaacccgtacccgccacgcttttactattgacgggcaaatgggcgtgaaccgcgacggaacattgaaaggttatagtctggatgttctgtctaacaccggcgcttatgcatctcacgggcactccattgcttctgctggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgatgccgcgacagcgttaggtattgatcctgttgaaattcgtttacgcaacgccgcccgcgaaggagatgctaatccgctcacgggaaaacgtatttacagcgcagggttgccggagtgtcttgaaaaaggccggaaaatctttgaatgggaaaaacgccgtgcagagtgccagaaccagcaaggcaatttacgtcgtggcgttggcgtcgcctgttttagctacacctctaacacctggcctgtcggcgtagaaatagcaggcgcgcgcctgttgatgaatcaggatggaaccatcaacgtgcaaagcggcgcgacggaaatcggccagggtgccgacaccgtgttctcgcaaatggtggcagaaaccgtgggagttccggtcagcgatgtccgcgtaatttcgacacaagacaccgacgttacaccattcgaccccggcgcatttgcctcacgtcagagctatgttgccgcgcctgcgctgcgcagtgcggcactgttattaaaagagaaaatcatcgctcacgccgcagtcatgctacatcagtcagcgatgaatctgaccctgataaaaggccatatcgtgctggttgaacgaccggaagagccgttaatgtcgttaaaagatttggcgatggacgctttctaccaccctgaacgcggcgggcagctctctgccgaaagctccatcaaaaccaccactaacccacctgcgtttggctgtacctttgttgatctgacggtcgatattgcactgtgtaaagtcaccatcaaccgcatcctcaacgttcatgattcgggccatattcttaatccgctgctggcagaaggtcaggtacacggcggaatgggaatgggcattggctgggcgctatttgaagagatgatcatcgatgcgaaaagcggcgtggtccgtaaccccaatctgctggattacaaaatgccgaccatgccggatctgccacaactggaaagcgcgttcgtcgaaatcaatgagccgcaatccgcatacggacataagtcactgggtgagccacccataattcctgtagccgctgctattcgtaacgcggtgaagatggctaccggtgttgcaatcaatacactgccgctaacgccaaaacgattatatgaagaattccatctggcaggattgatttga

SEQ ID NO: 6792 - protein, 752 aa, Escherichia coli
MRVDAIAKVTGRARYTDDYVMAGMCYAKYVRSPIAHGYAVSINDEQARSLPGVLAIFTWEDVPEIPFATAGHAWTLDENKRDTADRALLTRHVRHHGDAVAIVVARDELTAEKAAQLVSIEWQELPVITSPEAALAEDAAPIHNGGNLLKQSTMSTGNVQQTIDAADYQVQGHYQTPVIQHCHMESVTSLAWMEDDSRITIVSSTQIPHIVRRVVGQALDIPWSCVRVIKPFIGGGFGNKQDVLEEPMAAFLTSKLGGIPVKVSLSREECFLATRTRHAFTIDGQMGVNRDGTLKGYSLDVLSNTGAYASHGHSIASAGGNKVAYLYPRCAYAYSSKTCYTNLPSAGAMRGYGAPQVVFAVESMLDDAATALGIDPVEIRLRNAAREGDANPLTGKRIYSAGLPECLEKGRKIFEWEKRRAECQNQQGNLRRGVGVACFSYTSNTWPVGVEIAGARLLMNQDGTINVQSGATEIGQGADTVFSQMVAETVGVPVSDVRVISTQDTDVTPFDPGAFASRQSYVAAPALRSAALLLKEKIIAHAAVMLHQSAMNLTLIKGHIVLVERPEEPLMSLKDLAMDAFYHPERGGQLSAESSIKTTTNPPAFGCTFVDLTVDIALCKVTINRILNVHDSGHILNPLLAEGQVHGGMGMGIGWALFEEMIIDAKSGVVRNPNLLDYKMPTMPDLPQLESAFVEINEPQSAYGHKSLGEPPIIPVAAAIRNAVKMATGVAINTLPLTPKRLYEEFHLAGLI

SEQ ID NO: 6793 - DNA, 879 bp, Escherichia coli
atgtttgattttgcttcttaccatcgcgcaaccacccttgccgatgccatcaccctgctggctgacaatccgcaggccaaattgcttgccggtggcactgacgtactgatacagcttcaccatcacaatgaccgctatcgccatattgttgatatccacaatctggcagagctgcggggaataacacaggcggaagatggcgcgctgcgaatcggctccgcgacaacatttactcagctcattgaagatcccgtaatccaacgcaatctcccggcgttatgtgctgcggctgcatcaatcgccgggccgcagatccgtaatgtcgccacctacggcggaaatatttgcaacggtgccaccagcgcagattctgccacgccaacgctaatttatgacgcgaaactggagctccactccccacgcggtgttcgtttcgtcccgattaatggctttcacaccgggccgggcaaagtgtctcttgagcatgacgaaatccttgtcgcctttcattttccgccacagccgaaagaacacgcgggcagcgcacattttaaatatgccatgcgcgacgcaatggatatttcaacaattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagccatcagcgaatcagtcctgcaagatgtcgccccgcgttcttcatggcgggccagtaaagagtttcgtctgcatctcatccagacgatgacccaaaaagtgattagcgaagccgtcgccgcggcggggggaaaattgcaatga

SEQ ID NO: 6794 - protein, 292 aa, Escherichia coli
MFDFASYHRATTLADAITLLADNPQAKLLAGGTDVLIQLHHHNDRYRHIVDIHNLAELRGITQAEDGALRIGSATTFTQLIEDPVIQRNLPALCAAAASIAGPQIRNVATYGGNICNGATSADSATPTLIYDAKLELHSPRGVRFVPINGFHTGPGKVSLEHDEILVAFHFPPQPKEHAGSAHFKYAMRDAMDISTIGCAAHCRLDNGNFSELRLAFGVAAPTPIRCQHAEQTAQNAPLNLQTLEAISESVLQDVAPRSSWRASKEFRLHLIQTMTQKVISEAVAAAGGKLQ

SEQ ID NO: 6795 - DNA, 480 bp, Escherichia coli
atgaatcacagcgaaacaattaccatcgaatgcaccattaacgggatgccttttcagcttcacgccgcgccaggaatgccgctttcggaactactccgagaacaagggcttcttagtgtcaaacaaggttgctgcgtaggcgaatgcggtgcctgtacggtgctggtcgacggcacagcaatagacagttgcttattccttgcggcctgggctgaaggaaaagagatccgcacgctggaaggtgaagcgaaaggtggaaaactttctcatgttcaactggcttatgcgaaatccggcgcagtgcaatgcgggttttgtacgccgggcctgattatggctaccacggcgatgctggcaaaaccacgcgaaaaaccattaaccattacggaaattcgtcgtggactggcgggaaatctttgtcgctgcacggggtatcagatgattgtaaatacagttctggattgcgagaaaacgaagtaa

SEQ ID NO: 6796 - protein, 159 aa, Escherichia coli
MNHSETITIECTINGMPFQLHAAPGMPLSELLREQGLLSVKQGCCVGECGACTVLVDGTAIDSCLFLAAWAEGKEIRTLEGEAKGGKLSHVQLAYAKSGAVQCGFCTPGLIMATTAMLAKPREKPLTITEIRRGLAGNLCRCTGYQMIVNTVLDCEKTK

SEQ ID NO: 6797 - DNA, 1779 bp, Escherichia coli
atggagcttgcgactacgcagtcagtattgatgcaaattcaaccgacaattcagcgttttgccagaatgcttgccagcgttttgcagcttgaggttgagatcgttgatgaaaacttgtgtcgcgtcgccggaacgggcgcgtatgggaagtttcttggccgccagttgagcggcaactcacgcctgctccgccacgtcctggaaacgaaaactgaaaaagttgtgacacagtctcgcttcgatcccctttgtgaaggttgcgatagtaaagaaaattgccgcgaaaaagcatttctgggtacgcctgtcattttacaggaacgttgtgttggggtgataagtttgattgccgttacccacgagcaacaagaacatatcagtgataatttacgcgaattttccgattacgttcgccatatatccaccatttttgtttctaaacttctggaggatcagggaccaggagataacatcagtaaaatattcgcgaccatgatcgataatatggatcagggcgtgttagtggttgatgctgataatcgggttcagtttgttaatcagacagctttaaaaacactcggtgttgtacaaaataatattattggaaaacctgttcgtttcagaccattaacatttgagagtaattttacccatggtcatatgcaacatattgtttcgtgggatgataaaagtgaattaatcattggtcagttgcataacatccagggccgacaactatttttaatggcgtttcaccaatcgcataccagtttttctgtagcaaatgcacctgatgaaccgcatattgaacaattggttggcgagtgccgtgttatgcggcaattaaaacgactcattagccgtattgcacccagcccatccagcgttatggtggttggtgaaagcggcacgggtaaagaagtcgtcgcccgtgcaatccataagttgagcggaagacggaataaaccctttattgctatcaactgtgccgcgattccggaacagcttctggagagcgaactgttcggttatgttaaaggcgcatttactggcgcttctgccaacggtaaaacagggttgattcaggcggcgaatacgggcacgctgtttctcgatgaaattggtgatatgccattaatgttgcaggctaaattactgcgcgctattgaggcgcgtgaaattctgccgattggtgccagtagcccaatacaagtcgacatccgcatcatttctgcaactaatcagaatttggcccagttcattgccgaaggtaaattccgcgaagatctcttctaccgacttaatgttatcccgataactcttccaccgctgcgtgaacgtcaggaagatattgaattactggtgcattactttttacatctgcatacccgtcgtctgggatcggtttatcctggcattgctcctgatgtcgtcgaaatattgcgtaagcatcgttggcccggaaacctgcgcgagttaagcaatttgatggaatatctggttaacgttgttccttcaggtgaagttatcgacagcacgctattgccgccaaatctgctgaataatggcacaacggagcaaagtgatgtaacagaggtcagtgaggcgcacctgtcactcgatgatgcgggcggcacggcgctggaggagatggaaaagcaaatgatccgcgaggcgctttcacgtcataacagcaagaaggaagttgctgatgaactgggcatcggcattgctacgctctatcgcaagattaagaaatatgagttgttaaacacataa

SEQ ID NO: 6798 - protein, 592 aa, Escherichia coli
MELATTQSVLMQIQPTIQRFARMLASVLQLEVEIVDENLCRVAGTGAYGKFLGRQLSGNSRLLRHVLETKTEKVVTQSRFDPLCEGCDSKENCREKAFLGTPVILQERCVGVISLIAVTHEQQEHISDNLREFSDYVRHISTIFVSKLLEDQGPGDNISKIFATMIDNMDQGVLVVDADNRVQFVNQTALKTLGVVQNNIIGKPVRFRPLTFESNFTHGHMQHIVSWDDKSELIIGQLHNIQGRQLFLMAFHQSHTSFSVANAPDEPHIEQLVGECRVMRQLKRLISRIAPSPSSVMVVGESGTGKEVVARAIHKLSGRRNKPFIAINCAAIPEQLLESELFGYVKGAFTGASANGKTGLIQAANTGTLFLDEIGDMPLMLQAKLLRAIEAREILPIGASSPIQVDIRIISATNQNLAQFIAEGKFREDLFYRLNVIPITLPPLRERQEDIELLVHYFLHLHTRRLGSVYPGIAPDVVEILRKHRWPGNLRELSNLMEYLVNVVPSGEVIDSTLLPPNLLNNGTTEQSDVTEVSEAHLSLDDAGGTALEEMEKQMIREALSRHNSKKEVADELGIGIATLYRKIKKYELLNT

SEQ ID NO: 6799 - DNA, 93 bp, Escherichia coli
gtgataaaaaaagccaaacgttttcgtattttaaaaacaaccggaaactggcatcaatatgtgatcaaccccacacattatccgtcaaattag

SEQ ID NO: 6800 - protein, 30 aa, Escherichia coli
MIKKAKRFRILKTTGNWHQYVINPTHYPSN

SEQ ID NO: 6801 - DNA, 1191 bp, Escherichia coli
atgatgaaaactgttaatgagctgattaaggatatcaattcgctgacctctcacctgcatgaaaaagattttttgttaacgtgggaacagacgccagacgaactgaaacaagtactggacgttgccgccgcgttaaaagcactgcgtgctgaaaacatctcaaccaaagtctttaatagtggattaggtatttccgtattccgcgacaattccacccgtacccgcttctcttatgcttccgcgcttaacctgctcggccttgcacaacaagatcttgacgaaggaaaatcacaaatcgctcacggcgaaaccgtgcgtgaaaccgccaatatgatctccttctgcgctgacgctatcggtattcgcgacgatatgtatctgggcgcaggcaacgcctatatgcgtgaagttggcgcggcacttgatgacggctacaaacaaggggttctgccacagcgtccggctttagtgaacctgcaatgcgatattgaccacccgactcaatcaatggctgatctggcatggttacgtgaacactttggttcactggaaaacctgaaaggtaaaaaaatcgccatgacctgggcctactccccaagctatggcaaaccgctctctgtaccacaaggcatcatcggtctgatgacccgcttcggtatggatgtcaccctggcccatccggaaggctacgacctgatcccggatgtcgttgaagttgctaaaaacaatgctaaagcctccggtggtagcttccgtcaggtcaccagcatggaagaagccttcaaagacgcagacatcgtttatccgaagtcatgggcaccttacaaagtgatggaagagcgtactgaattgctgcgtgcgaacgatcacgaaggcttaaaagcactggaaaaacagtgtctggcacagaacgcgcaacacaaagactggcattgtactgaagagatgatggaactgacccgtgatggcgaagccctgtacatgcactgcctgccagctgatatcagcggcgtatcctgcaaagaaggtgaagtgactgaaggcgtattcgaaaaataccgtatcgctacctacaaagaagccagctggaagccttatatcatcgccgcgatgatcctgtcccgtaaatacgccaaaccaggtgcactgctcgagcaactgctgaaagaagcgcaagaacgcgtgaaataa

SEQ ID NO: 6802 - protein, 396 aa, Escherichia coli
MMKTVNELIKDINSLTSHLHEKDFLLTWEQTPDELKQVLDVAAALKALRAENISTKVFNSGLGISVFRDNSTRTRFSYASALNLLGLAQQDLDEGKSQIAHGETVRETANMISFCADAIGIRDDMYLGAGNAYMREVGAALDDGYKQGVLPQRPALVNLQCDIDHPTQSMADLAWLREHFGSLENLKGKKIAMTWAYSPSYGKPLSVPQGIIGLMTRFGMDVTLAHPEGYDLIPDVVEVAKNNAKASGGSFRQVTSMEEAFKDADIVYPKSWAPYKVMEERTELLRANDHEGLKALEKQCLAQNAQHKDWHCTEEMMELTRDGEALYMHCLPADISGVSCKEGEVTEGVFEKYRIATYKEASWKPYIIAAMILSRKYAKPGALLEQLLKEAQERVK

SEQ ID NO: 6803 - DNA, 1197 bp, Escherichia coli
atgtccgttttctcattgaagattgatatcgccgataacaaatttttcaacggcgaaacatcaccgcttttttcgcaaagccaggcaaaactggcacgccagttccaccagaaaattgctggttatcacccaacaccgctttgtgcgctggacgatctcgcaaacctgtttggtgtaaagaaaattctcgtcaaagacgaatcaaaacgattcggtctgaacgccttcaaaatgctcggcggtgcgtacgccatcgctcaattattgtgtgaaaaatatcatcttgatatcgaaacgctgtcatttgagcacctgaaaaatgccatcggcgaaaaaatgactttcgcgactaccaccgacggcaaccacgggcgcggtgtggcatgggcagcacagcaactcggacagaatgcggtgatttacatgccgaaaggttctgctcaggaacgcgttgacgccattctaaacctcggtgccgagtgcatcgtcacggatatgaactatgacgataccgttcgcctgaccatgcaacacgcgcagcagcacggctgggaagtggtacaggacacggcatgggaaggttacaccaaaatcccaacctggatcatgcaaggctacgcaacactggcggatgaagccgtcgagcaaatgcgtgaaatgggcgtcaccccgacacacgttctgctgcaagccggtgtcggtgcaatggccggtggtgtgctgggttatctggtcgacgtctatagcccgcaaaatctgcacagcattattgttgaacctgacaaagctgactgtatttatcgctccggcgtcaaaggcgacatcgtcaacgttggcggtgatatggccaccatcatggcgggcctggcctgcggcgaacctaacccactgggctgggaaatcctacgtaactgcgccacccaattcatctcctgccaggacagcgttgccgcattaggtatgcgcgtgctgggtaatccgtatggcaacgacccgcgcatcatctccggtgaatccggcgctgtcggtttgggcgttctcgcagcggttcattatcacccgcaacgtcaaagcctgatggaaaaactggcgctgaacaaagatgccgtggtgctggttatcagcactgaaggcgacaccgacgtgaagcactaccgcgaagttgtctgggaaggcaaacacgctgtagcaccttaa

SEQ ID NO: 6804 - protein, 398 aa, Escherichia coli
MSVFSLKIDIADNKFFNGETSPLFSQSQAKLARQFHQKIAGYHPTPLCALDDLANLFGVKKILVKDESKRFGLNAFKMLGGAYAIAQLLCEKYHLDIETLSFEHLKNAIGEKMTFATTTDGNHGRGVAWAAQQLGQNAVIYMPKGSAQERVDAILNLGAECIVTDMNYDDTVRLTMQHAQQHGWEVVQDTAWEGYTKIPTWIMQGYATLADEAVEQMREMGVTPTHVLLQAGVGAMAGGVLGYLVDVYSPQNLHSIIVEPDKADCIYRSGVKGDIVNVGGDMATIMAGLACGEPNPLGWEILRNCATQFISCQDSVAALGMRVLGNPYGNDPRIISGESGAVGLGVLAAVHYHPQRQSLMEKLALNKDAVVLVISTEGDTDVKHYREVVWEGKHAVAP

SEQ ID NO: 6805 - DNA, 1212 bp, Escherichia coli
atggctaagaatattccattcaaactgattcttgaaaaagcaaaagattaccaggcagacatgactcgcttcctgcgcgatatggttgctattcccagtgaaagctgcgacgagaaacgcgtagtacatcgtattaaagaagagatggaaaaagtcggcttcgataaagttgaaatcgacccaatgggcaatgttctcggttatatcggccacggcccgcgtctggtggcaatggacgctcatatcgatacagtcggcattggcaacatcaaaaactgggacttcgatccgtatgaaggcatggaaaccgacgagctgatcggtggtcgtggtacttccgaccaggaaggcggcatggcgtctatggtatatgccggaaaaatcattaaagatctcggtctggaagatgaatataccctgctggtcaccggtactgtgcaggaagaagactgcgacggtctgtgctggcaatacattattgaacaatccggcattcgcccggaatttgtggtcagtaccgaaccaaccgactgccaggtataccgtggtcaacgcggtcgtatggaaattcgcattgatgttcagggtgttagctgccacggttcggcaccagaacgtggtgataacgccattttcaaaatgggtccaattcttggcgaattacaagaactctcccaacgtctgggttatgacgaattcctcggcaaaggcaccctcaccgtttctgaaattttcttcacctccccaagccgttgcgctgtcgcagacagctgcgcagtttcaatcgaccgtcgtctgacctggggcgaaacctgggaaggcgcgctggacgagatccgcgccctgcctgcagtacagaaagctaacgcggttgtttctatgtacaactacgaccgcccatcctggactggcctggtttacccaaccgaatgctacttcccgacctggaaagtggaagaagatcacttcaccgttaaagcactggtgaatgcttatgaagggctgtttggtaaagcgcctgtcgttgataagtggaccttctcaactaacggcgtatccatcatgggtcgccacggcattccggtcatcggttttggccctggtaaagaaccggaagcgcacgcgccaaacgaaaaaacctggaaatctcacctggtaacctgtgccgctatgtacgctgcaatcccattaagctggctggcaaccgaataa

SEQ ID NO: 6806 - protein, 403 aa, Escherichia coli
MAKNIPFKLILEKAKDYQADMTRFLRDMVAIPSESCDEKRVVHRIKEEMEKVGFDKVEIDPMGNVLGYIGHGPRLVAMDAHIDTVGIGNIKNWDFDPYEGMETDELIGGRGTSDQEGGMASMVYAGKIIKDLGLEDEYTLLVTGTVQEEDCDGLCWQYIIEQSGIRPEFVVSTEPTDCQVYRGQRGRMEIRIDVQGVSCHGSAPERGDNAIFKMGPILGELQELSQRLGYDEFLGKGTLTVSEIFFTSPSRCAVADSCAVSIDRRLTWGETWEGALDEIRALPAVQKANAVVSMYNYDRPSWTGLVYPTECYFPTWKVEEDHFTVKALVNAYEGLFGKAPVVDKWTFSTNGVSIMGRHGIPVIGFGPGKEPEAHAPNEKTWKSHLVTCAAMYAAIPLSWLATE

SEQ ID NO: 6807 - DNA, 1386 bp, Escherichia coli
atgcgcgtattgataaaaaacggcattgttgttaatgcagatggacaggcgaagcaggatttgctgattgaaagcgggattgttcgccagttgggtaccgatatttcgccgcaactcccttgcgaagaaattgatgcctctggctgttacgttttccctggcggcgtggatgtccatacgcatttcaatattgatgtcggcatcgcgcgcagttgtgatgatttttttaccggtacccgcgctgctgcgtgtggcggtacaacaaccattattgaccatatgggatttggcccaaatggctgccggttacgccatcaactggaagtttatcgcggttatgccgcccacaaagcagtcatcgactacagctttcacggtgtcattcaacatattaatcacgctatcctcgacgaaattccgatgatggttgaggaaggactgagcagttttaaactctatttaacctatcaatataaactcaacgatgatgaagtgttgcaggcattacgccgcttgcatgagtccggcgcgctgaccaccgtacacccggaaaatgacgcagctatcgccagcaagcgggcggagtttatcgccgcagggttaaccgcgccgcgttatcatgccttgagtcgacctctggaatgcgaagcggaagccatcgcccgcatgattaacctggcacaaattgccggtaacgccccgctctatatcgtgcacctgtctaacggcttaggtctggattatctgcgtcttgcccgtgcgaatcaccagccagtctgggttgaaacctgcccacaatatctcctgttggacgaacgcagttacgatacagaagatggcatgaagttcattcttagcccaccgctgcgtaacgtacgcgagcaggacaaactgtggtgtggcatcagcgatggtgcgattgacgtggtggcaaccgatcactgcaccttctcgatggctcaacgcctgcaaatttctaaaggcgatttcagccgctgcccaaatggcttacccggtgtggagaaccgcatgcaactgctgttctccagtggcgtgatgacgggacgtatctcactggagcgttttgttgagttaaccagtgcaatgcccgccaggctgtttggcctgtggccgcaaaaagggatattagcgcccggttccgatggtgacgtggtgattatcgacccacgtcagagccaacaaattcagcatcgccatctccacgacaacgccgactactcgccctgggaggggtttacctgtcagggcgcgattgtcagaacattatcccgtggtgaaacgattttctgcgacggcacctttacaggcaaagccgggcgaggtcgtttcctgcgacgcaaaccgtttgtccctcccgtgctctaa

SEQ ID NO: 6808 - protein, 461 aa, Escherichia coli
MRVLIKNGIVVNADGQAKQDLLIESGIVRQLGTDISPQLPCEEIDASGCYVFPGGVDVHTHFNIDVGIARSCDDFFTGTRAAACGGTTTIIDHMGFGPNGCRLRHQLEVYRGYAAHKAVIDYSFHGVIQHINHAILDEIPMMVEEGLSSFKLYLTYQYKLNDDEVLQALRRLHESGALTTVHPENDAAIASKRAEFIAAGLTAPRYHALSRPLECEAEAIARMINLAQIAGNAPLYIVHLSNGLGLDYLRLARANHQPVWVETCPQYLLLDERSYDTEDGMKFILSPPLRNVREQDKLWCGISDGAIDVVATDHCTFSMAQRLQISKGDFSRCPNGLPGVENRMQLLFSSGVMTGRISLERFVELTSAMPARLFGLWPQKGILAPGSDGDVVIIDPRQSQQIQHRHLHDNADYSPWEGFTCQGAIVRTLSRGETIFCDGTFTGKAGRGRFLRRKPFVPPVL

SEQ ID NO: 6809 - DNA, 933 bp, Escherichia coli
atgagtaagaaaattgttctcgccctgggcgggaatgcgctgggcgatgacctggctgggcaaatgaaagcggtaaaaattacttctcaggcaattgttgatttaattgcccagggacatgaggtcatcgtcactcatggcaacgggccacaggtgggcatgattaaccaggcctttgaagctgcagcaaaaactgaagcgcactcgccaatgctgccgatgtctgtctgtgttgccttaagccagggttatattggttacgatctacaaaacgccttaagagaagaactgctttctcgtggcattaataaacctgtagcaacgctggttacccaggtcgaagtcgatgctaacgatccggcattcctcaacccgaccaagccgattggttcgttctttaccgagcaagaagcagagctactgacaaaacagggttacactctgaaagaagatgcgggtcgcggctatcgtcgtgtcgttgcttcgccaaaaccggttgatatcattgaaaaagaaacggttaaagctctggtagatgccggacaggtggtgatcaccgttggcggtggtggtatccctgttattcgtgaaggtaaccatctgcgtggtgccagcgcggttatcgataaagactgggccagcgcccgtttagcagaaatgatcgatgccgatatgctgatcattctgactgcggtagaaaaagtggccattaacttcggaaaagagaatgaacagtggctcgatcgcctgtcgttaagtgatgctgaacgctttatcgaagaaggtcattttgcgaaaggttctatgctgcctaaagtggaagctgccgcctcgtttgctcgctctcgcgcaggtcgtgaagcactgattaccgtattgagcaaagcgaaagaagggattgaaggcaaaaccggaacggtgatttgtcagtaa

SEQ ID NO: 6810 - protein, 310 aa, Escherichia coli
MSKKIVLALGGNALGDDLAGQMKAVKITSQAIVDLIAQGHEVIVTHGNGPQVGMINQAFEAAAKTEAHSPMLPMSVCVALSQGYIGYDLQNALREELLSRGINKPVATLVTQVEVDANDPAFLNPTKPIGSFFTEQEAELLTKQGYTLKEDAGRGYRRVVASPKPVDIIEKETVKALVDAGQVVITVGGGGIPVIREGNHLRGASAVIDKDWASARLAEMIDADMLIILTAVEKVAINFGKENEQWLDRLSLSDAERFIEEGHFAKGSMLPKVEAAASFARSRAGREALITVLSKAKEGIEGKTGTVICQ

SEQ ID NO: 6811 - DNA, 1626 bp, Escherichia coli
atgaatattttcacagaggctgcaaaactcgaagagcaaaattgtccgtttgcgatggcgcaaattgttgatagccgaggctcaaccccccgccattctgcacaaatgttagtgcgcgccgatggttctatcgtcggtacaattggtggcggaatggttgaacggaaggtgattgaagagtcgcttcaggcattgcaggaacgtaagccgcgattattccatggacgtatggctcgtaacggtgcggatgctgtcgggtcagattgtggaggtgcaatgtcagtatttatcagcgtccatggtatgcgtccacgtctggtgttgattggtgcggggcatgtcaaccgggcgatagcccagagtgcggcgctattaggatttgatatcgccgttgctgatatttatcgcgaaagcctcaatcctgaactattcccaccatcaaccacgcttctccatgctgagtcgtttggtgcggcagtggaagcactggatattcgccctgataattttgtcctgattgccacgaataatcaggatcgtgaagccctcgacaaactcattgaacaacccattgcatggctggggttgctggcaagtcgccgcaaggttcagcttttcctgcgccaattgcgtgagaaaggcgtggctgaagaacatattgcccgtttacatgcgcccgttggttacaacataggtgcggaaacgccgcaggagatcgccatcagcgtgctggcagaaatattacaggtgaaaaataacgcgccgggtgggctgatgatgaagccttctcatccttccggacaccagctggtggtgattcgcggtgcgggggatatcgccagtggtgtagcgctacgtctgtatcatgcgggttttaaagtgatcatgttggaagtggaaaaaccgacagtgattcgttgtaccgtggcgtttgcccaggccgtgttcgatggcgaaatgacggtcgaaggcgtcaccgcccgcctggcaaccagctctgcggaagcgatgaaacttaccgaacgcggatttatccctgtgatggtagatcccacctgttcattgcttgatgaactgaaaccgctttgcgtggtggacgctattctggcgaaacagaatttgggaacgcgggcagatatggcaccagtaacaatcgcgcttgggccgggctttactgcagggaaggattgtcatgcggtaattgaaacaaatcgcgggcactggctcggtcaggtgatttactcaggttgtgcgcaggagaataccggtgttcccggcaatattatggggcataccacccgacgagtgatccgcgctcctgctgcaggcattatgcgatccaacgtgaaattaggcgatctggtgaaagagggcgatgtcattgcctggattggtgagcatgaaattaaagcaccgttgacggggatggtgcgtggcttgttgaacgacggactggccgtggtcggtggttttaaaattggtgatatcgatcctcgtggtgaaacggctgatttcaccagcgtttctgataaagcccgggcgattggcggcggcgtacttgaggcgttaatgatgttgatgcatcagggcgttaaagcgacaaaagaagtgctggaagtggcttaa

SEQ ID NO: 6812 - protein, 541 aa, Escherichia coli
MNIFTEAAKLEEQNCPFAMAQIVDSRGSTPRHSAQMLVRADGSIVGTIGGGMVERKVIEESLQALQERKPRLFHGRMARNGADAVGSDCGGAMSVFISVHGMRPRLVLIGAGHVNRAIAQSAALLGFDIAVADIYRESLNPELFPPSTTLLHAESFGAAVEALDIRPDNFVLIATNNQDREALDKLIEQPIAWLGLLASRRKVQLFLRQLREKGVAEEHIARLHAPVGYNIGAETPQEIAISVLAEILQVKNNAPGGLMMKPSHPSGHQLVVIRGAGDIASGVALRLYHAGFKVIMLEVEKPTVIRCTVAFAQAVFDGEMTVEGVTARLATSSAEAMKLTERGFIPVMVDPTCSLLDELKPLCVVDAILAKQNLGTRADMAPVTIALGPGFTAGKDCHAVIETNRGHWLGQVIYSGCAQENTGVPGNIMGHTTRRVIRAPAAGIMRSNVKLGDLVKEGDVIAWIGEHEIKAPLTGMVRGLLNDGLAVVGGFKIGDIDPRGETADFTSVSDKARAIGGGVLEALMMLMHQGVKATKEVLEVA

SEQ ID NO: 6813 - DNA, 771 bp, Escherichia coli
gtgaaaagtataattgacccatcggcattattcattgatttaggcgcgcagaaacgtcccactgtgatttctattgttggtgctggggggaaaaccagcttgcttttttggctggcagaactgttccaggcgagtggcaggcgtgtattaatcactacgacgacacatatgtttatgccaacatctcactggcccgtggttttctgtcgtgatcccgccatgcttcctcatgcgtcttttatatcccccatttcattttgttttcactgctggaaagcgaaccagggaaaagtgcagggatttacgccagaagcgattgatgcactggtacaacgaccagagtgtgacgtaattctcattgaggcagatggctcgcgtggaatgccgttaaaagcgcctgatgagcacgaaccttgcatacctaaaagcagttgctgcgtgattgctgtgatgggaggacatattttgggtgcgaaagtgagcacagaaaatgtccatcgctggtcgcagtttgctgatattactgggttaacacctgatgcacccttgcaactgagcgatctcgttgcgctggttcgccaccctcagggggcgtttaaaaacgtaccgcaaggttgtcggcgagtctggttcattaaccgtttttctcaatgtgagaatgcgattgcgcaaagcgagctccttcaaccgctgcaacaacacaacgtagaggcaatctggctgggcgatatacaagaacatcctgcaatcgcgcgcagatttgtgaattag

SEQ ID NO: 6814 - protein, 256 aa, Escherichia coli
MKSIIDPSALFIDLGAQKRPTVISIVGAGGKTSLLFWLAELFQASGRRVLITTTTHMFMPTSHWPVVFCRDPAMLPHASFISPISFCFHCWKANQGKVQGFTPEAIDALVQRPECDVILIEADGSRGMPLKAPDEHEPCIPKSSCCVIAVMGGHILGAKVSTENVHRWSQFADITGLTPDAPLQLSDLVALVRHPQGAFKNVPQGCRRVWFINRFSQCENAIAQSELLQPLQQHNVEAIWLGDIQEHPAIARRFVN

SEQ ID NO: 6815 - DNA, 579 bp, Escherichia coli
atgtcagccatcgactgtataattaccgccgcaggattatcatcaagaatggggcaatggaaaatgatgttaccctggcaacagggaacaattcttgatacaagtatcaaaaatgcgttgcagttttgtagccgaattattttagtcaccggctatcgtggtaatgaactgcacgagcgttatgcgaaccagagcaatatcactattatccacaacccagattatgcgcagggtttactgacatcagtaaaggccgcagtacccgcggtgcaaacagaacattgttttctcacccacggagatatgccaaccctcaccatcgatatttttagaaaaatctggtcgttacgaaatgatggcgcaatactgccactccataatggcatccccggccatccgattttagtgtcaaaaccatgcctgatgcaggcaatccagcgacccaatgtcaccaatatgcgtcaggcactccttatgggagaacattattccgtcgaaatagaaaatgcagaaataattttagatattgatactccggacgactttattacagcgaagaaaaggtatactgaaatttag

SEQ ID NO: 6816 - protein, 192 aa, Escherichia coli
MSAIDCIITAAGLSSRMGQWKMMLPWQQGTILDTSIKNALQFCSRIILVTGYRGNELHERYANQSNITIIHNPDYAQGLLTSVKAAVPAVQTEHCFLTHGDMPTLTIDIFRKIWSLRNDGAILPLHNGIPGHPILVSKPCLMQAIQRPNVTNMRQALLMGEHYSVEIENAEIILDIDTPDDFITAKKRYTEI

SEQ ID NO: 6817 - DNA, 3099 bp, Escherichia coli
atgggggatattatgcgtcccattccgtttgaggaacttttgacgcgcatatttgatgaataccaacaacaacgctcaatctttggtattcccgagcaacagttttactcacccgtaaaaggtaaaactgttagcgtcttcggtgaaacctgtgccactcccgtcggccctgccgctggcccgcacacgcaacttgcgcaaaacatcgtcacctcctggctgactggcggacgcttcatcgaactaaaaaccgtccaaattcttgaccgcctggagctggaaaagccctgtatcgatgccgaagacgagtgctttaacaccgaatggtctaccgaatttaccctgcttaaagcctgggatgaatacctcaaagcctggtttgccctgcaccttctcgaagcgatgttccagccttctgattccggtaaatcgttcatctttaatatgagcgtcggttacaacctcgaaggtattaagcaaccgccgatgcagcagttcatcgacaatatgatggacgcatctgaccatccgaaattcgctcaataccgcgatgcacttaataagctactccaggatgaggcatttttagcccgccacggattgcaggaaaaacgcgaaagcttgcaagccttacccgctcgcatccccaccagcatggtacaaggggttaccctctccaccatgcacggctgtcctccgcatgaaatcgaagccatttgccgctacatgctggaagaaaaagggctcaacacctttgtgaaactcaacccgaccttactggggtacgcgcgtgttcgtgagatcctcgatgtctgcggtttcggttacatcggcttaaaagaagagtcatttgatcacgacctcaagctgacgcaagcactggaaatgctggaacgcctgatggcactggcaaaagaaaaatcactcggctttggcgtaaaactgactaacactctcggcaccatcaacaataaaggcgcattgcccggtgaagagatgtatatgtcaggccgtgcgctgttcccgctctccatcaacgttgcagcagttctctctcgcgcctttgacggcaaactgcccatttcttattccggtggtgccagtcagctgactatccgcgatatttttgatactggtattcgccctattactatggcaaccgacctgctgaaacctggcggctatctgcgcttaagtgcctgcatgcgcgagctggaaggctccgacgcctggggacttgaccacgttgacgtcgaacgactgaacagactggcagcagacgcgttaaccatggaatacacccagaaacactggaagccagaagagcgtattgaagtggctgaagacctgccgctgaccgattgctacgttgccccctgtgttactgcctgcgctatcaagcaagatattccggaatacatccgtttgcttggcgaacaccgctatgccgacgcgctggaactcatctatcaacgcaacgccctgcccgccattaccggtcatatttgcgatcaccagtgccaatacaactgtacccgcctggattacgacagtgcgctgaatatccgcgaactgaaaaaagtcgccctggaaaaaggttgggatgaatataagcaacgctggcacaaaccagccggttccggttcacgccatccggtagccgtgattggtgcaggtccggcaggtctggcggcaggttacttccttgccagagcgggccatccggttacgctgtttgaacgagaagccaatgcgggcggcgtggtgaaaaatatcattcctcagttccgtattcctgcagagttaattcagcacgatatcgattttgttgccgatcacggcgtgaaatttgagtacggttgctcaccggatctgaccgtcgaacagttaaaaaatcagggcttccactatgttctgattgccaccggcactgataaaaatagcggtgtgaaactggcgggcgacaaccaaaatgtctggaaatcactccccttcctgcgtgaatacaacaagggcacagcgctcaagctgggcaaacatgtggtcgttgtcggggcgggtaacacggcaatggactgcgctcgtgcggcgttacgcgttccaggcgtagaaaaagcaacggtcgtttaccgtcgttcactgcaagagatgccagcatggcgcgaagagtatgaagaagcgttgcacgacggcgtggagttccgtttcctgaataatccggaacgtttcgatgctgatggcaccttaaccttgcgcgttatgtcgcttggcgaacctgatgagaaaggtcgtcgccgtccggttgaaaccaacgaaacagtaacactgcatgtagacagcctgatcaccgccattggtgaacagcaggatactgaagccctgaatgcgatgggcgtgccgctggacaaaaacggctggccagacgtcgaccataatggcgaaacgcgtctgagtgacgtctttatgatcggcgacgtacagcgcggaccatcctccattgtcgctgctgtcggaaccgcgcgtcgggcgaccgatgccatcctgagtcgggaaaatatccgttcccaccagaacgataaatactggaataacgtcaatccggcggaaatctatcaacgtaaaggcgatatctctgtcactctggtgaacagtgacgatcgtgatgcgtttgtcgcgcaggaagccgctcgctgccttgaatgtaactacgtttgcagcaagtgtgtggatgtctgcccgaaccgcgccaacgtatccattgcggtcccaggcttccagaaccgtttccagacgctgcacctcgacgcttactgtaacgaatgtggcaactgcgcccaattctgcccgtggaacggtaaaccgtacaaagacaaaatcaccgtcttcagcctgtcgcaagactttgataacagcagcaacccaggcttccttgtggaagattgccgggtacgcgtacgtctgaataaccaaagctgggtgttaaacatcgacagcgaaggtcagttcaacaacgtaccaccggagctgaacgatatgtgccgcatcattagccatgtccaccagcatcatcattatctgctgggccgcgtggaggtgtaa

SEQ ID NO: 6818 - protein, 1032 aa, Escherichia coli
MGDIMRPIPFEELLTRIFDEYQQQRSIFGIPEQQFYSPVKGKTVSVFGETCATPVGPAAGPHTQLAQNIVTSWLTGGRFIELKTVQILDRLELEKPCIDAEDECFNTEWSTEFTLLKAWDEYLKAWFALHLLEAMFQPSDSGKSFIFNMSVGYNLEGIKQPPMQQFIDNMMDASDHPKFAQYRDALNKLLQDEAFLARHGLQEKRESLQALPARIPTSMVQGVTLSTMHGCPPHEIEAICRYMLEEKGLNTFVKLNPTLLGYARVREILDVCGFGYIGLKEESFDHDLKLTQALEMLERLMALAKEKSLGFGVKLTNTLGTINNKGALPGEEMYMSGRALFPLSINVAAVLSRAFDGKLPISYSGGASQLTIRDIFDTGIRPITMATDLLKPGGYLRLSACMRELEGSDAWGLDHVDVERLNRLAADALTMEYTQKHWKPEERIEVAEDLPLTDCYVAPCVTACAIKQDIPEYIRLLGEHRYADALELIYQRNALPAITGHICDHQCQYNCTRLDYDSALNIRELKKVALEKGWDEYKQRWHKPAGSGSRHPVAVIGAGPAGLAAGYFLARAGHPVTLFEREANAGGVVKNIIPQFRIPAELIQHDIDFVADHGVKFEYGCSPDLTVEQLKNQGFHYVLIATGTDKNSGVKLAGDNQNVWKSLPFLREYNKGTALKLGKHVVVVGAGNTAMDCARAALRVPGVEKATVVYRRSLQEMPAWREEYEEALHDGVEFRFLNNPERFDADGTLTLRVMSLGEPDEKGRRRPVETNETVTLHVDSLITAIGEQQDTEALNAMGVPLDKNGWPDVDHNGETRLSDVFMIGDVQRGPSSIVAAVGTARRATDAILSRENIRSHQNDKYWNNVNPAEIYQRKGDISVTLVNSDDRDAFVAQEAARCLECNYVCSKCVDVCPNRANVSIAVPGFQNRFQTLHLDAYCNECGNCAQFCPWNGKPYKDKITVFSLSQDFDNSSNPGFLVEDCRVRVRLNNQSWVLNIDSEGQFNNVPPELNDMCRIISHVHQHHHYLLGRVEV

SEQ ID NO: 6819 - DNA, 1329 bp, Escherichia coli
atgttgattctgaagaatgtcaccgcagtgcagttacacccggcgaaagtgcaggaaggcgttgatatcgccatcgaaaatgatgtgattgtcgctatcgacgatgccctgacgcaacgctatcccgatgccagctacaaagagatgcatggtcggattgtgatgccgggaattgtctgctcgcacaaccatttttactcggggctgtcccgcggaattatggcaaacatcgccccctgcccggatttcatctcaacgctgaaaaatctctggtggcgactcgatcgcgcccttgatgaagagtcgctctattacagcggactgatttgttccctggaagcgattaagagtggatgtacatcggttatcgatcaccatgcctctccggcgtatatcgacgggtcgctctccacattgcgcaacgcatttttaaaagttggcctgcgcgcgatgacctgttttgaaactactgaccgtaacaacggcatcaaagagttgcaggaaggtgtagaagaaaacatccgcttcgcccgtcagattgatgaggcgaagaaagcagcaaccgagccgtatctggtggaagctcatatcggcgctcacgcgccgtttaccgtgccggatgccggtctggagatgctgcgtgaagccgtgaaaagcacaggtcgtggtttgcatattcacgctgcggaagacctttacgacgtttcctacagtcaccattggtacggcaaagacctgctggcacgactggcgcaattcgatctcatcgacagcaaaacgctggtcgctcatgggctgtacttgtcgaaagatgacatcgccctactcaatcagcgcgatgcgttcctggtgcataacgcccgttcaaacatgaacaaccatgtcggctacaaccatcaccttagcgacatccgcaatctggcgttgggaacggacggcattggttcggacatgtttgaagagatgaaatttgccttctttaaacatcgcgatgcgggtggcccgctgtggcctgacagttttgccaaagcactggctaacggcaacgaactgatgagccgcaactttggcgcgaaatttgggcttctggaagccggttacaaagccgatttaaccatttgcgattacaactcgccgacgccgctgctggcagacaatatcgccgggcatatcgctttcggtatgggctcaggcagcgttcacagcgtgatggtcaatggtgtgatggtctatgaagaccgtcagtttaacttcgattgcgattccatttatgcgcaagccagaaaagccgctgccagtatgtggcgtcggatggatgcgctggcataa

SEQ ID NO: 6820 - protein, 442 aa, Escherichia coli
MLILKNVTAVQLHPAKVQEGVDIAIENDVIVAIDDALTQRYPDASYKEMHGRIVMPGIVCSHNHFYSGLSRGIMANIAPCPDFISTLKNLWWRLDRALDEESLYYSGLICSLEAIKSGCTSVIDHHASPAYIDGSLSTLRNAFLKVGLRAMTCFETTDRNNGIKELQEGVEENIRFARQIDEAKKAATEPYLVEAHIGAHAPFTVPDAGLEMLREAVKSTGRGLHIHAAEDLYDVSYSHHWYGKDLLARLAQFDLIDSKTLVAHGLYLSKDDIALLNQRDAFLVHNARSNMNNHVGYNHHLSDIRNLALGTDGIGSDMFEEMKFAFFKHRDAGGPLWPDSFAKALANGNELMSRNFGAKFGLLEAGYKADLTICDYNSPTPLLADNIAGHIAFGMGSGSVHSVMVNGVMVYEDRQFNFDCDSIYAQARKAAASMWRRMDALA

SEQ ID NO: 6821 - DNA, 780 bp, Escherichia coli
atgattgaacaatttttcagacccgactcagtcgaacaggcgctggaactgaagcgccgctaccaggatgaagccgtctggttcgccgggggcagcaaactcaacgctacaccaacccgtaccgataaaaagattgccatttccttgcaggatctggagctggactggattgactgggataacggtgcactacgaattggcgcaatgtctcgcttgcagccactgcgtgatgcgcgatttattcctgcagcactgtgtgaagccctcggttttgtttactcacgccatgttcgtaatcagtcgaccattggtggtgaaatcgccgcccggcaggaagagtcggtgctgcttcccgtcctgctggcactggatgctgaactggtttttggcaacggcgaaacgctgtcaatcgaggactacctggcctgcccatgcgatcgcctgttaaccgaaattatcattaaagatccgtatcgcacctgtgcgactcgcaaaattagccgttctcaggcaggtttaaccgtcgtgacggcagccgttgcaataacagaccacgacggtatgcgaattgcgctggatggcgtagccagtaaagcactgcgtctgcatgatgttgaaactcaaaatctggaaggcaatgcacttgaacaggctgtcgccaacgccattttcccgcaggaagatttgcggggcagcgtggcctataaacgctatatcacgggagttctggtagccgacctgtatgccgactgccaacaggctggggaggaagccgtatga

SEQ ID NO: 6822 - protein, 259 aa, Escherichia coli
MIEQFFRPDSVEQALELKRRYQDEAVWFAGGSKLNATPTRTDKKIAISLQDLELDWIDWDNGALRIGAMSRLQPLRDARFIPAALCEALGFVYSRHVRNQSTIGGEIAARQEESVLLPVLLALDAELVFGNGETLSIEDYLACPCDRLLTEIIIKDPYRTCATRKISRSQAGLTVVTAAVAITDHDGMRIALDGVASKALRLHDVETQNLEGNALEQAVANAIFPQEDLRGSVAYKRYITGVLVADLYADCQQAGEEAV

SEQ ID NO: 6823 - DNA, 2871 bp, Escherichia coli
atgatcatccactttactttaaatggcgcgcctcaggagctaaccgttaatccaggcgaaaacgtgcaaaagctgttgtttaacatgggaatgcactctgtacgcaacagtgatgatggttttgggtttgccggttctgacgcaattatctttaacggtaatatcgttaacgcgtccttgcttatcgccgcacagttagagaaggcagatattcgtaccgcagaatctctgggcaaatggaacgagttaagtctggttcaacaggccatggttgatgttggcgtggtgcagtctggttataacgatccagctgcggctctgattatcaccgatcttctcgatcgcatcgacgcacctacccgcgaagagatcgacgacgcgctctcaggtctgtttagccgcgatgctggctggcagcaatactatcaggtcattgaactggcggttgcacgtaaaaataatccgcaggccaccattgatatcgctccgactttccgtgacgaccttgaagtcattggcaagcattatcctaaaactgatgccgcgaaaatggtgcaggcaaaaccctgctatgttgaagaccgcgtaacggctgacgcctgcgtcattaaaatgttacgtagcccacacgctcacgcactgattactcatctggatgtcagcaaagctgaagccttaccgggcgtcgttcacgttattactcacctgaattgcccggatatttactataccccgggtggtcagagcgcaccggaaccatcaccgcttgaccgccgtatgttcggcaagaaaatgcgtcacgtcggcgatcgcgttgctgcggtagtagccgaaagtgaagacattgcgctcgaagcactgaagctcatcgatgttgaatatgaagtgcttaagccggtaatgtcgattgacgaggcaatggcggaagatgcgcctgtcgtgcacgatgaaccggtggtgtatgttgctggtgcgccagatactctggaagatgataacagccatgcagcccagcgcggcgagcatatgatcatcaacttcccgatcggttctcgcccacgcaaaaatatcgctgccagtattcatggtcatattggcgatatggacaaaggctttgccgatgccgatgtgatcattgagcgaacctataactcaacgcaggcgcagcagtgcccgactgaaacacatatctgctttacccgtatggacggcgatcgtctggtgatccacgcctccacccaggtaccatggcacttacgccgccaggtcgcgcgcctcgtgggcatgaaacaacataaagttcatgtcattaaagaacgtgtaggcggcggttttggctctaaacaggacatcctgctggaagaagtgtgcgcctgggcaacttgcgtgaccgggcgtccggtacttttccgctacacccgtgaagaagagtttattgctaacacctctcgtcacgtagcgaaagtcaccgtcaaactgggcgcgaaaaaagatggtcgcctgacggcagtgaagatggatttccgcgccaacactggcccttacggtaaccactcactcaccgtaccgtgtaacggaccggcgctgtcgctgccgttatatccatgcgataacgtcgatttccaggtcaccacctactacagcaacatttgcccaaatggtgcttatcagggttatggcgcaccgaaaggtaacttcgctatcaccatggcattagcggaactggctgaacagttacagatcgaccaactggaaattatcgaacgtaaccgggtacacgaagggcaagagctgaaaattctcggtgcaatcggtgaaggtaaagcgccgacctccgttccttccgccgccagctgcgcactggaagagatcctgcgtcagggtcgcgagatgatccaatggtcttcaccaaaaccacaaaacggtgactggcacatcggtcgcggcgtcgccattatcatgcagaaatcagggatcccagatatcgatcaggctaactgcatgatcaaactggaatcagacggtacctttatcgttcattctggcggtgcggatattggtactggcctggatactgtggtgacgaaactggcagcagaagtgctgcactgccccccgcaggacgtgcatgttatctccggtgataccgatcatgcgttgtttgataaaggcgcatatgcctcgtccggtacttgcttctcgggtaacgctgcgcgtttggcagcggaaaatctgcgggagaaaatcctgttccacggcgcgcaaatgttgggtgagccagtggcagatgttcaactagcaacgccgggcgtcgttcgcggcaagaaaggcgaagttagtttcggagagatagcccataaaggcgaaaccggcaccggctttggttcactggtgggaactggcagttatatcacgcctgatttcgccttcccgtatggcgcaaacttcgctgaagttgccgtcaacacgcgtacgggtgaaatccgcctggataaattctacgccttgctggactgcggtacaccggtcaatccagagttagcgctgggacaaatctacggtgccaccctgcgtgctatcggccacagtatgagcgaagagatcatttatgacgccgaaggtcacccgttaacgcgtgatttacgcagttacggcgcaccgaaaattggtgacattccgcgtgatttccgcgctgtgctggtgccgagcgacgataaagtcggcccattcggggcgaaatcgatctcggaaatcggtgtaaatggcgccgctccggcgattgctaccgcaattcacgatgcctgcggcatctggttacgcgaatggcatttcacaccggagaaaatactcaccgcgctggaaaaaatataa

SEQ ID NO: 6824 - protein, 956 aa, Escherichia coli
MIIHFTLNGAPQELTVNPGENVQKLLFNMGMHSVRNSDDGFGFAGSDAIIFNGNIVNASLLIAAQLEKADIRTAESLGKWNELSLVQQAMVDVGVVQSGYNDPAAALIITDLLDRIDAPTREEIDDALSGLFSRDAGWQQYYQVIELAVARKNNPQATIDIAPTFRDDLEVIGKHYPKTDAAKMVQAKPCYVEDRVTADACVIKMLRSPHAHALITHLDVSKAEALPGVVHVITHLNCPDIYYTPGGQSAPEPSPLDRRMFGKKMRHVGDRVAAVVAESEDIALEALKLIDVEYEVLKPVMSIDEAMAEDAPVVHDEPVVYVAGAPDTLEDDNSHAAQRGEHMIINFPIGSRPRKNIAASIHGHIGDMDKGFADADVIIERTYNSTQAQQCPTETHICFTRMDGDRLVIHASTQVPWHLRRQVARLVGMKQHKVHVIKERVGGGFGSKQDILLEEVCAWATCVTGRPVLFRYTREEEFIANTSRHVAKVTVKLGAKKDGRLTAVKMDFRANTGPYGNHSLTVPCNGPALSLPLYPCDNVDFQVTTYYSNICPNGAYQGYGAPKGNFAITMALAELAEQLQIDQLEIIERNRVHEGQELKILGAIGEGKAPTSVPSAASCALEEILRQGREMIQWSSPKPQNGDWHIGRGVAIIMQKSGIPDIDQANCMIKLESDGTFIVHSGGADIGTGLDTVVTKLAAEVLHCPPQDVHVISGDTDHALFDKGAYASSGTCFSGNAARLAAENLREKILFHGAQMLGEPVADVQLATPGVVRGKKGEVSFGEIAHKGETGTGFGSLVGTGSYITPDFAFPYGANFAEVAVNTRTGEIRLDKFYALLDCGTPVNPELALGQIYGATLRAIGHSMSEEIIYDAEGHPLTRDLRSYGAPKIGDIPRDFRAVLVPSDDKVGPFGAKSISEIGVNGAAPAIATAIHDACGIWLREWHFTPEKILTALEKI

SEQ ID NO: 6825 - DNA, 1401 bp, Escherichia coli
atgtctgatataaaccatgcaggttctgaccttatatttgaactggaggatcgccctccctttcatcaggctctcgtaggtgccattacccatctgttggcaattttcgttccgatggtaacccccgcgttaatcgtgggtgcggccttacagctttccgctgaaacaactgcctatcttgtttctatggcgatgatcgcctctggtattggtacctggttacaagtaaaccgctacggcatcgtcggttctggtttactttcaattcagtcagtcaatttttcatttgttacggtcatgattgcgctgggcagcagcatgaaaagcgacggttttcacgaagagttaatcatgtcgtcgctcctcggcgtctccttcgttggcgcatttctggttgtcggctcttcttttatcctgccctatttacgtcgggttattacgcctaccgtcagcggcattgtggtgctgatgatcggcttaagcctgattaaagtcggcattattgattttggtggaggatttgcagccaaaagcagcggtacgttcggcaattacgaacatctcggcgttggcttattggttttgattgtggtgatcggctttaactgctgccgcagtccgttgctacgcatgggtgggatcgccattgggctatgtgtcggctatatcgcatcgttatgcctgggcatggtggatttcagcagtatgcgcaatttgccgttaatcaccatcccgcatccgttcaaatacggctttagttttagcttccatcagttcctggtggttggcacgatttatctgcttagcgtgctggaagctgtcggcgatatcaccgccacggcaatggtttcccgccgtcccattcagggggaagagtatcagtcccgactgaaaggcggcgtgctggcagatggtctggtttctgttatcgcctccgctgtcggttcattaccattaaccacgtttgcgcaaaataatggggttattcagatgactggcgtcgcttcacgttatgtcgggcgaaccatcgcggtaatgctggttatcctcggcttatttccgatgattggcggcttttttacgaccattccctcggcagttctgggaggcgcaatgacgttgatgttttccatgattgccatcgcagggattcgcatcatcatcaccaacggtttaaagcgccgagaaacacttattgtcgccacttctttaggtttaggacttggcgtctcctacgatcccgaaatttttaaaatattgccagcctctatttatgtattagttgaaaaccctatttgtgctggcgggttaactgcgattttattaaatattatcctccctggtggctaccgacaggaaaacgttctgcctggtattacctcagcggaagagatggattaa

SEQ ID NO: 6826 - protein, 466 aa, Escherichia coli
MSDINHAGSDLIFELEDRPPFHQALVGAITHLLAIFVPMVTPALIVGAALQLSAETTAYLVSMAMIASGIGTWLQVNRYGIVGSGLLSIQSVNFSFVTVMIALGSSMKSDGFHEELIMSSLLGVSFVGAFLVVGSSFILPYLRRVITPTVSGIVVLMIGLSLIKVGIIDFGGGFAAKSSGTFGNYEHLGVGLLVLIVVIGFNCCRSPLLRMGGIAIGLCVGYIASLCLGMVDFSSMRNLPLITIPHPFKYGFSFSFHQFLVVGTIYLLSVLEAVGDITATAMVSRRPIQGEEYQSRLKGGVLADGLVSVIASAVGSLPLTTFAQNNGVIQMTGVASRYVGRTIAVMLVILGLFPMIGGFFTTIPSAVLGGAMTLMFSMIAIAGIRIIITNGLKRRETLIVATSLGLGLGVSYDPEIFKILPASIYVLVENPICAGGLTAILLNIILPGGYRQENVLPGITSAEEMD

SEQ ID NO: 6827 - DNA, 1317 bp, Escherichia coli
atgtcaggagaacacacgttaaaagcggtacgaggcagttttattgatgtcacccgtacggtcgataacccggaagaaattgcctctgcgctgcggtttattgaggatggtttattactcattaaacagggaaaagtggaatggtttggcgaatgggaagacggaaagcatcaaattcctgacaccattcgcgtgcgcgactatcgcggcaaactgatagtaccgggctttatcgatacacatatccattatccgcaaagtgaaatggtgggggcctatggtgaacaattgctggagtggttgaataaacacaccttccctactgaacgtcgttatgaggatttagagtacgcccgcgagatgtcggcgttcttcatcaagcagcttttacgtaacggaaccaccacggcgctggtgtttggcactgttcatccacaatccgttgatgcgctgtttgaagccgccagtcatatcaatatgcgtatgattgccggtaaagtgatgatggaccgaaacgcaccggattatctgctcgacactgccgaaagcagctatcaccaaagcaaagaactgattgaacgctggcacaaaaatggtcgtctgttgtatgcgattacgccacgcttcgcccctacctcatctcctgaacagatggcgatggcgcaacgcctgaaagaagaatatccggatacatgggtacatacccatctctgtgaaaacaaagatgaaattgcctgggtgaaatcgctttatcctgaccatgatggttatcttgatgtttaccatcagtacggcctgaccggtaaaaactgcgtctttgctcactgcgtccatctcgaagaaaaagagtgggatcgtctcagcgaaaccaaatccagcattgctttctgtccgacctccaacctttacctcggcagcggcttattcaacttgaaaaaagcatggcagaagaaagtcaaagtgggcatgggaacggatatcggtgccggaacaacttttaacatgctgcaaacgctgaacgaagcctacaaggtattgcaattacaaggctatcgcctctcggcatatgaagcgttttacctggccacgctcggcggagcgaaatctctgggccttgacgatttgattggcaactttttacctggcaaagaggctgatttcgtggtgatggaacccactgccactccgctacagcagctgcgctatgacaactctgtttctttagtcgacaaattgttcgtgatgatgacgttgggcgatgaccgttcgatctaccgcacctacgttgatggtcgtctggtgtacgaacgcaactaa

SEQ ID NO: 6828 - protein, 438 aa, Escherichia coli
MSGEHTLKAVRGSFIDVTRTVDNPEEIASALRFIEDGLLLIKQGKVEWFGEWEDGKHQIPDTIRVRDYRGKLIVPGFIDTHIHYPQSEMVGAYGEQLLEWLNKHTFPTERRYEDLEYAREMSAFFIKQLLRNGTTTALVFGTVHPQSVDALFEAASHINMRMIAGKVMMDRNAPDYLLDTAESSYHQSKELIERWHKNGRLLYAITPRFAPTSSPEQMAMAQRLKEEYPDTWVHTHLCENKDEIAWVKSLYPDHDGYLDVYHQYGLTGKNCVFAHCVHLEEKEWDRLSETKSSIAFCPTSNLYLGSGLFNLKKAWQKKVKVGMGTDIGAGTTFNMLQTLNEAYKVLQLQGYRLSAYEAFYLATLGGAKSLGLDDLIGNFLPGKEADFVVMEPTATPLQQLRYDNSVSLVDKLFVMMTLGDDRSIYRTYVDGRLVYERN

SEQ ID NO: 6829 - DNA, 1368 bp, Escherichia coli
atgtctggagacatcctacaaacaccggacgcaccaaagccacagggcgcgctggataattattttaaaattaccgctcgtggcagtaccgttcgtcaggaagtactggctggcttaacgacctttctggccatggtttattccgttatcgtcgttccgggaatgctgggcaaagcaggttttcctcccgcagctgtgtttgttgccacctgtctggtcgcgggcttcggctcgttgctgatggggttatgggccaatttgccaatggcgattggttgcgctatttccttgacggcgtttaccgcattcagtctggtactcgggcaacaaattagcgttcctgtcgcactgggcgcagtctttctgatgggcgtcatcttcaccgctatttccgtaaccggtgtgcgtacctggatcttacgtaatttgccgatggggatcgctcacggtacaggtatcggtatcggcctgtttctgctgctgattgctgctaacggtgtgggaatggttataaaaaacccgattgaaggcttgccagtggcgctcggtgcctttacctccttcccggtgatgatgagcttactggggctggcggtcatcttcggtctggaaaagtgccgcgtacccggcgggatcttgttggtgattattgcaatttcgatcatcggcttaatctttgacccagcggtgaagtaccacggtctggtggcgatgccaagcctgactggcgaagatggtaagtctctgattttcagcctcgatattatgggcgcactccagccaactgtacttccgagtgtactggcattggtgatgaccgcagtgttcgacgccactggcaccatccgtgccgtcgccggtcaggcgaatttgttggataaagacaaccagatcatcaacggcggcaaagccctgaccagtgactcagtaagttcaatattctccggcctggtgggcgcagcgcccgcggcggtttatatcgaatcagcggcaggaaccgccgccggggggaaaaccggtttaaccgcaaccgtggttggtgtgttgttcctgatgattctgtttttatcaccgttatcgtttctgatccccggttatgccacagctcccgcactgatgtacgtgggtttgctgatgttaagcaacgtctcgaagctggatttcaacgattttattgacgcaatggctggcctggtgtgtgccgtgttcatcgttctgacttgtaatatcgttaccggtattatgctgggctttgtaacactggtggtgggtcgcgtctttgcgcgcgaatggcaaaagctgaatattggtacggtgatcattactgccgcactggtcgcgttttacgcgggtggttgggcaatctaa

SEQ ID NO: 6830 - protein, 455 aa, Escherichia coli
MSGDILQTPDAPKPQGALDNYFKITARGSTVRQEVLAGLTTFLAMVYSVIVVPGMLGKAGFPPAAVFVATCLVAGFGSLLMGLWANLPMAIGCAISLTAFTAFSLVLGQQISVPVALGAVFLMGVIFTAISVTGVRTWILRNLPMGIAHGTGIGIGLFLLLIAANGVGMVIKNPIEGLPVALGAFTSFPVMMSLLGLAVIFGLEKCRVPGGILLVIIAISIIGLIFDPAVKYHGLVAMPSLTGEDGKSLIFSLDIMGALQPTVLPSVLALVMTAVFDATGTIRAVAGQANLLDKDNQIINGGKALTSDSVSSIFSGLVGAAPAAVYIESAAGTAAGGKTGLTATVVGVLFLMILFLSPLSFLIPGYATAPALMYVGLLMLSNVSKLDFNDFIDAMAGLVCAVFIVLTCNIVTGIMLGFVTLVVGRVFAREWQKLNIGTVIITAALVAFYAGGWAI

SEQ ID NO: 6831 - DNA, 489 bp, Escherichia coli
atgaaatcgttaattatcgttaatccggctgactgtattggctgccgtacttgtgaagtggcctgtgtggtcgctcacccttcagaacaggagttgaatgccgatatctttttaccccggctgaaggtacaacggctggatagcatcagtgcgccggtgatgtgccatcagtgtgaaaacgccccttgtgttggcgcttgtcccgtgggggcgctgacgatgggcgagcaggtggtgcaggcaaattctgcccgttgtattggctgtcagagttgcgtcagtgcgtgcccgtttggaatgatcaccattcagtcattgccgggggatacccggcaacaaatcgtgaaatgcgatctctgtgaacagcgggaagaggggccagcctgcgttgaatcttgcccgacacaggcgctgcagttgctgactgaaagagaactcaggcgagtccgccagcagcgtattgttgccagcagtgagaatcctctgtga

SEQ ID NO: 6832 - protein, 162 aa, Escherichia coli
MKSLIIVNPADCIGCRTCEVACVVAHPSEQELNADIFLPRLKVQRLDSISAPVMCHQCENAPCVGACPVGALTMGEQVVQANSARCIGCQSCVSACPFGMITIQSLPGDTRQQIVKCDLCEQREEGPACVESCPTQALQLLTERELRRVRQQRIVASSENPL

SEQ ID NO: 6833 - DNA, 1920 bp, Escherichia coli
atgaataagtttatcgctgctgaagctgcggaatgtataggctgccatgcttgtgaaattgcctgtgcggtggcacataatcaagaaaactggccgctgagtcacagtgactttcgaccgcgtatccacgttgtagggaaaggccaggctgcgaatccggtggcctgccatcactgcaacaatgccccttgcgttacggcttgtccggttaatgctctgactttccagtccgatagcgtacaactggacgagcaaaaatgtattggttgtaaaagatgcgcaatcgcttgcccctttggcgtcgttgagatggtcgatacgattgcacagaaatgcgacctttgtaaccagcgcagttccggcacgcaagcctgtattgacgtctgcccaacacaggcgttacggctgatggacgataaagggttgcagcagataaaggtggcccgccagcgcaaaacggcagcaggaaaagcgtcatcagacgctcagccatctcgcagtgcagcgttgctccccgttaactcgcgtaaaggcgcagataaaatttcagcgagtgaacggaaaacccactttggcgaaatctattgcgggctggatccacaacaagcgacttatgagagtgaccgctgtgtttattgtgccgaaaaagctaactgcaactggcattgtccgctgcataacgctattccggattacatccgtctggtacaggaaggaaagattattgaagcggcagaactttgccaccagaccagttccttacccgaaatctgcggcagggtatgtccacaggaccgtctttgtgaaggtgcatgtactttgaaagatcactctggcgcagtctctatcggtaatctggaacgctacatcaccgatactgcgctggcgatgggctggcgtcccgatgtcagcaaagttgttccccgtagcgaaaaagtggcggtgattggcgctggacctgcaggattagggtgtgctgatattctggcgcgcgcgggagttcaggttgatgtctttgatcgccatccagaaattggcggtatgctgacttttggcattcctcctttcaaactcgataaaacggtattaagccagcggcgagagatattcaccgcaatgggaatcgatttccatctcaactgtgaaattggccgcgatatctctttcaacgaattaacggcggaatatgatgctgttttcctcggcgtggggacttacgggatgatgcgagcagatctgccgcatgaagatgcgcctggtgtcattcaggcgttaccgttcctgaccgcccatacccgccagctcatgggattgccggagtctgcagagtatccgctgacggatgtggaaggtaagcgagttgtggtattgggcggtggcgatacgacaatggattgtttgcggacttccatccgccttaatgctgccagcgtgacctgtgcgtatcgtcgtgatgaagtcagtatgccgggttcgcgcaaagaggtggtcaatgcccgcgaggaaggtgttgagtttcagttcaatgttcagccgcaatatatcgcttgtgatgaagatggacgcttaacggcggtgggcctgattcgtaccgctatgggtgagccggggccggatggccgccgtcgtcctcgtccggttgcgggttcagagtttgaattgcccgccgatgttctcattatggcctttggtttccaggcacataccatgccgtggttgcagggcagcggaattaaactcgataaatggggcctgattcaaaccggcgacgtcgggtatttacccacccagacgcatctgaaaaaagtctttgctggtggtgatgcagttcatggcgcagatctggttgtcactgcaatggccgcaggaaggcaggcggcgcgcgatatgttaactctgtttgatacgaaggcatcgtga

SEQ ID NO: 6834 - protein, 639 aa, Escherichia coli
MNKFIAAEAAECIGCHACEIACAVAHNQENWPLSHSDFRPRIHVVGKGQAANPVACHHCNNAPCVTACPVNALTFQSDSVQLDEQKCIGCKRCAIACPFGVVEMVDTIAQKCDLCNQRSSGTQACIDVCPTQALRLMDDKGLQQIKVARQRKTAAGKASSDAQPSRSAALLPVNSRKGADKISASERKTHFGEIYCGLDPQQATYESDRCVYCAEKANCNWHCPLHNAIPDYIRLVQEGKIIEAAELCHQTSSLPEICGRVCPQDRLCEGACTLKDHSGAVSIGNLERYITDTALAMGWRPDVSKVVPRSEKVAVIGAGPAGLGCADILARAGVQVDVFDRHPEIGGMLTFGIPPFKLDKTVLSQRREIFTAMGIDFHLNCEIGRDISFNELTAEYDAVFLGVGTYGMMRADLPHEDAPGVIQALPFLTAHTRQLMGLPESAEYPLTDVEGKRVVVLGGGDTTMDCLRTSIRLNAASVTCAYRRDEVSMPGSRKEVVNAREEGVEFQFNVQPQYIACDEDGRLTAVGLIRTAMGEPGPDGRRRPRPVAGSEFELPADVLIMAFGFQAHTMPWLQGSGIKLDKWGLIQTGDVGYLPTQTHLKKVFAGGDAVHGADLVVTAMAAGRQAARDMLTLFDTKAS

SEQ ID NO: 6835 - DNA, 1449 bp, Escherichia coli
atgagcgccatagattaccaacttccctcatcttctgggcaagaccgcccaactgatgaggttgaccgcatattatcaccaggaaagctgatcatactcggtctgcaacacgtccttgtcatgtacgcaggtgcagtcgctgttcctcttatgattggtgaccgactcggcctatcaaaagaagctattgcgatgctcatcagctcggatctcttttgctgcgggatcgtcacattattgcaatgtatcggtatcggccgctttatggggatccgcctgccggtgattatgtcggtgaccttcgccgctgtaacaccaatgatagctattggtatgaacccggatatcggcctgctggggatattcggtgccactatcgccgcgggttttatcaccacattattagcgccacttatcggtcgcttgatgcctttattcccgccactggttaccggtgtggttattacttctatcgggcttagcatcattcaggtgggtattgactgggccgccggaggtaaagggaatccgcaatatggtaatcccgtttatttaggtatctcctttgccgtcttaatttttatcttgctcattactcgctatgcgaaaggatttatgtccaacgtcgccgtattactggggattgtatttggttttttactttcgtggatgatgaatgaagtcaatttatccgggctacatgatgcttcatggtttgcgattgtcacgccgatgtcatttggtatgccgattttcgatcccgtttccattctgaccatgactgccgtgttaatcatcgtgtttatcgagtcgatggggatgttcctggcactgggtgaaatagtcggtcgtaaactctcttcacacgatattattcgcgggctgcgtgtcgatggtgtagggacaatgataggcggaacgtttaacagcttcccccacacgtcattttctcaaaacgttggcctggttagcgtgacgcgcgttcatagccgctgggtgtgcattgcttccggtatcattttgatcctgttcggcatggtgcccaaaatggcggtgctggtggcctcgattccgcaatttgtgctgggcggcgcggggctggtgatgttcggcatggtactggcgacagggattcgaattctgtcgcgctgtaactacaccactaaccgttacaacctctatattgtggcgatcagtctcggtgttggcatgacgccaacgctctctcacgatttcttttctaagttaccggccgtactgcaaccgttgctgcatagcggcattatgctcgcaacccttagcgccgttgtgctgaacgtcttctttaatggctaccagcatcatgctgacctggtgaaggaatccgtctctgataaagatttaaaagtcaggacagtacgtatgtggcttctgatgcgcaagctgaagaaaaatgagcatggagaataa

SEQ ID NO: 6836 - protein, 482 aa, Escherichia coli
MSAIDYQLPSSSGQDRPTDEVDRILSPGKLIILGLQHVLVMYAGAVAVPLMIGDRLGLSKEAIAMLISSDLFCCGIVTLLQCIGIGRFMGIRLPVIMSVTFAAVTPMIAIGMNPDIGLLGIFGATIAAGFITTLLAPLIGRLMPLFPPLVTGVVITSIGLSIIQVGIDWAAGGKGNPQYGNPVYLGISFAVLIFILLITRYAKGFMSNVAVLLGIVFGFLLSWMMNEVNLSGLHDASWFAIVTPMSFGMPIFDPVSILTMTAVLIIVFIESMGMFLALGEIVGRKLSSHDIIRGLRVDGVGTMIGGTFNSFPHTSFSQNVGLVSVTRVHSRWVCIASGIILILFGMVPKMAVLVASIPQFVLGGAGLVMFGMVLATGIRILSRCNYTTNRYNLYIVAISLGVGMTPTLSHDFFSKLPAVLQPLLHSGIMLATLSAVVLNVFFNGYQHHADLVKESVSDKDLKVRTVRMWLLMRKLKKNEHGE

SEQ ID NO: 6837 - DNA, 549 bp, Escherichia coli
atgcaaacggaacacgtcattttattgaatgcacagggagttcccacgggtacgctggaaaagtatgccgcacacacggcagacaccctcttacatctcgcgttttccagttggctgtttaatgccaaagggcaattattagttacccgccgcgcccttagcaaaaaagcgtggcctggcgtgtggactaactcggtttgtgggcacccacaactgggagaaagcaacgaagaggcggtgatccgccgttgccgttatgagcttggcgtagaaattacgcctcctgaatctatctatcctgactttcgctaccgcgccaccgatccgaatggcattgtggaaaatgaagtgtgtccggtatttgccgcacgcacgaccagtgcgttacagatcaacgatgatgaagtgatggattatcaatggtgtgatttagcagcggttttacgcggtattgatgctacgccgtgggcgttcagtccgtggatggtgatgcaggcgacaaatcgcgaagccagaaaacgattatctgcatttacccagcttaaataa

SEQ ID NO: 6838 - protein, 182 aa, Escherichia coli
MQTEHVILLNAQGVPTGTLEKYAAHTADTLLHLAFSSWLFNAKGQLLVTRRALSKKAWPGVWTNSVCGHPQLGESNEEAVIRRCRYELGVEITPPESIYPDFRYRATDPNGIVENEVCPVFAARTTSALQINDDEVMDYQWCDLAAVLRGIDATPWAFSPWMVMQATNREARKRLSAFTQLK

SEQ ID NO: 6839 - DNA, 1518 bp, Escherichia coli
atgtctgaacaacacgcacagggcgctgacgcggtagtcgatcttaacaatgaactgaaaacgcgtcgtgagaagctggcgaacctgcgtgagcaggggattgccttcccgaacgatttccgtcgcgatcatacctctgaccaattgcacgcagaattcgacggtaaagagaacgaagaactggaagcgctgaacatcgaagtcgccgttgctggccgcatgatgacccgtcgtattatgggtaaagcgtctttcgttaccctgcaggacgttggcggtcgcattcagttgtacgttgcccgtgacgatctgccggaaggcgtttacaacgagcagttcaaaaaatgggacctcggcgatatcctcggcgcgaaaggtaaactgttcaaaaccaaaaccggcgaactgtctatccactgtaccgagctgcgtctgctgaccaaagcactgcgtccgctgccggataaattccacggcttgcaggatcaggaagcgcgctatcgtcagcgttatctggatctcatctctaacgatgaatcccgcaacacctttaaagtgcgctcgcagatcctctctggtattcgccagttcatggtgaaccgcggctttatggaagttgaaacgccgatgatgcaggtgatccctggcggtgccgctgcgcgtccgtttatcactcaccataacgcgctggatctcgacatgtacctgcgtatcgcgccggaactgtacctcaagcgtctggtggtcggtggcttcgagcgtgtattcgaaatcaaccgtaacttccgtaacgaaggtatttccgtacgtcataacccagagttcaccatgatggaactctatatggcttacgcagattacaaagatcttatcgagctgaccgaatcgctgttccgtactctggcacaggatattctcggtaagacggaagtgacctacggcgacgtaacgctggacttcggtaaaccgttcgaaaaactgaccatgcgtgaagcgatcaagaaatatcgcccggaaactgacatggcggatctggacaacttcgactctgcgaaagcgattgctgaatctatcggcatccacgttgagaaaagctggggtctgggccgtatcgttaccgagatcttcgaagaagtggcagaagcacatctgatccagccgaccttcattactgaatatccggcagaagtttctcctctggcgcgtcgtaacgacgttaacccggaaatcacagaccgctttgagttcttcattggtgggcgtgaaatcggtaacggctttagcgagctgaatgacgcggaagatcaggcgcagcgcttcctggatcaggttgccgcgaaagatgcaggtgacgacgaagcgatgttctacgacgaagattatgtcaccgcactggaacatggcttaccaccgacagccggtctgggaattggtatcgaccgtatggtaatgctgttcaccaacagccataccatccgcgacgttattctgttcccggcgatgcgtccggtaaaataa

SEQ ID NO: 6840 - protein, 505 aa, Escherichia coli
MSEQHAQGADAVVDLNNELKTRREKLANLREQGIAFPNDFRRDHTSDQLHAEFDGKENEELEALNIEVAVAGRMMTRRIMGKASFVTLQDVGGRIQLYVARDDLPEGVYNEQFKKWDLGDILGAKGKLFKTKTGELSIHCTELRLLTKALRPLPDKFHGLQDQEARYRQRYLDLISNDESRNTFKVRSQILSGIRQFMVNRGFMEVETPMMQVIPGGAAARPFITHHNALDLDMYLRIAPELYLKRLVVGGFERVFEINRNFRNEGISVRHNPEFTMMELYMAYADYKDLIELTESLFRTLAQDILGKTEVTYGDVTLDFGKPFEKLTMREAIKKYRPETDMADLDNFDSAKAIAESIGIHVEKSWGLGRIVTEIFEEVAEAHLIQPTFITEYPAEVSPLARRNDVNPEITDRFEFFIGGREIGNGFSELNDAEDQAQRFLDQVAAKDAGDDEAMFYDEDYVTALEHGLPPTAGLGIGIDRMVMLFTNSHTIRDVILFPAMRPVK

SEQ ID NO: 6841 - DNA, 882 bp, Escherichia coli
atgaaacaggggctggaagatgtttctggtctgctggaactggctgtagaagctgacgacgaagaaacctttaacgaagccgttgctgaactcgacgccctggaagaaaaactggcgcagcttgagttccgccgtatgttctctggcgaatatgacagcgccgactgctacctcgatattcaggcggggtctggcggcacggaagcacaggactgggcgagcatgcttgagcgtatgtatctgcgctgggcagaatcgcgtggtttcaaaactgaaattatcgaagagtcggaaggtgaagtggcgggtattaaatccgtaacgatcaaaatctccggcgattacgcttacggctggctgcgtacagaaactggcgttcaccgcctggtgcgtaagagcccgtttgactccggcggtcgtcgccacacgtcgttcagctccgcgtttgtttacccggaagttgatgacgatatcgatatcgaaatcaatccggcggatctgcgcattgacgtttatcgcgcgtccggcgcgggcggtcagcacgttaaccgtaccgaatctgcggtgcgtattactcacatcccgaccgggatcgtgactcagtgccagaacgaccgttcccagcacaagaacaaagaccaagccatgaagcagatgaaagcgaagctttatgaactggagatgcagaagaaaaatgccgagaaacaggcgatggaagacaataaatccgacatcggctggggcagccagattcgttcttatgtccttgatgactcccgcattaaagatctgcgtaccggggtagaaacccgcaacacgcaggccgtgctggacggcagcctggatcaatttatcgaagcaagtttgaaagcagggttatga

SEQ ID NO: 6842 - protein, 293 aa, Escherichia coli
MKQGLEDVSGLLELAVEADDEETFNEAVAELDALEEKLAQLEFRRMFSGEYDSADCYLDIQAGSGGTEAQDWASMLERMYLRWAESRGFKTEIIEESEGEVAGIKSVTIKISGDYAYGWLRTETGVHRLVRKSPFDSGGRRHTSFSSAFVYPEVDDDIDIEINPADLRIDVYRASGAGGQHVNRTESAVRITHIPTGIVTQCQNDRSQHKNKDQAMKQMKAKLYELEMQKKNAEKQAMEDNKSDIGWGSQIRSYVLDDSRIKDLRTGVETRNTQAVLDGSLDQFIEASLKAGL

SEQ ID NO: 6843 - DNA, 1734 bp, Escherichia coli
gtgaaacaacagatacaacttcgtcgccgtgaagtcgatgaaacggccgacttgcccgctgaattgcctcccttgctgcgccgtttatatgccagccggggtgtgcgtagcgcgcaggaactggaacgcagtgttaaaggcatgctgccctggcagcaactgagcggcgtcgaaaaggccgttgagatcctttacaacgcttttcgcgaaggcacgcggattattgtggtcggtgatttcgacgccgacggtgccaccagcacggctctaagcgtgctggcgatgcgctcgcttggttgcagcaatatcgactacctggttccaaaccgtttcgaagacggttacggcttaagcccggaagtagtcgatcaggctcatgcccgtggcgcgcagttaattgtcacggtggataacggtatttcctcccatgcgggggttgaacacgctcgttcgttgggcattccggttattgttaccgatcaccatttgccaggcgacacattacccgcagcggaagcgatcattaaccctaacttgcgcgactgtaatttcccgtcgaaatcactggcaggcgtgggtgtggcgttttatctgatgctggcgctgcgcacctttttgcgcgatcagggctggtttgatgagcgcggcatcgcaattcctaatctggcagaactgctggatctggtagcgttggggacagtggcggacgtcgtgccgctggacgctaataatcgcattctgacctggcaggggatgagtcgcatccgtgccggaaagtgccgtccggggattaaagcgctgctggaagtggccaatcgcgatccacaaaaactcgccgccagcgatttaggttttgcgctggggccacgtctcaatgctgccgggcgactggacgatatgtccgttggcgtggcgctgttgctgtgcgacaacatcggcgaagcgcgcgtgctggcaaatgaactcgatgcgctaaaccagacgcgaaaagagatcgaacagggaatgcaagttgaagccctgaccttgtgcgagaaactggagcgcagccgcgacacgctacccggcgggctggcaatgtatcaccccgaatggcatcagggcgttgttggcattctggcatcgcgtatcaaagagcgttttcaccgtccggttatcgcctttgcgccagctggtgatggtacgctgaaaggttccggtcgctccattcaggggctgcatatgcgtgatgcgctggagcgattagacacactctaccccggcatgatgctcaagtttggcggtcatgcgatggcggcgggtttgtcgctggaagaggataaattcgaactctttcaacaacggtttggcgaactggttacggagtggttggacccttcgctattgcaaggcgaagtggtgtcggacggtccgttaagtccggccgaaatgaccatggaagtggcgcagctgttgcgcgatgctggcccgtgggggcagatgttcccggagccgctgtttgacggtcattttcgtctgctgcaacagcggctggtgggcgaacgtcatttgaaagtcatggtcgaaccggtcggcggcggtccactgctggacgggattgcttttaatgtcgataccgccctctggccggataacggtgtgcgcgaagtgcaactggcttacaagctcgatatcaacgagtttcgcggcaaccgcagcctgcaaattatcatcgacaatatctggccaatttag

SEQ ID NO: 6844 - protein, 577 aa, Escherichia coli
MKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGDTLPAAEAIINPNLRDCNFPSKSLAGVGVAFYLMLALRTFLRDQGWFDERGIAIPNLAELLDLVALGTVADVVPLDANNRILTWQGMSRIRAGKCRPGIKALLEVANRDPQKLAASDLGFALGPRLNAAGRLDDMSVGVALLLCDNIGEARVLANELDALNQTRKEIEQGMQVEALTLCEKLERSRDTLPGGLAMYHPEWHQGVVGILASRIKERFHRPVIAFAPAGDGTLKGSGRSIQGLHMRDALERLDTLYPGMMLKFGGHAMAAGLSLEEDKFELFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPI

SEQ ID NO: 6845 - DNA, 711 bp, Escherichia coli
atgaagaaaggttttatgttatttaccttgttggcagcgttttcaggctttgttcaggctgatgacgcggcaattcaacaaacgttagccaaaatgggcatcaaaagcagcgatattcagcccgcgcccgttgctggcatgaagacagttctgactaacagcggtgtgttgtacatcaccgatgatggtaaacatatcattcaggggccaatgtatgacgttagtggcacggctccggtcaatgtcaccaataagatgctgttaaagcagttgaatgcgcttgaaaaagagatgatcgtttataaagcgccgcaggaaaaacacgtcatcaccgtgtttactgatattacctgtggttactgccacaaactgcatgagcaaatggcagactataacgcgctggggatcaccgtgcgttatcttgctttcccgcgccaggggctggacagcgatgcagagaaagaaatgaaagctatctggtgtgcgaaagataaaaacaaagcgtttgatgatgtgatggcaggtaaaagcgtcgcaccagccagctgcgacgtggatattgccgaccattacgcacttggcgtccagcttggcgttagcggtactccggcagttgtgctgagcaatggcacacttgttccaggttaccagccgccgaaagacatgaaagaattcctcgacgaacaccaaaaaatgaccagcggtaaataa

SEQ ID NO: 6846 - protein, 236 aa, Escherichia coli
MKKGFMLFTLLAAFSGFVQADDAAIQQTLAKMGIKSSDIQPAPVAGMKTVLTNSGVLYITDDGKHIIQGPMYDVSGTAPVNVTNKMLLKQLNALEKEMIVYKAPQEKHVITVFTDITCGYCHKLHEQMADYNALGITVRYLAFPRQGLDSDAEKEMKAIWCAKDKNKAFDDVMAGKSVAPASCDVDIADHYALGVQLGVSGTPAVVLSNGTLVPGYQPPKDMKEFLDEHQKMTSGK

SEQ ID NO: 6847 - DNA, 897 bp, Escherichia coli
gtgaaacaggagctggcacgcatcgagcagtttcttgatgctctgtggctggaaaaaaatctggctgaaaatacgttgaacgcttaccgtcgcgatctgtcaatgatggtggagtggttgcatcaccgcgggttgacgctggcgacggcgcaaagtgacgatttgcaggcattactggcagaacggctggagggcgggtataaagccaccagctcagcgcgtttgctgagtgcagtgcgccgattgttccagtatctttatcgcgaaaagtttcgtgaagatgatcccagtgcgcatctcgcttcaccgaaattgccccagcgtttgccaaaagatttaagcgaagcgcaggtcgaacgtttattacaggcaccattaattgatcagccactggagctacgcgataaagccatgcttgaagtgttgtatgctaccggactgcgtgtctctgaactggtcgggttgacaatgagtgatatcagcctgcgtcagggcgtagtgcgggtcattggtaaaggcaacaaagagcgcctggtgccgttaggtgaagaggcggtttactggctggaaacctatctggaacatgggcgtccgtggctgttgaatggtgtgtcaattgacgtgttgtttcccagccagcgtgcgcagcagatgacgcgacagaccttctggcaccgcattaaacattatgccgtgctggcgggtatcgacagcgaaaagctgtcaccgcatgtgttgcgtcacgcttttgccactcacttattaaatcatggtgcggatttgcgcgtggtgcagatgctactgggccacagcgatctctccaccacgcaaatttatacgcatgtcgctaccgagcgtctgcggcaacttcatcaacagcatcacccgcgggcgtga

SEQ ID NO: 6848 - protein, 298 aa, Escherichia coli
MKQELARIEQFLDALWLEKNLAENTLNAYRRDLSMMVEWLHHRGLTLATAQSDDLQALLAERLEGGYKATSSARLLSAVRRLFQYLYREKFREDDPSAHLASPKLPQRLPKDLSEAQVERLLQAPLIDQPLELRDKAMLEVLYATGLRVSELVGLTMSDISLRQGVVRVIGKGNKERLVPLGEEAVYWLETYLEHGRPWLLNGVSIDVLFPSQRAQQMTRQTFWHRIKHYAVLAGIDSEKLSPHVLRHAFATHLLNHGADLRVVQMLLGHSDLSTTQIYTHVATERLRQLHQQHHPRA

SEQ ID NO: 6849 - DNA, 522 bp, Escherichia coli
atgaatatgggtcttttttacggttccagcacctgttacaccgaaatggcggcagaaaaaatccgcgatattatcggcccagaactggtgaccttacataacctcaaggacgactccccgaaattaatggagcagtacgatgtgctcatcctgggtatcccgacctgggattttggcgaaatccaggaagactgggaagccgtctgggatcagctcgacgacctgaacctcgaaggtaaaattgttgcgctgtatgggcttggcgatcaactgggatacggcgagtggttcctcgatgcgctcggtatgctgcatgacaaactctcgaccaaaggcgtgaagttcgtcggctactggccaacggaaggatatgaatttaccagcccgaaaccggtgattgctgacgggcaactgttcgtgggtctggcgctggatgaaactaaccagtatgaccttagcgacgagcgtattcaaagctggtgcgagcaaatcctcaacgaaatggcagagcattacgcctga

SEQ ID NO: 6850 - protein, 173 aa, Escherichia coli
MNMGLFYGSSTCYTEMAAEKIRDIIGPELVTLHNLKDDSPKLMEQYDVLILGIPTWDFGEIQEDWEAVWDQLDDLNLEGKIVALYGLGDQLGYGEWFLDALGMLHDKLSTKGVKFVGYWPTEGYEFTSPKPVIADGQLFVGLALDETNQYDLSDERIQSWCEQILNEMAEHYA

SEQ ID NO: 6851 - DNA, 408 bp, Escherichia coli
gtggtcctgtggcaatctgatttgcgcgtctcctggcgcgcacagtggctttccttgctgattcatgggctggttgccgctgttattttactcatgccctggccgctcagttacaccccgttatggatggtgttactttcgctggtggtgtttgattgcgttcgcagccagcggcgcattaatgctcgccagggggaaattcgcctgttgatggacgggcgtttgcgctggcaagggcaggagtggagcatcgtcaaagcgccgtggatgattaagagcggcatgatgctgcgtttacgttctgatagcggtaaacggcaacatttatggctggcagccgacagcatggacgaagccgaatggcgggatttacggcggattttgttgcaacaagagacgcaaagataa

SEQ ID NO: 6852 - protein, 135 aa, Escherichia coli
MVLWQSDLRVSWRAQWLSLLIHGLVAAVILLMPWPLSYTPLWMVLLSLVVFDCVRSQRRINARQGEIRLLMDGRLRWQGQEWSIVKAPWMIKSGMMLRLRSDSGKRQHLWLAADSMDEAEWRDLRRILLQQETQR

SEQ ID NO: 6853 - DNA, 267 bp, Escherichia coli
atggacattaacaacaaagcccgcattcattgggcatgccgccgtggtatgcgcgaactcgatatttcaatcatgccgtttttcgaacatgagtacgacagcttaagcgatgacgaaaaacgcatctttattcgtctgctggaatgtgacgatccggacctgtttaactggctgatgaatcacggtaaaccagccgatgcagaactggaaatgatggtccgactcatccagacacggaaccgggaacgtggtcctgtggcaatctga

SEQ ID NO: 6854 - protein, 88 aa, Escherichia coli
MDINNKARIHWACRRGMRELDISIMPFFEHEYDSLSDDEKRIFIRLLECDDPDLFNWLMNHGKPADAELEMMVRLIQTRNRERGPVAI

SEQ ID NO: 6855 - DNA, 981 bp, Escherichia coli
atggcttttacaccttttcctccccgtcagcctacggcttctgcccgtttgccactgacgctgatgacgcttgatgactgggcgcttgccactattactggcgcggacagcgaaaaatatatgcaaggccaggtgacagcagatgtcagccagatgactgaagatcagcacctgctcgccgcccattgcgacgccaaaggtaaaatgtggagcaatttacgtctgttccgcgacggcgatggctttgcatggattgaacggcgcagcgtgcgtgaaccgcagctgactgaactgaaaaaatatgcggtgttctctaaagtgaccatcgcgccagacgacgagcgtgtgctgcttggtgttgccggttttcaggcgcgcgccgcgttggcaaatctctttagtgaactaccttcgagagaaaaacaggtagtcaaagaaggcgcgaccacgttgctatggtttgaacacccggcagaacgtttcctgatcgtaaccgatgaagctactgccaatatgctgaccgataaactgcgcggtgaagcggaactgaacaatagccaacagtggctggcattaaacattgaagcgggttttccggtgattgatgccgccaacagcgggcagtttatcccccaggcgaccaacctccaggcgctgggcggtatcagctttaagaaaggctgctataccggacaagagatggtggcgcgagcaaaattccgtggtgccaacaaacgcgcgctctggttgctgaagggtagcgccagccgactgccggaagctggtgaagacttagagctgaaaatgggcgagaactggcgtcgtaccggtacggtgctggctgcggtcaaactggaagatggtcaggttgtggtgcaggttgtcatgaataacgatatggaaccggacagcatcttccgcgtgcgtgacgatgcgaatacattgcgtatcgagccactgccatattcgctggaagagtaa

SEQ ID NO: 6856 - protein, 326 aa, Escherichia coli
MAFTPFPPRQPTASARLPLTLMTLDDWALATITGADSEKYMQGQVTADVSQMTEDQHLLAAHCDAKGKMWSNLRLFRDGDGFAWIERRSVREPQLTELKKYAVFSKVTIAPDDERVLLGVAGFQARAALANLFSELPSREKQVVKEGATTLLWFEHPAERFLIVTDEATANMLTDKLRGEAELNNSQQWLALNIEAGFPVIDAANSGQFIPQATNLQALGGISFKKGCYTGQEMVARAKFRGANKRALWLLKGSASRLPEAGEDLELKMGENWRRTGTVLAAVKLEDGQVVVQVVMNNDMEPDSIFRVRDDANTLRIEPLPYSLEE

SEQ ID NO: 6857 - DNA, 660 bp, Escherichia coli
atggttcagaagcccctcattaagcagggatattcgctggcagaggaaattgccaacagcgtcagtcacggcattgggctggtgtttggtatcgttgggctggtgttgctactggttcaggcggtggatctcaatgccagcgccacggcgataaccagttacagcctctatggcggcagtatgatcctgctgttcctcgcttcgacgctctatcacgccattccccatcaacgggcaaaaatgtggctgaagaaatttgaccactgtgccatttatctgttgattgccggaacctatacgccgtttttgctggtggggctggattctccgttagcgcgcgggttgatgattgttatctggagcctggcattgctgggtattctgtttaaactgaccatcgcgcaccgattcaaaattttatctctggtgacctatctggcgatgggctggctgtcgctggtggtaatttatgaaatggcagttaagctcgcggcgggcagcgttaccttactggcggtaggcggtgtggtttattcgctcggggtgattttctacgtctgcaagcgcattccatacaatcatgccatctggcacggctttgtgctcggcggtagtgtgtgccactttctggcgatctatttgtatattgggcaggcgtaa

SEQ ID NO: 6858 - protein, 219 aa, Escherichia coli
MVQKPLIKQGYSLAEEIANSVSHGIGLVFGIVGLVLLLVQAVDLNASATAITSYSLYGGSMILLFLASTLYHAIPHQRAKMWLKKFDHCAIYLLIAGTYTPFLLVGLDSPLARGLMIVIWSLALLGILFKLTIAHRFKILSLVTYLAMGWLSLVVIYEMAVKLAAGSVTLLAVGGVVYSLGVIFYVCKRIPYNHAIWHGFVLGGSVCHFLAIYLYIGQA

SEQ ID NO: 6859 - DNA, 312 bp, Escherichia coli
atgcagccaaacgacatcactttttttcaacgtttccaggatgacattctggctgggcgtaaaaccatcaccatccgcgacgagtctgaatcgcacttcaaaacgggtgatgtgcttcgtgtcggacgttttgaagatgacggttatttttgcacgattgaagtcaccgcaacctcaaccgtaacgctggatacgctgacggaaaaacatgcagagcaggaaaatatgaccctgactgaactgaaaaaggtcattgccgacatctatcccgaccagacacagttttatgtgattgaatttaaatgtctttaa

SEQ ID NO: 6860 - protein, 103 aa, Escherichia coli
MQPNDITFFQRFQDDILAGRKTITIRDESESHFKTGDVLRVGRFEDDGYFCTIEVTATSTVTLDTLTEKHAEQENMTLTELKKVIADIYPDQTQFYVIEFKCL

SEQ ID NO: 6861 - DNA, 1434 bp, Escherichia coli
gtgaaaaaactcaccttaccgaaagatttcttatggggcggcgcagttgccgctcatcaggtcgaaggcggctggaacaaaggcggcaaagggccgagcatttgtgacgttctgaccggtggcgcacacggcgtgccgcgcgaaatcaccaaagaagttgtgcctggcaaatactatccaaaccatgaagccgttgatttttatggtcactacaaggaggacatcaagctatttgccgaaatgggcttcaaatgttttcgtacttccatcgcctggacgcgcatttttccaaaaggcgatgaagctcagccaaacgaagaagggctgaagttctacgatgatatgatcgatgaactgctgaaatacaacatcgaaccggtgatcaccctctcccactttgaaatgccgctgcatctggtgcagcaatatggtagctggaccaaccgtaaagtggttgatttctttgtccgtttcgcggaagtggtatttgaacgctataagcataaagtcaaatactggatgaccttcaacgaaattaacaaccagcgtaactggcgtgcaccgctgttcggttactgctgctccggcgtggtgtataccgagcatgaaaacccggaagagacgatgtatcaggtgctgcatcaccagtttgtcgccagcgccctggcggtgaaagccgcgcatcgcatcaacccggagatgaaagtcggttgtatgctggcgatggtgccgctctatccttactcctgtaacccggacgatgtgatgtttgcccaggagtcgatgcgcgaacgttacgtctttaccgatgtgcagttgcgtggctattacccgtcctatgtgttgaacgagtgggaacgccgcggatttaacatcaaaatggaagacggcgatctggatgtactgcgcgaaggcacctgcgattatctcggcttcagctattacatgaccaacgcggtgaaggccgaaggcggcaccggcgatgcgatctctggttttgaaggcagcgtaccgaacccgtatgttaaagcgtctgactggggctggcagattgatccggttggtctgcgttacgcgctttgcgagctgtatgagcgttaccagaagccgctgtttattgtcgaaaacggttttggcgcttacgacaaagtggaagatgatggcagcatcaatgacgattaccgcattgactacctgcgcgcccatattgaagagatgaaaaaagcggtgacttacgatggcgtggacctgatgggctacacgccgtggggctgcatcgactgtgtgtcgttcaccaccgggcagtacagcaaacgctacggctttatctatgtgaataaacatgacgacggtactggcgatatgtcgcgttcacgtaagaagagctttaactggtacaaagaggtgattgccagcaacggcgagaatctgtaa

SEQ ID NO: 6862 - protein, 477 aa, Escherichia coli
MKKLTLPKDFLWGGAVAAHQVEGGWNKGGKGPSICDVLTGGAHGVPREITKEVVPGKYYPNHEAVDFYGHYKEDIKLFAEMGFKCFRTSIAWTRIFPKGDEAQPNEEGLKFYDDMIDELLKYNIEPVITLSHFEMPLHLVQQYGSWTNRKVVDFFVRFAEVVFERYKHKVKYWMTFNEINNQRNWRAPLFGYCCSGVVYTEHENPEETMYQVLHHQFVASALAVKAAHRINPEMKVGCMLAMVPLYPYSCNPDDVMFAQESMRERYVFTDVQLRGYYPSYVLNEWERRGFNIKMEDGDLDVLREGTCDYLGFSYYMTNAVKAEGGTGDAISGFEGSVPNPYVKASDWGWQIDPVGLRYALCELYERYQKPLFIVENGFGAYDKVEDDGSINDDYRIDYLRAHIEEMKKAVTYDGVDLMGYTPWGCIDCVSFTTGQYSKRYGFIYVNKHDDGTGDMSRSRKKSFNWYKEVIASNGENL

SEQ ID NO: 6863 - DNA, 2874 bp, Escherichia coli
atgacacagacgttaagccagcttgaaaacagcggcgcttttattgaacgccatatcggaccggacgccgcgcaacagcaagaaatgctgaatgccgttggcgcacaatcgttaaacgcgctgaccggccagattgtgccgaaagatattcagcttgcgactccgccgcaggttggcgcaccggcgaccgaatacgccgcactggcagaactcaaggctattgccagtcgcaataaacgcttcacgtcttacatcggcatgggttacaccgccgtgcagctaccgccggttatcctgcgtaacatgctggaaaatccgggctggtataccgcgtatactccgtatcaacctgaagtctcccagggccgccttgaagcactgctcaacttccagcaggtaacgctggatttaaccgggctggatatggcctctgcttctcttcttgacgaagccaccgctgccgcagaagcaatggcgatggcgaaacgcgtcagcaaactgaaaaatgccaaccgcttctttgttgcttctgacgttcatccgcaaacgctggatgtggtccgtactcgtgccgaaacctttggttttgaagtgattgtcgatgacgcgcaaaaagtgctcgaccatcaggacgttttcggcgtgctgttacagcaggtcggcactactggtgaaattcacgactacaccgcgcttattagcgaactgaaatcacgcaaaattgtggtcagcgttgccgccgatattatggcgctggtgctgttaactgcgccaggtaaacagggcgcggatattgtttttggttcggcgcaacgctttggcgtaccgatgggctacggtggcccacacgcggcattctttgcggcgaaagacgaatacaaacgctcaatgccgggccgtattatcggtgtatcgaaagatgcagctggcaacaccgctctgcgcatggcgatgcagactcgcgagcaacatattcgtcgtgagaaagcgaactccaacatttgtacttcccaggtactgctggcaaacatcgccagcctgtatgccgtttatcacggcccggttggcctgaaacgtatcgctaaccgcatccaccgtctgaccgatatcctggcggcgggcctgcaacaaaaaggtctgaagctgcgccatgcgcactatttcgatactttgtgtgtggaagtggtcgacaaagcgggcgtgctggcgcgtgccgaagcagctgaaatcaacctgcgtagcgatattctgaacgcggttgggatcacccttgatgaaacaaccacgcgcgaaaacgtgatgcagcttttcagcgtgctgttgggcgataaccacgggctggacatcgacacactggacaaagacgtggctcacgacagtcgctctattcaggctgcgatgctgcgcgacgacgaaatcctcacccatccggtgtttaatcgctaccacagcgaaaccgaaatgatgcgctatatgcactcgctggagcgtaaagatctggcgctgaatcaggcgatgatcccgctgggttcctgcaccatgaaactgaacgccgccgccgagatgatcccgatcacctggccggaatttgccgaactgcacccgttctgcccgccagaacaggctgaaggttatcagcagatgatcgcgcagctggctgactggctggtgaaactgaccggttacgacgccgtttgtatgcagccgaactctggcgcacagggcgaatacgcgggcctgctggcgattcgtcattatcatgaaagccgcaacgaagggcatcgcgatatctgcctgatcccggcttctgcgcacggcactaacccggcttccgcgcatatggcaggaatgcaggtggtggttgtggcgtgtgataaaaacggcaacatcgatctgactgatctgcgcgcgaaagcggaacaggcgggcgataacctctcctgtatcatggtgacctatccttctacccacggcgtgtatgaagaaacgatccgtgaagtgtgtgaagtcgtgcatcagttcggcggtcaggtttaccttgatggcgcgaacatgaacgctcaggttggcatcacctcgccgggctttattggtgcggacgtttcccaccttaacctgcataaaactttctgcattccgcatggcggtggtggtccgggtatgggaccgatcggtgtgaaagcgcatctggctccgtttgtaccgggtcatagcgtggtgcaaatcgaaggcatgttaacccgtcagggcgcggtttctgcggcaccgttcggtagtgcctctatcctgccaatcagctggatgtacatccgcatgatgggcgcagaagggctgaaaaaagcaagccaggtggcaattcttaacgccaactatattgccagccgtctgcaggatgccttcccggtgctgtataccggtcgcgacggtcgcgtggcgcacgaatgtattctcgatattcgcccgctgaaagaagaaaccggcatcagcgagctggatattgccaagcgcctgatcgactacggtttccacgcgccgaccatgtcgttcccggtggcgggtacgctgatggttgaaccgactgaatctgaaagcaaagtggaattggatcgctttatcgatgcgatgctggctatccgcgcagaaattgaccaggtgaaagccggtgtctggccgctggaagataacccgctggtgaacgcgccgcacattcagagcgaactggtcgccgagtgggcgcatccgtacagtcgtgaagttgcagtattcccggcaggtgtggcagacaaatactggccgaccgtgaaacgtctggatgatgtttacggcgaccgtaacctgttctgctcctgcgtaccgattagcgaataccagtaa

SEQ ID NO: 6864 - protein, 957 aa, Escherichia coli
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASDVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVVDKAGVLARAEAAEINLRSDILNAVGITLDETTTRENVMQLFSVLLGDNHGLDIDTLDKDVAHDSRSIQAAMLRDDEILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 6865 - DNA, 390 bp, Escherichia coli
atgagcaacataccagcagaactgaaatacagcaaagaacacgaatggttgcgtaaagaagccgacggcacttacaccgttggcatcaccgaacacgctcaggagctgttaggcgatatggtgtttgttgacctaccggaagtgggcgcaacggttagcgcgggcgatgactgcgcggttgccgaatcggtaaaagcggcgtcagacatttatgcgccagtaagcggtgaaatcgtggcggtaaacgatgcactgagcgattccccggaactggtgaacagcgaaccgtatgcaggcggctggattttcaaaatcaaagccagcgatgaaagcgaactggaatcactgctggatgcaaccgcatacgaagcattgttagaagacgagtaa

SEQ ID NO: 6866 - protein, 129 aa, Escherichia coli
MSNIPAELKYSKEHEWLRKEADGTYTVGITEHAQELLGDMVFVDLPEVGATVSAGDDCAVAESVKAASDIYAPVSGEIVAVNDALSDSPELVNSEPYAGGWIFKIKASDESELESLLDATAYEALLEDE

SEQ ID NO: 6867 - DNA, 1164 bp, Escherichia coli
atgctgggtttcgtggtgataatttcgccatggaaaagttgtcagccccgcttattcaatgaggacaagatggcacaacagactcctttgtacgaacaacacacgctttgcggcgctcgcatggtggatttccacggctggatgatgccgctgcattacggttcgcaaatcgacgaacatcatgcggtacgtaccgatgccggaatgtttgatgtgtcacatatgaccatcgtcgatcttcgcggcagccgcacccgggagtttctacgttatctgctggcgaacgatgtggcgaagctcaccaaaagcggcaaagccctttactcggggatgttgaatgcctctggcggtgtgatagatgatctcatcgtctactactttactgaagatttcttccgcctcgttgttaactccgctacccgcgaaaaagacctctcctggattacccaacacgctgaacctttcggcatcgaaattactgttcgtgatgacctttccatgatcgccgtacaagggccgaatgcgcaggcaaaagctgccacactgtttaatgacgcccagcgtcaggcggtggaagggatgaaaccgttctttggcgtgcaggcgggcgatctgtttattgccaccaccggttacaccggtgaagcgggctacgaaattgcgctgcccaatgaaaaagcggccgatttctggcgcgcgctggtggaagctggcgttaagccatgtggcctgggcgcgcgtgacacgctgcgtctggaagcgggcatgaatttgtatagccaggagatggacgaaactatttctcctttagccgccaatatgggctggactatcgcctgggaaccggcagatcgtgactttatcggtcgtgaagctctggaagcgcagcgtgaacatggcacagaaaaactggttggtctggtgatgaccgaaaaaggcgtgctgcgtaatgaactgccggtacgttttactgatgcgcagggcaaccagcatgaaggcattatcaccagcggtactttctccccaacgctgggttatagcattgcgctggcgcgcgtgccggaaggtattggtgaaacggcgattgtgcaaattcgcaaccgtgaaatgccggttaaagtgacgaaacctgtttttgtgcgtaacggcaaagccgtcgcgtga

SEQ ID NO: 6868 - protein, 387 aa, Escherichia coli
MLGFVVIISPWKSCQPRLFNEDKMAQQTPLYEQHTLCGARMVDFHGWMMPLHYGSQIDEHHAVRTDAGMFDVSHMTIVDLRGSRTREFLRYLLANDVAKLTKSGKALYSGMLNASGGVIDDLIVYYFTEDFFRLVVNSATREKDLSWITQHAEPFGIEITVRDDLSMIAVQGPNAQAKAATLFNDAQRQAVEGMKPFFGVQAGDLFIATTGYTGEAGYEIALPNEKAADFWRALVEAGVKPCGLGARDTLRLEAGMNLYSQEMDETISPLAANMGWTIAWEPADRDFIGREALEAQREHGTEKLVGLVMTEKGVLRNELPVRFTDAQGNQHEGIITSGTFSPTLGYSIALARVPEGIGETAIVQIRNREMPVKVTKPVFVRNGKAVA

SEQ ID NO: 6869 - DNA, 1203 bp, Escherichia coli
atgcaaagtgttgatgtagccattgttggtggcggcatggtggggctggcggttgcctgcggcttacaggggagcggcttacgcgttgccgtactggagcagcgcgtaccggaacctctggcggcggatgcaccaccacaactgcgcgtttcggctatcaatgccgccagcgaaaaattactcacccgtcttggcgtctggcaggacattctctctcgtagggccagttgttatcacggtatggaagtgtgggacaaagacagttttggtcacatttcgtttgacgatcaaagcatgggctatagtcatcttgggcatatcgttgaaaactcagtgattcactacgcgctgtggaacaaagcccggcagtcgtcagatatcactctgttggcccccgcagaattacagcaggtcgcctggggagaaaatgaaaccttcctgacgttgaaagatggcagcatgttaacggcgcgtctggtgattggcgcagacggcgctaattcttggttgcgcaacaaagccgatattccgctgactttctgggattatcagcatcacgcgctggtggcgaccattcgcacggaagaaccgcatgatgcggtggcgcggcaggttttccatggcgaaggcattctggcctttttaccgcttagcgatccgtatctttgctcgattgtctggtcactgtcgccagaggaagcgctgcggatgcagcaggctagtgaagacgaatttaatcgcgcgttaaatatcgcttttgataatcgcctgggcttatgcaaggttgaaagtgagcgcctggtgttcccgctaacggggcgttatgcgcgccagtttgccgcgcaccgtctggcgctggtgggcgacgccgcgcataccattcacccgttggcggggcagggggtaaatctcggctttatggatgctgcagagctgattgctgaactgaaacggttgcatcgtcagggtaaagacatcgggcagtacatttacctgcgtcgctatgagcgtagccgcaagcacagcgcggcgctgatgctggctggtatgcagggattccgcgatctgttttccggggctaatccggcgaaaaaattgctgcgtgatattggtctgaaactggctgatacgcttcctggcgttaagccacaacttattcgtcaggcaatgggattaaacgatttgcctgaatggctgcgttaa

SEQ ID NO: 6870 - protein, 400 aa, Escherichia coli
MQSVDVAIVGGGMVGLAVACGLQGSGLRVAVLEQRVPEPLAADAPPQLRVSAINAASEKLLTRLGVWQDILSRRASCYHGMEVWDKDSFGHISFDDQSMGYSHLGHIVENSVIHYALWNKARQSSDITLLAPAELQQVAWGENETFLTLKDGSMLTARLVIGADGANSWLRNKADIPLTFWDYQHHALVATIRTEEPHDAVARQVFHGEGILAFLPLSDPYLCSIVWSLSPEEALRMQQASEDEFNRALNIAFDNRLGLCKVESERLVFPLTGRYARQFAAHRLALVGDAAHTIHPLAGQGVNLGFMDAAELIAELKRLHRQGKDIGQYIYLRRYERSRKHSAALMLAGMQGFRDLFSGANPAKKLLRDIGLKLADTLPGVKPQLIRQAMGLNDLPEWLR

SEQ ID NO: 6871 - DNA, 1179 bp, Escherichia coli
atgagagtaatcatcgtcggtggcggcatggcgggcgcgacgctggcgctggctatttcccggttaagtcacggggcgctgccagtacatttgattgaagcgaccgcgccagagtcacatgcgcatccgggctttgatggacgagctattgcgctggcggcgggtacctgtcagcaactggcgcgcatcggcgtctggcaatctctggctgattgcgcaactgccatcaccacagtgcatgtcagcgatcgtggtcacgctggatttgtcaccctcgccgcagaagattaccaactggcggcgctggggcaggttgtcgaattgcacaatgtcgggcaacggctgtttgcattgctgcgcaaagcacctggcgtaacgctgcattgccctgatcgcgtggctaacgttgcccgtactcagagccacgttgaagtgacgctggagagtggtgagacgctgacgggccgcgtgctggtagccgctgatggcacccattcagcgttagccaccgtgtgcggcgttgactggcagcaggagccttacgaacaactggctgtgattgccaacgttgcgacttccgttgcgcatgaagggcgcgcttttgaacgctttacgcaacatggcccgctggcgatgttgccgatgtctgacggacgctgttcgctggtctggtgtcatccactggaacggcgcgaagaggtgctgtcgtggagcgacgagaagttttgccgtgaactccagtcggcctttggctggcgacttgggaaaattactcatgccggtaaacgcagtgcttatccgctagcgctaacccgcgccgccaaacctattacccatcgtaccgtgctggtgggcaatgcggcgcaaactctgcatcccatcgccgggcaaggatttaacctcggtatgcgtgatgtcatgagccttgcggaaaccctgactcaggcgcaggaacgcggagaagacatgggtgattacggcgtattgtgccgttatcagcagcgtcgacagagcgatcgcgaagcaaccatcggcgtcacggacagccttgtacatctttttgccaaccgttggaccccgctggttgtcgggcgcaacatcgggctgatgacgatggaattatttaccccggcacgcgatgtgctggcgcagcgcaccctcggttgggtggcgcgttga

SEQ ID NO: 6872 - protein, 392 aa, Escherichia coli
MRVIIVGGGMAGATLALAISRLSHGALPVHLIEATAPESHAHPGFDGRAIALAAGTCQQLARIGVWQSLADCATAITTVHVSDRGHAGFVTLAAEDYQLAALGQVVELHNVGQRLFALLRKAPGVTLHCPDRVANVARTQSHVEVTLESGETLTGRVLVAADGTHSALATVCGVDWQQEPYEQLAVIANVATSVAHEGRAFERFTQHGPLAMLPMSDGRCSLVWCHPLERREEVLSWSDEKFCRELQSAFGWRLGKITHAGKRSAYPLALTRAAKPITHRTVLVGNAAQTLHPIAGQGFNLGMRDVMSLAETLTQAQERGEDMGDYGVLCRYQQRRQSDREATIGVTDSLVHLFANRWTPLVVGRNIGLMTMELFTPARDVLAQRTLGWVAR

SEQ ID NO: 6873 - DNA, 1326 bp, Escherichia coli
atgagtgatatatcccggcaagaatttcagcgtcgccgtcaggccctggtagagcaaatgcaacccggcagcgccgcgctgatttttgctgcaccagaagtaacacgtagcgccgacagcgaatacccctatcgtcagaacagtgacttctggtacttcaccggctttaacgaaccggaagcggtgctggtgctgattaaaagcgatgacactcataaccacagcgttttgtttaaccgcgttcgcgacctgacggcagagatctggtttggtcgtcgcttaggccaggatgccgcgccagagaaactgggcgttgaccgcgcactggcattcagcgaaatcaatcagcaactttatcaactacttaatggtctggatgtggtttaccacgcccagggcgaacatgcatatgctgatgaaatcgtgaacagcgcgcttgagaaactgcgtaaaggttcgcggcaaaatctcaccgcaccggcaacgatgatcgactggcgtcctgttgttcatgaaatgcgcctgttcaaatcaccagaagagattgccgtacttcgccgcgcgggtgaaatcaccgcactggcgcatacacgggcgatggaaaaatgccgtccggggatgttcgagtaccatctggaaggcgaaattcaccacgaatttaaccgccacggtgcgcgttacccttcctataacaccattgttggcagcggtgaaaacggctgcattttgcactacaccgaaaacgagtgtgaactgcgtgacggtgacctggtgttgattgacgcgggttgtgaatacaaaggttacgctggcgacattacccgcaccttcccggtcaacggcaaattcactcaggctcagcgtgaaatctatgacattgtgctggagtctcttgaaaccagcctgcgcctgtatcgtccgggaacttccattcaggaagtcactggtgaagtggtgcgcatcatggttagcggtctggtaaaactcggcatcctgaaaggtgaagttgatgaactgatcgctcagaacgcccatcgtcctttctttatgcatggccttagccactggttaggactggatgttcatgacgttggtgtttatggtcaggatcgctcgcgtattctggaaccgggtatggttctgaccgtagaaccagggctgtatattgcgccggatgcagaagtgccagaacagtatcgcggtatcggcattcgtattgaagacgatattgtgattaccgaaaccggtaatgaaaacctcaccgccagcgtggtgaaaaagccggaagaaatcgaagcgttgatggcagctgcgagaaagcaatga

SEQ ID NO: 6874 - protein, 441 aa, Escherichia coli
MSDISRQEFQRRRQALVEQMQPGSAALIFAAPEVTRSADSEYPYRQNSDFWYFTGFNEPEAVLVLIKSDDTHNHSVLFNRVRDLTAEIWFGRRLGQDAAPEKLGVDRALAFSEINQQLYQLLNGLDVVYHAQGEHAYADEIVNSALEKLRKGSRQNLTAPATMIDWRPVVHEMRLFKSPEEIAVLRRAGEITALAHTRAMEKCRPGMFEYHLEGEIHHEFNRHGARYPSYNTIVGSGENGCILHYTENECELRDGDLVLIDAGCEYKGYAGDITRTFPVNGKFTQAQREIYDIVLESLETSLRLYRPGTSIQEVTGEVVRIMVSGLVKLGILKGEVDELIAQNAHRPFFMHGLSHWLGLDVHDVGVYGQDRSRILEPGMVLTVEPGLYIAPDAEVPEQYRGIGIRIEDDIVITETGNENLTASVVKKPEEIEALMAAARKQ

SEQ ID NO: 6875 - DNA, 585 bp, Escherichia coli
atgcttatgtctatacagaacgaaatgcctggttacaacgaaatgaaccagtatctgaaccaacaagggacgggtctgacccctgctgagatgcatggtttaatcagtgggatgatatgtggcggtaacgatgacagctcatggctgccgctacttcacgacctgacgaacgaaggcatggctttcggtcatgagctggcacaggcactgcgcaaaatgcactctgccaccagcgatgccctgcaggatgacggcttcctttttcagctttatctgcctgatggcgatgatgtcagcgttttcgatcgggctgatgcgctggctggttgggtcaatcacttcctgcttggtcttggcgttacgcaaccgaagctggacaaagtgaccggcgaaaccggtgaagccatcgacgatctgcgtaacatcgcgcagttgggttacgacgaagacgaagatcaggaagagcttgaaatgtcgcttgaagagatcatcgagtacgtccgtgttgccgcgctgttatgccacgacacctttactcatccgcaaccgaccgcgccagaagtacaaaaaccgactctacactaa

SEQ ID NO: 6876 - protein, 194 aa, Escherichia coli
MLMSIQNEMPGYNEMNQYLNQQGTGLTPAEMHGLISGMICGGNDDSSWLPLLHDLTNEGMAFGHELAQALRKMHSATSDALQDDGFLFQLYLPDGDDVSVFDRADALAGWVNHFLLGLGVTQPKLDKVTGETGEAIDDLRNIAQLGYDEDEDQEELEMSLEEIIEYVRVAALLCHDTFTHPQPTAPEVQKPTLH

SEQ ID NO: 6877 - DNA, 330 bp, Escherichia coli
atgtctgcacaacccgtcgatatccaaatttttggccgttcactgcgtgtgaactgcccgcctgaccaaagggatgcgttgaatcaggcagcggatgatctgaaccaacggttgcaagatctgaaagaacgcactagagtcacaaatactgaacagttggtcttcattgccgcattgaatatcagctatgagttagcgcaagaaaaagcgaagactcgtgactacgcggcaagtatggaacagcgtattcggatgctgcagcagaccatagaacaagcgttacttgaacaaggtcgcatcaccgaaaaaactaaccaaaactttgaatga

SEQ ID NO: 6878 - protein, 109 aa, Escherichia coli
MSAQPVDIQIFGRSLRVNCPPDQRDALNQAADDLNQRLQDLKERTRVTNTEQLVFIAALNISYELAQEKAKTRDYAASMEQRIRMLQQTIEQALLEQGRITEKTNQNFE

SEQ ID NO: 6879 - DNA, 747 bp, Escherichia coli
atgtggcgctccgcggttggtgagcatgctcggtccgtccgagaagccttaaaactgcgacgacacattcaccttgaaccaagggttcaagggttacagcctgcggcggcatctcggagattcccttcttacctggcaccagccatgacgcaactaccagaactcccactgacattatcccgacaagaaatccgcaaaatgattcggcaacgtcgtcgtacgttaacgccggaacaacagcaggaaatgggtcaacaagccgctacccggatgatgacgtatcccccagtggtgatggcgcatacggtcgctgtattcctctcttttgatggcgaactcgacacccagccactcatagaacaactctggcgcgccggtaagcgcgtatatcttccagttttgcatccctttagtgccggtaacttgctgttcctgaattaccatccgcaaagcgaactggtgatgaacaggttgaagatccacgagccaaaactggacgtgcgcgatgtgcttcccctttcccggttagatgtattgatcacgccgctggtggcttttgatgaatacggtcaacgcttgggaatgggcggtggtttttatgatcggaccttacaaaactggcagcactataaaatgcaaccggtgggttatgcgcatgattgccagttagtagaaaaactcccagtggagaaatgggatattccactgcctgcggtggttacaccgtcgaaagtctgggaatggtaa

SEQ ID NO: 6880 - protein, 248 aa, Escherichia coli
MWRSAVGEHARSVREALKLRRHIHLEPRVQGLQPAAASRRFPSYLAPAMTQLPELPLTLSRQEIRKMIRQRRRTLTPEQQQEMGQQAATRMMTYPPVVMAHTVAVFLSFDGELDTQPLIEQLWRAGKRVYLPVLHPFSAGNLLFLNYHPQSELVMNRLKIHEPKLDVRDVLPLSRLDVLITPLVAFDEYGQRLGMGGGFYDRTLQNWQHYKMQPVGYAHDCQLVEKLPVEKWDIPLPAVVTPSKVWEW

SEQ ID NO: 6881 - DNA, 1233 bp, Escherichia coli
atggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtataggaacaaaccaggttgatctggatgcggcggcaaagcgcgggatcccggtatttaacgcaccgttctcaaatacgcgctctgttgcggagctggtgattggcgaactgctgctgctattgcgcggcgtgccggaagccaatgctaaagcgcatcgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaacaaactgccgctgggcaacgccactcaggtacagcatctttctgacctgctgaatatgagcgatgtggtgagtctgcatgtaccagagaatccgtccaccaaaaatatgatgggcgcgaaagagatttcgctaatgaaacccggctcgctgctgattaatgcttcgcgcggtactgtggtggatattccagcgctgtgtgacgcgctggcgagcaaacatctggcaggggcggcaatcgacgtattcccgacggaaccggcgaccaatagcgatccatttacctctccgctgtgtgaattcgacaatgtccttctgacgccacacattggtggttcgactcaggaagcgcaggagaatatcggtctggaagttgcgggtaaattgatcaagtattctgacaatggttcaacgctctctgcggtgaacttcccggaagtctcgctgccactgcacggtggtcgtcgtctgatgcacatccacgaaaaccgtccgggtgtgctgactgcgctcaacaaaatttttgccgagcagggcgtcaacatcgccgcgcaatatctgcaaacttccgcccagatgggttatgtagttattgatattgaagccgacgaagacgttgccgaaaaagcgctgcaggcaatgaaagctattccgggtaccattcgcgcccgtctgctgtactaa

SEQ ID NO: 6882 - protein, 410 aa, Escherichia coli
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIHENRPGVLTALNKIFAEQGVNIAAQYLQTSAQMGYVVIDIEADEDVAEKALQAMKAIPGTIRARLLY

SEQ ID NO: 6883 - DNA, 660 bp, Escherichia coli
atgacgcaggatgaattgaaaaaagcagtaggatgggcggcacttcagtatgttcagcccggcaccattgttggtgtaggtacaggttccaccgccgcacactttattgacgcactcggtacaatgaaaggccagattgaaggggccgtttccagttcagatgcttccactgaaaaactgaaaagcctcggcattcacgtttttgatctcaacgaagtcgacagccttggcatctacgttgatggcgcagatgaaatcaacggccacatgcaaatgatcaaaggcggcggcgcggcgctgacccgtgaaaaaatcattgcttcggttgcggaaaaatttatctgtattgcagacgcttccaagcaggttgatattctgggcaaattcccgctgccagtagaagttatcccgatggcacgtagtgcagtggcgcgccagctggtgaaactgggcggtcgtccggaataccgtcagggcgtagtgaccgataacggcaacgtgatcctcgacgtccacggcatggaaatccttgacccgatagcgatggaaaacgccataaatgcgattcctggcgtggtgactgttggtttgtttgctaaccgtggcgcggacgttgcgctgattggcacacctgacggtgtcaaaactattgtgaaatga

SEQ ID NO: 6884 - protein, 219 aa, Escherichia coli
MTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 6885 - DNA, 279 bp, Escherichia coli
ttgtatcagtggttaacgcgcagcttaaaagatcagggatttgcgctaatgcatttcgctcagcgagttcgcgccctggttgtgttgaatggcgtggcgttattacctcagtttgcctgtaaacaggggcttgcgaacggggaactggtgcgcctgtttgcaccgtggagcggcatacccagaccgttgtatgctttatttgcggggcgaaaggggatgcccgccattgcgcgatattttatggatgagttaaccacgcggcttgccaacggggtctga

SEQ ID NO: 6886 - protein, 92 aa, Escherichia coli
MYQWLTRSLKDQGFALMHFAQRVRALVVLNGVALLPQFACKQGLANGELVRLFAPWSGIPRPLYALFAGRKGMPAIARYFMDELTTRLANGV

SEQ ID NO: 6887 - DNA, 894 bp, Escherichia coli
atgaaacgcccggactacagaacattacaggcactggatgcggtgatacgtgaacgaggatttgagcgcgcggcacaaaagctgtgcattacacaatcagccgtctcacagcgcattaagcaactggaaaatatgttcgggcagccgctgttagtgcgtaccgtaccgccgcgcccgacggaacaagggcaaaaactgttggcgctactacgccaggtggagctgctggaagaagagtggctgggcgatgaacaaaccggttcgactccgctgctgctttcactggcggtcaacgccgacagtctggcgacgtggttgcttccggcactggctcctgtgttggctgattcgcccatccgcctcaacttgcaggtagaagatgaaacccgcactcaggaacgtctgcgtcgcggcgaagtggtcggcgcagtgagtattcaacatcaggcgctgccgagttgtcttgtcgataaactcggtgcgctcgactatctgttcgtcagctcaaaaccgtttgccgaaaaatatttccctaacggcgtaacgcgttcggcattactgaaagcgccagtggtcgcgtttgaccatcttgacgatatgcaccaggcctttttgcagcaaaatttcgatctgcctcctggcagcgtaccctgccatatcgttaattcttcggaagcgttcgtgcaacttgctcgtcagggcaccacctgctgtatgatcccgcacctgcaaatcgagaaagagctggccagcggcgaactgattgacttaacgccagggctatttcaacgccggatgctctactggcaccgctttgctcctgaaagccgcatgatgcgtaaagtcactgatgcgttgctcgattatggtcacaaagttcttcgtcaggattaa

SEQ ID NO: 6888 - protein, 297 aa, Escherichia coli
MKRPDYRTLQALDAVIRERGFERAAQKLCITQSAVSQRIKQLENMFGQPLLVRTVPPRPTEQGQKLLALLRQVELLEEEWLGDEQTGSTPLLLSLAVNADSLATWLLPALAPVLADSPIRLNLQVEDETRTQERLRRGEVVGAVSIQHQALPSCLVDKLGALDYLFVSSKPFAEKYFPNGVTRSALLKAPVVAFDHLDDMHQAFLQQNFDLPPGSVPCHIVNSSEAFVQLARQGTTCCMIPHLQIEKELASGELIDLTPGLFQRRMLYWHRFAPESRMMRKVTDALLDYGHKVLRQD

SEQ ID NO: 6889 - DNA, 1056 bp, Escherichia coli
atgtctaacgtgcaggagtggcaacagcttgccaacaaggaattgagccgtcgggagaaaactgtcgactcgctggttcagcaaaccgcggaagggatcgccatcaagccgctgtataccgaagccgatctcgataatctggaggtgacgggtacccttcctggtttgccaccctacgttcgtggcccgcgtgccactatgtataccgcccaaccgtggaccatccgtcagtatgctggtttctcgacagcaaaagagtccaacgctttttatcgccgtaacctggccgcccaccgaggctacgactccgataacccacgcgtggcgggcgacgtcggcaaagcgggcgtcgctatcgacaccggggaagatatgaaagtcctgttcgaccagatcccgctggataaaatgtcggtttcgatgaccatgaatggcgcagtgctaccagtactggcgttttatatcgtcgccgcagaagagcaaggtgttacatccgataaactgaccggcaccattcagaacgatatcctcaaagagtacctctgccgcaatacctatatttacccgccaaaaccgtcaatgcgtattatcgcagacatcatcgcctggtgttccggcaacatgccgcgatttaataccatcagtatcagcagttaccacatgggtgaagcgggtgccaactgcgtgcagcaggtagcatttacgctcgccgataggattgagtacatcaaagcagcaatctccgccgggctgaaaattgatggcttcgtccctcgcctgtcgtttttcttcggcattggcatggatctgtttatgaacgccgccatgttgcgtgcggcacgttatttatggagcgaagcggtcagtggatttggcgcacaggatccgtataacaacgttatccgcaccaccattgatcattgtgcacatcctatgtgtcgggattatctgcatcgctatctggaaaatgcgtccggcggacatattcaccacgatcttagccacgtcttcgacttacaccgtaatttaattgcaaccggatcgatgctgggttaa

SEQ ID NO: 6890 - protein, 351 aa, Escherichia coli
MSNVQEWQQLANKELSRREKTVDSLVQQTAEGIAIKPLYTEADLDNLEVTGTLPGLPPYVRGPRATMYTAQPWTIRQYAGFSTAKESNAFYRRNLAAHRGYDSDNPRVAGDVGKAGVAIDTGEDMKVLFDQIPLDKMSVSMTMNGAVLPVLAFYIVAAEEQGVTSDKLTGTIQNDILKEYLCRNTYIYPPKPSMRIIADIIAWCSGNMPRFNTISISSYHMGEAGANCVQQVAFTLADRIEYIKAAISAGLKIDGFVPRLSFFFGIGMDLFMNAAMLRAARYLWSEAVSGFGAQDPYNNVIRTTIDHCAHPMCRDYLHRYLENASGGHIHHDLSHVFDLHRNLIATGSMLG

SEQ ID NO: 6891 - DNA, 897 bp, Escherichia coli
atggacatttttatttcgaaaaagatgcgcaatttcattttattagcgcaaaccaataatattgcccgggcggcagaaaaaatccatatgacggcttcgcgatttggcaaaagcattgccgcgctggaagaacaaattggctatacgctatttacccgcaaagataataatatcagcctcaataaagccggacaggaactgtatcaaaaactgttcccggtttatcaacgactttctgcgattgataatgaaatccataactcaggacgtcgttcacgagacattgtgataggcatagataatacttatccgaccattatttttgatcagttgattagtctcggagataagtacgaaggcgtgaccgcccagccagttgagttcagcgcaaatggcgttatcgataatctttttgaccgtcagttagattttataatctccccacagcatgtatctgcacgagttcaggaactggaaaacctgactatcagtgaactaccgccgctgcgattgggctttctcgtttctcgccgttatgaagagcgacaagagcaagagctgcttcaggagctgccctggctacaaatgcgctttcaaaactgggctaacttcgaagcaatgattgatgcgaatatgcgtccttgtgggatcaatccaaccattatttatcgtccctatagttttatggccaaaatcagcgacgtggagcggggacattttctgacggtgatcccgcattttgcctggcgactggtgaatccggcaacgctgaaatattttgatgcgccgcacaggccgatgtatatgcaggaatatctttattcaatcagaaatcatcgttataccgccacgatgcttcagcatattgctgaagatcgtgacgggacaaaccattaa

SEQ ID NO: 6892 - protein, 298 aa, Escherichia coli
MDIFISKKMRNFILLAQTNNIARAAEKIHMTASRFGKSIAALEEQIGYTLFTRKDNNISLNKAGQELYQKLFPVYQRLSAIDNEIHNSGRRSRDIVIGIDNTYPTIIFDQLISLGDKYEGVTAQPVEFSANGVIDNLFDRQLDFIISPQHVSARVQELENLTISELPPLRLGFLVSRRYEERQEQELLQELPWLQMRFQNWANFEAMIDANMRPCGINPTIIYRPYSFMAKISDVERGHFLTVIPHFAWRLVNPATLKYFDAPHRPMYMQEYLYSIRNHRYTATMLQHIAEDRDGTNH

SEQ ID NO: 6893 - DNA, 741 bp, Escherichia coli
gtgaagttcaaagttatcgccctggcggcattaatgggtattagcgggatggcagcgcaggctaacgaattgccggatggaccgcatattgtcacctccggtacggcaagcgtggatgcggtgccagacattgccactcttgcgattgaagttaacgtggccgcgaaggatgccgctactgccaagaaacaggcagatgagcgcgtcgcacaatacatttccttccttgagctcaatcagatcgcgaaaaaagatatcagctcagcgaacttacgcactcagccagattatgattatcaggatggtaaaagtatcctgaaaggctaccgcgcagtgagaacggtggaagtcacgctccgtcagttagacaaactgaattccttgctggacggcgcgctaaaggcgggtcttaacgaaattcgttctgtgtcgctgggcgtggcgcagccggatgcctataaagacaaagcgcgtaaggcagcgattgataacgcgattcatcaggcgcaggaactggcgaacggctttcatcgtaaactggggccggtatatagcgtacgctaccatgtttccaactatcagcccagcccaatggtgcggatgatgaaagccgatgccgcgccggtgtccgcccaggaaacttacgagcaggccgctattcagtttgatgatcaggtcgatgtaatcttccagttagaacctgtggatcaaccacccgctaaaacacctgctgcacattaa

SEQ ID NO: 6894 - protein, 246 aa, Escherichia coli
MKFKVIALAALMGISGMAAQANELPDGPHIVTSGTASVDAVPDIATLAIEVNVAAKDAATAKKQADERVAQYISFLELNQIAKKDISSANLRTQPDYDYQDGKSILKGYRAVRTVEVTLRQLDKLNSLLDGALKAGLNEIRSVSLGVAQPDAYKDKARKAAIDNAIHQAQELANGFHRKLGPVYSVRYHVSNYQPSPMVRMMKADAAPVSAQETYEQAAIQFDDQVDVIFQLEPVDQPPAKTPAAH

SEQ ID NO: 6895 - DNA, 591 bp, Escherichia coli
atgatcctaccgctcggtccacaaaatgcttttgtgatgaatcagggcattcgtcgtcagtatcacattatgattgccttactttgtgctatcagcgatttggtcctgatttgtgcggggatttttggtggcagcgcgttattgatgcagtcgccgtggttgctggcgctgacctggggcggcgtagccttcttgctgtggtatggttttggcgcttttaaaacagcaatgagcagtaacattgagttagccagtgccgaagtcctgaaacaaggcagatggaaaattatcgccaccatgttggcagtgacctggctgaatccgcatgtttacctggatacttttgttgtgctgggcagccttggcgggcaacttgatgtggaaccaaaacgttggtttgcgctcggaacaattagcgcctctttcctgtggttctttggtctggctattctcgcagcctggctggcaccgcgcctgcgcacggcaaaatcacagcgcattatcaatctggtagtgggatgtgttatgtggtttattgccttgcagctggcgagagacggtattgctcatgcacaagccttgttcagttag

SEQ ID NO: 6896 - protein, 196 aa, Escherichia coli
MILPLGPQNAFVMNQGIRRQYHIMIALLCAISDLVLICAGIFGGSALLMQSPWLLALTWGGVAFLLWYGFGAFKTAMSSNIELASAEVLKQGRWKIIATMLAVTWLNPHVYLDTFVVLGSLGGQLDVEPKRWFALGTISASFLWFFGLAILAAWLAPRLRTAKSQRIINLVVGCVMWFIALQLARDGIAHAQALFS

SEQ ID NO: 6897 - DNA, 861 bp, Escherichia coli
atggaagatttgaatgttgtcgatagcataaacggcgcgggaagctggctggtggctaaccaggcgctgctgctaagttatgcagtaaacatcgtggcggcactcgcgatcatcatcgttggtttgattatcgcgcggatgatttccaacgcggtgaatcgcctgatgatctcccgtaaaatcgatgccactgttgctgattttctttctgcattagtccgttacggaattatcgcctttacgctaatcgctgcactggggcgcgtgggcgtacaaacagcgtcagtcattgctgtactcggtgccgcaggcttagctgttggtctggctttgcaggggtcactgtctaacctggccgctggcgtgttacttgtcatgttccgcccgttccgtgccggagaatatgttgacctcggcggcgtagccggtactgtgctgagtgtgcagattttctccaccaccatgcgtactgcagacggtaaaattatcgttattccgaacggtaaaattattgccgggaatattattaacttctcccgcgagccagctcgccgtaacgaatttattattggcgtggcgtatgattccgatatcgatcaggttaagcagatcctgaccgatattatccagtctgaagatcgcattttgaaagatcgcgaaatgactgtgcgtctgaacgaacttggcgcatcgtcgattaatttcgtggtccgcgtctggagcaacagcggcgatctgcaaaacgtgtactgggatgtgctggagcgtattaaacgtgaatttgatgccgccggtatcagcttcccgtacccgcaaatggatgtgaactttaagcgggtgaaagaagacaaagctgcgtaa

SEQ ID NO: 6898 - protein, 286 aa, Escherichia coli
MEDLNVVDSINGAGSWLVANQALLLSYAVNIVAALAIIIVGLIIARMISNAVNRLMISRKIDATVADFLSALVRYGIIAFTLIAALGRVGVQTASVIAVLGAAGLAVGLALQGSLSNLAAGVLLVMFRPFRAGEYVDLGGVAGTVLSVQIFSTTMRTADGKIIVIPNGKIIAGNIINFSREPARRNEFIIGVAYDSDIDQVKQILTDIIQSEDRILKDREMTVRLNELGASSINFVVRVWSNSGDLQNVYWDVLERIKREFDAAGISFPYPQMDVNFKRVKEDKAA

SEQ ID NO: 6899 - DNA, 1155 bp, Escherichia coli
gtgagcgaacgtagacgcagcacatgcaacttgaagtatgacgagtataaggcccgacgatacaggacaagagacatgtctaagatttttgatttcgtaaaacctggcgtaatcactggtgatgacgtacagaaagttttccaggtagcaaaagaaaacaacttcgcactgccagcagtaaactgcgtcggtactgactccatcaacgccgtactggaaaccgcagctaaagttaaagcgccggttatcgttcagttctccaacggtggtgcttcttttatcgctggtaaaggcgtgaaatctgacgttccgcagggcgctgctatcctgggtgcgatctctggtgcgcatcacgttcaccagatggctgaacactacggtgttccggtgatcctgcacaccgaccactgcgcgaaaaaactgctgccgtggatcgacggtctgctggacgcgggtgaaaaacacttcgctgctaccggtaagccgctgttctcttctcacatgattgacctgtctgaagaatctctgcaagagaacattgaaatctgctctaaatacctggagcgcatgtccaaaatcggcatgactctggaaatcgaactgggttgcaccggtggtgaagaagacggcgtggacaacagccacatggacgcttctgcactgtacacccagccggaagacgttgattacgcatacaccgagctgagcaaaatcagcccgcgtttcaccatcgctgcgtccttcggtaacgtacacggtgtttacaagccgggtaacgtggttctgactccgaccatcctgcgcgactctcaggaatatgtttctaagaaacacaacctgccgcacaacagcctgaacttcgtcttccacggtggttccggttctactgctcaggaaatcaaagattccgtaagctacggcgtagtgaaaatgaacatcgataccgatacccaatgggcaacctgggaaggtgttctgaactactacaaagaaaacgaagcttacctgcaaggccagctgggcaacccgaaaggcgaagatcagccgaacaagaaatactacgatccgcgcgtatggctgcgtgccggtcagacttcgatgatcgctcgtctggaaaaagcattccaggaactgaacgcgatcgacgttctgtaa

SEQ ID NO: 6900 - protein, 384 aa, Escherichia coli
MSERRRSTCNLKYDEYKARRYRTRDMSKIFDFVKPGVITGDDVQKVFQVAKENNFALPAVNCVGTDSINAVLETAAKVKAPVIVQFSNGGASFIAGKGVKSDVPQGAAILGAISGAHHVHQMAEHYGVPVILHTDHCAKKLLPWIDGLLDAGEKHFAATGKPLFSSHMIDLSEESLQENIEICSKYLERMSKIGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSTAQEIKDSVSYGVVKMNIDTDTQWATWEGVLNYYKENEAYLQGQLGNPKGEDQPNKKYYDPRVWLRAGQTSMIARLEKAFQELNAIDVL

SEQ ID NO: 6901 - DNA, 1227 bp, Escherichia coli
ttgctttcaggtaagacgcaagcagcgtctgcaaaacttttagaatcaacgagaggattcaccatgtctgtaattaagatgaccgatctggatcttgctgggaaacgtgtatttatccgtgcggatctgaacgtaccagtaaaagacgggaaagtaaccagcgacgcgcgtatccgtgcttctctgccgaccatcgaacttgccctgaaacaaggcgcaaaagtgatggtaacttcccacctgggtcgtcctaccgaaggcgagtacaacgaagaattctctctgctgccggttgttaactacctgaaagacaaactgtctaacccggttcgtctggttaaagattacctcgacggcgttgacgttgctgaaggtgaactggttgttctggaaaacgttcgcttcaacaaaggcgagaagaaagatgacgaaactctgtccaaaaaatacgctgcactgtgtgacgtgttcgtaatggacgcattcggtactgctcaccgcgcgcaggcttctactcacggtatcggtaaattcgctgacgttgcgtgcgcaggcccgctgctggcagctgaactggacgcgctgggtaaagcactgaaagaacctgctcgcccgatggtggctatcgttggtggttctaaagtatctaccaaactgaccgttctggactccctgtctaaaatcgctgaccagctgatcgttggcggtggtatcgctaacacctttatcgcggcacaaggccacgatgtgggtaaatccctgtacgaagctgacctggttgacgaagctaaacgtctgctgaccacctgcaacatcccggttccgtctgatgttcgcgtagcaaccgagttctctgaaactgcaccggctaccctgaaatctgttaacgatgtgaaagctgacgagcagatcctggatatcggtgatgcttccgctcaggaactggctgaaatcctgaagaatgcgaaaaccattctgtggaacggtccggttggcgtgttcgaattcccgaacttccgcaaaggtactgaaatcgtggctaacgctatcgcagacagcgaagcgttctccatcgctggcggcggcgacactctggcagcaatcgacctgttcggcattgctgacaaaatctcctacatctccactggcggcggcgcattcctcgaattcgtagaaggtaaagtactgcctgcagtagcgatgctcgaagagcgcgctaagaagtaa

SEQ ID NO: 6902 - protein, 408 aa, Escherichia coli
MLSGKTQAASAKLLESTRGFTMSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 6903 - DNA, 1020 bp, Escherichia coli
atgaccgtacgcgtagcgataaatggcttcggtcgcatcgggcgtaatgtggttcgtgctttgtatgaatccggacgccgtgcggaaattaccgtggtggcaatcaacgaactggcggatgctgcgggcatggcgcatttgttgaaatatgacaccagccatggccgttttgcatgggaagtacgacaggaacgcgatcaactttttgttggtgatgacgccatccgtgtattgcatgaacgttcactgcaatcgctcccctggcgtgaacttggcgttgatgtagtcctcgactgcaccggcgtatatggctcccgcgagcatggtgaagcacacattgccgccggggctaaaaaagtgctcttttcacatcctggcagtaacgatctcgacacgaccgttgtttatggcgtcaatcaggatcaacttcgtgcggaacaccgcatcgtttctaacgcttcctgtaccacgaattgcataattcccgtcatcaaattgttagatgatgcgtacggtattgagtccggcactgtgaccacaattcactccgccatgcacgatcaacaggttattgatgcataccatcctgacctgcgtcgcactcgggcagccagtcagtcgatcattccggtcgatactaaactggccgccggtatcacacgattttttccgcaatttaacgatcgctttgaagcgattgcggtacgtgtgccaaccataaatgtgacggcaatcgatttaagcgtgacggtgaagaaacctgtaaaagccaatgaagtcaacctgttgctgcaaaaagcagcacaaggtgcatttcatggtatagttgactatacggaattgccgttggtctctgtagattttaaccacgatccgcacagtgccattgtcgatggcacccaaacccgggtcagtggcgcacacctgatcaaaacgttggtctggtgcgataacgaatggggctttgctaaccgaatgctcgacacgacgttagctatggctactgttgctttcaggtaa

SEQ ID NO: 6904 - protein, 339 aa, Escherichia coli
MTVRVAINGFGRIGRNVVRALYESGRRAEITVVAINELADAAGMAHLLKYDTSHGRFAWEVRQERDQLFVGDDAIRVLHERSLQSLPWRELGVDVVLDCTGVYGSREHGEAHIAAGAKKVLFSHPGSNDLDTTVVYGVNQDQLRAEHRIVSNASCTTNCIIPVIKLLDDAYGIESGTVTTIHSAMHDQQVIDAYHPDLRRTRAASQSIIPVDTKLAAGITRFFPQFNDRFEAIAVRVPTINVTAIDLSVTVKKPVKANEVNLLLQKAAQGAFHGIVDYTELPLVSVDFNHDPHSAIVDGTQTRVSGAHLIKTLVWCDNEWGFANRMLDTTLAMATVAFR

SEQ ID NO: 6905 - DNA, 93 bp, Escherichia coli
gtgacggcacaacgaaaagattttgctacgcttattcgtgattctgcaaagtggaataaattccacaggggcggggctgaaaacgtgacgtaa

SEQ ID NO: 6906 - protein, 30 aa, Escherichia coli
MTAQRKDFATLIRDSAKWNKFHRGGAENVT

SEQ ID NO: 6907 - DNA, 432 bp, Escherichia coli
atgatgacattgccctacccatattcttcctccgcacgcttttacgcgctgcgcctgctccccgggcaggaagttctctcccaattacgcgccttcgcgcagcaacaacaacttcacgccgcgtggattgcaggttgtaccggcagtctgactgacgtcgccttacgctatgccgggcaagaaaacactgccctgctaagcggtaagttcgaagtcatcgcattgaacggcacgctggaacagagtggtgaacatcttcatctctgcgtttccgatccacacggcacgatgcttggcggtcatatgatgcccggctgtaccgtgcggaccacgcttgaactggtgatcggctgcctggaggaactggcgtttagccgccagctttgcgcgctttctggttacgacgagttgcatatttcccccgttaaataa

SEQ ID NO: 6908 - protein, 143 aa, Escherichia coli
MMTLPYPYSSSARFYALRLLPGQEVLSQLRAFAQQQQLHAAWIAGCTGSLTDVALRYAGQENTALLSGKFEVIALNGTLEQSGEHLHLCVSDPHGTMLGGHMMPGCTVRTTLELVIGCLEELAFSRQLCALSGYDELHISPVK

SEQ ID NO: 6909 - DNA, 579 bp, Escherichia coli
atggcgcgtcgccacttttccagtcaggcactggtgttgatcgttatctctatcgccatcaatatgatcggcggacaactggccagcatggttaaattacctatttttctcgactccatcggcacacttattagcgcggtactgcttggtccggtgatcgggatgctgaccggtttactgaccaatttactctggggattgctgaccgacccgatcgccgccgcatttgcgcccgtcgcgatggtcatcggcctggtcgccggttggctggcgcgagcgggttggtttcgcaccctgccaaaagtcgttgttagcggcgtgattattacgcttgcggtaacggtcgtcgctgtaccgctgcgtactgcgctgttcggcggcgtgacaggaagcggagccgatttgttcgttgcctggatgcactcgatggggcaaaacctggtggagtcggtggcgattacggtgataggcgcgaacctggtcgataaaattctcacagcggtgattgtctggcttttactgcgtcagctgccgattcgcaccacgcgccattttccggcaatggctgccgtgcgctaa

SEQ ID NO: 6910 - protein, 192 aa, Escherichia coli
MARRHFSSQALVLIVISIAINMIGGQLASMVKLPIFLDSIGTLISAVLLGPVIGMLTGLLTNLLWGLLTDPIAAAFAPVAMVIGLVAGWLARAGWFRTLPKVVVSGVIITLAVTVVAVPLRTALFGGVTGSGADLFVAWMHSMGQNLVESVAITVIGANLVDKILTAVIVWLLLRQLPIRTTRHFPAMAAVR

SEQ ID NO: 6911 - DNA, 708 bp, Escherichia coli
atgcatccgtttacatccttaacgctgtgggcgctggcggcctgcaccacgcttatcctgcccacacagacaatattgccagtctatagcgcggcgacctttttctgccttattgcgctaaaggccacgcggcggcgggcaaaatatgtcgtctggctgatgttctcgctgggggctggactgtggctggtgcacggtggctggctgacagaatggctaagcggcacgccacgctctccagaacggtgggcgcatgctattacgctctggttgcggattctggcgattgtttcaacctcacagttgtggatgcagtacgtccccgtgcaacgttttatccgcgctttgtttgcttctcgcctgccgccgggcgtcgcttatctgtttgccgggccgttattggtcgttgagcagttaaaacggcaattggcgattattcatgaagcgcagcgcgcccgcggcgtgccgctggatgagggctggtatcagcgtttacgtgcgatgcccgcgttaattattccgctaacacacaatgcgctaaacgatcttgctgtccgtggtgcggcactggatatgcgggcatttcgaatcaacaataggcgcactacgttatgggcaccagccgatagcaccctacaacgcgtagcacgttacgccatgatattgctaatgctggctgaattcggagcgtggatatggttacgttag

SEQ ID NO: 6912 - protein, 235 aa, Escherichia coli
MHPFTSLTLWALAACTTLILPTQTILPVYSAATFFCLIALKATRRRAKYVVWLMFSLGAGLWLVHGGWLTEWLSGTPRSPERWAHAITLWLRILAIVSTSQLWMQYVPVQRFIRALFASRLPPGVAYLFAGPLLVVEQLKRQLAIIHEAQRARGVPLDEGWYQRLRAMPALIIPLTHNALNDLAVRGAALDMRAFRINNRRTTLWAPADSTLQRVARYAMILLMLAEFGAWIWLR

SEQ ID NO: 6913 - DNA, 678 bp, Escherichia coli
atggttacgttagaacagtttcgctattgcccgacacactcaacgcatcctccgttctgttatgactttcactatgtcaaaccggggatggtcgccatctttggtgacaacggcagtggcaaaagtacgctggcgcagctgatggcgggctggtatccggactttctaccaggagagataaccggcacggggacgcttctcggtacgcccattgggcgtctcccgcttaatgaacaatccgccaccatccagctcgtccagcaatcgccctatttgcagctctccggctgtacctttagcgtggaagaagaagttgcctttgggccagaaaatctgtgtcttgctgaaaaagagattatggcgcggattgacgccgccctggccctgaccgagtgccagccgttgcgccatcgtcacccggcaacactctccggtggagagacacagcgtgtggtcatcgcctgcgccatcgcgatgcagccaaagctcttaattcttgatgaagcctttagccgcctgacgccgcaggcccgcgaaatgctgttgcagcgcttacaacactgggcgcttgaacgtggttcgctgattattctttttgaacgtcatcacacacctttcctgaaccactgccagcaagcgtggcaattgcaaaacggagcgctccagccactatgttaa

SEQ ID NO: 6914 - protein, 225 aa, Escherichia coli
MVTLEQFRYCPTHSTHPPFCYDFHYVKPGMVAIFGDNGSGKSTLAQLMAGWYPDFLPGEITGTGTLLGTPIGRLPLNEQSATIQLVQQSPYLQLSGCTFSVEEEVAFGPENLCLAEKEIMARIDAALALTECQPLRHRHPATLSGGETQRVVIACAIAMQPKLLILDEAFSRLTPQAREMLLQRLQHWALERGSLIILFERHHTPFLNHCQQAWQLQNGALQPLC

SEQ ID NO: 6915 - DNA, 714 bp, Escherichia coli
gtgaaaatcgaactgacggtgaatggactaaaggtacaggcgcagtactctgatgatgaaattgaaaatgtacataaaccattgctgcgtatgctggcggccttacagacagtaaatccgcagcggcgtacggtggtttttctttgcgctccgccggggacgggtaaatctaccctaaccaccttctgggaatatctcgcgcaacaagacccggaactgcccgctattcagacgctgccgatggatggttttcaccattacaatagctggctggatgtgcatcaattgcgacccttcaaaggcgcaccagagacattcaacgttgcgaaactggcggaaaatctgtgccgggttgtggaaggggattgtacgtggccgcagtacgatcgacaaaagcatgatcctgttgaagatgtgttgcacgttaccgcaccactcgtcatcgtcgaaggaaactggttgttgttggacgacgagaagtggtgccagcttgcgcaattttgtgatttctcgatctttatcaaagctcccgcatctgcgttgcgggagcgtctggtggggcgcaagctggcgggagggttatcgctggcagacgcagaagccttttatgaccgtaccgacgggccgaatgttcgccgggtgctggaagagagtctgcctgcaaatttgaccttaatgatgaccgctacgggtgaatatcgtctgatggattaa

SEQ ID NO: 6916 - protein, 237 aa, Escherichia coli
MKIELTVNGLKVQAQYSDDEIENVHKPLLRMLAALQTVNPQRRTVVFLCAPPGTGKSTLTTFWEYLAQQDPELPAIQTLPMDGFHHYNSWLDVHQLRPFKGAPETFNVAKLAENLCRVVEGDCTWPQYDRQKHDPVEDVLHVTAPLVIVEGNWLLLDDEKWCQLAQFCDFSIFIKAPASALRERLVGRKLAGGLSLADAEAFYDRTDGPNVRRVLEESLPANLTLMMTATGEYRLMD

SEQ ID NO: 6917 - DNA, 711 bp, Escherichia coli
gtggcaattgcaaaacggagcgctccagccactatgttaacgttaaatcagatatcttatcgctggcctggcgcggctacggattgtctttgcgacatttctctgcaactcaaacaaggtgaatggctggcgctgaccggcgacaatggcgcgggaaaatcgacgctgttacgagtaatggcaggtcttcttacgcccacagccggtacggttatgctgcaacaacaagcgatgaaaaacctgaaaaaccgccagcgcgcggcaaagattggcgtactgtttcaggaagcggaaaatcagctttttcacagcaccgttgctgacgaaatcgcatttggtttgatactgcaaaaatgcccggcggatgaaatcactcaacataccaatgctgccctgcaatgctgtcagttagcagacactgccagcgcgcatccgttagatctgcatagtgcgcagcgacggatggtcgccgtcgcctgcctggaagcactctctccgccactattgctactggacgagccgagtcgggattttgacgaaaattggttgagcgtgtttgaaagctggctggaaaagtgccgccagcgaggcacgagcgtcgtagcaatcagtcatgacgccgcatttacccggcgtcatttctctcgtgtggtgcgactggaagatggtgtaatcaggaacgttaatccatcagacgatattcacccgtag

SEQ ID NO: 6918 - protein, 236 aa, Escherichia coli
MAIAKRSAPATMLTLNQISYRWPGAATDCLCDISLQLKQGEWLALTGDNGAGKSTLLRVMAGLLTPTAGTVMLQQQAMKNLKNRQRAAKIGVLFQEAENQLFHSTVADEIAFGLILQKCPADEITQHTNAALQCCQLADTASAHPLDLHSAQRRMVAVACLEALSPPLLLLDEPSRDFDENWLSVFESWLEKCRQRGTSVVAISHDAAFTRRHFSRVVRLEDGVIRNVNPSDDIHP

SEQ ID NO: 6919 - DNA, 486 bp, Escherichia coli
gtgcttgagcaactggatgcacaggacaatttattttcatttatgaaaactgcgcattctattttgctccaggggatacgccagtttctgccgtcgctgtttgtcgataacgatgaagagatcgtcgaatatgcagtgaagccgttactcgcccaaagcggcccgcttgacgatattgatgttgcgctgcgtttgatttatgcgctggggaaaatggataaatggctgtacgccgatatcacgcatttttcccagttttggcattacctgaacgaacaggatgaaacgcccggatttgccgatgacatggcctgggattttatcagcaacgtcaatagcataatccgcaatgcgagtctctatgacgcgttgaaagcgatgaaattcgccgatttcgccgtctggtcagaggcgcgttttagcgggatggtcaaaacggcgctgatgctggcagtaacgaccaccttaaaggaattaacgccgtga

SEQ ID NO: 6920 - protein, 161 aa, Escherichia coli
MLEQLDAQDNLFSFMKTAHSILLQGIRQFLPSLFVDNDEEIVEYAVKPLLAQSGPLDDIDVALRLIYALGKMDKWLYADITHFSQFWHYLNEQDETPGFADDMAWDFISNVNSIIRNASLYDALKAMKFADFAVWSEARFSGMVKTALMLAVTTTLKELTP

SEQ ID NO: 6921 - DNA, 189 bp, Escherichia coli
atgatgtccctggcgtggccattatttcgcgttacggaacaggcagcgttggctgcctggccgcaaaccggctgtggcgacaaaaataaaattgatagccttgcggtcaccgcgatgcgccaggcattaaacgacgttgcttttcgtgggcgagtggttatcggcgagggggaacgatatcctctttag

SEQ ID NO: 6922 - protein, 62 aa, Escherichia coli
MMSLAWPLFRVTEQAALAAWPQTGCGDKNKIDSLAVTAMRQALNDVAFRGRVVIGEGERYPL

SEQ ID NO: 6923 - DNA, 1278 bp, Escherichia coli
atgaaaaccaaagttgctgctatttatggcaagcgggatgtccgtctgcgcgaatttgagctgccagaaattaccgataatgaactgttagtgaatgtaatttctgacagcgtttgtttatccacctggaaagcggcgttactcggtagtgaacataaacgcgtccccgacgatttagaaaatcatccggtcattaccgggcatgaatgtgccggggttattgtcgaagtgggtaaaaatctcactggcaaatataaaaaaggccagcgttttgtattgcaaccggcgatggggttaccaggcgggtattcagcgggctacagctacgaatattttggcggtaacgccacctatatgattattcccgaaatcgcgattaatttaggctgtgtattaccgtatcacggctcttattttgctgcggcctcgctggcggaaccgatgtgctgcattattggcgcttatcatgccaattatcacaccacgcaatatgtttatgagcatcgtatgggcgtcaaacctggcggcaatattgcgctactggcgtgtgcaggcccgatgggaattggcgctatcgattacgctattaacggcggcatacaaccgtcgcgggtggtggtagtcgatatcgacgacaaacggctggcgcaggtgcagatgctgctgccggtggaactggcggccagtaaaggcattgagctggtgtatatgaataccaaaggggtgagcgatccggtccagacgctgcgggcgctgacggatgatgccggatttgatgacgtatttgtctatgcagcggtgccttcagtcgtcgagatggcggatgaattactggcggaagatggctgcctgaacttctttgccggtccgacggataaaaacttcaaagtgccgtttaatttctacaacgtccattacaacagtacgcacgttgtcggcacgtccggcggttccacggacgacatgaaagaggcgattgcccttagcgccacggggcagttacagccgtcgtttatggtgacccatatcggtggcctggatgcggtgccagaaaccgtgctcaatctgccggatatccctggcggtaaaaaactcatttataacggcgtgaccatgccgctgaccgccattgccgattttgccgaaaaaggcaaaaccgatccgctgtttaaagagctggcgcggctggttgagaaaacgcacggcatctggaatgaacaggccgagaaatatctgctggcacaatttggcgttgatattggggaggccgcgcaatga

SEQ ID NO: 6924 - protein, 425 aa, Escherichia coli
MKTKVAAIYGKRDVRLREFELPEITDNELLVNVISDSVCLSTWKAALLGSEHKRVPDDLENHPVITGHECAGVIVEVGKNLTGKYKKGQRFVLQPAMGLPGGYSAGYSYEYFGGNATYMIIPEIAINLGCVLPYHGSYFAAASLAEPMCCIIGAYHANYHTTQYVYEHRMGVKPGGNIALLACAGPMGIGAIDYAINGGIQPSRVVVVDIDDKRLAQVQMLLPVELAASKGIELVYMNTKGVSDPVQTLRALTDDAGFDDVFVYAAVPSVVEMADELLAEDGCLNFFAGPTDKNFKVPFNFYNVHYNSTHVVGTSGGSTDDMKEAIALSATGQLQPSFMVTHIGGLDAVPETVLNLPDIPGGKKLIYNGVTMPLTAIADFAEKGKTDPLFKELARLVEKTHGIWNEQAEKYLLAQFGVDIGEAAQ

SEQ ID NO: 6925 - DNA, 1389 bp, Escherichia coli
atggaaaacaagtctgctcgtgcaaaggtccaggcttttgggggctttttgactgcaatggtcatccccaatattggtgcttttattgcctggggttttataacggcattatttattcccaccggctggctgccgaatgaacatttcgccaaaattgttggtccgatgattacctatttattgcccgtgatgattggttctaccggtggtcatctggtcggcggtaaacgcggcgcggtcatgggcggaattggtacgattggtgtgatcgtcggcgctgaaatcccgatgttccttggctcgatgattatggggccgctcggtggtctggtgattaaatatatcgacaagtcgctggaaaaacgcatacctgccggttttgagatggttatcaataacttctcattaggtatcgcggggatgctcctttgtctgctgggttttgaagtgatcggcccggcggtgttaattgctaatactttcgtcaaagagtgtattgaggcgctggtacatgcgggttatctacctttgctgtcagtcatcaatgaaccggcgaaagtgcttttccttaataatgcgatcgatcagggcgtctattatccgctgggaatgcaacaggcttcggttaacggtaaatccatcttcttcatggtggcctccaatccaggtcctggtctggggctgctgctggcgtttaccttgtttggtaaagggatgagtaaacgttctgcgcccggggcgatgattattcacttcctcggtgggatccacgaactgtatttcccgtatgtgctgatgaagccgctgaccattattgccatgattgcgggcggtatgtctggcacctggatgtttaacttactggacggtggtttggtggctggcccaagtccggggtctatctttgcttacctggcactgacgccgaaaggctcgttcctggcgacaattgccggtgttacggtaggtaccctggtgtcctttgctatcacttcgctgatactgaagatggaaaaaacggtggaaacggagagcgacgatgagtttgctcagtcagccaatgcggttaaggcgatgaaacaagaaggtgcattctcgttaagccgtgttaagcgtattgcctttgtttgcgatgcagggatgggctccagtgcgatgggcgcaaccaccttccgtaaacgcctggaaaaagcggggctggcaatagaagtaaaacattacgccatagaaaacgtgcctgcggatgcggatatcgtcgttactcacgccagtctggaagggcgcgtgaaacgtgtgacggataaaccactgatattgattaataactatattggcgatccaaaactcgacactttatttaatcaattaaccgctgaacataaacactga

SEQ ID NO: 6926 - protein, 462 aa, Escherichia coli
MENKSARAKVQAFGGFLTAMVIPNIGAFIAWGFITALFIPTGWLPNEHFAKIVGPMITYLLPVMIGSTGGHLVGGKRGAVMGGIGTIGVIVGAEIPMFLGSMIMGPLGGLVIKYIDKSLEKRIPAGFEMVINNFSLGIAGMLLCLLGFEVIGPAVLIANTFVKECIEALVHAGYLPLLSVINEPAKVLFLNNAIDQGVYYPLGMQQASVNGKSIFFMVASNPGPGLGLLLAFTLFGKGMSKRSAPGAMIIHFLGGIHELYFPYVLMKPLTIIAMIAGGMSGTWMFNLLDGGLVAGPSPGSIFAYLALTPKGSFLATIAGVTVGTLVSFAITSLILKMEKTVETESDDEFAQSANAVKAMKQEGAFSLSRVKRIAFVCDAGMGSSAMGATTFRKRLEKAGLAIEVKHYAIENVPADADIVVTHASLEGRVKRVTDKPLILINNYIGDPKLDTLFNQLTAEHKH

SEQ ID NO: 6927 - DNA, 444 bp, Escherichia coli
atgcggcttattgattattttccagaattatcaatctcagttatacattcaacaaaagactggcaggaagctatcaatttctcgatggcatcactgttagcaaaaaactatatcagcgagaattacattcaggctattaaagattccaccatcagcaatggtccttattatattctcgcaccaggcgtggcaatgcctcatgcgcgaccggaatgtggagcgcttaaaaccgggatgtctttgacgttacttaaacaaggcgtttattttccggggaatgacgaaccgattaaattactcatcggactttctgctgccgatgccgattcgcacattgctgctattcaggcgttaagtgaattactgtgcgaagaagaaatactcgaacaactcttaaccgcatcatcagaaaaacaattagcgggcattatcagccgcggataa

SEQ ID NO: 6928 - protein, 147 aa, Escherichia coli
MRLIDYFPELSISVIHSTKDWQEAINFSMASLLAKNYISENYIQAIKDSTISNGPYYILAPGVAMPHARPECGALKTGMSLTLLKQGVYFPGNDEPIKLLIGLSAADADSHIAAIQALSELLCEEEILEQLLTASSEKQLAGIISRG

SEQ ID NO: 6929 - DNA, 909 bp, Escherichia coli
atgaaagcacctgtttcattaacctcatttcgcccacaaaaatctcttgctatcgccattggcgtgcttgccgtggttgtgctgccatttctctcgtattacaccgttaatgaaggtgaacgcggcattttgctgcgctacggaaaaatcgtaaaagttgccgagccggggctgggttttaagatcccttttatggaaagcgtagagaaaatttccacgcgtaatcaggctgtggtctatcagggattacaggcctacagccgcgaccagcaaccggcacaaatgacagtatcagtcagcttccacattaaaccttcagaagcaggcgcggtttataccacctacaacaccattgaagcattaaaagatcgtctgattgtccgtcagttgccaactcaactggagaacgttttcggacaatataccgccatcagcgccgtacaggatcgtacaaaactggttcaggatctgcaaaatgccatgcgcaaagccgttgttgggccagtggtaattgacggggtccagattgaaaatattgatttttctgacgcttatgaaaagtcgattgaagaccgaatgaaagcagaagtcgccattgccacgcgtaagcaaaatctggaaacggagaaaatccaggcgcaaatagcggtaactcaggcccaggcggaagcagacagtaaactagcggcagccaaagcagaagcggaaactattcgcgtaagaggcgcggcagaggctgaaactattcgtttaaaaagtgcggctgaagcagaagctatccgcctgcgcggtgaagctctgcgggagaatcccggacttgttgccctcaccactgctgagcgttgggacggtaaactgcccgataccatgatccccggcagcacagttccgtttatctctactaagtaa

SEQ ID NO: 6930 - protein, 302 aa, Escherichia coli
MKAPVSLTSFRPQKSLAIAIGVLAVVVLPFLSYYTVNEGERGILLRYGKIVKVAEPGLGFKIPFMESVEKISTRNQAVVYQGLQAYSRDQQPAQMTVSVSFHIKPSEAGAVYTTYNTIEALKDRLIVRQLPTQLENVFGQYTAISAVQDRTKLVQDLQNAMRKAVVGPVVIDGVQIENIDFSDAYEKSIEDRMKAEVAIATRKQNLETEKIQAQIAVTQAQAEADSKLAAAKAEAETIRVRGAAEAETIRLKSAAEAEAIRLRGEALRENPGLVALTTAERWDGKLPDTMIPGSTVPFISTK

SEQ ID NO: 6931 - DNA, 1992 bp, Escherichia coli
atgtcctcacgtaaagagcttgccaatgctattcgtgcgctgagcatggacgcagtacagaaagccaaatccggtcacccgggtgcccctatgggtatggctgacattgccgaagtcctgtggcgtgatttcctgaaacacaacccgcagaatccgtcctgggctgaccgtgaccgcttcgtgctgtccaacggccacggctccatgttgatctacagcctgctgcacctcaccggttacgatctgccgatggaagaactgaaaaacttccgtcagctgcactcgaaaactccgggtcacccggaagtgggttacaccgcaggtgtagaaaccaccaccggtccgctgggtcagggtattgccaacgcagtcggtatggcgattgcagaaaaaacgctggcggcgcagtttaaccgtccgggccacgacatcgtcgaccactacacctacgccttcatgggcgacggctgcatgatggaaggcatctcccacgaagtttgctctctggcgggtacgttgaagctgggtaaactgattgcgttctacgatgacaacggtatttctatcgatggtcacgttgaaggctggtttaccgacgacaccgcaatgcgtttcgaagcttacggttggcacgttattcgcgacatcgacggtcatgacgcggcatccatcaaacgcgcaatagaagaagcgcgcgcagtgaccgacaaaccgtccctgctgatgtgcaaaaccatcatcggtttcggttccccgaacaaagccggtacccacgactcccacggtgcgccgctgggcgacgctgaaattgccctgacccgcgaacagctgggctggaaatacgcgccgttcgaaatcccgtctgaaatctatgctcagtgggatgcgaaagaagcaggccaggcgaaagagtccgcatggaacgagaaattcgctgcttacgcgaaagcttatccgcaggaagccgctgaatttacccgccgtatgaaaggcgaaatgccgtctgacttcgacgcgaaagcgaaagagttcattgctaaacttcaggctaatccggcgaaaatcgccagccgtaaagcgtctcagaatgctatcgaagcgttcggtccgctgttgccggaattcctcggcggctccgctgaccttgctccgtctaacctgaccctgtggtctggttctaaagcaatcaacgaagatgctgcaggtaactacatccactacggtgttcgcgagttcggtatgaccgcgattgctaacggtatctccctgcacggtggtttcctgccgtatacctcaaccttcctgatgttcgtggaatacgcacgtaatgccgtacgtatggctgcgctgatgaaacagcgtcaggtgatggtttacacccacgactccatcggtctgggcgaagatggcccgactcaccagccggtagaacagatcgcttctctgcgcgtgaccccgaacatgtctacatggcgtccgtgtgaccaggttgaatccgcagtagcgtggaaatacggcgttgagcgtcaggacggcccgactgcgcttatcctctcccgtcagaacctggcgcagcaggaacgtactgaagagcagctggcaaacatcgcgcgcggtggttatgtgctgaaagactgtgctggtcagccggaactgatcttcatcgcgaccggttctgaagttgaactggctgttgccgcctacgaaaaactgactgccgaaggcgtgaaagcgcgcgtggtttccatgccgtctaccgacgcattcgacaagcaggacgcggcttaccgtgaatccgtactgccgaaagcggttaccgctcgtgttgcggtggaagctggcattgctgactactggtacaagtatgttggcctgaacggcgctatcgtcggcatgaccaccttcggtgaatctgctccggcagagcagctgtttgaagagttcggcttcaccgttgacaacgttgttgcgaaagcaaaagcgctgctgtaa

SEQ ID NO: 6932 - protein, 663 aa, Escherichia coli
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAIEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQIASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAEQLFEEFGFTVDNVVAKAKALL

SEQ ID NO: 6933 - DNA, 978 bp, Escherichia coli
ttgggctacgccggaaaatttgccaacaatttaccgcaagccgctcgtcatgtacatggaacatccttttgccgcttcagaaatctctggatcatgctcgcatgttgcgcaatccactcgcccgtccgctgcgcttttccttatactgagactgagcgtcgattcacctgcaaacggcgcatttttagaataatcctgaccttgtgcggaagagaaaacatgaaaattcgcgccttattggtagcaatgagcgtggctacggtgctgaccggttgccagaatatggactccagtggactgctctcatcaggagcggaagcttttcaggcttacagtttgagtgatgcgcaggtgaaaaaactgagcgatcaggcatgccaggagatggacagcaaagcgacgattgcgccagccaatagcgaatatgctagacgtctgacgacaatttctcgcgcgttaggcgataacatcaacggtcagccggtgaattacaaagtgtatatggcgaaggatgtgaacgcctttgcaatggctaacggctgtatccgcgtctatagcgggctgatggatatgatgacggataacgaagtcgaagcggtgctcggtcacgaaatggggcacgtggcattaggccatgtgaagaaaggaatgcaggtagcacttggtacaaacgcaattcgcgttgcggcggcctctgcaggcggaattgtcggcagtttgtcacaatcacaactgggagacctgggcgaaaagctagtcaattcgcaatttacccaacgtcaggaatcagaggccgatgattactcctacgatttgctgcgccaacgcggtatcagcccggcaggtcttgccaccagctttgaaaaactggcgaagctggaagaaggccgtcaaagctcaatgtttgacgaccatccagcatccgccgaacgcgcccagcatattcgcgatcgtatgagcgcggatggagttaagtaa

SEQ ID NO: 6934 - protein, 325 aa, Escherichia coli
MGYAGKFANNLPQAARHVHGTSFCRFRNLWIMLACCAIHSPVRCAFPYTETERRFTCKRRIFRIILTLCGRENMKIRALLVAMSVATVLTGCQNMDSSGLLSSGAEAFQAYSLSDAQVKKLSDQACQEMDSKATIAPANSEYARRLTTISRALGDNINGQPVNYKVYMAKDVNAFAMANGCIRVYSGLMDMMTDNEVEAVLGHEMGHVALGHVKKGMQVALGTNAIRVAAASAGGIVGSLSQSQLGDLGEKLVNSQFTQRQESEADDYSYDLLRQRGISPAGLATSFEKLAKLEEGRQSSMFDDHPASAERAQHIRDRMSADGVK

SEQ ID NO: 6935 - DNA, 921 bp, Escherichia coli
atgagcaccttaggtcatcaatacgataactcactggtttccaacgcctttggttttttacgcctgccgatgaacttccagccatatgacagcgatgctgactgggtgattactggcgtgccgttcgatatggccacttctggccgtgcgggggggcgccacggtccggcagcgatccgtcaggtttcgacgaatctggcctgggaacacaaccgcttcccgtggaatttcgacatgcgtgagcgcctgaacgtcgtggactgcggtgatctggtatatgccttcggcgatgcccgtgagatgagcgagaagctgcaggcgcacgccgagaagctgctggctgctggtaagcgtatgctctccttcggtggtgaccactttgttacgctgccgctgctgcgcgctcatgcgaagcatttcggcaaaatggcactggtacactttgacgcccacaccgacacctatgcgaacggttgtgaatttgaccacggcaccatgttctataccgcgccgaaagaaggtctgatcgacccgaatcattccgtgcagattggtattcgtaccgagtttgataaagacaacggctttaccgtgctggacgcctgccaggtgaacgatcgcagcgtggatgacattatcgcccaggtgaaacagattgtgggtgatatgccggtttacctgacctttgatatcgactgcctggatcctgctttcgcgccgggaaccggtacgccggtaattggcggcctgacctccgatcgcgccattaaactggtacgcggcttgaaagatctcaacatcgttgggatggacgtagtggaagtggctccggcatacgatcagtcggaaatcaccgctctggctgcggcgacgctggcgctggagatgctgtatattcaggcggcgaaaaagggagagtaa

SEQ ID NO: 6936 - protein, 306 aa, Escherichia coli
MSTLGHQYDNSLVSNAFGFLRLPMNFQPYDSDADWVITGVPFDMATSGRAGGRHGPAAIRQVSTNLAWEHNRFPWNFDMRERLNVVDCGDLVYAFGDAREMSEKLQAHAEKLLAAGKRMLSFGGDHFVTLPLLRAHAKHFGKMALVHFDAHTDTYANGCEFDHGTMFYTAPKEGLIDPNHSVQIGIRTEFDKDNGFTVLDACQVNDRSVDDIIAQVKQIVGDMPVYLTFDIDCLDPAFAPGTGTPVIGGLTSDRAIKLVRGLKDLNIVGMDVVEVAPAYDQSEITALAAATLALEMLYIQAAKKGE

SEQ ID NO: 6937 - DNA, 732 bp, Escherichia coli
atgaaaaaatggaaagtacgtagcgcgttggtggcattaatcgtgctgctggccggttgttccagtaatgcgcagtataatagcagtgcatcgggtaatgtcggcaccgcctggggtggggatgtgcactcaacggttcatggcgtatctgctgaacgagcctggcgcgatccggcagagatgatcgttattagttattcgactaatgttccttccggctacgaccgcgtttatagcattcgtattaacgaactggaatatgctattcgcgatggtaattttaaatctctaccaattacgcgggtttatgattcatccaataatgaaccacgctatattgtccatgccagagtcggaatgaattatcaattatatgtccgtaattacagtcgtaacaccaactacgagatcgttgctacggttgatggcctggatgttctgaatggtaaacaaggttcgctgaataacaacggttatattgtgaatgccggagattcgttagcgattaaaggattccgcaaagataaacataccgaagcggcttttcagttcgccaacgttgctgattcctacgcagccaattcggcgcaaggcgatgtgcgtaataccggtgtaatcggctttgccgcctttgaattacaaggcccggcgaaaaacgcgctgccgccgtgctctggacaagcctttccggcagataacaatggctatgcgccgccaccgtgtcggaaatag

SEQ ID NO: 6938 - protein, 243 aa, Escherichia coli
MKKWKVRSALVALIVLLAGCSSNAQYNSSASGNVGTAWGGDVHSTVHGVSAERAWRDPAEMIVISYSTNVPSGYDRVYSIRINELEYAIRDGNFKSLPITRVYDSSNNEPRYIVHARVGMNYQLYVRNYSRNTNYEIVATVDGLDVLNGKQGSLNNNGYIVNAGDSLAIKGFRKDKHTEAAFQFANVADSYAANSAQGDVRNTGVIGFAAFELQGPAKNALPPCSGQAFPADNNGYAPPPCRK

SEQ ID NO: 6939 - DNA, 1899 bp, Escherichia coli
atgagctcccaggaagccagcaagatgctgcgtacttacaatattgcctggtggggcaataactactatgacgttaacgagctgggccacatcagcgtgtgcccggacccggacgtcccggaagctcgcgtcgatctcgcgcagttagtgaaaactcgcgaagcacagggtcagcgtctgcctgcactgttctgtttcccacagatcctgcagcaccgtttgcgttccattaacgccgcgttcaaacgagcgcgggaatcctacggctataacggcgattacttcctcgtttatccgatcaaagttaaccagcaccgccgcgtgattgagtccctgattcattcgggcgaaccgctgggcctggaagccggttccaaagctgagttgatggcggtgctggcacatgctggcatgacccgtagcgtcatcgtctgcaacggttataaggaccgcgaatatatccgcctggcattaattggcgagaagatgggccacaaggtctatctggtcattgagaagatgtcagaaattgccattgtgctggatgaagcagaacgtctgaatgtcgttcctcgtctgggcgtgcgtgcacgtctggcgtcgcaaggctcgggtaaatggcagtcctccggcggggaaaaatcgaagtttggcctggcggcgactcaagtactgcaactggttgaaacgctgcgtgaagccgggcgtctcgacagcctgcaactgctgcacttccacctcggttcgcagatggcgaatattcgcgatatcgcgacaggcgttcgtgaatccgcgcgtttctatgtggaactgcacaagctgggcgtcaatattcagtgcttcgacgtcggcggcggtctgggcgtggactatgaaggcacccgttctcagtctgactgctccgtaaactacggcctcaatgaatacgccaacaacatcatctgggcgattggtgatgcgtgtgaagaaaatggtctgccacatccgacggtaatcaccgaatcgggtcgtgcggtgactgcgcatcacaccgtgctggtgtcgaatatcatcggcgtggaacgtaacgaatacacggtgccgaccgcgcctgcagaagacgcaccgcgcgccctgcaaagcatgtgggaaacctggcaggaaatgcacgaaccgggaactcgccgttctctgcgtgaatggttacacgacagccagatggatctgcacgacattcatatcggctactcttccggcacctttagcctgcaagaacgcgcatgggctgagcagctttatttgagcatgtgccatgaagtgcaaaagcagctggatccgcaaaaccgtgctcatcgtccgattatcgacgagctgcaggaacgtatggcggacaaaatgtacgtcaacttctcgctgttccagtcgatgccggatgcgtgggggatcgaccagttgttcccggttctgccgctggaagggctggatcaagtgccggaacgccgcgctgtgctgctggatattacctgtgactcagacggtgctatcgaccactatattgatggtgacggtattgccacgacaatgcctatgccggagtacgatccggagaatccgccgatgctcggtttctttatggtcggcgcatatcaggagatcctcggcaacatgcacaacctgttcggtgataccgaagcggttgacgtgttcgtcttccctgatggtagcgtagaggtagaactgtctgacgaaggcgataccgtggcggacatgctgcaatatgtgcagctcgatccgaaaacgctgttaacccagttccgcgatcaggtgaagaaaaccgatcttgatgctgaactgcaacaacagttccttgaagagttcgaggcaggtttgtacggttatacctatcttgaagatgaataa

SEQ ID NO: 6940 - protein, 632 aa, Escherichia coli
MSSQEASKMLRTYNIAWWGNNYYDVNELGHISVCPDPDVPEARVDLAQLVKTREAQGQRLPALFCFPQILQHRLRSINAAFKRARESYGYNGDYFLVYPIKVNQHRRVIESLIHSGEPLGLEAGSKAELMAVLAHAGMTRSVIVCNGYKDREYIRLALIGEKMGHKVYLVIEKMSEIAIVLDEAERLNVVPRLGVRARLASQGSGKWQSSGGEKSKFGLAATQVLQLVETLREAGRLDSLQLLHFHLGSQMANIRDIATGVRESARFYVELHKLGVNIQCFDVGGGLGVDYEGTRSQSDCSVNYGLNEYANNIIWAIGDACEENGLPHPTVITESGRAVTAHHTVLVSNIIGVERNEYTVPTAPAEDAPRALQSMWETWQEMHEPGTRRSLREWLHDSQMDLHDIHIGYSSGTFSLQERAWAEQLYLSMCHEVQKQLDPQNRAHRPIIDELQERMADKMYVNFSLFQSMPDAWGIDQLFPVLPLEGLDQVPERRAVLLDITCDSDGAIDHYIDGDGIATTMPMPEYDPENPPMLGFFMVGAYQEILGNMHNLFGDTEAVDVFVFPDGSVEVELSDEGDTVADMLQYVQLDPKTLLTQFRDQVKKTDLDAELQQQFLEEFEAGLYGYTYLEDE

SEQ ID NO: 6941 - DNA, 147 bp, Escherichia coli
gtgcttaataatgttatgaaaaagaaaccggttgcgcagttggagcgtcagcattcactgctggaaaatccatgtgcttatgggttgttatcgcagttccaggctgcgatagtcgttaactgttttacacttaataaaataatttga

SEQ ID NO: 6942 - protein, 48 aa, Escherichia coli
MLNNVMKKKPVAQLERQHSLLENPCAYGLLSQFQAAIVVNCFTLNKII

SEQ ID NO: 6943 - DNA, 126 bp, Escherichia coli
gtgtgctttttatttaagccgcgcgccgcgttttataccccacaatggcagaaaattgcaaaagataaatacgcagaatgccagcattgtcaggaaaaatttccagccacgtttttaacagaatga

SEQ ID NO: 6944 - protein, 41 aa, Escherichia coli
MCFLFKPRAAFYTPQWQKIAKDKYAECQHCQEKFPATFLTE

SEQ ID NO: 6945 - DNA, 1155 bp, Escherichia coli
atggcaaaacacctttttacgtccgagtccgtctctgaagggcatcctgacaaaattgctgaccaaatctctgatgccgttttagacgcgatcctcgaacaggatccgaaagcacgcgttgcttgcgaaacctacgtaaaaaccggcatggttttagttggcggcgaaatcaccaccagcgcctgggtagacatcgaagagatcacccgtaataccgttcgcgaaattggctatgtacattccgacatgggctttgacgctaactcctgtgcggttctgagcgccatcggtaaacagtctcctgacatcaaccagggcgttgaccgtgccgatccgctggaacagggcgcgggcgaccagggtctgatgtttggctacgcaactaatgaaaccgacgtgctgatgccagcacctatcacttatgcacaccgtctggtacagcgtcaggctgaagtgcgtaaaaacggcactctgccgtggctgcgcccggacgcgaaaagccaggtgactttccagtatgacgacggcaaaatcgttggcattgatgctgtcgtgctttccactcagcactctgaagagatcgaccagaaatcgctgcaagaagcggtaatggaagagatcatcaagccgattctgcccgctgaatggctgacttctgccaccaaattcttcatcaacccgaccggtcgtttcgttatcggtggcccgatgggtgactgcggtctgactggtcgtaaaatcatcgttgatacctacggcggcatggcgcgtcatggtggcggtgcattctccggtaaagatccatcaaaagtggaccgttccgcagcctacgcagcacgttatgtcgcgaaaaacattgttgctgctggcctggccgatcgttgtgaaattcaggtttcctacgcaatcggcgtggctgaaccgacttccatcatggtagaaactttcggtactgagaaagtgccttctgaacaactgactctgctggtacgtgaattcttcgacctgcgcccatacggtctgattcagatgctggatctgctgcacccgatctacaaagaaaccgcagcatacggtcactttggtcgtgaacatttcccgtgggaaaaaaccgacaaagcgcagctgctgcgtgatgctgccggtctgaagtaa

SEQ ID NO: 6946 - protein, 384 aa, Escherichia coli
MAKHLFTSESVSEGHPDKIADQISDAVLDAILEQDPKARVACETYVKTGMVLVGGEITTSAWVDIEEITRNTVREIGYVHSDMGFDANSCAVLSAIGKQSPDINQGVDRADPLEQGAGDQGLMFGYATNETDVLMPAPITYAHRLVQRQAEVRKNGTLPWLRPDAKSQVTFQYDDGKIVGIDAVVLSTQHSEEIDQKSLQEAVMEEIIKPILPAEWLTSATKFFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVPSEQLTLLVREFFDLRPYGLIQMLDLLHPIYKETAAYGHFGREHFPWEKTDKAQLLRDAAGLK

SEQ ID NO: 6947 - DNA, 1395 bp, Escherichia coli
atgcctgacgctaaaaaacaggggcggtcaaacaaggcaatgacgtttttcgtctgcttccttgccgctctggcgggattactctttggcctggatatcggtgtaattgctggcgcactgccgtttattacagatgaattccagattacttcgcacacgcaagaatgggtcgtaagctccatgatgttcggtgcggcagtcggtgcggtgggcagcggctggctctcctttaaactcgggcgcaaaaagagcctgatgatcggcgcaatcctgtttgttgccggttcactgttctctgcggctgcgccaaacgttgaagtactgattctttcccgcgttctgctggggctggcggtgggtgtggcctcttataccgcaccactgtacctgtcagaaattgcgccggaaaaaattcgcggcagtatgatctcgatgtatcagttgatgatcactatcgggatcctcggcgcttatctttctgataccgccttcagctacaccggtgcatggcgctggatgctgggtgtgattatcatcccggcaattttgctgctgattggtgtcttcttcctgccagacagcccacgttggtttgccgccaaacgccgttttgttgatgccgaacgcgtgctgctacgcctgcgtgacaccagcgcggaagcgaaacgcgaactggatgaaatccgtgaaagtttgcaggttaaacagagtggctgggcgctgtttaaagagaacagcaacttccgccgcgcggtgttccttggcgtactattgcagataatgcagcaattcaccgggatgaacgtcatcatgtattacgcgccgaaaatcttcgaactggcgggttataccaacaccaccgagcaaatgtgggggacagtgattgtcggcctgaccaacgtacttgccacctttatcgcaatcggccttgttgaccgctggggacgtaaaccaacgctaacgctgggcttcctggtgatggctgctggtatgggcgtactcggtacaatgatgcatatcggtatccactctccgtcggcgcagtatttcgccatcgccatgctgctgatgtttattgtcggttttgccatgagtgctggtccgctgatttgggtactgtgctccgaaattcagccgctgaaaggccgcgattttggcatcacctgctccactgccaccaactggattgccaacatgatcgttggcgcaacgttcctgaccatgctcaacacgctgggtaacgccaacaccttctgggtgtatgctgctctgaacgtactgtttatcctgctgacattgtggctggtaccggaaaccaaacatgtttcgctggaacatattgaacgtaatctgatgaaaggtcgtaaactgcgcgaaatcggcgctcacgattaa

SEQ ID NO: 6948 - protein, 464 aa, Escherichia coli
MPDAKKQGRSNKAMTFFVCFLAALAGLLFGLDIGVIAGALPFITDEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQIMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 6949 - DNA, 498 bp, Escherichia coli
atgaaaacatcccgtctccctatcgccatccaacaggccgttatgcgtcgcctgcgggaaaaactcgcccaggcgaacctgaagctagggcgtaactacccggagccaaaactctcttacacccagcgcggaacctctgccggaacagcctggctggaaagctatgaaattcgcctcaatcccgttttgctgttggaaaacagtgaagcctttattgaagaagtggtgccgcacgaactggcacatttgctggtatggaaacatttcggccgcgtagcgccacatggcaaagagtggaagtggatgatggaaagcgtgctgggcgttcccgcccgccgtacgcatcagttcgaactgcaatccgtgcgccgcaacaccttcccctaccgctgcaagtgccaggagcatcagcttaccgtacgccgtcataatcgcgtagttcgtggcgaagccgtctatcgctgtgttcactgcggcgaacagctggttgcgaaataa

SEQ ID NO: 6950 - protein, 165 aa, Escherichia coli
MKTSRLPIAIQQAVMRRLREKLAQANLKLGRNYPEPKLSYTQRGTSAGTAWLESYEIRLNPVLLLENSEAFIEEVVPHELAHLLVWKHFGRVAPHGKEWKWMMESVLGVPARRTHQFELQSVRRNTFPYRCKCQEHQLTVRRHNRVVRGEAVYRCVHCGEQLVAK

SEQ ID NO: 6951 - DNA, 708 bp, Escherichia coli
atgtaccgttatttgtctattgctgcggtggtactgagcgcagcattttccggcccggcattggccgaaggtatcaatagtttttctcaagcgaaagccgcggcggtaaaagtccacgctgacgcgcccggtacgttttattgcggatgtaaaattaactggcagggcaaaaaaggcgttgttgatctgcaatcgtgcggctatcaggtgcgaaaaaatgaaaaccgtgccagccgcgtagagtgggaacacgtcgttcctgcctggcaattcggtcaccagcgccagtgctggcaggacggtggacgtaaaaattgcgccaaagatccggtctatcgcaagatggaaagcgatatgcataacctgcagccgtcagtcggtgaggtgaatggcgatcgcggcaactttatgtacagccagtggaatggcggtgaaggccagtacggtcaatgcgccatgaaggtcgatttcaaagaaaaagttgccgaaccaccagcgcgtgcacgcggtgccattgcgcgcacctacttctatatgcgtgaccaatacaacctgacactctctcgtcagcaaacgcagctgttcaacgcatgggacaagatgtatccagttaccgactgggagtgcgagcgtgatgaacgcatcgcgaaggtgcagggcaatcataacccgtatgtgcaacgcgcttgccaggcgcgaaagagctaa

SEQ ID NO: 6952 - protein, 235 aa, Escherichia coli
MYRYLSIAAVVLSAAFSGPALAEGINSFSQAKAAAVKVHADAPGTFYCGCKINWQGKKGVVDLQSCGYQVRKNENRASRVEWEHVVPAWQFGHQRQCWQDGGRKNCAKDPVYRKMESDMHNLQPSVGEVNGDRGNFMYSQWNGGEGQYGQCAMKVDFKEKVAEPPARARGAIARTYFYMRDQYNLTLSRQQTQLFNAWDKMYPVTDWECERDERIAKVQGNHNPYVQRACQARKS

SEQ ID NO: 6953 - DNA, 732 bp, Escherichia coli
atgcgtatcccccgcatttatcatcctgaaccactgaccagccattctcacatcgcgctttgcgaagatgccgccaaccatatcgggcgcgtactgcgtatggggccgggacaggcgctgcaattgtttgacggcagcaaccaggtctttgacgccgaaattaccagcgccagcaaaaaaagcgtggaagtgaaggtgctggaaggccagatcgacgatcgcgaatctccgctgcatattcacctcggtcaggtgatgtcgcgtggtgaaaaaatggaatttactatccagaaatcgatcgaactcggtgtaagcctcattacgccacttttttctgagcgctgcggcgttaaactggatagtgaacgtctgaacaagaagctccagcagtggcagaagattgcaattgctgcctgtgagcagtgtggccgtaaccgggtgccggaaatccgtccagcgatggatctggaagcctggtgtgcagagcaggatgaaggactgaaactgaatcttcacccgcgcgccagtaacagcatcaatacgttgccgttaccggtcgaacgcgtccgcctgctgattggcccggaaggcggtttatcggcagatgaaattgccatgactgcccgctatcaatttactgatatcctgttgggacctcgcgttttgcgtactgagacaactgcgctcaccgccattaccgcgctacaagtgcgttttggcgatttgggctaa

SEQ ID NO: 6954 - protein, 243 aa, Escherichia coli
MRIPRIYHPEPLTSHSHIALCEDAANHIGRVLRMGPGQALQLFDGSNQVFDAEITSASKKSVEVKVLEGQIDDRESPLHIHLGQVMSRGEKMEFTIQKSIELGVSLITPLFSERCGVKLDSERLNKKLQQWQKIAIAACEQCGRNRVPEIRPAMDLEAWCAEQDEGLKLNLHPRASNSINTLPLPVERVRLLIGPEGGLSADEIAMTARYQFTDILLGPRVLRTETTALTAITALQVRFGDLG

SEQ ID NO: 6955 - DNA, 951 bp, Escherichia coli
atgatcaagctcggcatcgtgatggaccccatcgcaaacatcaacatcaagaaagattccagtttcgctatgttgctggaagcacagcgtcgtggttacgaacttcactatatggagatggccgatctctatttgatcaatggtgaggctcgcgctcgtacccgtactttgagcgtcgaacagaactacgataaatggtacgagttcacgggtgagcaggatctgccgctggccgatctcgatgtgatcctgatgcgtaaagacccgccgtttgataccgagtttatctacgcgacctatattctggaacgtgccgaagagaaagggacgctgatcgttaacaagccgcagagcctgcgcgactgtaacgaaaaactgttcactgcctggttctctgacttaacgccagaaacactggtcacgcgcaataaagcgcagttgaaagcgttctgggaaaaacacagcgacatcattcttaagccgctggacggtatgggcggcgcgtcgattttccgcgtgaaagaaggtgatccaaacctcggcgtgattgccgaaaccctgactgagcatggcactcgctactgcatggcgcaaaattacctgccagccattaaagatggcgacaaacgcgtgctggtagtggatggcgagccggtgccgtattgcctggcgcgtattccgcaggggggcgaaacccgtggcaatctggctgccggtggtcgcggtgaacctcgtccgctgacggaaagtgactggaaaatcgcccgtcagattgggccgacgctgaaagaaaaagggctgatttttgttggtctggatatcatcggcgaccgtctgactgaaattaacgtcaccagcccaacctgtattcgtgagattgaagcagagtttccggtgtcgatcaccggaatgttaatggatgccatcgaagcacgtttacagcagcagtaa

SEQ ID NO: 6956 - protein, 316 aa, Escherichia coli
MIKLGIVMDPIANINIKKDSSFAMLLEAQRRGYELHYMEMADLYLINGEARARTRTLSVEQNYDKWYEFTGEQDLPLADLDVILMRKDPPFDTEFIYATYILERAEEKGTLIVNKPQSLRDCNEKLFTAWFSDLTPETLVTRNKAQLKAFWEKHSDIILKPLDGMGGASIFRVKEGDPNLGVIAETLTEHGTRYCMAQNYLPAIKDGDKRVLVVDGEPVPYCLARIPQGGETRGNLAAGGRGEPRPLTESDWKIARQIGPTLKEKGLIFVGLDIIGDRLTEINVTSPTCIREIEAEFPVSITGMLMDAIEARLQQQ

SEQ ID NO: 6957 - DNA, 636 bp, Escherichia coli
gtgacagcgcccttctttccacgcatactgggcgctgttgcttttttgaaccaggaaacagaacctctgacaatgaatttacagcatcactttcttattgccatgcctgctctccaggatccgattttccgtcgttccgtggtctacatttgcgaacataataccaatggtgcaatggggatcatcgtcaacaagccgctggaaaatctcaaaattgaagggattctggaaaagctgaagatcacgccggagccgcgtgatgaatcaatccgtctggataaaccggttatgctcggcggtccgctggctgaagatcgcgggtttattttgcatactccgccctccaattttgcttccagcattcgcatttcagacaacacagtgatgaccacttcccgcgatgtgctggaaacgctcggcaccgataaacaaccgtctgacgtattggtggctctgggttatgcctcctgggagaaaggtcaactggaacaagaaattctcgataacgcgtggctaacggccccggcagatctgaatattctgttcaaaacgccgattgccgaccgctggcgcgaggcggcaaaactgattggtgtggatattctcaccatgcctggtgtggcaggacacgcctga

SEQ ID NO: 6958 - protein, 211 aa, Escherichia coli
MTAPFFPRILGAVAFLNQETEPLTMNLQHHFLIAMPALQDPIFRRSVVYICEHNTNGAMGIIVNKPLENLKIEGILEKLKITPEPRDESIRLDKPVMLGGPLAEDRGFILHTPPSNFASSIRISDNTVMTTSRDVLETLGTDKQPSDVLVALGYASWEKGQLEQEILDNAWLTAPADLNILFKTPIADRWREAAKLIGVDILTMPGVAGHA

SEQ ID NO: 6959 - DNA, 417 bp, Escherichia coli
atgagtggaaccttactcgccttcgacttcggcaccaaaagcattggcgtagcggtcggccaacgcattaccggcaccgctcgccctttgcctgcaattaaagcgcaggacggtacgccggactggaacattatcgagcgtttactgaaagagtggcagccggacgaaatcatcgtcggtttgccgctgaatatggacggcaccgaacagccgttaaccgccagagcgcgtaaatttgccaaccgtattcatggtcgtttcggtgttgaagtaaagctccatgacgagcgtcttagcaccgtggaggcacgttccggtctgtttgaacagggcggctatcgggcgctcaacaaaggcaaagtcgactctgcctctgcggttattattctcgaaagctatttcgagcagggatattaa

SEQ ID NO: 6960 - protein, 138 aa, Escherichia coli
MSGTLLAFDFGTKSIGVAVGQRITGTARPLPAIKAQDGTPDWNIIERLLKEWQPDEIIVGLPLNMDGTEQPLTARARKFANRIHGRFGVEVKLHDERLSTVEARSGLFEQGGYRALNKGKVDSASAVIILESYFEQGY

SEQ ID NO: 6961 - DNA, 1026 bp, Escherichia coli
gtgccaggttatgcgcaatatcgttcattttccgaggatcttagtatgaatatggaagaaattgtggcccttagtgtaaagcataacgtctcggatctacacctgtgcagcgcctggcccgcacgatggcgtattcgcgggagaatggaagctgcgccgtttgacgcgccggacgtcgaagagctactgcgggagtggctggatgacgatcagcgggcaatattgctggagaatggtcagctggattttgctgtgtcgctggcggaaaaccagcgattgcgcggcagtgcgttcgcacaacggcaaggtatttctctggcgttacggctgttaccttcgcactgcccgcagctcgaacagcttggcgcaccaccggtattgccggaattactcaagagcgagaatggcctgattctggtgacgggggcgacggggagcggcaaatctaccacgctggcggcgatggttggctatctcaatcaacatgccgatgcgcatattctgacgctggaagatcctgtggaatatctctataccagtcagcgatgtttgatccagcagcgggagattggtttgcactgtatgactttcgcatcgggattgcgggctgcattgcgggaagatcctgatgtgattttgctcggagagctgcgtgatagcgagacaatccgtctggcgctgacggcggcagaaaccgggcatctggtgctggcgacattacacacgcgcggcgcagcgcaggcagttgagcgactggtggattcatttcctgcgcaggaaaaagatcccgtgcgtaatcaactggcaggtagtttacgggcagtgttgtcacaaaaactggaagtggataaacaggaaggacgcgtggcgctgtttgaattactgattaacacacccgcggtggggaatttgattcgtgaagggaaaacccaccagttaccgcatgttattcaaaccgggcagcaggtggggatgataacgtttcagcagagttatcagcagcgggtgaaagaagggcgcttgtga

SEQ ID NO: 6962 - protein, 341 aa, Escherichia coli
MPGYAQYRSFSEDLSMNMEEIVALSVKHNVSDLHLCSAWPARWRIRGRMEAAPFDAPDVEELLREWLDDDQRAILLENGQLDFAVSLAENQRLRGSAFAQRQGISLALRLLPSHCPQLEQLGAPPVLPELLKSENGLILVTGATGSGKSTTLAAMVGYLNQHADAHILTLEDPVEYLYTSQRCLIQQREIGLHCMTFASGLRAALREDPDVILLGELRDSETIRLALTAAETGHLVLATLHTRGAAQAVERLVDSFPAQEKDPVRNQLAGSLRAVLSQKLEVDKQEGRVALFELLINTPAVGNLIREGKTHQLPHVIQTGQQVGMITFQQSYQQRVKEGRL

SEQ ID NO: 6963 - DNA, 705 bp, Escherichia coli
atgaacgatattgcgcataacctggcacaggtccgggacaaaatctcagcggctgcaacgcgttgcggccgttctccagaagaaattacgctgcttgcagtcagtaaaacaaaacctgcgagcgccatcgcagaagccattgatgccgggcagcgtcaatttggtgaaaactacgttcaggaaggggtagataaaattcgccactttcaggaactgagcgtaacaggattagaatggcattttattggcccgttgcagtctaataaaagccgcctggtggcagagcatttcgactggtgtcataccatcgaccgtttgcgcatcgctacccgtctgaacgaccagcgcccggcagaacttccccctcttaacgtactgattcaaattaacattagtgatgaaaacagtaagtccgggattcaactggctgaactggacgagctggcagctgcggtcgctgaactaccgcgtttacgtctgcgcgggctgatggcaatccctgcgcctgagtcagaatatgtaaggcagtttgaagttgcacgccaaatggctgtagcatttgccggactgaaaacgcgctacccgcatatcgacacgctctctctgggaatgtcggacgatatggaagccgccattgcggcaggtagcacgatggttcgtatcggcactgcaatttttggtgcgcgtgattactctaaaaaataa

SEQ ID NO: 6964 - protein, 234 aa, Escherichia coli
MNDIAHNLAQVRDKISAAATRCGRSPEEITLLAVSKTKPASAIAEAIDAGQRQFGENYVQEGVDKIRHFQELSVTGLEWHFIGPLQSNKSRLVAEHFDWCHTIDRLRIATRLNDQRPAELPPLNVLIQINISDENSKSGIQLAELDELAAAVAELPRLRLRGLMAIPAPESEYVRQFEVARQMAVAFAGLKTRYPHIDTLSLGMSDDMEAAIAAGSTMVRIGTAIFGARDYSKK

SEQ ID NO: 6965 - DNA, 567 bp, Escherichia coli
atgaatacgttgactttcctgctttcaacggtcattgagctgtataccatggtgctgttattacgcatctggatgcagtgggctcattgtgatttttacaaccccttctcacagtttgtagtgaaggtaacgcagccgattatcgggccactgcgccgcgttattccggcaatgggccccattgatagcgcctcgctgctggttgcctatattctcagtttcattaaagccatcgtgctgtttaaagtggtgaccttcctgccaatcatttggattgccggtttattgattctgctgaaaaccatcggcctgctgattttctgggtcctgctggtgatggcgattatgagctgggtaagccagggtcgtagcccgattgaatacgtgctgattcagctggccgatccgctgctgcgcccgattcgccgcttgctaccggcaatgggtgggattgatttctcgccgatgatcctcgttctgctgctgtatgtcatcaatatgggtgtcgcagaagtcttgcaggcgaccggaaatatgctgctgccggggctgtggatggcgttatga

SEQ ID NO: 6966 - protein, 188 aa, Escherichia coli
MNTLTFLLSTVIELYTMVLLLRIWMQWAHCDFYNPFSQFVVKVTQPIIGPLRRVIPAMGPIDSASLLVAYILSFIKAIVLFKVVTFLPIIWIAGLLILLKTIGLLIFWVLLVMAIMSWVSQGRSPIEYVLIQLADPLLRPIRRLLPAMGGIDFSPMILVLLLYVINMGVAEVLQATGNMLLPGLWMAL

SEQ ID NO: 6967 - DNA, 303 bp, Escherichia coli
gtggatggcgttatgagtgccgtaacagttaatgatgacggtctggttttacggctctatattcagccgaaagccagccgtgattctattgtcggtttacatggcgacgaggtaaaagtcgccattaccgcgccgccggttgacggccaggccaacagccatctggtgaagtttctcggtaagcaattccgggttgccaaaagccaggtggtgattgaaaaaggcgaacttggccgccacaaacaaattaaaatcattaatccgcaacaaatcccgccagaaatcgcggcgttaattaattag

SEQ ID NO: 6968 - protein, 100 aa, Escherichia coli
MDGVMSAVTVNDDGLVLRLYIQPKASRDSIVGLHGDEVKVAITAPPVDGQANSHLVKFLGKQFRVAKSQVVIEKGELGRHKQIKIINPQQIPPEIAALIN

SEQ ID NO: 6969 - DNA, 594 bp, Escherichia coli
atgcaaaaagttgtcctcgcaaccggcaatgccggtaaagtgcgtgagctggcgtcgctgcttagcgacttcggtcttgatatcgtggcccaaacagacctcggcgtagattccgctgaagaaaccggcctgacctttatcgaaaacgcgattctgaaagcgcgccatgcggcaaaagtgaccggtttaccggcaattgccgacgactccggtctggcggtagatgcgctgggtggcgcgccgggtatttactccgcgcgttattccggtgaagacgcgaccgatcaaaagaatctgcaaaaactgctggaaacaatgaaagacgtaccggacgaccaacgtcaggcgcgtttccactgcgtgctggtatatctgcgtcacgcggaagatcccactccgctggtatgccacggtagctggccaggcgtgattactcgtgaaccagcgggcactggtggctttggttatgatccaatcttcttcgtaccttccgaagggaaaaccgctgccgaactgacccgcgaagaaaagagcgccatttcccaccgtggtcaggcgttgaaactgctgctggacgctttacgtaatggttaa

SEQ ID NO: 6970 - protein, 197 aa, Escherichia coli
MQKVVLATGNAGKVRELASLLSDFGLDIVAQTDLGVDSAEETGLTFIENAILKARHAAKVTGLPAIADDSGLAVDALGGAPGIYSARYSGEDATDQKNLQKLLETMKDVPDDQRQARFHCVLVYLRHAEDPTPLVCHGSWPGVITREPAGTGGFGYDPIFFVPSEGKTAAELTREEKSAISHRGQALKLLLDALRNG

SEQ ID NO: 6971 - DNA, 1137 bp, Escherichia coli
atggttaaattaccgccgctgagtctctacattcacatcccgtggtgcgtgcagaaatgcccgtactgcgatttcaactctcacgcgttgaaaggagaagtgccgcacgacgattatgttcagcatctgcttaacgatctggacaacgatgtggcttacgctcagggccgtgaagtgcagacaatctttattggcggtggtacgccgagcctgctttccggcccggcgatgcaaacgctgctggacggcgtgcgtgcgcgtttgccgctgacagcggatgcagaaattacgatggaagcgaaccctggtacggttgaagccgatcgctttgtcgattatcagcgtgctggtgtgaaccgcatctctattggtgtgcagagttttagcgaagaaaagctgaaacgacttgggcgcattcatggcccgcaagaagcgaaacgagctgcgaagctggcgagcggtttagggttacgtagctttaaccttgatttgatgcatgggctgccggatcaatcactggaagaggcgctaggcgatctgcgccaggctattgaactgaatccgccgcatctttcctggtatcaactgaccatcgaacctaatacgctgtttggctctcgcccaccggtgctgccggacgacgatgcgttgtgggatatattcgaacaggggcatcagttattaaccgcagcgggttatcagcaatatgaaacttccgcttactccaaacccggttatcagtgccagcacaatctcaactactggcgctttggtgactacattggtattggctgcggcgcgcacggcaaagtgaccttcccggatgggcgcattctgcgtaccaccaaaacgcgtcatccgcgtggttttatgcagggaagatatctggaaagccagcgtgatgtcgaagctgcagataaaccgtttgagttctttatgaatcgcttccgtctgctggaagccgcgccgcgcgtggagtttagccagtatactggcctttctgaagaagttattcgcccacagttagaagaggctatcgctcagggttatctcacagaatgtgcagattactggcagataacggaacatgggaagttgtttttaaattcgttgctggagctttttctggcggagtaa

SEQ ID NO: 6972 - protein, 378 aa, Escherichia coli
MVKLPPLSLYIHIPWCVQKCPYCDFNSHALKGEVPHDDYVQHLLNDLDNDVAYAQGREVQTIFIGGGTPSLLSGPAMQTLLDGVRARLPLTADAEITMEANPGTVEADRFVDYQRAGVNRISIGVQSFSEEKLKRLGRIHGPQEAKRAAKLASGLGLRSFNLDLMHGLPDQSLEEALGDLRQAIELNPPHLSWYQLTIEPNTLFGSRPPVLPDDDALWDIFEQGHQLLTAAGYQQYETSAYSKPGYQCQHNLNYWRFGDYIGIGCGAHGKVTFPDGRILRTTKTRHPRGFMQGRYLESQRDVEAADKPFEFFMNRFRLLEAAPRVEFSQYTGLSEEVIRPQLEEAIAQGYLTECADYWQITEHGKLFLNSLLELFLAE

SEQ ID NO: 6973 - DNA, 1008 bp, Escherichia coli
gtgaaaaagcaatggattgttggtacggcgctgtttatgttgatgactggtaatgtctgggcagatggtgaaccgccaactgaaaatatcttaaaagatcaattcaaaaagcagtatcacggcattctcaagcttgatgtcatcaccttaaaaaatcttgatgctaagggtaatcaggccacctggtcagcggaaggcgatgtctcttccagtgacgatctctatacctgggtcggtcagttggcagattacgagctgctcgaacagacctggacgaaagataaaccggtgaaattctcggcgatgttaaccagtaaaggaacgcccgcgtctggctggtcggtgaacttttactcttttcaggcggcagccagcgatcgtgggcgggtggttgacgatatcaaaacgaataataaatatctgatcgtgaatagcgaagatttcaattatcgctttagtcagcttgagtctgcgttgaataaccagaataactcgattcctgcactgaaaaaggatgtaaaagcgcttgataagcaaatggtggcggcgcagaaagcagcggatgcatattggggaaaagatgcaaacggtaagcaaatgacccgcgaagacgcctttaaaaaaattcaccaacagcgtgatgattttaataaacagaacgatagtgaggcgttcgcggttaaatatgacaaagaggtttatcaaccggcgattgcggcatgtcataaacagagtgaagagtgttatgaagtgccaattcagcagaaacgagattttgatatcaacgaacaacggcgacagacttttctgcaatcacaaaaacttagccgtaaattgcaggatgactggataacgctcgagaaagggcaatatccgttaacgatgaaagtttcagaaataaacagtaaaaaagtcgcgattttgatgaaaattgacgatatcaaccaggctaatgaacgctggaaaaaagataccgaacaactgcggcgcaatggggtgattaagtaa

SEQ ID NO: 6974 - protein, 335 aa, Escherichia coli
MKKQWIVGTALFMLMTGNVWADGEPPTENILKDQFKKQYHGILKLDVITLKNLDAKGNQATWSAEGDVSSSDDLYTWVGQLADYELLEQTWTKDKPVKFSAMLTSKGTPASGWSVNFYSFQAAASDRGRVVDDIKTNNKYLIVNSEDFNYRFSQLESALNNQNNSIPALKKDVKALDKQMVAAQKAADAYWGKDANGKQMTREDAFKKIHQQRDDFNKQNDSEAFAVKYDKEVYQPAIAACHKQSEECYEVPIQQKRDFDINEQRRQTFLQSQKLSRKLQDDWITLEKGQYPLTMKVSEINSKKVAILMKIDDINQANERWKKDTEQLRRNGVIK

SEQ ID NO: 6975 - DNA, 1047 bp, Escherichia coli
atggagtttttcaaaaagacggcacttgccgcactggttatgggttttagtggtgcagcattggcattacccaatatcaccattttagcaaccggcgggaccattgccggtggtggtgactccgcaaccaaatctaactacacagcgggtaaagttggcgtagaaaatctggttaatgcggtgccgcaactgaaggacattgcgaacgttaaaggcgagcaggtagtgaatattggctcccaggacatgaacgatgatgtctggctgacactggcgaaaaaaattaacaccgactgcgataaaactgacggcttcgtcattacccacggtaccgacacgatggaagaaaccgcttacttcctcgacctgacggtgaaatgcgacaaaccggtggtgatggtcggtgcaatgcgcccgtccacgtctatgagcgcagacggtccattcaacctgtataacgcggtagtgaccgcagctgataaagcctccgctaatcgtggcgtactggtagtgatgaacgacaccgtgcttgatggccgtgatgtcaccaaaaccaacaccaccgatgtagcgaccttcaagtctgttaactacggtcctctgggttacattcacaacggtaagattgactaccaacgtaccccggcacgtaagcacaccagcgacacgccgttcgatgtctctaagctgaatgaactgccgaaagtcggcattgtttataactacgctaacgcatccgatcttccggctaaagcactggtagatgcgggctatgatggcatcgttagcgctggcgtgggtaacggcaacctgtataaaaccgtatttgacacccttgcaaccgctgcgaaaaacggcactgcagtagtgcgttcttcccgcgtaccgacgggcgctaccactcaagatgccgaagtggatgatgcgaaatacggcttcgtcgcctccggcatgttgaacccgcaaaaagcgcgcgttctgctgcaactggctctgacgcaaactaaagatccgcagcagatccagcagatcttcaatcagtactaa

SEQ ID NO: 6976 - protein, 348 aa, Escherichia coli
MEFFKKTALAALVMGFSGAALALPNITILATGGTIAGGGDSATKSNYTAGKVGVENLVNAVPQLKDIANVKGEQVVNIGSQDMNDDVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKTVFDTLATAAKNGTAVVRSSRVPTGATTQDAEVDDAKYGFVASGMLNPQKARVLLQLALTQTKDPQQIQQIFNQY

SEQ ID NO: 6977 - DNA, 717 bp, Escherichia coli
atgcgcaaaatgctgctggcggcagcactttcagtgacggcaatgaccgctcacgccgactaccagtgcagcgtcacgccgcgtgacgatgtgattgtcagcccgcaaaccgtgcaggtgaagggcgaaaacggcaatctggtgatcacgccagacggcaacgtgatgtataacggtaagcaatattccctgaatgccgcccagcgcgagcaggcgaaggattatcaggctgaactacgtagcaccctgccgtggattgatgaaggcgcgaaaagccgcgtcgagaaagctcgtattgcgctggataaaattatcgttcaggagatgggcgaaagcagcaaaatgcgcagccgtctgaccaaacttgatgcgcagctgaaagagcagatgaaccgcattatcgaaacgcgcagcgatggcctgacgtttcactataaagccattgatcaggttcgtgccgaaggccagcaattagtgaatcaggcaatgggcggaattttacaggacagcattaatgaaatgggcgcgaaagcggtgctgaaaagcggcggtaacccattacagaacgtgctgggaagcctgggcggcctgcaatcctcaatccaaaccgagtggaaaaagcaggaaaaagatttccagcagtttggcaaagatgtttgtagccgcgttgtgactctggaagatagccgcaaagccctggtcgggaatttaaaataa

SEQ ID NO: 6978 - protein, 238 aa, Escherichia coli
MRKMLLAAALSVTAMTAHADYQCSVTPRDDVIVSPQTVQVKGENGNLVITPDGNVMYNGKQYSLNAAQREQAKDYQAELRSTLPWIDEGAKSRVEKARIALDKIIVQEMGESSKMRSRLTKLDAQLKEQMNRIIETRSDGLTFHYKAIDQVRAEGQQLVNQAMGGILQDSINEMGAKAVLKSGGNPLQNVLGSLGGLQSSIQTEWKKQEKDFQQFGKDVCSRVVTLEDSRKALVGNLK

SEQ ID NO: 6979 - DNA, 141 bp, Escherichia coli
atgcaaaactgcctgatgtgctacgcttatcaggcctacaaagatgcacgatcgagtaggccggataaggcgtttacgccgcatccggcatggaaaacgcgcactttgttatcaatctggggccagcaaatgctggcctga

SEQ ID NO: 6980 - protein, 46 aa, Escherichia coli
MQNCLMCYAYQAYKDARSSRPDKAFTPHPAWKTRTLLSIWGQQMLA

SEQ ID NO: 6981 - DNA, 357 bp, Escherichia coli
atgggacttaatgttcgagagggtgaaataatggcaaagaaccgtagccgtcgtctgcgtaaaaaaatgcacatcgacgaattccaggaattaggattttcggtggcatggcgattcccggaaggtacatcggaagaacagattgataaaaccgttgatgactttattaacgaggttatcgaaccgaacaaactggcctttgacggcagcggttatctggcctgggaaggtctgatctgcatgcaggaaatcggcaaatgcaccgaagaacatcaggcgattgtgcgtaagtggctggaagaacgcaaactggaagaggtacgcaccagcgaacttttcgacgtttggtgggactaa

SEQ ID NO: 6982 - protein, 118 aa, Escherichia coli
MGLNVREGEIMAKNRSRRLRKKMHIDEFQELGFSVAWRFPEGTSEEQIDKTVDDFINEVIEPNKLAFDGSGYLAWEGLICMQEIGKCTEEHQAIVRKWLEERKLEEVRTSELFDVWWD

SEQ ID NO: 6983 - DNA, 720 bp, Escherichia coli
atgaaaaacgacgtcatctcaccggaatttgatgaaaacggccgcccgctgcgccgtatccgtagttttgtgcgccgccaggggcgactgaccaaaggccaggaacatgcgctggaaaactactggccggtgatgggcgttgagttcagcgaagatatgctggatttccctgcgctttttggccgtgaagcgccggtgacgcttgagattggttttggcatgggcgcgtcgctggtggcaatggctaaagatcgccccgagcaggacttcctcggcattgaagtgcattcaccgggcgttggtgcgtgcctgtcttctgcgcatgaagagggcttaagcaacctgcgcgtgatgtgtcacgatgcggttgaagtgctgcataaaatgattcctgacaattcattgcgcatggtgcagctctttttccctgacccgtggcacaaagcgcgccataataaacgccgtatcgttcaggtgccgtttgccgagctggtaaaaagcaaactgcagctggggggcatattccatatggcgaccgactgggaaccttatgcggaacatatgcttgaagtgatgtcttctattgacggttataaaaacctgtcagagagcaatgattacgtaccgcgtccggcatcacgtccggtgacgaaatttgaacaacgtggtcatcgtcttggtcacggagtatgggacttaatgttcgagagggtgaaataa

SEQ ID NO: 6984 - protein, 239 aa, Escherichia coli
MKNDVISPEFDENGRPLRRIRSFVRRQGRLTKGQEHALENYWPVMGVEFSEDMLDFPALFGREAPVTLEIGFGMGASLVAMAKDRPEQDFLGIEVHSPGVGACLSSAHEEGLSNLRVMCHDAVEVLHKMIPDNSLRMVQLFFPDPWHKARHNKRRIVQVPFAELVKSKLQLGGIFHMATDWEPYAEHMLEVMSSIDGYKNLSESNDYVPRPASRPVTKFEQRGHRLGHGVWDLMFERVK

SEQ ID NO: 6985 - DNA, 1083 bp, Escherichia coli
ttgcccccaacaacagtgaattcggtgaccatgcaagcgtcgcaattttcagcccaggttctggactggtacgataaatacgggcggaaaacgctgccctggcaaattgacaagacgccctacaaagtatggctctcagaagtgatgttgcaacaaactcaggttgcgaccgttatcccctattttgaacgctttatggcgcgcttcccaacggtgaccgatctcgccaatgcgccgctcgacgaagttctccacttgtggaccgggcttggctattacgcccgcgcgcgcaatctgcataaagcggcacaacaagtggcgaccttacacggcggtaaattcccggaaacctttgaagaagtcgcggcgttaccgggcgtcgggcgttccaccgcaggcgcgattctctcgctttctctgggtaagcactttccgattctcgacggtaacgtcaaacgggtgctggcgcgctgctatgctgtaagcggctggcctgggaaaaaagaggtcgagaataaactatggagtttgagcgagcaggtgacgcccgcggttggcgtggaacggtttaatcaggcgatgatggatttgggcgcgatgatttgtacgcgctctaagccgaaatgttcgctctgtccgctacaaaacggatgtattgccgccgccaacaatagctggtcgctttatccgggcaaaaaaccgaaacagacgctgccagagcgcaccggctactttttgctgttacagcacgaagatgaagtattgctggcgcagcgtccgtcgagcggattgtggggcggtttatactgtttcccgcagtttgccgatgaagaaagtttgcggcagtggctggcgcaacgacagatttctgccgataacctgacgcagctgaccgcgtttcggcataccttcagccatttccacttagatattgtgcctatgtggcttcccgtgtcgtcattcaccggctgcatggatgaagacaatgcgctctggtataacttagcgcaaccgccgtcagttggcctggcggctcccgtggagcgtttgttacagcagttacgcactggcgcgccggtttag

SEQ ID NO: 6986 - protein, 360 aa, Escherichia coli
MPPTTVNSVTMQASQFSAQVLDWYDKYGRKTLPWQIDKTPYKVWLSEVMLQQTQVATVIPYFERFMARFPTVTDLANAPLDEVLHLWTGLGYYARARNLHKAAQQVATLHGGKFPETFEEVAALPGVGRSTAGAILSLSLGKHFPILDGNVKRVLARCYAVSGWPGKKEVENKLWSLSEQVTPAVGVERFNQAMMDLGAMICTRSKPKCSLCPLQNGCIAAANNSWSLYPGKKPKQTLPERTGYFLLLQHEDEVLLAQRPSSGLWGGLYCFPQFADEESLRQWLAQRQISADNLTQLTAFRHTFSHFHLDIVPMWLPVSSFTGCMDEDNALWYNLAQPPSVGLAAPVERLLQQLRTGAPV

SEQ ID NO: 6987 - DNA, 276 bp, Escherichia coli
atgagcagaacgattttttgtactttcctgcaacgtgaagcagaaggtcaggattttcagctgtaccccggcgaactgggaaaacgcatctataacgagatctccaaagaagcctgggcgcagtggcagcacaaacaaaccatgctgattaatgaaaagaaactcaacatgatgaatgccgagcaccgcaagctgctggagcaggagatggtcaacttcctgttcgagggtaaagaggtgcatatcgagggctatacgccggaagataaaaaataa

SEQ ID NO: 6988 - protein, 91 aa, Escherichia coli
MSRTIFCTFLQREAEGQDFQLYPGELGKRIYNEISKEAWAQWQHKQTMLINEKKLNMMNAEHRKLLEQEMVNFLFEGKEVHIEGYTPEDKK

SEQ ID NO: 6989 - DNA, 1080 bp, Escherichia coli
atgaaaaaatatctcgcgctggctttgattgcgccgttgctcatctcctgttcgacgaccaaaaaaggcgatacctataacgaagcctgggtcaaagataccaacggttttgatattctgatggggcaatttgcccacaatattgagaacatctggggcttcaaagaggtggtgatcgccggtcctaaggactacgtgaaatacaccgatcaatatcagacccgcagccacatcaacttcgatgacggtacgattactatcgaaaccatcgccgggacagaacctgccgcgcatctgcgccgggcaattatcaaaacgttgctgatgggggacgatccgagttcggtcgatctctattccgacgttgatgatattacgatttcgaaagaacctttcctttacggtcaggtggtggacaacaccgggcagccgattcgctgggaaggtcgcgcgagcaacttcgcggattatctgctgaaaaaccgtctgaagagccgcagcaacgggctgcgtatcatctacagcgtcaccattaacatggtgccgaaccaccttgataaacgtgcgcacaaatatctcggcatggtccgccaggcgtcacggaaatatggcgttgatgagtcgctgattctggcgattatgcagaccgagtcatcctttaacccatatgcggtcagccgttccgatgcgctggggttaatgcaggtggtacaacatactgccgggaaagatgtgttccgctcgcaggggaaatccggcacgccgagccgcagtttcttgtttgatcctgccagcaatattgataccggcaccgcgtatctggcgatgctgaacaacgtttatctcggcggaattgataacccaacatcgcggcgttatgccgtcatcaccgcctataacggcggcgcaggcagcgtgctgcgagtcttttcgaatgataagattcaggctgccaatattattaacaccatgacgccgggcgatgtttatcagacgctgacgacccgccatccctctgcggaatctcgccgttatctttataaagtgaataccgcgcaaaaatcctaccgccgccgataa

SEQ ID NO: 6990 - protein, 359 aa, Escherichia coli
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 6991 - DNA, 1257 bp, Escherichia coli
atgaatcttaagctgcagctgaaaatcctctcttttctgcagttctgtctgtggggaagttggctgacgaccctcggctcctatatgtttgttaccctgaagtttgacggtgcttctattggcgcagtttatagttcactgggtatcgccgcggtctttatgcctgcgctgctggggattgtggccgacaaatggttaagtgcgaaatgggtctatgccatttgccacaccattggcgctatcacgctgttcatggcggcagaggtcactacgccggaggcgatgttccttgtgatattgattaactcgtttgcttatatgccaacgcttgggttaatcaacaccatctcttactatcgcctgcaaaatgccgggatggatatcgttactgacttcccgccaatccgtatctggggcaccatcggctttatcatggcaatgtgggtggtgagcctgtccggcttcgaattaagccacatgcagctgtatattggcgcagcgctttccgccattctggttctgtttaccctgactctgccgcatattccggttgctaaacagcaagcgaatcagagctggacaaccctgctgggcctcgatgcattcgctctgtttaaaaacaagcgtatggcaatcttcttcatcttctcaatgctgctgggcgcggaactgcagattaccaacatgttcggtaataccttcctgcacagcttcgacaaagatccgatgtttgccagcagcttcatcgtgcagcatgcgtcaatcatcatgtcgatttcgcagatctctgaaaccctgttcattctgaccatcccgttcttcttaagccgctacggtattaagaacgtaatgatgatcagtattgtggcgtggatcctgcgttttgctctgtttgcttacggcgacccgactccgttcggtactgtactgctggtactgtcgatgatcgtttacggttgcgcattcgacttcttcaacatctctggttcggtgtttgtcgaaaaagaagttagtccggcaattcgcgccagcgcgcaggggatgttcctgatgatgaccaacggcttcggctgtatcctcggcggcatcgtgagcggtaaagtggttgagatgtacacccaaaacggcattaccgactggcagaccgtatggctgattttcgcaggttactccgtggttctggccttcgcgttcatggcgatgttcaaatataaacacgttcgtgtcccgacaggtacacagacggttagccactaa

SEQ ID NO: 6992 - protein, 418 aa, Escherichia coli
MNLKLQLKILSFLQFCLWGSWLTTLGSYMFVTLKFDGASIGAVYSSLGIAAVFMPALLGIVADKWLSAKWVYAICHTIGAITLFMAAEVTTPEAMFLVILINSFAYMPTLGLINTISYYRLQNAGMDIVTDFPPIRIWGTIGFIMAMWVVSLSGFELSHMQLYIGAALSAILVLFTLTLPHIPVAKQQANQSWTTLLGLDAFALFKNKRMAIFFIFSMLLGAELQITNMFGNTFLHSFDKDPMFASSFIVQHASIIMSISQISETLFILTIPFFLSRYGIKNVMMISIVAWILRFALFAYGDPTPFGTVLLVLSMIVYGCAFDFFNISGSVFVEKEVSPAIRASAQGMFLMMTNGFGCILGGIVSGKVVEMYTQNGITDWQTVWLIFAGYSVVLAFAFMAMFKYKHVRVPTGTQTVSH

SEQ ID NO: 6993 - DNA, 2220 bp, Escherichia coli
gtgaccagtttgacccatatctcatggggcagggttttccaccttgtccggtattcttacttccccgaaacgggttttgcgcttatgaaatcaatgaatattgccgccagtagtgaactggtatcccgactttctactcatcgctgcgtggtagcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggtaatagcacctttgcttgccctggacatcaacatggtgcgttctttaaaaagcatcctgccggacgccatttttacgatttctttggcgagaacatctttcgcgccgatatgtgtaacgctgacgtaaaattgggcgatctgcttattcatgaaggatcggcgaaagatgcgcagaaatttgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgttgattcaggcgggggcgacgccggtctatctggaagcttcacgtaacccgtttggtttcattggcggtattgatgcgcactgttttaatgaagagtatctgcgccagcaaattcgcgacgttgcgccagaaaaagccgacctgccgcgcccgtttcgcctggcgattattcagctgggaacctatgacggcactgtctataacgcccgtcaggtgatcgataccgttgggcatctgtgtgattacattctgtttgattccgcgtgggtcggttacgaacagtttatcccgatgatggcggatagctcgccgctgctgttagaacttaacgaaaacgatccggggatctttgtgacccagtcggtgcacaaacagcaggcgggattctcacagacgtcgcagatccataaaaaagataaccatatccgtggacaggcgcgtttttgcccgcataagcggttgaataatgcctttatgctccatgcttctaccagcccgttctatccgctgttcgccgcgctggacgttaacgccaaaattcatgaaggggagagtgggcgtcggctgtgggctgagtgcgttgagttgggtattgagtcgcgcaaggctattcttgcgcgctgtaagctgttccgcccgtttatcccgcccgttgttgatggcaaattgtggcaggattatccgacgtcagtgttagccagcgaccgccgttttttcagttttgatccgggggcgaagtggcacggctttgaaggatatgccgcggatcagtattttgttgatccgtgcaagctgttactcaccacgcagggtatcgatgccgaaaccggcgaatatagcgattttggcgttccagcgacgattctggcgcactatctgcgtgagaacggcattgtgccggagaagtgcgatctcaactccattctgttcttattaactccggcggaaagccacgagaagctggcacaactggtggcgatgctggcgcagtttgaacagcatattgaggatgactcgccgctggctgaggtgttgccgagcgtttataacaaatatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaatccccaggatgcgcatagcgcttatattcgcggtgaagtggagttggtgcggattcgtgatgccgaagggcgaattgcggcagaaggggcgttgccttatccacctggcgtgctttgcgtggtacccggggaagtctggggtggggcggttcaacgttatttccttgcgctggaagaaggcgtgaatttgttgccgggattttcgccggagttgcaaggtgtctatagcgaaaccgatgcgaatggcatgaaacggttgtacggttatgtgttgaagtaa

SEQ ID NO: 6994 - protein, 739 aa, Escherichia coli
MTSLTHISWGRVFHLVRYSYFPETGFALMKSMNIAASSELVSRLSTHRCVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENIFRADMCNADVKLGDLLIHEGSAKDAQKFAAKVFHADKTYFVLNGTSAANKVVTNALLTRGDLVLFDRNNHKSNHHGALIQAGATPVYLEASRNPFGFIGGIDAHCFNEEYLRQQIRDVAPEKADLPRPFRLAIIQLGTYDGTVYNARQVIDTVGHLCDYILFDSAWVGYEQFIPMMADSSPLLLELNENDPGIFVTQSVHKQQAGFSQTSQIHKKDNHIRGQARFCPHKRLNNAFMLHASTSPFYPLFAALDVNAKIHEGESGRRLWAECVELGIESRKAILARCKLFRPFIPPVVDGKLWQDYPTSVLASDRRFFSFDPGAKWHGFEGYAADQYFVDPCKLLLTTQGIDAETGEYSDFGVPATILAHYLRENGIVPEKCDLNSILFLLTPAESHEKLAQLVAMLAQFEQHIEDDSPLAEVLPSVYNKYPVRYRDYTLRQLCQEMHDLYVSFDVKDLQKAMFRQQSFPSVVMNPQDAHSAYIRGEVELVRIRDAEGRIAAEGALPYPPGVLCVVPGEVWGGAVQRYFLALEEGVNLLPGFSPELQGVYSETDANGMKRLYGYVLK

SEQ ID NO: 6995 - DNA, 708 bp, Escherichia coli
gtggtcatcggcccttttatcaacgcaagtgcagtcttactgggtggcgttttcggcgcactccttagccaacgcttaccggaacgtatccgcgtctccatgacatcaatttttggtctggcatcgctggggattggtattttactggtggtgaaatgcgccaaccttccggcgatggttttagcaaccttactcggagcattaatcggcgaaatttgtctgctggaaaaaggcgtcaatacagtggtcgccaaagcgcataatctgtttcaccactcgcgtaagaagccagcgcatgaatcttttattcagaattttgtcgcgattattgttctgttttgcgccagcggcaccggaatcttcggggcgatgaacgaagggatgaccggcgatccgagtattttaatcgccaagtcatttcttgatttctttacggcgatgatcttcgcctgctcgctgggtattgcggtgtcggtgattagcattccattactgatcatccagttaacactggcgtgggctgccgcgctgatattaccgctgaccacaccgtcgatgatggcagacttcagcgccgtaggcggtttattgctgctggcaaccggattacgcatctgtggtattaaaatgttcccggtggtcaacatgcttccagcactccttctggcaatgccgctttccgccgcctggaccgcctggtttgcctga

SEQ ID NO: 6996 - protein, 235 aa, Escherichia coli
MVIGPFINASAVLLGGVFGALLSQRLPERIRVSMTSIFGLASLGIGILLVVKCANLPAMVLATLLGALIGEICLLEKGVNTVVAKAHNLFHHSRKKPAHESFIQNFVAIIVLFCASGTGIFGAMNEGMTGDPSILIAKSFLDFFTAMIFACSLGIAVSVISIPLLIIQLTLAWAAALILPLTTPSMMADFSAVGGLLLLATGLRICGIKMFPVVNMLPALLLAMPLSAAWTAWFA

SEQ ID NO: 6997 - DNA, 156 bp, Escherichia coli
atggcagcgcttgtggtaacctggtttaatccggtgataaaggcattttacatgcatctgtcagcagccggaaaaaccaaaaaaatggcgctggttgactgtatgcgtaaattgctgaccatcctgaacgcaatgctcagaaagaacgaagagtga

SEQ ID NO: 6998 - protein, 51 aa, Escherichia coli
MAALVVTWFNPVIKAFYMHLSAAGKTKKMALVDCMRKLLTILNAMLRKNEE

SEQ ID NO: 6999 - DNA, 984 bp, Escherichia coli
atgtctgaaagacatttacctgatgaccagagcagtactatcgatccatatctaattacctctgttcgccagactctggcagaacaaggcgcagcattacaaaacttgtctaaacaactggattccgggcagtaccagcgtgtccttaatttgataatgaactgtaaagggcacgttattctttcgggaatgggtaaatcagggcatgtcggtcgtaaaatgtcagcgacgctggcctctacgggtacgcctagtttctttattcatcctgcagaagctttccatggcgatctgggcatgattacgccttacgatcttctgatccttatttctgccagcggtgaaacggatgaaatcctcaagctagttccttcactgaaaaatttcggcaaccgaattatcgccattaccaataatggaaattccacgctggcgaaaaatgctgatgccgtgctggaactccatatggcgaatgaaacctgcccgaataatcttgcaccaacaacgtctaccacgctgacgatggcgatcggcgatgcgctggcgattgccatgatccgccaacgcaaatttatgccgaatgattttgcgcgctatcacccgggcggttcattaggtcgtcgcctgctgacccgcgttgctgatgtcatgcaacatgatgttcctgcggtacagctggatgcgtcatttaaaaccgtgattcaacgtatcaccagcggatgccagggaatggtgatggtagaagacgcagaaggtgggctagcgggcattatcaccgacggtgacctgcgtcgctttatggaaaaagaggattctctgacatccgccacggctgcgcagatgatgacacgtgaaccgctgacgctaccggaagacaccatgatcattgaagcggaagaaaaaatgcaaaaacaccgtgtctcaacgttattggtgaccaacaaggcaaataaagtcactggccttgtgcgcattttcgactaa

SEQ ID NO: 7000 - protein, 327 aa, Escherichia coli
MSERHLPDDQSSTIDPYLITSVRQTLAEQGAALQNLSKQLDSGQYQRVLNLIMNCKGHVILSGMGKSGHVGRKMSATLASTGTPSFFIHPAEAFHGDLGMITPYDLLILISASGETDEILKLVPSLKNFGNRIIAITNNGNSTLAKNADAVLELHMANETCPNNLAPTTSTTLTMAIGDALAIAMIRQRKFMPNDFARYHPGGSLGRRLLTRVADVMQHDVPAVQLDASFKTVIQRITSGCQGMVMVEDAEGGLAGIITDGDLRRFMEKEDSLTSATAAQMMTREPLTLPEDTMIIEAEEKMQKHRVSTLLVTNKANKVTGLVRIFD

SEQ ID NO: 7001 - DNA, 1149 bp, Escherichia coli
atgttgataaaagtgaagtctgccgtatcctggatgcgtgctcgtctgtctgccatctcactggcagatatccaaaaacacctggcgaaaatcatcattctggcaccgatggcggtgctgctgatctatctggctatcttcagccagcctcgctatatgagcgagtcgaaagtcgccattaaacgctcggatgatttaaacagcggcagcctgaattttggtctgcttctgggtgcctctaaccccagttccgcagaagatgctttgtatctgaaagagtacatcaactcgccggatatgctggcggcgctggataagcaactaaattttcgtgaagcatttagccacagcgggctcgattttcttaatcatcttagcaaggatgaaaccgcagaaggattcctgaagtactacaaggaccgtatcaacgtctcgtatgacgataaaaccggattactgaatattcagacgcagggctttagcccggagtttgcgcttaagtttaaccagaccgtgctgaaagagtcagagcgctttatcaatgagatgtcacatcgcatcgcgcgtgaccagcttgcctttgcagaaacggagatggaaaaggcacgccagcgtctggacgccagcaaagcggaattgctctcttatcaggacaacaacaacgttctggatccacaggcacaggcacaggcggcgagcacgttagtcaatacgctgatgggccagaagatccagatggaagcggatctgcgtaacttgctgacgtatctgcgtgaggacgccccgcaagtagtgagtgcgcgtaatgcgattcagtcattgcaggcacaaatcgatgaagaacaaagcaaaatcactgcgccacagggtgacaagctaaaccgtatggcagtggattttgaagaaatcaaatcaaaagtagagttcaacaccgagctgtacaaactgaccctgacctccattgaaaagacccgtgtagaagcggctcgtaagctcaaggtgctgtcagtgatcagttcgccacagttgccgcaggaatcgtcttttccaaatatcccttatttgatcgcctgctggttactggtgtgctgcctgctgttcggcaccctgaaactgttgctggctgttattgaagatcaccgagactaa

SEQ ID NO: 7002 - protein, 382 aa, Escherichia coli
MLIKVKSAVSWMRARLSAISLADIQKHLAKIIILAPMAVLLIYLAIFSQPRYMSESKVAIKRSDDLNSGSLNFGLLLGASNPSSAEDALYLKEYINSPDMLAALDKQLNFREAFSHSGLDFLNHLSKDETAEGFLKYYKDRINVSYDDKTGLLNIQTQGFSPEFALKFNQTVLKESERFINEMSHRIARDQLAFAETEMEKARQRLDASKAELLSYQDNNNVLDPQAQAQAASTLVNTLMGQKIQMEADLRNLLTYLREDAPQVVSARNAIQSLQAQIDEEQSKITAPQGDKLNRMAVDFEEIKSKVEFNTELYKLTLTSIEKTRVEAARKLKVLSVISSPQLPQESSFPNIPYLIACWLLVCCLLFGTLKLLLAVIEDHRD

SEQ ID NO: 7003 - DNA, 1677 bp, Escherichia coli
atgaaattatttaaatcaattttactgattgccgcctgtcacgcggcgcaggccagcgcggccattgatattaacgctgacccaaaccttacaggagccgcgccgcttaccggtattctgaacgggcaacagtcggatacgcaaaacatgagcggcttcgacaatactccgccgccctcaccgccggtggtaatgagccgtatgtttggtgctcaacttttcaacggcaccagcgcggatagcggtgcgacggtaggattcaaccctgactatattctgaatccgggtgatagcattcaggttcgcttgtggggtgcgttcacctttgatggtgcgttacaggttgatcccaaaggtaatattttcctgccgaacgttggtccggtgaaagttgctggcgtcagtaatagtcagctaaatgccctggtcacatccaaagtgaaggaagtataccagtccaacgtcaacgtctacgcctccttattacaggcgcagccagtaaaagtgtacgtgaccggatttgtgcgtaatcctggtctgtatggcggtgtgacgtctgattcgttactcaattatctgatcaaggctggcggcgttgatccagagcgcggaagttacgttgatattgtggtcaagcgcggtaaccgcgtgcgctccaacgtcaacctgtacgacttcctgctgaacggcaaactggggctttcgcagttcgccgatggtgacaccatcatcgtcgggccgcgtcagcatactttcagcgttcagggcgatgtctttaacagctacgactttgagttccgcgaaagcagcattcccgtaacggaagcgttgagctgggcgcgccctaagcctggcgcgactcacattacgattatgcgtaaacaggggctgcaaaaacgcagcgaatactatccgatcagttctgcgccaggccgtatgttgcaaaatggcgataccttaatcgtgagcactgaccgctatgccggcaccattcaggtgcgggttgaaggcgcacactccggtgaacatgccatggtactgccttatggttccactatgcgtgcggttctggaaaaagtccgcccgaacagcatgtcgcagatgaacgcggttcagctttatcgcccatcagtagctcagcgtcagaaagagatgctgaatctctcgctgcaaaaactggaggaagcatcactttctgcccagtcctccaccaaagaagaagccagcctgcgaatgcaggaagcgcaactgatcagccgctttgtggcgaaagcacgcaccgtagttccgaaaggtgaagtgatcctcaacgaatccaatattgattctgttctgcttgaagatggcgacgtcatcaatattccggagaaaacatcgctggttatggttcatggcgaagtgctgttcccgaacgcggtgagctggcagaagggtatgaccaccgaggattacatcgagaaatgtggtggcctgacgcagaaatcgggtaacgccagaattatcgtcattcgtcagaacggtgctgccgtcaacgcagaagatgtggattcactcaaaccgggcgatgagattatggttctgccgaaatatgaatcgaaaaacattgaagttacccgtggtatttccaccatcctctatcagctggcggtgggtgcaaaagtgattctgtctttgtaa

SEQ ID NO: 7004 - protein, 558 aa, Escherichia coli
MKLFKSILLIAACHAAQASAAIDINADPNLTGAAPLTGILNGQQSDTQNMSGFDNTPPPSPPVVMSRMFGAQLFNGTSADSGATVGFNPDYILNPGDSIQVRLWGAFTFDGALQVDPKGNIFLPNVGPVKVAGVSNSQLNALVTSKVKEVYQSNVNVYASLLQAQPVKVYVTGFVRNPGLYGGVTSDSLLNYLIKAGGVDPERGSYVDIVVKRGNRVRSNVNLYDFLLNGKLGLSQFADGDTIIVGPRQHTFSVQGDVFNSYDFEFRESSIPVTEALSWARPKPGATHITIMRKQGLQKRSEYYPISSAPGRMLQNGDTLIVSTDRYAGTIQVRVEGAHSGEHAMVLPYGSTMRAVLEKVRPNSMSQMNAVQLYRPSVAQRQKEMLNLSLQKLEEASLSAQSSTKEEASLRMQEAQLISRFVAKARTVVPKGEVILNESNIDSVLLEDGDVINIPEKTSLVMVHGEVLFPNAVSWQKGMTTEDYIEKCGGLTQKSGNARIIVIRQNGAAVNAEDVDSLKPGDEIMVLPKYESKNIEVTRGISTILYQLAVGAKVILSL

SEQ ID NO: 7005 - DNA, 741 bp, Escherichia coli
atgagcaaagcagttattgtcattccggctcgttatggctcatcgcgcctgccgggtaagccactgctcgatattgttggtaaaccgatgatccagcatgtttacgagcgtgcgttacaggtggcgggcgttgcggaagtttgggtggcaacagacgatcagcgtgttgaaaaggccgtgcaggcatttggcgggaaagccatcatgacgcgcaacgatcatgaatccggcaccgatcggctggtcgaggtgatgcataaagtcgaggcagatatctacattaacctgcagggcgacgaaccaatgattcgcccgcgggatgtagatacgctgttacaaggaatgcgtgatgaccccgcgttgccagtggcaacgctatgccacgcgatttctgccgaagaagcgaccgagccaagcacggtaaaagtggtggtaaatacccaccaggatgcgctttatttcagccgttcgcctattccgtatccgcgaaatgctgaaaaagcgcgctacctgaaacacgtcggtatttacgcttatcgtcgcgatgtgctgcaaaactacagccagttaccagagtccatgccagagcaggcagaatcactggagcagctgcggttgatgagcgcagggatcaacatccgcacatttgaggttgccgcaaccggtccgggcgtcgacaccccagcatgcctggaaaaagtgcgcgccctgatggcacaggaactggctgaaaacgcatga

SEQ ID NO: 7006 - protein, 246 aa, Escherichia coli
MSKAVIVIPARYGSSRLPGKPLLDIVGKPMIQHVYERALQVAGVAEVWVATDDQRVEKAVQAFGGKAIMTRNDHESGTDRLVEVMHKVEADIYINLQGDEPMIRPRDVDTLLQGMRDDPALPVATLCHAISAEEATEPSTVKVVVNTHQDALYFSRSPIPYPRNAEKARYLKHVGIYAYRRDVLQNYSQLPESMPEQAESLEQLRLMSAGINIRTFEVAATGPGVDTPACLEKVRALMAQELAENA

SEQ ID NO: 7007 - DNA, 2028 bp, Escherichia coli
atgattggcatttactcgcctggcatctggcgtattccgcatctggagaaatttctggcgcaaccgtgccagaaactttctctgctgcgccctgttccgcaagaagttaatgctatcgccgtgtggggacatcgtcccagcgcggcgaaaccagtcgccatcgccaaagcagcgggaaaacccgtcattcgtctggaagatggatttgtgcgttcgctggatcttggcgtcaatggcgagccgccgctttctctggtggtggatgattgtggcatttactacgatgccagcaagccttcggcgctggagaaactggtacaggataaagccggaaatacagctctgataagccaggccagagaagcgatgcacaccatcgtgaccggggatatgtcgaaatataatctggcgcctgcgtttgtggctgatgagtcagaacgtacaaacatcgttctggttgtcgatcagacatttaatgatatgtcagtgacgtatggcaatgctggcccgcatgagtttgctgccatgctggaagccgcgatggcggaaaatcctcaagccgaaatttgggtgaaggtgcacccagatgtactggaaggaaagaaaacaggttatttcgccgatctgcgcgccacgcaacgagtacgtttaattgccgagaatgtcagcccgcagtcgctgttgcgacacgtttcccgggtttacgtcgtgacctcccaatacggctttgaagccttgctggcaggaaaaccagtaacatgtttcggccagccctggtatgcaagctggggcttaaccgacgatcgccatccgcagtccgctttgttatctgcccgacgcggttctgccacgctggaggaactttttgccgctgcatacctgcgttactgtcgctatatcgatccgcaaacgggagaagtaagcgatctatttaccgtgctgcaatggctgcaattacaacgtcgacatctgcaacagcgtaatggttatttatgggcgccaggcttaacgctgtggaagtcggcgatcctgaaacccttcttacgaacgccaacaaaccggctgagtttttcacgtcgctgtactgcggcgagcgcctgcgtggtatggggtgtaaagggggaacagcaatggcgagccgaagcgcagcgaaaatcactgccattatggcgaatggaagatggttttctgcgttcatccggacttggctctgacctgctgccgccgctatcgttggtactggataaacgcgggatctactatgacgccacgcgccccagcgacctggaagtgctgcttaatcatagccagctaacgctggcgcagcagatgcgagctgaaaaattacgccagcgactggttgaaagtaaactgagcaagtacaacctgggagccgatttctctctaccagccaaagccaaagataaaaaagttatcctggtgccgggtcaggtagaggacgatgcctctattaaaacaggcacagtctcgattaagagcaaccttgagttattacgcacagtacgcgagcgtaatccgcacgcctacattgtttataaaccgcacccggatgtactggtggggaatcgcaagggcgatattccggcagaactgactgctgaactcgctgattatcaggcactggacgccgatattattcaatgcattcagcgcgcagatgaagtgcataccatgacgtcgctgtcggggtttgaagcgttattacatggcaagcacgtacattgttacggcctgcccttctatgccggttggggtttaaccgtcgatgaacatcgttgcccgcgtcgcgagcgaaaattaacgttagcggatttgatctatcaggcgctgattgtttatccaacctatatccacccaacacggctacaacctattacggttgaagaggcggcggaatatttgatccagacaccgcgcaagccgatgtttattacccgaaaaaaagcggggcgagtaatacgttattaccgcaaattaattatgttctgtaaggtcagatttggctaa

SEQ ID NO: 7008 - protein, 675 aa, Escherichia coli
MIGIYSPGIWRIPHLEKFLAQPCQKLSLLRPVPQEVNAIAVWGHRPSAAKPVAIAKAAGKPVIRLEDGFVRSLDLGVNGEPPLSLVVDDCGIYYDASKPSALEKLVQDKAGNTALISQAREAMHTIVTGDMSKYNLAPAFVADESERTNIVLVVDQTFNDMSVTYGNAGPHEFAAMLEAAMAENPQAEIWVKVHPDVLEGKKTGYFADLRATQRVRLIAENVSPQSLLRHVSRVYVVTSQYGFEALLAGKPVTCFGQPWYASWGLTDDRHPQSALLSARRGSATLEELFAAAYLRYCRYIDPQTGEVSDLFTVLQWLQLQRRHLQQRNGYLWAPGLTLWKSAILKPFLRTPTNRLSFSRRCTAASACVVWGVKGEQQWRAEAQRKSLPLWRMEDGFLRSSGLGSDLLPPLSLVLDKRGIYYDATRPSDLEVLLNHSQLTLAQQMRAEKLRQRLVESKLSKYNLGADFSLPAKAKDKKVILVPGQVEDDASIKTGTVSIKSNLELLRTVRERNPHAYIVYKPHPDVLVGNRKGDIPAELTAELADYQALDADIIQCIQRADEVHTMTSLSGFEALLHGKHVHCYGLPFYAGWGLTVDEHRCPRRERKLTLADLIYQALIVYPTYIHPTRLQPITVEEAAEYLIQTPRKPMFITRKKAGRVIRYYRKLIMFCKVRFG

SEQ ID NO: 7009 - DNA, 1143 bp, Escherichia coli
atgggaccttttttcaatgacgtcgccgaatggttagagtcattaggccgtaacgctgtgaatgttgtattcaacggtggggatcgtttttactgccgtcatcgacaatacctggcttactaccaaacgccgaaagagtttcccggatggttacgggatctccatcggcaatatgactttgataccatcctctgctttggtgactgccgcccattgcacaaagaagcaaaacgctgggcaaagtcgaaagggatccgctttctggcatttgaggaaggatatttacgcccgcaatttattaccgttgaagaagacggagtgaacgcatattcatcgctaccgcgcgatccggatttttatcgtaagttaccagatatgcctacgccgcacgttgagaacttaaaaccttcaacgatgaaacgtataggtcatgcgatgtggtattacctgatgggctggcattaccgccatgagttccctcgctaccgccaccataaatcgttttccccctggtatgaagcacgttgctgggttcgtgcatactggcgcaagcaactttacaaggtaacacagcgtaaggtattaccgaggttaatgaacgagttggaccagcgttattatcttgccgttttgcaggtatataacgatagccagattcgtaaccacagcaattataacgatgtgcgtgactatattaatgaagtcatgtactcattttcacgtaaagcgccgaaagaaagttatttggtgatcaaacatcatccgatggatcgtggtcacagactctatcgaccattaattaagcggttaagtaaggaatatggcttaagtgagcgcgtcatttatgtgcacgatctcccgatgccggaactattacgccacgcaaaagcggtggtgacgattaacagtacggcggggatctctgcactgattcataacaaaccactcaaagtgatgggcaatgccctgtacgacatcaagggcttgacgtatcaagggcatttgcaccagttctggcaggccgattttaaaccggatatgaaactgtttaagaagtttcgggggtatttattgatgaagacgcaggttaattgggtttattatggggggaacacaacaaactgccaacataatatatattaa

SEQ ID NO: 7010 - protein, 380 aa, Escherichia coli
MGPFFNDVAEWLESLGRNAVNVVFNGGDRFYCRHRQYLAYYQTPKEFPGWLRDLHRQYDFDTILCFGDCRPLHKEAKRWAKSKGIRFLAFEEGYLRPQFITVEEDGVNAYSSLPRDPDFYRKLPDMPTPHVENLKPSTMKRIGHAMWYYLMGWHYRHEFPRYRHHKSFSPWYEARCWVRAYWRKQLYKVTQRKVLPRLMNELDQRYYLAVLQVYNDSQIRNHSNYNDVRDYINEVMYSFSRKAPKESYLVIKHHPMDRGHRLYRPLIKRLSKEYGLSERVIYVHDLPMPELLRHAKAVVTINSTAGISALIHNKPLKVMGNALYDIKGLTYQGHLHQFWQADFKPDMKLFKKFRGYLLMKTQVNWVYYGGNTTNCQHNIY

SEQ ID NO: 7011 - DNA, 1230 bp, Escherichia coli
atgatatttgatgctagtttaaagaagttgaggaaattatttgtaaatccaattgggtttttccgtgactcatggttttttaattctaaaaacaaggctgaagagctactatcaccgttaaaaataaaaagtaaaaatatttttataattagtaacctggggcaattaaaaaaagctgagtcatttgtacaaaaatttagcaagagaagtaactatcttattgttttggcaactgaaaaaaatactgagatgccaaaaattattgttgaacaaataaataataaattattttcttcatacaaggtactattcattccaactttcccaaatgttttttcacttaaaaaggttatatggttttataacgtatataattatttagttttaaattcaaaagctaaagatgcttattttatgagctatgcgcaacattatgcaatcttcgtatatttgttcaaaaaaaataatataagatgttcattaattgaagaggggacagggacttataaaaccgaaaaagaaaacccagtagtaaatattaatttttattcagagattattaattcaattatcttgttccattatccagatttgaaatttgaaaatgtatacggtacatatccaattttgcttaagaaaaaatttaatgcgcaaaaatttgttgagtttaaaggtgctccatcagttaaatcatcaaccagaatagataatgttatccataaatattctataactagagatgatataatatatgcaaatcaaaagtatttgattgaacatacattatttgcggattcgttaatttctatcttacttagaatagataagcctgataatgcaagaatatttataaaacctcaccctaaagagcctaaaaaaaatattaatgcaattcaaaaggcaataaaaaaggcaaaatgtcgtgacataattcttataacagagccagactttttaatagagccggtaataaaaaaagcaaaaataaaacacttaattggattaacatcatcttctttggtatatgcacctttagtttctaaaagatgtcagtcttattcaatagcgcctcttatgataaagttgtgtgataatgataaatcccaaaaagggattaatacgctgcgtctccatttcgatattttaaagaattttgataatgttaaaatattatcggatgatataacatctccctctttgcacgataaaaggattttcttgggggagtaa

SEQ ID NO: 7012 - protein, 409 aa, Escherichia coli
MIFDASLKKLRKLFVNPIGFFRDSWFFNSKNKAEELLSPLKIKSKNIFIISNLGQLKKAESFVQKFSKRSNYLIVLATEKNTEMPKIIVEQINNKLFSSYKVLFIPTFPNVFSLKKVIWFYNVYNYLVLNSKAKDAYFMSYAQHYAIFVYLFKKNNIRCSLIEEGTGTYKTEKENPVVNINFYSEIINSIILFHYPDLKFENVYGTYPILLKKKFNAQKFVEFKGAPSVKSSTRIDNVIHKYSITRDDIIYANQKYLIEHTLFADSLISILLRIDKPDNARIFIKPHPKEPKKNINAIQKAIKKAKCRDIILITEPDFLIEPVIKKAKIKHLIGLTSSSLVYAPLVSKRCQSYSIAPLMIKLCDNDKSQKGINTLRLHFDILKNFDNVKILSDDITSPSLHDKRIFLGE

SEQ ID NO: 7013 - DNA, 1236 bp, Escherichia coli
atgctgttagaattattaaggattttattaaatcaaaaaataaagattacaaagatttttatgacatcccggaatgtaccaccagttatgactagaaaaaaagtgctttgttttgtctttcgttatgattctcattttttagctttgaaaaatatttttgagcagatagatgttgattcatatgatttatttttttgctgcttggataattctctacaagagtttgtaaaaaaaaatttagatgaaaagatagttgtattctatcctgatgactttgtttgttttttcacttttattaatattgagtttattttttgttcaacaggagggaaggaccttcatgaaattgttaatactgtaagaacaaaagataccataattatatcttgttttcctggcattgtccttacttctcagatagaagcttttatttcaaaatctaatagtcactatttacttattaactccccaaaagatattaaaacgtataaaaaaatttgtaaaataataggggttccttttaatggaattctttttggtccaccatggattaaaaatgtcaatatcaatgcaaaaagtgagaattcttgtcttatcgttgatcaagttaatgaacccttgacgccaataaagaggatagaatatgcacgttttttgattagagtaattcagaaacatccacatatgaattttatttttaaaactcgaaatcctcttatatcaccagactcaattgtttttgatattaaggaatacattgaacgcttcgatttgaaaaatataacatttagcgatgataatattgattctttaatttctaaagttgaatattgtattacaatatcttcttcggtcgcaatatattgtctggctaataaaattaaggtttatttaataaatggatttaatcatacttgcaatggacaatgttatttttcaagatctggacttattgttgactataataagtttaattttaaacacattccacgtattaaaaaaaaatggatggaggagaacttttattactctagggatattcaacataagattttgaatgatattttaaaaatgccgtcaaatgttaatgttaggacttttggaattaaaagatctacattgattatattgtttttgatcttttttaatttctttttctcattaggaccaaaaaaaataaaaacattgaaaaaaatccataaagttttattaaggtataagaaagatgatatttga

SEQ ID NO: 7014 - protein, 411 aa, Escherichia coli
MLLELLRILLNQKIKITKIFMTSRNVPPVMTRKKVLCFVFRYDSHFLALKNIFEQIDVDSYDLFFCCLDNSLQEFVKKNLDEKIVVFYPDDFVCFFTFINIEFIFCSTGGKDLHEIVNTVRTKDTIIISCFPGIVLTSQIEAFISKSNSHYLLINSPKDIKTYKKICKIIGVPFNGILFGPPWIKNVNINAKSENSCLIVDQVNEPLTPIKRIEYARFLIRVIQKHPHMNFIFKTRNPLISPDSIVFDIKEYIERFDLKNITFSDDNIDSLISKVEYCITISSSVAIYCLANKIKVYLINGFNHTCNGQCYFSRSGLIVDYNKFNFKHIPRIKKKWMEENFYYSRDIQHKILNDILKMPSNVNVRTFGIKRSTLIILFLIFFNFFFSLGPKKIKTLKKIHKVLLRYKKDDI

SEQ ID NO: 7015 - DNA, 1176 bp, Escherichia coli
atgaaaaaaatattatacgtaactggatctagagctgaatatggaatagttcggagacttttgacaatgctaagagaaactccagaaatacagcttgatttggcagttacaggaatgcattgtgataatgcgtatggaaatacaatacatattatagaacaagataattttaatattatcaaggttgtggatataaatatcaatacaacttcacatactcacattctccattcaatgagtgtttgcctcaattcgtttggtgattttttttcaaataacacatatgatgcggttatggttttaggcgatagatatgaaatattttcagtcgctatcgcagcatcaatgcataatattccattaattcatattcatggtggtgaaaagacattagctaattatgatgagtttattaggcattcaattactaaaatgagtaaactccatcttacttctacagaagagtataaaaaacgagtaattcaactaggtgaaaagcctggtagtgtgtttaatattggttctcttggtgcagaaaatgctctttcattgcatttaccaaataagcaggagttggaactaaaatatggttcactgttaaaacggtactttgttgtagtattccatcctgaaacactttccacgcagtcggttaatgatcaaatagatgagttattgtcagcgatttctttttttaaaaatactcacgactttatttttattggcagtaacgctgacactggttctgatataattcagagaaaagtaaaatatttttgcaaagagtataagttcagatatttgatttctattcgttcagaagattatttggcaatgattaaatactcttgtgggctaattgggaactcctcctctggtttaattgaggttccatctttaaaagttgcaacaattaacattggtgataggcagaaaggccgtgttcgtggagccagtgtaatagatgtacccgttgaaaaaaatgcaatcgtcagagggataaatatatctcaagatgaaaaatttattagtgttgtacagtcatctagtaatccttattttaaagaaaatgctttaattaatgctgttagaattattaaggattttattaaatcaaaaaataaagattacaaagatttttatgacatcccggaatgtaccaccagttatgactag

SEQ ID NO: 7016 - protein, 391 aa, Escherichia coli
MKKILYVTGSRAEYGIVRRLLTMLRETPEIQLDLAVTGMHCDNAYGNTIHIIEQDNFNIIKVVDININTTSHTHILHSMSVCLNSFGDFFSNNTYDAVMVLGDRYEIFSVAIAASMHNIPLIHIHGGEKTLANYDEFIRHSITKMSKLHLTSTEEYKKRVIQLGEKPGSVFNIGSLGAENALSLHLPNKQELELKYGSLLKRYFVVVFHPETLSTQSVNDQIDELLSAISFFKNTHDFIFIGSNADTGSDIIQRKVKYFCKEYKFRYLISIRSEDYLAMIKYSCGLIGNSSSGLIEVPSLKVATINIGDRQKGRVRGASVIDVPVEKNAIVRGINISQDEKFISVVQSSSNPYFKENALINAVRIIKDFIKSKNKDYKDFYDIPECTTSYD

SEQ ID NO: 7017 - DNA, 1257 bp, Escherichia coli
atgagaacaaaaattattgcgataattccagcccgtagtggatctaaagggttgagaaataaaaatgctttgatgctgatagataaacctcttcttgcttatacaattgaagctgccttgcagtcagaaatgtttgagaaagtaattgtgacaactgactccgaacagtatggagcaatagcagagtcatatggtgctgattttttgctgagaccggaagaactagcaactgataaagcatcatcatttgaatttataaaacatgcgttaagtatatatactgattatgagagctttgctttattacaaccaacttcaccctttagagattcgacccatattattgaggctgtaaagttatatcaaactttagaaaaataccaatgtgttgtttctgttactagaagcaataagccatcacaaataattagaccattagatgattactcgacactgtctttttttgaccttgattatagtaaatataatcgaaactcaatagtagaatatcatccgaatggagctatatttatagctaataagcagcattatcttcatacaaagcatttttttggtcgctattcactagcttatattatggataaggaaagctctttagatatagatgatagaatggatttcgaacttgcaattaccattcagcaaaaaaaaaatagacaaaaaatactttatcaaaacatacataatagaatcaatgagaaacgaaatgaatttgatagtgtaagtgatataactttaattggacactcgctgtttgattattgggacgtaaaaaaaataaatgatatagaagttaataacttaggtatcgctggtataaactcgaaggagtactatgaatatattattgagaaagagctgattgttaatttcggagagtttgttttcatcttttttggaactaatgatatagttgttagtgattggaaaaaagaagacacattgtggtatttgaagaaaacatgccagtatataaagaagaaaaatgctgcatcaaaaatttatttattgtcggttcctcctgtttttgggcgtattgatcgagataatagaataattaatgatttaaattcttatcttcgagagaatgtagattttgcgaagtttattagcttggatcacgttttaaaagactcttatggcaatctaaataaaatgtatacttatgatggcttacattttaatagtaatgggtatacagtattagaaaacgaaatagcggagattgttaaatga

SEQ ID NO: 7018 - protein, 418 aa, Escherichia coli
MRTKIIAIIPARSGSKGLRNKNALMLIDKPLLAYTIEAALQSEMFEKVIVTTDSEQYGAIAESYGADFLLRPEELATDKASSFEFIKHALSIYTDYESFALLQPTSPFRDSTHIIEAVKLYQTLEKYQCVVSVTRSNKPSQIIRPLDDYSTLSFFDLDYSKYNRNSIVEYHPNGAIFIANKQHYLHTKHFFGRYSLAYIMDKESSLDIDDRMDFELAITIQQKKNRQKILYQNIHNRINEKRNEFDSVSDITLIGHSLFDYWDVKKINDIEVNNLGIAGINSKEYYEYIIEKELIVNFGEFVFIFFGTNDIVVSDWKKEDTLWYLKKTCQYIKKKNAASKIYLLSVPPVFGRIDRDNRIINDLNSYLRENVDFAKFISLDHVLKDSYGNLNKMYTYDGLHFNSNGYTVLENEIAEIVK

SEQ ID NO: 7019 - DNA, 1041 bp, Escherichia coli
atgagtaatatatatatcgttgctgaaattggttgcaaccataatggtagtgttgatattgcaagagaaatgatattaaaagccaaagaggccggtgttaatgcagtaaaattccaaacatttaaagctgataaattaatttcagctattgcacctaaggcagagtatcaaataaaaaacacaggagaattagaatctcagttagaaatgacaaaaaagcttgaaatgaagtatgacgattatctccatctaatggaatatgcagtcagtttaaatttagatgttttttctaccccttttgacgaagactctattgattttttagcatctttgaaacaaaaaatatggaaaatcccttcaggtgagttattgaatttaccgtatcttgaaaaaatagccaagcttccgatccctgataagaaaataatcatatcaacaggaatggctactattgatgagataaaacagtctgtttctatttttataaataataaagttccggttggtaatattacaatattacattgcaatactgaatatccaacgccctttgaggatgtaaaccttaatgctattaatgatttgaaaaaacacttccctaagaataacataggcttctctgatcattctagcgggttttatgcagctattgcggcggtgccttatggaataacttttattgaaaaacatttcactttagataaatctatgtctggcccagatcatttggcctcaatagaacctgatgaactgaaacatctttgtattggggtcaggtgtgttgaaaaatctttaggttcaaatagtaaagtggttacagcttcagaaaggaagaataaaatcgtagcaagaaagtctattatagctaaaacagagataaaaaaaggtgaggttttttcagaaaaaaatataacaacaaaaagacctggtaatggtatcagtccgatggagtggtataatttattgggtaaaattgcagagcaagactttattccagatgaattaataattcatagcgaattcaaaaatcagggggaataa

SEQ ID NO: 7020 - protein, 346 aa, Escherichia coli
MSNIYIVAEIGCNHNGSVDIAREMILKAKEAGVNAVKFQTFKADKLISAIAPKAEYQIKNTGELESQLEMTKKLEMKYDDYLHLMEYAVSLNLDVFSTPFDEDSIDFLASLKQKIWKIPSGELLNLPYLEKIAKLPIPDKKIIISTGMATIDEIKQSVSIFINNKVPVGNITILHCNTEYPTPFEDVNLNAINDLKKHFPKNNIGFSDHSSGFYAAIAAVPYGITFIEKHFTLDKSMSGPDHLASIEPDELKHLCIGVRCVEKSLGSNSKVVTASERKNKIVARKSIIAKTEIKKGEVFSEKNITTKRPGNGISPMEWYNLLGKIAEQDFIPDELIIHSEFKNQGE

SEQ ID NO: 7021 - DNA, 570 bp, Escherichia coli
ggctataacattgccctgattggtcaaaatggagccggtaaatcaactttacttcggataattggtggtatagatcgtcctgatagtgggaacattattacagaacataaaatttcatggcccgttggattggctggtggatttcaaggaagtttaaccggtcgtgaaaatgttaaatttgttgcccgactatatgcaaaacgcgatgagttaaatgagagggttgattttgttgaagagttttccgaactcggaaaatatttcgatatgcccattaaaacttattcttctggcatgaggtcaaggttagcttttggattaagtatggcttttaaattcgactattatcttattgatgaaatcactgctgttggagacgcaaagtttaaaaagaaatgttcagatatattcgataaaataagagaaaaatctcatttaataatggtgtcacatagtgaacgagctttaaaggagtattgtgatgttgctatttatcttaacaaagaggggcaaggtaaattttataaaaatgttacggaagccattgctgattacaaaaaagacctatag

SEQ ID NO: 7022 - protein, 189 aa, Escherichia coli
GYNIALIGQNGAGKSTLLRIIGGIDRPDSGNIITEHKISWPVGLAGGFQGSLTGRENVKFVARLYAKRDELNERVDFVEEFSELGKYFDMPIKTYSSGMRSRLAFGLSMAFKFDYYLIDEITAVGDAKFKKKCSDIFDKIREKSHLIMVSHSERALKEYCDVAIYLNKEGQGKFYKNVTEAIADYKKDL

SEQ ID NO: 7023 - DNA, 837 bp, Escherichia coli
ttggtagctgttaagccaagggcggtagcgtacctgaagagattaggatcacatcatcaaatggcaagaagtggatttgaagttcagaaagtcaccgtagaggcattatttctacgagaaatacgaacacgctttggtaagtttcgtctggggtatttgtgggcgattcttgaaccctccgcgcatttgctgatactgttgggaattttgggttacgttatgcaccgcactatgccagacatctcgttcccggtgtttttacttaatggcctgattcccttttttatctttagtagtattagcaaacgttctattggtgctattgaagcgaaccagggactgtttaattatcgaccagtaaaacccatcgatacgatcattgcacgtgcactgcttgagacactgatttacgttgctgtttatattttgctcatgcttatcgtctggatgacaggcgaatatttcgaaattacaaactttttacaacttgtgctcacctggagtttgttaatcattctttcatgtggcgtcggcttaatatttatggtcgttggtaaaacctttcctgaaatgcaaaaggtcctgccgatactgcttaagccgctgtatttcatctcctgcatcatgttccctctacactcgattccaaaacaatactggtcatatctactctggaacccattagtgcatgttgtggagttaagccgcgaggcagttatgcctggctatatcagtgaaggcgtgagtctgaactaccttgcaatgtttactctggtcaccctgttcatcggcctggcattataccgaacgcgtgaagaggcaatgctgacatcatga

SEQ ID NO: 7024 - protein, 278 aa, Escherichia coli
MVAVKPRAVAYLKRLGSHHQMARSGFEVQKVTVEALFLREIRTRFGKFRLGYLWAILEPSAHLLILLGILGYVMHRTMPDISFPVFLLNGLIPFFIFSSISKRSIGAIEANQGLFNYRPVKPIDTIIARALLETLIYVAVYILLMLIVWMTGEYFEITNFLQLVLTWSLLIILSCGVGLIFMVVGKTFPEMQKVLPILLKPLYFISCIMFPLHSIPKQYWSYLLWNPLVHVVELSREAVMPGYISEGVSLNYLAMFTLVTLFIGLALYRTREEAMLTS

SEQ ID NO: 7025 - DNA, 537 bp, Escherichia coli
atgttacgcgataaatttattcactattttcagcaatggcgtgaacgccagttaagccgtggcgaacactggctgacacaacacttggcggggcgttctccgcgcgaaaagggcatgttactggcagcggtggtgttcctgtttagcgtcggatattacgtcctcatctggcagccgttgagcgaacggatagaacaacaggagacgatgttgcaacagctggtggcaatgaacacccgactgaagaacgccgcgccggatattattgcagcgcgaaaatctgccacaacaacgcctgcgcaggtatcgcgggtcatcagtgacagtgcttccgcgcactcggtggccatcaagcggatagccgagcgtggggagaatattcaggtctggatagaacctgtggtgtttaatgaccttctgaaatggttaaacgcactggatgaaaaatatgcgctgcgggtgacacaaattgatgtcagtgctgctgagaagcctgggatggtgaatgtgcagcggctggagtttggacgggggtag

SEQ ID NO: 7026 - protein, 178 aa, Escherichia coli
MLRDKFIHYFQQWRERQLSRGEHWLTQHLAGRSPREKGMLLAAVVFLFSVGYYVLIWQPLSERIEQQETMLQQLVAMNTRLKNAAPDIIAARKSATTTPAQVSRVISDSASAHSVAIKRIAERGENIQVWIEPVVFNDLLKWLNALDEKYALRVTQIDVSAAEKPGMVNVQRLEFGRG

SEQ ID NO: 7027 - DNA, 1170 bp, Escherichia coli
atgcttgagatttttttcccgctttgcgccgctgatcccatccgttggcagcgccatacacccgacgtggagcacggtatctggcctgacgttgctgacgaacgtctccagcaatggctgcaaactgatgcgattcgactctacattcccggcgaatggatcagcgtctggcaggttgaactgcctgatgtgccccgcaagcagataccgacgattctgcccgccttgctggaagaagagctgaaccaggatatcgatgaactgcatttcgccccgttgaaaatcgaccagcaactggcaaccgtagctgtgattcaccagcagcatatgcgcaacattgcgcagtggttgcaggcaaacggcatcacccgcgctaccgtcgcgccggactggatgtccattccttgtgggtttatggctggcgatgcgcaacgggttatctgccgcatcgatgaatgccggggatggagcgccgggcgggcgctggctccggtcatgttccgcgcacagctcaatgagcagaatttaccgatttcactaactgtggtcggcattgcaccggaagaactgtctgcatgggctggtgcggacgccgaacgcctgaccgttacggctctgcccgccattaccacttatggcgaatcggaagggaacctgctaacagggccgtggcagcctcgtgtcagctaccgaaaacagtgggcgcgctggcgggtgatgattctgccgatattgctgattctggttgcgctggtagtggaacggggcgtgacgttatggagcgtcagcgaacaggtggcgcaaagccgcacccaggcggaaaaaaagttcttaacactgttcccggagcagaagcggattgtgaatttgcgttcccaggtgacgatggcgctgaaaaaatatcgcccgcaggccgatgatacccggctgctcgccgagttgtcagcgatagccagcaccctgaaatcagcatcactttccgacatcgaaatgcgtggtttcacctttgatcaaaaacgccagacgctccaccttcagttgcgggccgcgaactttgccagtttcgacaaactgcgtagcgcactggcggcagattatgttgtgcaacaggacgcgttacagaaagagggtgatgcggtttccggcggcgtaacgttgcggaggaaataa

SEQ ID NO: 7028 - protein, 389 aa, Escherichia coli
MLEIFFPLCAADPIRWQRHTPDVEHGIWPDVADERLQQWLQTDAIRLYIPGEWISVWQVELPDVPRKQIPTILPALLEEELNQDIDELHFAPLKIDQQLATVAVIHQQHMRNIAQWLQANGITRATVAPDWMSIPCGFMAGDAQRVICRIDECRGWSAGRALAPVMFRAQLNEQNLPISLTVVGIAPEELSAWAGADAERLTVTALPAITTYGESEGNLLTGPWQPRVSYRKQWARWRVMILPILLILVALVVERGVTLWSVSEQVAQSRTQAEKKFLTLFPEQKRIVNLRSQVTMALKKYRPQADDTRLLAELSAIASTLKSASLSDIEMRGFTFDQKRQTLHLQLRAANFASFDKLRSALAADYVVQQDALQKEGDAVSGGVTLRRK

SEQ ID NO: 7029 - DNA, 978 bp, Escherichia coli
atgatcacctcaccaccaaaacgcggaatggcactggtcgtggtgctggtattgctggcggttatgatgctggtgaccatcacgctttccgggcggatgcagcaacaacttgggcgaacgcgcagccagcaggagtaccagcaggcgctgtggtacagcgccagtgcagaaagcctggcgctgagcgcgctcagtctgagcctgaaaaatgaaaagcgtgtgcatctggcacaaccgtgggcttctggcccgcgttttttcccactgccgcaggggcaaattgccgtcactctgcgtgacgcacaggcctgctttaacctgaatgccctcgctcagccgacgacggcgtcgcgtccgctcgcggtacaacaactgattgccctgatctcgcgcctcgatgtgcctgcttatcgggccgaactgatagccgaaagcctgtgggagtttattgacgaagaccgcagcgtgcagacgcgtctgggtcgtgaagacagcgagtatctcgcccgctcggtgccgttctacgccgctaatcaaccgctggctgatatcagcgagatgcgcgtggtgcagggaatggacgccgggctttatcaaaaactgaaaccgttggtctgtgcgctgccgatggcccgccagcaaatcaacatcaatacattagatgtcacgcaaagtgtgattcttgaggcgctgtttgacccgtggttaagccctgttcaggcgcgggcattattacaacaacgtccggcgaagggctgggaagatgtcgatcagtttcttgctcagccgctacttgcagacgtcgatgagcgtactaaaaaacagctaaaaaccatcctgagcgtggacagcaattacttctggctgcgttcagatatcaccgtgaatgagattgaactgacgatgaattcgttaattgtccgcatgggcccacaacacttttctgttctctggcatcagacaggagaaagtgagtga

SEQ ID NO: 7030 - protein, 325 aa, Escherichia coli
MITSPPKRGMALVVVLVLLAVMMLVTITLSGRMQQQLGRTRSQQEYQQALWYSASAESLALSALSLSLKNEKRVHLAQPWASGPRFFPLPQGQIAVTLRDAQACFNLNALAQPTTASRPLAVQQLIALISRLDVPAYRAELIAESLWEFIDEDRSVQTRLGREDSEYLARSVPFYAANQPLADISEMRVVQGMDAGLYQKLKPLVCALPMARQQININTLDVTQSVILEALFDPWLSPVQARALLQQRPAKGWEDVDQFLAQPLLADVDERTKKQLKTILSVDSNYFWLRSDITVNEIELTMNSLIVRMGPQHFSVLWHQTGESE

SEQ ID NO: 7031 - DNA, 570 bp, Escherichia coli
atgctggtggcgatagccatttttgcctcactggcactgatggcgcagcaggtgacaaacggcgttacacgcgtgaatagcgccgtcgccggacacgatcaaaaactaaacctcatgcagcaaacgatgagttttctgacccacgatctgacacaaatgatgccgcgtccggtaagaggcgatcagggccagcgtgaaccagcgttactggcgggcgctggcgttctggtgtctgagagtggaggaatgcgttttgtgcgcggcggtgtggttaacccgttgatgcgtctgccacgcagcaatctgctcaccgtcggttaccgcattcatgacggttatctcgaacggttagcctggccactgaccgatgcggcaggcagcgtgaagccaacaacgcaaaaattaatcccggcggattcgctccgtttgcagttctacgacggcacgcgctggcaggagagctggtcatcagtgcaggcgattcctgtggcagtacgcataaccctgcattcgccacaatggggcgaaattgaacgcatctggttgttacgcgggccgcaattatcatga

SEQ ID NO: 7032 - protein, 189 aa, Escherichia coli
MLVAIAIFASLALMAQQVTNGVTRVNSAVAGHDQKLNLMQQTMSFLTHDLTQMMPRPVRGDQGQREPALLAGAGVLVSESGGMRFVRGGVVNPLMRLPRSNLLTVGYRIHDGYLERLAWPLTDAAGSVKPTTQKLIPADSLRLQFYDGTRWQESWSSVQAIPVAVRITLHSPQWGEIERIWLLRGPQLS

SEQ ID NO: 7033 - DNA, 372 bp, Escherichia coli
atgaagcgcggatttaccttgctggaagtgatgctcgcgctggcgatttttgcgctggctgccatggcggtgttacagattgccagcggtacgctgagtaatcagcaaatccttgaggagaaaacggtagcgggctgggtagctgaaaaccagactgcgctgctttacctgatgacccgtgaacaacgagcggtcaggcaccagggcgagagtgatatggcaggaagccgctggtactggcgaacgatccctctgaataccggtaacgtgctgctccaggcggtggatattgaagtcagtcttcatgacgacttttcgccagtgattcagtcaagacgcgcctggtttagcgccgtgggaggccaacagtga

SEQ ID NO: 7034 - protein, 123 aa, Escherichia coli
MKRGFTLLEVMLALAIFALAAMAVLQIASGTLSNQQILEEKTVAGWVAENQTALLYLMTREQRAVRHQGESDMAGSRWYWRTIPLNTGNVLLQAVDIEVSLHDDFSPVIQSRRAWFSAVGGQQ

SEQ ID NO: 7035 - DNA, 531 bp, Escherichia coli
atgctggtgattttccttatcggccttgccagtgcgggcgtggtacagacgtttgcgaccgcttcagagccgcctgcgaaaaaagcggcgcaggattttctgactcgctttgcgcagtttaaggacagggcagtgatcgaagggcaaacactcggtgtgctaatcgacccgccaggttaccagtttatgcagcgtcgtcacgggcaatggttgcccgtttctgcgacccggttatcggcacaggttacggtgccgaaacaggtgcagatgctgttacaacccggcagtgatatctggcagaaggaatatgcgctggagctgcagcgtcgtcgcctgacgctgcacgatattgaactggagctgcaaaaagaggcgaaaaagaagacgccgcagatccgtttttcgccttttgaacccgccacgccgtttacgctgcgcttctactcggcggcgcaaaacgcatgttgggcggtaaagctggcgcacgatggcgcgttatccctcaatcaatgtgatgagaggatgccatga

SEQ ID NO: 7036 - protein, 176 aa, Escherichia coli
MLVIFLIGLASAGVVQTFATASEPPAKKAAQDFLTRFAQFKDRAVIEGQTLGVLIDPPGYQFMQRRHGQWLPVSATRLSAQVTVPKQVQMLLQPGSDIWQKEYALELQRRRLTLHDIELELQKEAKKKTPQIRFSPFEPATPFTLRFYSAAQNACWAVKLAHDGALSLNQCDERMP

SEQ ID NO: 7037 - DNA, 456 bp, Escherichia coli
atgaattcgttatcccgcacacaaaaaccacgggcaggttttaccctgctggaagtgatggtggtgattgttattcttggcgtcctggcaagtctggtagtgcctaacctgctgggcaacaaagagaaagccgatcggcaaaaagccatcagcgatatcgtggcgctggaaaacgcactggatatgtaccgactggataacgggcgttatccgaccaccgaacagggactggaggcgctgatccagcagccagccaatatggcggacgcccgcaactaccgtaccggtggatacatcaaacgactgccaaaagatccgtggggcaatgattatcagtatctcagcccgggtgaaaaagggctgtttgatgtttataccctgggagcagatggtcaggaaaacggggagggcgctggcgcagatatcggtaactggaatttgcaggagtttcagtaa

SEQ ID NO: 7038 - protein, 151 aa, Escherichia coli
MNSLSRTQKPRAGFTLLEVMVVIVILGVLASLVVPNLLGNKEKADRQKAISDIVALENALDMYRLDNGRYPTTEQGLEALIQQPANMADARNYRTGGYIKRLPKDPWGNDYQYLSPGEKGLFDVYTLGADGQENGEGAGADIGNWNLQEFQ

SEQ ID NO: 7039 - DNA, 1224 bp, Escherichia coli
atggcactgttttactatcaggcgctggagcgtaatggtcgcaaaaccaaaggcatgattgaggcggattccgcgcgtcatgcccgtcaattgttacgcggtaaagacctcattcccgtgcacattgaagcccggatgaatgcatcggcagggggattgttgcagcgtcggcggcacgcacatcgtcgcgtggcgacggcagatctggcgctgttcactcgtcaactggcaacgctggtgcaggcagcaatgccgctggaaacctgcttacaggcggtcagtgagcaaagcgaaaaactgcatgtaaaaagcctcggaatggcgctgcgcagccggattcaggaaggttataccctgtcggacagcctgcgcgaacatccccgcgtctttgactccctgttttgttcgatggtcgctgccggagaaaaatccggacatctcgacgtggtgctcaatcgcctggcggattacaccgaacagcggcagcgtctgaaatcacgcctgctgcaggccatgctctatccgctggttctgctggtggtggcaacgggcgtagtcactattttgctgacggcagtggtgccgaaaattatcgaacagtttgatcatctcggacacgcgctacccgcctccacccgaatgctcatcgctatgagcgacgcgttacaggccagcggcgtgtactggctggcgggtttgctggggcttctggtgctggggcaacggttactcaaaaatcctgcgatgcgcctgcgctgggataaaaccttgctgcgcctgcccgtgacggggcgtgttgcgcgcggactgaatacggcgcgtttttcccgcacgttaagcatcctcaccgccagcagtgttccgctgttggaaggcattcagaccgccgccgccgtgtcggcaaatcgttatgtcgagcaacaactgctgctggcggcagatcgcgtccgcgaaggaagcagcctgcgcgccgcgctggcggatctgcgcctgtttccaccgatgatgctgtacatgatcgcctccggcgaacagagcggcgagctggaaaccatgcttgaacaggccgcggtcaaccaggaacgggaatttgatacacaggtggggctggcgttagggctgtttgagccggcgctggtggtgatgatggcgggtgtggtgctgtttatcgtcatcgccatcctcgaaccgatgctgcaactgaacaatatggttggaatgtaa

SEQ ID NO: 7040 - protein, 407 aa, Escherichia coli
MALFYYQALERNGRKTKGMIEADSARHARQLLRGKDLIPVHIEARMNASAGGLLQRRRHAHRRVATADLALFTRQLATLVQAAMPLETCLQAVSEQSEKLHVKSLGMALRSRIQEGYTLSDSLREHPRVFDSLFCSMVAAGEKSGHLDVVLNRLADYTEQRQRLKSRLLQAMLYPLVLLVVATGVVTILLTAVVPKIIEQFDHLGHALPASTRMLIAMSDALQASGVYWLAGLLGLLVLGQRLLKNPAMRLRWDKTLLRLPVTGRVARGLNTARFSRTLSILTASSVPLLEGIQTAAAVSANRYVEQQLLLAADRVREGSSLRAALADLRLFPPMMLYMIASGEQSGELETMLEQAAVNQEREFDTQVGLALGLFEPALVVMMAGVVLFIVIAILEPMLQLNNMVGM

SEQ ID NO: 7041 - DNA, 1494 bp, Escherichia coli
atggtgcctgtagcacaggaaaccaccgctaacaccgtgcgtctgccctacagtttcagccgtcggtttagcctggtggcatggtgcgaagcgtcgctggagatcctccatgttcatccgttgtcgctctctgttttgcaggagctacaacgggggctgaacgcgccctttacgctgcggcaaatcgacgaggccgaatttgaacagcggctgaatgcggtctggcagcgggactcttccgaagctcgccagctgatggaagatctcggttccgccgaggacttttttaccctcgctgaagaactgccggaaacggaagatctgctggaaagtgacgacgatgcgccgatcatcaaactgatcaacgccatgctggcagaggcaatcaaagaaggcgcttcggatatccacattgagacgtttgaaaagagtctggtgatccgttttcgtgttgacggcacattacatgaaatgttgcgccccggtcgtaaactggcctcgctgctggtctcgcgtatcaaggtgatggcgcgactggatattgccgaaaagcgcgtaccgcaggatggccgtattgcgttgctgctgggcggtcgggcgattgacgtccgtgtatctaccatgccttccgcctggggagaacgggtggtgctgcgactgctggacaaaaaccaggctcgcctgacgctggagcgtctgggtttaagtctcgaactgactgcgcagttgcgccagctgttacacaaaccgcacggcatttttctggtgacggggccgaccggttccggcaaaagcaccacgctgtacgctggattgcaggagctgaacaaccactcgcgtaacattctcacggttgaagaccctatcgaatacatgattgaagggatcggtcagacgcaggttaacacccgcgtcggcatgacattcgcccgtggcctgcgcgcaattttgcgtcaggacccggatgtggtgatggtcggtgaaatccgcgataccgaaaccgcagaaatcgctgttcaggcttcactgaccggacacctggtactttccacgctgcataccaacacagcggtgggggcgatcacacgtttgcaggatatgggcgtggagcctttcctgctctcttccagtctgacgggcgtgatggcgcagcgactggtccgcacgctgtgctccgactgccgtcaggccgcgcctgccaccgacgaagaaaaacgtcttatggggatctccgatacgcatgccgtcacgctgtaccatccgcagggctgccccgcctgtaatcacaaaggttttcgcggacgtactgccatccatgaactgattgtggtggacgccacattgcgtgatttgatccaccgtcaggccggggaactggagctggaacgttatgtccggcaacactctgcgggtatccgcagtaacggcattgagaaagtgctcgccggagaaacctctctcgatgaagttctgcgggtaaccatggaggcgtaa

SEQ ID NO: 7042 - protein, 497 aa, Escherichia coli
MVPVAQETTANTVRLPYSFSRRFSLVAWCEASLEILHVHPLSLSVLQELQRGLNAPFTLRQIDEAEFEQRLNAVWQRDSSEARQLMEDLGSAEDFFTLAEELPETEDLLESDDDAPIIKLINAMLAEAIKEGASDIHIETFEKSLVIRFRVDGTLHEMLRPGRKLASLLVSRIKVMARLDIAEKRVPQDGRIALLLGGRAIDVRVSTMPSAWGERVVLRLLDKNQARLTLERLGLSLELTAQLRQLLHKPHGIFLVTGPTGSGKSTTLYAGLQELNNHSRNILTVEDPIEYMIEGIGQTQVNTRVGMTFARGLRAILRQDPDVVMVGEIRDTETAEIAVQASLTGHLVLSTLHTNTAVGAITRLQDMGVEPFLLSSSLTGVMAQRLVRTLCSDCRQAAPATDEEKRLMGISDTHAVTLYHPQGCPACNHKGFRGRTAIHELIVVDATLRDLIHRQAGELELERYVRQHSAGIRSNGIEKVLAGETSLDEVLRVTMEA

SEQ ID NO: 7043 - DNA, 2046 bp, Escherichia coli
atgacgttgtctatctggcgtaagaagacaactggcctcaaaacaaaaaagcgtttactgccgctgatgctggcagcggcattgtgtagttcaccggtctgggcggaagaagccactttcaccgctaattttaaagataccgacctgaaatcgttcatcgaaaccgtcggcgctaaccttaataaaaccatcattatggggccgggcgttcaggggaaagtgagtattcgcactatgactccgctcaatgaacgccagtattaccagttattccttaacctgctggaagcacaggggtatgcggtcgtaccgatggaaaacgacgtgctgaaggtggtgaaatcaagcgccgcgaaagtcgagccgctgccgctggtcggtgaaggcagtgacaactacgcgggcgatgaaatggtcaccaaagtcgtgccggtacgcaatgtgtcggtacgcgagctggcaccgattctgcgccagatgattgacagcgcaggctcaggcaacgttgttaattacgatccctccaacgtgattatgcttaccggacgcgcctccgttgtggagcgcctgacggaagtgatccagcgcgtggatcacgcgggtaatcgcaccgaagaggtgatcccgctggataacgcctcagcctcggaaattgcccgcgtgctggaaagcctgaccaaaaacagcggcgagaaccagccagcaacgctgaaatctcaaattgtcgccgatgaacgcaccaacagcgtgattgtcagtggtgaccccgccacgcgagacaaaatgcgccgtctgatccgtcggctggattcagaaatggagcgcagcggcaacagccaggtgttctatctcaaatacagcaaagccgaagatctggtcgatgtgctgaagcaggtcagcggtacgctcacggcggctaaagaagaggcggaaggcacagttggtagcgggcgtgaggttgtctccatcgccgccagcaaacacagtaatgccctgattgttactgcgccgcaggacattatgcagtcgctgcaaagcgtgattgaacaactggatattcgccgtgctcaggtgcatgtcgaggcgttaatcgtggaagttgccgaaggcagcaatatcaacttcggcgtgcagtgggggtcaaaagatgccggattaatgcagtttgccaacggtacgcaaatccctattggtacgctgggggcagcgatttctgcagccaagccgcagaaaggttccacggtgatcagcgaaaacggtgctaccaccataaatccggatactaacggcgatctctccacgctcgctcagcttctttctggctttagcggtacggcggttggcgtggtgaaaggcgactggatggcgctggtacaggcggtcaaaaacgactccagctcgaacgtgctctccacgccgagtatcaccacgctggacaaccaggaagccttcttcatggtgggccaggacgttccggtattaaccggctctaccgttggttccaataacagcaatcctttcaatacggtagagaggaaaaaagtcggcatcatgctgaaagtcacgccgcagattaacgaaggtaacgcggtacagatggtgattgagcaggaagtctcgaaagtggaagggcagaccagtctcgatgtcgtgtttggcgagcgcaaactgaaaaccaccgtgctggctaacgatggtgagctgatcgtgcttggcggtctgatggacgaccaggcgggagaaagcgtggcgaaagtgccgctgctgggcgatatcccagtgattggtaacctgtttaaatcgacggcggataaaaaagaaaaacgtaacctgatggtgtttatccgcccgaccattttgcgtgacggtatggcggcagacggcgtgtcgcagcgcaaatataactacatgcgcgctgagcaaatctaccgcgatgagcaaggcttaagcctgatgccgcacaccgcgcagccgatattgccagcgcaaaatcaggccttaccgccggaagtacgcgcgttcctcaatgccgggagaacgcgttaa

SEQ ID NO: 7044 - protein, 681 aa, Escherichia coli
MTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPVIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 7045 - DNA, 960 bp, Escherichia coli
ttggcgcgggttgtttttcgtgacgcacgaatttatctcattcaatggctgactaaaattcgtcacattcttagccagatacaatctcttaatacagacaaagagcatctgcgaaaaatggtgcgcgggatgttctggctcatgctgcttattatttctgcaaaaatggcgtattcactctggcgctatttctccttttctgcggaatatacggcggtttcctcatcggtgaataaaccgctccgtgcggatgcaaaaccgttcgataaaaatgacgtgcaattagtcagccaacaaaactggtttggcaaatatcaacccgtcgccgcaccggtaaaacaacctgaatctgcgcctgtggcagaaacgcgtcttaatgtggtgctgcgtgggatcgcctttggtgccagacccggcgtggtgattgaagaaggcggcaaacagcaggtctatttgcagggtgaacggcttggctctcacaacgcagtgattgaggaaatcaaccgcgaccatgtgatgctgcgctatcaggggaaaatggaacgtctgagtctggcagaggaggaacgcccccctgtggcggtgaccagcaaaaaagccgccagcgacgaagcaaagcaagctgttgctgaacctgtcgtcagtgcgccagtggagatcccggctgccgtgcgtcaggcactggcgaaagatccgcagaaaatttttaactatatccagcttacgcctgtgcgtaaggagggaattgtcggttatgcagtgaagccgggggcagatcgttctctgttcgatgccagcggtttcagggaaggcgatatcgccattgcgctaaatcagcaggatttcactgatccacgagcaatgattgctctgatgcggcagttaccttcaatggattccattcaacttacggttttacgcaagggtgcgcgctacgacatttccatcgcactgcgctaa

SEQ ID NO: 7046 - protein, 319 aa, Escherichia coli
MARVVFRDARIYLIQWLTKIRHILSQIQSLNTDKEHLRKMVRGMFWLMLLIISAKMAYSLWRYFSFSAEYTAVSSSVNKPLRADAKPFDKNDVQLVSQQNWFGKYQPVAAPVKQPESAPVAETRLNVVLRGIAFGARPGVVIEEGGKQQVYLQGERLGSHNAVIEEINRDHVMLRYQGKMERLSLAEEERPPVAVTSKKAASDEAKQAVAEPVVSAPVEIPAAVRQALAKDPQKIFNYIQLTPVRKEGIVGYAVKPGADRSLFDASGFREGDIAIALNQQDFTDPRAMIALMRQLPSMDSIQLTVLRKGARYDISIALR

SEQ ID NO: 7047 - DNA, 369 bp, Escherichia coli
ttgttgagcgttacaggattattaagtggctgcgccagccataatgaaaacgccagtttactggcgaaaaaacaggcgcaaaatatcagccaaaacctgccgattaaatctgcgggatataccttagtgctggcgcaaagtagtggcacgacggtaaaaatgaccattatcagcgaatcgggtactcagaccacgcagacacctgacgcctttttaaccagctatcaacgacaaatgtgcgctgacccaacggtgaaattaatgatcaccgagggaattaattacagcataacgattaatgatacacgtacaggtaaccagtatcagcggaaactggatcgtaccacctgtggaatagtcaaagcataa

SEQ ID NO: 7048 - protein, 122 aa, Escherichia coli
MLSVTGLLSGCASHNENASLLAKKQAQNISQNLPIKSAGYTLVLAQSSGTTVKMTIISESGTQTTQTPDAFLTSYQRQMCADPTVKLMITEGINYSITINDTRTGNQYQRKLDRTTCGIVKA

SEQ ID NO: 7049 - DNA, 906 bp, Escherichia coli
atgcccgatgcgccagcttatcgggcctggaggaaagccatatggcatacacccgcaggcccgcatccggcaagttacaacaaacaacctttaaccatgctttttgatgtttttcagcaataccccgcggcgatgcccatactggcaaccgtcggaggattgatcatcggcagttttttgaatgtggtgatttggcgttaccccatcatgctgcgccaacaaatggcggagtttcatggtgaaacgccgagtacgcagtcaaaaataagccttgcgctaccgcgttcgcactgtccgcattgccagcagactatccgcgttcgtgacaatattccgctgctctcctggctgatgctcaaagggcgctgccgcgactgtcaggcgaaaatcagcaagcgttatccgctggttgagttattgacagcactcgcttttttgctggcgagtctggtgtggccagaaagtggatgggggctggcggtgatgatattatccgcgtggctgattgccgcgagcatcatcgacctcgacaaccaatggctgcccgatgtttttactcagggcgtattgtggacaggactgattgcggcatgggcgcagcagagtccgttaacgctacaagacgcagtcaccggcgttctggtggggtttatcactttttactccctgcgctggatagccggaatagttctgcgtaaagaagcattaggcatgggcgatgtattactcttcgctgcgttaggtggatgggtggggccgttgtcgttacccaatgtggctttaatcgcatcatgctgcggtctgatatatgccgttattacaaaaagaggatcaaccacactgccttttggaccgtgtttaagtctgggcggtatagcaacactttatctacaggcattgttttaa

SEQ ID NO: 7050 - protein, 301 aa, Escherichia coli
MPDAPAYRAWRKAIWHTPAGPHPASYNKQPLTMLFDVFQQYPAAMPILATVGGLIIGSFLNVVIWRYPIMLRQQMAEFHGETPSTQSKISLALPRSHCPHCQQTIRVRDNIPLLSWLMLKGRCRDCQAKISKRYPLVELLTALAFLLASLVWPESGWGLAVMILSAWLIAASIIDLDNQWLPDVFTQGVLWTGLIAAWAQQSPLTLQDAVTGVLVGFITFYSLRWIAGIVLRKEALGMGDVLLFAALGGWVGPLSLPNVALIASCCGLIYAVITKRGSTTLPFGPCLSLGGIATLYLQALF

SEQ ID NO: 7051 - DNA, 4581 bp, Escherichia coli
ttgtcacttgcgttattaatgaataagaaatttaaatataagaaatcgcttttagcggctattttaagcgcaaccctgttagccggttgtgatggtggtggttcaggatcgtcctccgatacgccgtctgtagattctggatcagggactttgccggaagtgaaacccgatccaacaccaaccccggagccgacacctgagccgacgccggacccagaacctacgccggatccaacacctgatcctgagccgacaccagaaccggagccagaacctgttcctacgaaaacgggttatctgaccctgggcggaagccagcgggtaactggtgctacctgtaatggtgaatccagcgatggctttacctttacgccaggcaataccgtgagttgtgtggtgggcagtacgaccattgcaacattcaacacccagtcagaagctgcgcgtagcctgcgtgcggttgacaaagtgtcgtttagcctggaggacgcgcaggagctggcgaattctgaaaataagaaaaccaacgccatctctctggtgacgtccagcgacagttgccccgcagatgcagaacagctttgtcttactttctcgtcagtggttgatcgcgcgcgatttgaaaaactgtataagcaaattgatctggcaacagacaatttcagcaagctggtcaatgaagaggtggaaaacaatgctgcgactgataaagcgccgtccacccatacctcaacggtagtgccagtcacgacagagggaacaaaaccggatctgaacgcgtccttcgtgtcggctaacgcggaacagttttatcagtatcaacccactgaaatcattctttccgaaggccaactggtggatagcctggggaacggtgttgctggcgttgactactacaccaattcaggccgtggcgtaactgacgaaaacggtaaattttcctttagctggggcgaaaccatctcctttggtatcgatacctttgaactgggctcagtacgtggcaataagtcgaccattgcgctgactgaattgggtgatgaagttcgcggggcaaatatcgatcagctcattcatcgttattcgacgactggtcaaaataatactcgtgttgttccggacgatgtacgcaaggtctttgccgaatatcccaacgtgatcaacgagataatcaatctttcgttatccaacggtgcgacgctggatgaaggcgatcaaaacgttgtgctgcctaacgaatttatcgagcagtttaagacgggtcaggccaaagagatcgataccgcgatttgtgcgaaaaccgacggttgtaacgaggctcgctggttctcgctgacaacgcgcaatgttaatgacggccagattcagggcgttattaacaagctgtggggcgtggatacgaactatcagtctgtcagcaagttccacgtcttccatgactctaccaacttctatggcagcaccggtaacgcgcgcggtcaggcggtggtaaatatctccaactcggcattcccgattctgatggcgcgtaatgataaaaactactggctggcgtttggcgaaaaacgcgcctgggataaaaatgagctggcgtacattacggaagcgccttccattgtgcagccagagaacgttacgcgcgatactgcgactttcaacctgccgtttatttcgctggggcaagtcggtgaaggcaaactgatggttatcggtaacccgcactacaacagcatcctgcgttgcccgaacggttacagttggggcggtggtgttaatagtaaaggtgagtgtacgctcagcggtgattctgatgacatgaagcactttatgcagaacgtactgcgctacttgtcaaatgacatctggcagccaaataccaagagcatcatgactgtcggcaccaacctggagaacgtttatttcaaaaaagcgggccaggtattgggaaatagtgcaccatttgctttccatgaggatttcactggtatcacggttaaacagttgaccagctatggcgatctgaatccggaagagattccgttgctgatcctcaacggctttgaatatgtgactcagtggtctggcgatccctatgctgtgcctctgcgtgcagataccagcaaaccgaagctgactcagcaggatgtgaccgatctgatcgcttatctgaacaaaggtggctcggtgctgatcatggaaaacgtgatgagcaatcttaaggaagagagcgcgtccagttttgtgcgtctgctggatgccgcgggtctgtcaatggctctgaacaaatcggtggtgaacaacgatccgcaagggtatccggatcgcgttcgtcagcgtcgcgcgactggcatttgggtttatgaacgttatcctgctgcagacggcgcgcaaccgccgtacaccatcgacccaaatacaggggaagtgacctggaaataccagcaagacaacaagcctgatgacaagccgaaactggaagttgcgagctggcaggaggaagttgagggcaaacaggtaacgcgttatgcctttattgatgaagcggaatacacaacagaagaatctctggaagcggcaaaggcaaaaatctttgagaagtttcctgggttacaggagtgtaaggactcgacttaccattacgagattaactgtttggagcgccgcccaggcacggatgttccggtaacaggtggcatgtatgttccgcgctatacgcaactgaatcttgacgccgacaccgcgaaagcgatggtgcaggcggcggatttaggcaccaacattcagcgcctgtatcagcatgagctttatttccgtaccaaaggcagtaaaggtgagcgtctgaacagtgttgatctggaacgtctgtaccagaacatgtcggtctggctgtggaacgatacgaaatatcgttacgaagagggcaaggaagatgagctgggctttaaaacgttcaccgagttcctgaactgctacgccaatgatgcctatgcaggcggcaccaagtgctccgcagatctgaaaaaatcgctggtcgataacaacatgatctacggtgacggtagcagcaaagcgggcatgatgaacccaagctatccgctcaactatatggaaaaaccgctgacgcgtctgatgctgggccgttcctggtgggatctgaacattaaggttgatgtggagaagtacccaggatccgtatcggcaaagggtgagagcgttacggaaaacatcagcctgtactcgaatccgaccaaatggtttgcgggtaacatgcagtcaaccggcctgtgggcaccggcccagcaggacgtcaccattaagtcttcggcgtcagtcccagtgactgttaccgtggcgctggctgacgacctgactggacgtgagaagcatgaagttgcgctgaaccgtccgccaagagtgactaaaacgtatactctggaggctaacggtgaagtgaccttcaaggtgccttatggtggtctgatttatatcaagggcgacagtaaggatgatgtttctgctaacttcacctttaccggtgtagtaaaagcgccgttctataaagacggcgaatggaaaaacgatctggactcaccggcgccgctgggcgagctggagtctgcgtcgttcgtctataccacgccgaagaagaaccttgaggccagcaatttcactggtggtgtagcagaattcgctaaagatctggatacctttgccagctcgatgaatgacttctacggtcgtaatgatgaagacggtaagcaccggatgtttacctataaaaacttgacggggcacaagcatcgtttcaccaacgatgtgcagatctccatcggtgatgcgcactcgggttatccggtaatgaacagcagcttctcgacgaacagcaccacgctgccgacgacgccgctgaacgactggctgatttggcacgaagtcggtcataacgctgcagaaacaccgctgaacgtaccgggtgcaactgaagtggcgaacaacgtgctggcgctgtacatgcaggatcgctatctcggtaagatgaaccgtgtcgctgacgacattaccgtcgcgccggaatatctggacgagagcaacggtcaggcctgggcgcgcggcggtgcgggtgaccgtctgctgatgtacgcacagttgaaggagtgggcagaggaaaactttgatatcaaacagtggtatccagatggtgagctgcctaagttctacagcgatcgtaaagggatgaagggctggaacctgttccagttgatgcaccgtaaagcgcgcggcgatgatgttggtaacagcacctttggtggcaagaattactgtgctgaatccaatggtaacgctgccgacacgctgatgctgtgtgcatcctgggtcgctcaggcggatctttcggaattctttaagaaatggaatccgggtgcaagtgcttaccagttgccgggagcaacggagatgagtttccagggcggtgtgagctcttcggcttacagcacgctggcgtcactcaagctgccgaaaccggaaaaagggccggaaaccattaacaaggttaccgagcataagatgtctgccgagtaa

SEQ ID NO: 7052 - protein, 1526 aa, Escherichia coli
MSLALLMNKKFKYKKSLLAAILSATLLAGCDGGGSGSSSDTPSVDSGSGTLPEVKPDPTPTPEPTPEPTPDPEPTPDPTPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDTNYQSVSKFHVFHDSTNFYGSTGNARGQAVVNISNSAFPILMARNDKNYWLAFGEKRAWDKNELAYITEAPSIVQPENVTRDTATFNLPFISLGQVGEGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQRRATGIWVYERYPAADGAQPPYTIDPNTGEVTWKYQQDNKPDDKPKLEVASWQEEVEGKQVTRYAFIDEAEYTTEESLEAAKAKIFEKFPGLQECKDSTYHYEINCLERRPGTDVPVTGGMYVPRYTQLNLDADTAKAMVQAADLGTNIQRLYQHELYFRTKGSKGERLNSVDLERLYQNMSVWLWNDTKYRYEEGKEDELGFKTFTEFLNCYANDAYAGGTKCSADLKKSLVDNNMIYGDGSSKAGMMNPSYPLNYMEKPLTRLMLGRSWWDLNIKVDVEKYPGSVSAKGESVTENISLYSNPTKWFAGNMQSTGLWAPAQQDVTIKSSASVPVTVTVALADDLTGREKHEVALNRPPRVTKTYTLEANGEVTFKVPYGGLIYIKGDSKDDVSANFTFTGVVKAPFYKDGEWKNDLDSPAPLGELESASFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVGNSTFGGKNYCAESNGNAADTLMLCASWVAQADLSEFFKKWNPGASAYQLPGATEMSFQGGVSSSAYSTLASLKLPKPEKGPETINKVTEHKMSAE

SEQ ID NO: 7053 - DNA, 1683 bp, Escherichia coli
atggttacctggacccaaatgtatatgccgatgggaggactggggctatccgctctggtcgccctgatcccaataatattcttcttcgttgcactcgcggtattacgtctgaaaggacatgtcgctggagcaataacccttatattatctattctgattgcgatattcgcctttaaaatgccgattgatatggcatttgctgctgcgggctatggctttatttatggtttatggcctattgcgtggattattgtcgcggcggtattcctgtataaattaaccgttgccagcggccagttcgatattatccgcagctcggttatctccatcaccgacgatcagcgtttgcaggtgttactgattggtttctcctttggtgcgctgctggaaggggcggctggctttggcgcaccggtggcgattaccggtgctctactggtgggcctgggcttcaaaccgctatacgcggcggggctgtgtctgattgccaacactgcgccggtggcgtttggtgcgttgggcgtgccgattctggtcgccggtcaggtaacgggaatcgatccgttccacattggcgcaatggcgggacgtcagttaccgttcctgtcggttcttgtgccgttctggctggtagcaatgatggacggctggaaaggggtgaaagagacgtggccagcggcgctggttgcagggggaagcttcgctgtcactcagttctttacctctaactatattggtccggaactgccggatattacttcggcgctggtgagtatcgtctcactcgctttattccttaaagtctggcggccgaaaaataccgaaacggcaatcagcatgggacaatccgcaggtgcgatggtggtgaataaaccatcttctggcggtcccgtgccttcagaatatagtctggggcaaatcattcgtgcgtggtcaccgtttttaatcttaacggtgctggtcaccatctggaccatgaagccgtttaaagcgttatttgctccgggcggcgcgttttattcactggtgattaatttccagatccctcatttgcatcaacaagtgttgaaagcggcacccattgtcgcccaaccaacgccaatggacgcggtgtttaaattcgaccctctctcggctggcggcaccgctatttttattgcggcgattatctctatcttcatcctcggcgtgggcatcaagaaagggattggcgtctttgccgaaacgctaattagtctgaagtggccgatattgtcgattggcatggtgctggcgttcgccttcgtcaccaactattccggtatgtccaccacgctggcgctggtactggcaggtacaggcgtgatgttcccgtttttctcaccgtttctcggctggctgggcgtattccttaccggctcggacacctcctctaacgccctgtttggttcactgcaatcgaccacggcgcagcaaatcaacgtctctgacaccctgctggtggcagcaaacaccagcggcggcgtaactggcaagatgatctccccgcaatctatcgccgtggcctgcgccgcgacgggcatggtggggcgagaatctgaactgttccgctacaccgtgaagcacagtctgatttttgccagcgttatcggcattatcacgctgttgcaggcgtatgtgtttaccgggatgttagtttcgtaa

SEQ ID NO: 7054 - protein, 560 aa, Escherichia coli
MVTWTQMYMPMGGLGLSALVALIPIIFFFVALAVLRLKGHVAGAITLILSILIAIFAFKMPIDMAFAAAGYGFIYGLWPIAWIIVAAVFLYKLTVASGQFDIIRSSVISITDDQRLQVLLIGFSFGALLEGAAGFGAPVAITGALLVGLGFKPLYAAGLCLIANTAPVAFGALGVPILVAGQVTGIDPFHIGAMAGRQLPFLSVLVPFWLVAMMDGWKGVKETWPAALVAGGSFAVTQFFTSNYIGPELPDITSALVSIVSLALFLKVWRPKNTETAISMGQSAGAMVVNKPSSGGPVPSEYSLGQIIRAWSPFLILTVLVTIWTMKPFKALFAPGGAFYSLVINFQIPHLHQQVLKAAPIVAQPTPMDAVFKFDPLSAGGTAIFIAAIISIFILGVGIKKGIGVFAETLISLKWPILSIGMVLAFAFVTNYSGMSTTLALVLAGTGVMFPFFSPFLGWLGVFLTGSDTSSNALFGSLQSTTAQQINVSDTLLVAANTSGGVTGKMISPQSIAVACAATGMVGRESELFRYTVKHSLIFASVIGIITLLQAYVFTGMLVS

SEQ ID NO: 7055 - DNA, 2172 bp, Escherichia coli
atgagtcaaaccataacccagggccgtttacgcattgacgccaattttaaacgttttgtggatgaagaagttttgcctggcgtggaactggatgctgccgcgttctggcacaatgttgatgagatcgttcacgatctggcgccagagaatcgtcagttgctggcagagcgcgatcgcattcaggcggcgcttgatgagtggcatcgcagcaatccggggccggtaaaagataaagcggcctataaatctttcctgcgtgaactgggctacctggtgccacagcctgaccacgttacggtggaaaccacgggcatcgacagcgaaatcaccagtcaggcggggccacagctggtggttccggcgatgaacgcccgctacgcgctgaacgcggcgaacgctcgctggggctcactgtacgatgcgttatacggcagcgacatcatcccgcaggaaggggcgatggtcagcggctacgatccgcagcgtggtgagcaggttatcgcctgggttcggcgtttcctcgatgaatcactaccgctggaaaatggcagctatcaggatgtggtggcgtttaaggtggtcgataaacaattacgcatccagttgaaaaatggtaaagaaaccacgttacgtactccagcacagtttgtcggttaccgtggcgatactgctgcgccgacctgcattttgctgaaaaataacggcctgcatattgagctacaaatcgatgccaacgggcggattggcaaagacgatccggcgcacatcaacgatgttatcgtcgaagcggccatcagtaccattctcgactgcgaagattcggttgcggcggttgatgcggaagataaaatcctgctgtaccgcaacctgctgggcctgatgcaggggactctgcaagagaaaatggagaagaacggtcggcaaatcgtgcgtaaactgaatgacgatcgtcagtacactgccgccgatggatctgaaatttctctgcacggacgctcgttgctgtttatccgcaacgtgggtcatttgatgaccattcctgtgatttgggacagcgaaggcaatgaaatcccggaaggcattcttgatggtgtcatgactggcgcgattgccctctatgatttaaaagtgcagaaaaactcgcgcactggcagcgtctatattgtgaaaccgaaaatgcacggtccgcaggaagtggcgttcgccaacaaactgttttcccgcgttgagacaatgctcggtatggcaccgaataccctgaaaatgggcattatggatgaagaacgccggacctcgctgaacttgcgtagctgtatcgctcaggcgcgcaaccgcgtggcgttcatcaataccggtttcctcgaccgtaccggcgatgaaatgcattcggtgatggaagcgggcccgatgctgcgtaaaaaccagatgaaatcgacgccgtggatcaaagcctacgaacgtaataacgtgctttccggtctgttctgtgggctacgtggaaaagcgcaaatcggtaaaggcatgtgggcaatgccggacctgatggcagacatgtacagccagaagggcgaccaattgcgtgccggggcaaacacggcctgggttccgtcgccaactgccgctacgctccatgcgctgcactaccaccaaaccaacgtacagagcgtgcaagccaacattgcccagaccgagttcaatgctgaatttgaaccgctgctggacgatctgctgactattccggttgctgaaaacgctaactggtcggcgcaagagatccaacaagagctggataacaacgtgcaggggattctggggtacgtggtgcgttgggtggagcaggggattggttgttcaaaagtgccggatattcacaacgtggcgttgatggaagaccgcgcaacgctgcgtatttccagccagcatatcgccaactggttacgtcacggtattctgaccaaagatcaggtgcaggcgtcgctggagaatatggcgaaagtggttgatcagcaaaacgctggcgatccggcttatcgtccaatggtggagaatttcgctaactcgtgtgcttttaaagctgcctgcgatttgatcttcctcggcgtgaaacagccaaacggctataccgaaccgttattacacgcatggcgtttacgcgaaaaagaaaatcattaa

SEQ ID NO: 7056 - protein, 723 aa, Escherichia coli
MSQTITQGRLRIDANFKRFVDEEVLPGVELDAAAFWHNVDEIVHDLAPENRQLLAERDRIQAALDEWHRSNPGPVKDKAAYKSFLRELGYLVPQPDHVTVETTGIDSEITSQAGPQLVVPAMNARYALNAANARWGSLYDALYGSDIIPQEGAMVSGYDPQRGEQVIAWVRRFLDESLPLENGSYQDVVAFKVVDKQLRIQLKNGKETTLRTPAQFVGYRGDTAAPTCILLKNNGLHIELQIDANGRIGKDDPAHINDVIVEAAISTILDCEDSVAAVDAEDKILLYRNLLGLMQGTLQEKMEKNGRQIVRKLNDDRQYTAADGSEISLHGRSLLFIRNVGHLMTIPVIWDSEGNEIPEGILDGVMTGAIALYDLKVQKNSRTGSVYIVKPKMHGPQEVAFANKLFSRVETMLGMAPNTLKMGIMDEERRTSLNLRSCIAQARNRVAFINTGFLDRTGDEMHSVMEAGPMLRKNQMKSTPWIKAYERNNVLSGLFCGLRGKAQIGKGMWAMPDLMADMYSQKGDQLRAGANTAWVPSPTAATLHALHYHQTNVQSVQANIAQTEFNAEFEPLLDDLLTIPVAENANWSAQEIQQELDNNVQGILGYVVRWVEQGIGCSKVPDIHNVALMEDRATLRISSQHIANWLRHGILTKDQVQASLENMAKVVDQQNAGDPAYRPMVENFANSCAFKAACDLIFLGVKQPNGYTEPLLHAWRLREKENH

SEQ ID NO: 7057 - DNA, 405 bp, Escherichia coli
atgaaaactaaagtcattcttagccagcaaatggcgagtgcaattattgccgcaggtcaggaagaggcgcagaaaaataactggtctgtttccattgctgttgccgatgacggcggtcatctgctggcgttaagtcgcatggacgattgcgcgccgattgcggctaacatctcccaggagaaagcgcgtaccgccgcgctggggcgtcgtgaaactaagggctatgaagagatggtgaacaacggacgtaccgcgttcgtgactgcgccgttactgacgtcgctggaaggtggcgtaccggttgttgtggatgggcaaattattggtgccgtgggcgtttctggtttaaccggagcacaggatgcgcaggtcgcgaaagcggcagcagcggtgttggcgaaataa

SEQ ID NO: 7058 - protein, 134 aa, Escherichia coli
MKTKVILSQQMASAIIAAGQEEAQKNNWSVSIAVADDGGHLLALSRMDDCAPIAANISQEKARTAALGRRETKGYEEMVNNGRTAFVTAPLLTSLEGGVPVVVDGQIIGAVGVSGLTGAQDAQVAKAAAAVLAK

SEQ ID NO: 7059 - DNA, 1224 bp, Escherichia coli
atgcaaacccgattaacagaagagatgcggcagaacgcgcgcgcgctggaagccgacagcatcctgcgcgcctgtgttcactgcggattttgtaccgcaacctgcccaacctatcagcttctgggcgatgaactggacgggccgcgcgggcgcatctatctgattaaacaggtgctggaaggcaacgaagtcacgcttaaaacacaggagcatctcgatcgctgtctcacttgccgcaattgtgaaaccacctgtccttctggtgtgcgttatcacaatttgctggatatcgggcgtgatattgtcgagcagaaagtgaaacgcccactgccggagcgaatgctgcgcgaaggattgcgccaggtagtgccgcgtccggcggtcttccgtgcgctgacgcaggtagggctggtgctgcgaccgtttttaccggaacaggtcagagcaaaactgcctgctgaaaccgtgaaagctaaaccgcgtccaccactgcgccataagcgtcgggttttaatgctggaaggctgcgcccagcctacgctttcgcccaacaccaacgcggcaactgcgcgagtgctggatcgtctggggatcagcgtcatgccagctaacgaagcaggctgttgtggcgcggtggactatcatcttaatgcgcaagagaaagggttagcgcgggcgcgcaataatattgatgcctggtggcccgcgattgaagcaggtgccgaggcaattttgcaaaccgccagcggttgtggcgcgtttgtcaaagagtatgggcagatgctgaaaaacgatgcgttgtatgccgataaagcgcgtcaggtcagtgagctggcggtcgatttagtcgaacttctgcgcgaggaaccgctggaaaaactggcaattcgcggcgataaaaaactggccttccactgcccgtgtaccctacaacatgcgcaaaagctgaacggcgaagtggaaaaagtgttgcttcgtcttggatttaccttaacggacgttcccgacagccatctgtgctgcggttcagcgggaacatatgcgttaacgcatcccgatctggcacgccagctgcgggataacaaaatgaatgcgctggaaagcggcaaaccggaaatgatcgtcaccgccaacattggttgccagacgcatctggcgagcgccggtcgtacctctgtgcgtcactggattgaaattgtagaacaagcccttgaaaaggaataa

SEQ ID NO: 7060 - protein, 407 aa, Escherichia coli
MQTRLTEEMRQNARALEADSILRACVHCGFCTATCPTYQLLGDELDGPRGRIYLIKQVLEGNEVTLKTQEHLDRCLTCRNCETTCPSGVRYHNLLDIGRDIVEQKVKRPLPERMLREGLRQVVPRPAVFRALTQVGLVLRPFLPEQVRAKLPAETVKAKPRPPLRHKRRVLMLEGCAQPTLSPNTNAATARVLDRLGISVMPANEAGCCGAVDYHLNAQEKGLARARNNIDAWWPAIEAGAEAILQTASGCGAFVKEYGQMLKNDALYADKARQVSELAVDLVELLREEPLEKLAIRGDKKLAFHCPCTLQHAQKLNGEVEKVLLRLGFTLTDVPDSHLCCGSAGTYALTHPDLARQLRDNKMNALESGKPEMIVTANIGCQTHLASAGRTSVRHWIEIVEQALEKE

SEQ ID NO: 7061 - DNA, 1053 bp, Escherichia coli
atgctacgcgagtgtgattacagccaggcgctgctggagcaggtgaatcaggcgattagcgataaaacgccgctggtgattcagggcagcaatagtaaagcctttttaggtcgccctgtcaccgggcaaacgctggatgtgcgttgtcatcgcggcattgttaattacgacccgaccgagctggtgataaccgcgcgtgccggaacgccgctggtggcgattgaagcagcgctggagagcgccgggcaaatgctcccctgcgagccgccgcattatggtgaagaagccacctggggcgggatggtcgcttgcgggctggcggggccgcgtcgcccgtggagtggttcggtccgcgattttgtcctcggcacgcgcattattaccggcactggaaaacatctgcgttttggtggcgaagtgatgaaaaacgttgccggatacgatctctcacggttaatggccggaagctacggttgtcttggcgtgctcactgaaatctcgatgaaagtgttaccgcgaccgcgcgcctccctgagcctgcgtcgggaaatcagcctgcaagaagccatgaatgaaatcgcccagtggcaactccagccgctacccattagtggcttatgttacttcgacaatgcgttgtggatccgccttgagggcggcgaaggatcggtaaaagcagcgcgtgaactgctgggtggcgaagaggttgcaggtcagttctggcagcaattgcgtgaacaacaactgccgttcttctcgttaccaggtaccttatggcgcatttcattacccagtgatgcgccgatgatggatttacccggcgagcaactgatcgactggggcggggcgttacgctggctgaaatcgacagccgatgataatcaaatccatcgcatcgcccgcaacgctggcggtcatgcgacccggtttagtgccggagacggtggctttgccccgctaccggcacctttattccgctatcaccagcagcttaaacagcagctcgatccttgcggcgtgtttaaccccggtcgcatgtacgcggaactttga

SEQ ID NO: 7062 - protein, 350 aa, Escherichia coli
MLRECDYSQALLEQVNQAISDKTPLVIQGSNSKAFLGRPVTGQTLDVRCHRGIVNYDPTELVITARAGTPLVAIEAALESAGQMLPCEPPHYGEEATWGGMVACGLAGPRRPWSGSVRDFVLGTRIITGTGKHLRFGGEVMKNVAGYDLSRLMAGSYGCLGVLTEISMKVLPRPRASLSLRREISLQEAMNEIAQWQLQPLPISGLCYFDNALWIRLEGGEGSVKAARELLGGEEVAGQFWQQLREQQLPFFSLPGTLWRISLPSDAPMMDLPGEQLIDWGGALRWLKSTADDNQIHRIARNAGGHATRFSAGDGGFAPLPAPLFRYHQQLKQQLDPCGVFNPGRMYAEL

SEQ ID NO: 7063 - DNA, 1491 bp, Escherichia coli
ttgtacgaagagcgtcttgatggcgctttacccgaagtcgaccgcacatcggtactgatggcactgcgtgagcatgtccctggactggagatcctgcataccgatgaggagatcattccttacgagtgtgacgggttgagcgcgtatcgcacgcgtccattactggttgttctgcctaagcagatggaacaggtgacggcgattctggctgtctgccaccgcctgcgtgtgccggtggtgacccgtggcgcaggcaccgggctttctggtggcgcgctgccgctggaaaaaggtgtgttgttggtgatggcgcgctttaaagagatcctcgacattaaccccatcggtcgccgcgcgcgcgtgcagccgggcgtgcgtaacctggcgatctcccaggccgttgcgccgcataatctctattacgcgccggatccgtcctcacaaatcgcctgttcgattggcggcaatgtggcggaaaatgccggtggcgttcactgcctgaaatatggtctaaccgtacataacctgctgaaaattgaagtgcaaatgctggatggcgaggcgctgacgctgggatcggacgcgctggattcgcctggttttgacctgctggcgctgtttaccggatcggaaggtatgctcggcgtgaccaccgaagtaacggtgaagctgttgccgaagccgcccgtggcgcgggttctgttagccagctttgactcggtagaaaaagccggacttgcggttggtgacatcatcgccaatggcattatccccggtgggctggagatgatggataacctgtcgattcgcgcggcggaagattttattcatgccggttatcccgtcgatgccgaagcgattttgttatgcgaactggacggcgtggagtctgacgtacaggaagactgcgagcgggttaacgacatcttgttgaacgcgggtgcgactgacgtccgtctggcacaggacgaagcagagcgagtacgtttctgggccggtcgcaaaaatgcgttcccggcggtaggacgtatctccccggattactactgcatggatggcaccatcccgcgccgcgccctgccaggcgtactggaaggcattgcccgtttatcgcagcaatatgatttacgcgttgccaacgtctttcatgccggagacggcaacatgcacccgttaatccttttcgatgccaacgaacccggtgaatttgcccgcgcggaagaactgggcgggaagatcctcgaactctgcgttgaagttggcggcagcatcagtggggaacatggcatcgggcgcgaaaaaatcaatcaaatgtgcgcccagttcaacagcgatgaaatcacgaccttccatgcggtcaaggcggcgtttgaccccgatggtttgctgaacccaggaaaaaacattcccacgctacaccgctgtgctgaatttggtgccatgcatgtgcatcacggtcatttaccttttcctgaactggagcgtttctga

SEQ ID NO: 7064 - protein, 496 aa, Escherichia coli
MYEERLDGALPEVDRTSVLMALREHVPGLEILHTDEEIIPYECDGLSAYRTRPLLVVLPKQMEQVTAILAVCHRLRVPVVTRGAGTGLSGGALPLEKGVLLVMARFKEILDINPIGRRARVQPGVRNLAISQAVAPHNLYYAPDPSSQIACSIGGNVAENAGGVHCLKYGLTVHNLLKIEVQMLDGEALTLGSDALDSPGFDLLALFTGSEGMLGVTTEVTVKLLPKPPVARVLLASFDSVEKAGLAVGDIIANGIIPGGLEMMDNLSIRAAEDFIHAGYPVDAEAILLCELDGVESDVQEDCERVNDILLNAGATDVRLAQDEAERVRFWAGRKNAFPAVGRISPDYYCMDGTIPRRALPGVLEGIARLSQQYDLRVANVFHAGDGNMHPLILFDANEPGEFARAEELGGKILELCVEVGGSISGEHGIGREKINQMCAQFNSDEITTFHAVKAAFDPDGLLNPGKNIPTLHRCAEFGAMHVHHGHLPFPELERF

SEQ ID NO: 7065 - DNA, 825 bp, Escherichia coli
gtgcgtgttttgcgagttaagaacagaaaaattggtcctacctgtgcacgaggtccgggaatgaaagatgaacgtcgccctatttgcgaagtggttgcagagagtatcgaacggttaattatcgacggcgtgttgaaggtcggtcagccgcttccctcggaacgtcggctgtgtgaaaagctcggcttctcacgctccgcactgcgtgaagggctgaccgtgctgcgcgggcgcgggattattgaaacggcgcagggtcgcgattctcgtgtcgcacggcttaatcgggtgcaggacgccagcccgctgatccatctgttcagtacgcagccgcgaacgctgtacgatctgctcgacgttcgcgcattactggagggcgaatcggcaaggctggcggcaacgctgggaacccaggctgattttgttgtgataacccgctgttatgaaaaaatgctcgccgccagtgagaacaacaaagagatttcgctgatcgaacatgcgcagttggatcacgctttccatctcgccatttgtcaggcttctcacaatcaggtgctggtgtttacgctgcaatcattgaccgacctgatgtttaattcggtgtttgccagcgtaaataatctctaccatcgaccacagcaaaaaaagcagatcgatcgccagcatgcgcggatctacaacgcggtgttgcagcggctgccgcacgttgcccagcgcgcagcacgcgatcatgtgcggaccgtgaaaaagaatctccacgatatcgagctggaaggccaccatttgattcgctcggcggtgccgctggagatgaagcaggggtga

SEQ ID NO: 7066 - protein, 274 aa, Escherichia coli
MRVLRVKNRKIGPTCARGPGMKDERRPICEVVAESIERLIIDGVLKVGQPLPSERRLCEKLGFSRSALREGLTVLRGRGIIETAQGRDSRVARLNRVQDASPLIHLFSTQPRTLYDLLDVRALLEGESARLAATLGTQADFVVITRCYEKMLAASENNKEISLIEHAQLDHAFHLAICQASHNQVLVFTLQSLTDLMFNSVFASVNNLYHRPQQKKQIDRQHARIYNAVLQRLPHVAQRAARDHVRTVKKNLHDIELEGHHLIRSAVPLEMKQG

SEQ ID NO: 7067 - DNA, 1143 bp, Escherichia coli
atggaatgcgatctgctgatgattaaaattgaaaaagtaattaataaaaaagaccttaaggcatttatcgcttttccgtcatcactttatcccgatgatccaaactggataccccctttattcattgaacgcagcgagcatttgtctgcgaagaatccggggacggaccatatcatctggcaggcgtgggtagcaaaaaaagccgggcagatagtcgggcggattaccgcgcaaatcgataccttgcaccgtgagcgttacggtgaagataccggtcatttcggcatgattgactccattgatgatccgcaggtttttgccgcgttgtttggtacagcggaagcgtggttgaagtcacaaggtgcaagtaagatcagcgggcctttcagcctgaatatcaatcaggaaagcggattactgattgaaggttttgacactccgccctgtgcgatgatgccacacggcaaaccgtggtatgccgcgcatattgaacaactgggttatcacaaaggcattgatttactggcgtggtggatgcagcgaaccgatctcactttctctccggcgctaaaaaaactgatggatcaggtgcgcaaaaaagtgaccattcgctgcatcaatcgccagcggtttgccgaagatatgcagatcctgcgtgagattttcaattctggctggcagcacaactggggatttgtgccgtttaccgaacatgaattcgcgaccatgggcgatcaacttaaatatctggtgccggacgatatgatctacatcgctgagattgattctgcaccctgcgcgtttattgttggcttgccgaacatcaacgaggcgattgtcgatctgaacggatcgctctttcccttcggctgggcaaaattgctgtggcgtttgaaagtcagcggtgtgcgaactgcgcgagtgccgctgatgggcgtgcgggacgagtatcagttcagccgcatcggcccggtgattgcgctgttattgattgaagccttacacgatccgtttgcccgccggaagatcgatgcgctggaaatgtcatggatcctcgaaaccaatacaggcatgaataacatgctggaacgcattggggcggagccgtacaagcgttaccgattgtatgaaaagcagatttga

SEQ ID NO: 7068 - protein, 380 aa, Escherichia coli
MECDLLMIKIEKVINKKDLKAFIAFPSSLYPDDPNWIPPLFIERSEHLSAKNPGTDHIIWQAWVAKKAGQIVGRITAQIDTLHRERYGEDTGHFGMIDSIDDPQVFAALFGTAEAWLKSQGASKISGPFSLNINQESGLLIEGFDTPPCAMMPHGKPWYAAHIEQLGYHKGIDLLAWWMQRTDLTFSPALKKLMDQVRKKVTIRCINRQRFAEDMQILREIFNSGWQHNWGFVPFTEHEFATMGDQLKYLVPDDMIYIAEIDSAPCAFIVGLPNINEAIVDLNGSLFPFGWAKLLWRLKVSGVRTARVPLMGVRDEYQFSRIGPVIALLLIEALHDPFARRKIDALEMSWILETNTGMNNMLERIGAEPYKRYRLYEKQI

SEQ ID NO: 7069 - DNA, 1752 bp, Escherichia coli
ttgatatccaattttttcgtggtgtatatgtctaataaaatctttacgcattccctacctatgcgctatgccgattttccaacgctggttgatgctttggactacgccgctctgagtagcgccggaatgaatttttatgacagacgttgccaacttgaagatcaactggaatatcagacgttaaaagcgcgtgccgaagctggtgcgaaaaggttgttatcgctgaacctgaaaaaaggcgatcgcgtggcgctgattgccgaaacgagtagcgggtttgtagaggctttttttgcctgccagtatgccggcttagtcgccgtcccgttggcgattccaatgggcgtaggtcagcgggattcctggagcgccaaactgcagggtttactggcaagttgccagcccgcagccattatcactggtgatgagtggttgccactggtcaatgccgcgacgcataacaacaaccccgaattacatgttttaagccacgcctggtttaaggcattaccggaagccgatgttgtgctccagcgtccagttccaaacgatatcgcctacctccagtacacctccggcagcacccgttttccccgtggcgtcattatcacccatcacgaagtgatggctaatctacgtgctataagccacgatgggattaaattacgccctggcgaccgctgcgtctcctggctgcctttctaccatgatatgggactggtcggctttctcctgacccccgtcgccacgcagctttcagtagattatttgcgcactcaggattttgccatgcgtcctctgcaatggcttaaattgatcagtaaaaatcgtggcaccgtttccgttgcaccgccgtttggctatgaattgtgccagcgccgcgtgaatgaaaaagatctcgctgaactggatctttcctgctggcgcgtcgctggtattggcgcagaacccatatccgcagaacaactccatcaattcgctgaatgtttccgtcaggttaactttgacgataaaactttcatgccgtgctacggactggcagaaaatgcgctggctgtcagcttctctgatgaagcctgcggggttgtggttaacgaagtggatcgcgacatcctcgaataccagggtaaagccgtcgcgccgggtgctgaaacacgcgccgtatcgactttcgtcaactgcggtaaagcgttgccggaacatggcattgaaatccgcaatgaagcagatatacctgtcgcggaacgtgtggtaggccatatttgcatctccggccccagcctgatgagcgggtactttggcgaccaggtttcgcaagacgagattgccgcgacgggctggttagacaccggcgaccttggttatctgctggacggttatctgtatgtcaccggacgcattaaagatctgattattattcgtggccgtaatatctggccgcaggatattgaatacattgcggaacaggagccggaaattcattctggcgatgcgattgcttttgttaccgcccaggaaaaaatcattttgcagatccagtgtcggatcagcgacgaagaacgtcgcgggcagcttatccacgcgctggcagctcggatccaaagcgaatttggcgttaccgcggatatcgatctgttgccgccccacagtattccccgaacatcctccggcaagcctgcccgtgcggaagcgaaaaaacgttatcagaaggcttatgctgccagtcttcatgtgcaggaatccctggcatga

SEQ ID NO: 7070 - protein, 583 aa, Escherichia coli
MISNFFVVYMSNKIFTHSLPMRYADFPTLVDALDYAALSSAGMNFYDRRCQLEDQLEYQTLKARAEAGAKRLLSLNLKKGDRVALIAETSSGFVEAFFACQYAGLVAVPLAIPMGVGQRDSWSAKLQGLLASCQPAAIITGDEWLPLVNAATHNNNPELHVLSHAWFKALPEADVVLQRPVPNDIAYLQYTSGSTRFPRGVIITHHEVMANLRAISHDGIKLRPGDRCVSWLPFYHDMGLVGFLLTPVATQLSVDYLRTQDFAMRPLQWLKLISKNRGTVSVAPPFGYELCQRRVNEKDLAELDLSCWRVAGIGAEPISAEQLHQFAECFRQVNFDDKTFMPCYGLAENALAVSFSDEACGVVVNEVDRDILEYQGKAVAPGAETRAVSTFVNCGKALPEHGIEIRNEADIPVAERVVGHICISGPSLMSGYFGDQVSQDEIAATGWLDTGDLGYLLDGYLYVTGRIKDLIIIRGRNIWPQDIEYIAEQEPEIHSGDAIAFVTAQEKIILQIQCRISDEERRGQLIHALAARIQSEFGVTADIDLLPPHSIPRTSSGKPARAEAKKRYQKAYAASLHVQESLA

SEQ ID NO: 7071 - DNA, 915 bp, Escherichia coli
atgaatcaaactgtcgcggtgacgggcgctaccgggtttatcggtaaatatattattgataacctgctcgcccgcggctttcatgttcgcgcattgacgcgtactgcccgcgctcacgtcaatgataatctcacttgggtgcgcggttcgctggaagatacacattcgcttagcgaactggttgccggagccagcgcggtggtccattgcgccgggcaagtgcgcgggcacaaagaagagatttttacccgctgcaacgttgacggcagcctgcgcctgatgcaagcggcaaaagagagcggcttttgccaacgttttctgtttatctcttcgctggcggcgcgccatcccgaactctcctggtacgcaaattccaaacacgtcgctgaacaacggctgactgcaatggctgacgaaattacgttgggcgtttttcgcccgacagccgtgtatggtcccggcgataaagagttaaaaccgctgtttgactggatgctgcgcggtctgctgccacgacttggcacgccagagacacagctctcttttcttcacgtcaccgattttgcgcaagcagtgagtcagtggttaagcgccgaaactgtacagacgcaaacctatgaattatgcgatggcgtcgccggaggctatgactggcaacgtgtccaacagcttgttgccgatgtccgctgtggttccgtgcggatggtcggtattcctcagccgctactcacctgccttgcggatatcagtaccgcgttgaaccgtctggcgggtaaagaaccgatgctgactcgttcgaaaatccgtgaattaacccatgccgactggtcggcaagtaataaccgtatttctgaagatattaattggtttcccgggattagcctggaacacgcattacgcaacgggctattttga

SEQ ID NO: 7072 - protein, 304 aa, Escherichia coli
MNQTVAVTGATGFIGKYIIDNLLARGFHVRALTRTARAHVNDNLTWVRGSLEDTHSLSELVAGASAVVHCAGQVRGHKEEIFTRCNVDGSLRLMQAAKESGFCQRFLFISSLAARHPELSWYANSKHVAEQRLTAMADEITLGVFRPTAVYGPGDKELKPLFDWMLRGLLPRLGTPETQLSFLHVTDFAQAVSQWLSAETVQTQTYELCDGVAGGYDWQRVQQLVADVRCGSVRMVGIPQPLLTCLADISTALNRLAGKEPMLTRSKIRELTHADWSASNNRISEDINWFPGISLEHALRNGLF

SEQ ID NO: 7073 - DNA, 249 bp, Escherichia coli
atggtaaatcgtgaaatagtaatggattacatcctttcctgtttacaggatttggtcgaaaacggtgtggaaattaagcccgacagcgatctcgtcaacgatcttggcctggagtcgatcaaagtgatggatctcttaatgatgctggaagacagattcgatatttccattcctattaatattctgctggatgtcaaaacccctgcgcaattaatggaaactctacttccatggctggagaataactaa

SEQ ID NO: 7074 - protein, 82 aa, Escherichia coli
MVNREIVMDYILSCLQDLVENGVEIKPDSDLVNDLGLESIKVMDLLMMLEDRFDISIPINILLDVKTPAQLMETLLPWLENN

SEQ ID NO: 7075 - DNA, 1173 bp, Escherichia coli
atggggctatacgataaatatgcgcgccttgctggcgagcgcctgcaatttagtgacaacgggttaacaccatttggcacctgtattgatgaagtgtattccgccaccgaaggccggatcggcaataaaaaagtgattctggccgggaccaataattatctcggtttaacctttaatcatgatgctatccgcgaaggtcaggcagcgttagcggcccaaggcaccggcaccaccggttctcgtatggcaaacggcagttatgcgccgcatctggcgttagagaaagagattgccgagtttttcaatcgccctaccgctatcgttttttcaaccggttataccgctaatttaggcgtcatcagcacacttgccgaccataacgccgtggtgttactggatgccgacagccacgccagtatttatgacgcctgttctctcggcggcgcggagattattcgtttccgccataatgacgtcaacgatctggaacggcgcatggtccgcctcggtgaacgggcgaaagaggcgattattatcgttgaaggcatctacagtatgctcggtgacgttgcgccgctggcagaaattgttgatatcaaacgtcgtctcggcggatatttaattgtcgatgaagcacattcgtttggcgtgttaggcgctacggggcgcggactggccgaagctgtcggcgttgaagacgacgtggatattatcgttggcaccttcagtaaaagtctggcctcgattggcggttttgctgtcggttcggaagcgatggaagtgctgcgctacggcagccgcccgtatatttttaccgcctctccttctccgtcctgcattgcgaccgtgcgctcgtcgttaagaaccattgcctcacaaccagagctgcgccaaaagctgatggataacgccaaccatctgtatgatggtctgcaaaaactgggttacgagttaagttcacatattagcccggtagtgccagtaataatcggttcgaaagaggaaggtttacgcatctggcgcaagcttatttcgctgggcgtttatgtgaatcttatcctgccacctgccgcgcctgctggcatcacgctgctgcgctgtagcgtaaacgctgcccacagtcgtgagcaaatcgatgccatcattcaggcatttgctactcagaagcagtaa

SEQ ID NO: 7076 - protein, 390 aa, Escherichia coli
MGLYDKYARLAGERLQFSDNGLTPFGTCIDEVYSATEGRIGNKKVILAGTNNYLGLTFNHDAIREGQAALAAQGTGTTGSRMANGSYAPHLALEKEIAEFFNRPTAIVFSTGYTANLGVISTLADHNAVVLLDADSHASIYDACSLGGAEIIRFRHNDVNDLERRMVRLGERAKEAIIIVEGIYSMLGDVAPLAEIVDIKRRLGGYLIVDEAHSFGVLGATGRGLAEAVGVEDDVDIIVGTFSKSLASIGGFAVGSEAMEVLRYGSRPYIFTASPSPSCIATVRSSLRTIASQPELRQKLMDNANHLYDGLQKLGYELSSHISPVVPVIIGSKEEGLRIWRKLISLGVYVNLILPPAAPAGITLLRCSVNAAHSREQIDAIIQAFATQKQ

SEQ ID NO: 7077 - DNA, 1161 bp, Escherichia coli
gtggttagtgcccggactcatgctaatgggcctgttgatgctggtcgcacgcgacttctccttgctgcagaaatttccccgatgaatgttttcagtcgctatttaatccgtcacctctttctcggttttgccgccgccgcagggctattgctgccgctttttaccaccttcaacctgattaacgaactggatgatgtcagtccgggcggttatcgctggactcaggcagtgctggtggtgctgatgaccttaccgcgcacactggtcgaactttcgccgtttatcgcgttattgggggggattgttggtctcgggcagttatcgaaaaacagtgagcttaccgccattcgcagcacggggttttctatcttccgcattgcactggtggcgctggttgcagggatactgtggactgtttcgttaggcgcgattgatgagtgggtggcgtcaccattgcagcaacaggcgctgcaaatcaaatcgactgccaccgcgttgggggaggacaatgacattatcggcaatatgctttgggccaggcgcggtaatgaatttgtgacggtgaaatcgctgaacgagcagggccagccggtgggcgtggagatttttcattaccgcgacgatctctcgctcgaatcctacatttatgcgcgcagtgccaccattgaagacgataaaacgtggatcctgcatggtgtgaattataaaaaatggttgaatggcaaagaaacgctggaaacattagataatcttgcctggcaatcggccttcaccagtatgaatcttgaagagttatcgatgccggggaatactttttctgtccgtcagcttaatcattacatccattatttgcaggataccgggcaacccagcagcgaataccaccttgcactgtgggaaaaactggggcaaccgatcttgactctggcgatgattttgctggctgtgccgtttacctttagtgtcccgcgctcgccagggatgggtagccgtctcgctgtaggcgtcatcgttggtttactcacctggatcagctatcaaatcatggtcaatctgggattgctatttgcgttgagcgcacctgttaccgcgctcggtttaccggtagcgtttgtgctggtggcgttgagcctggtgtattggtatgacagacaacattaa

SEQ ID NO: 7078 - protein, 386 aa, Escherichia coli
MVSARTHANGPVDAGRTRLLLAAEISPMNVFSRYLIRHLFLGFAAAAGLLLPLFTTFNLINELDDVSPGGYRWTQAVLVVLMTLPRTLVELSPFIALLGGIVGLGQLSKNSELTAIRSTGFSIFRIALVALVAGILWTVSLGAIDEWVASPLQQQALQIKSTATALGEDNDIIGNMLWARRGNEFVTVKSLNEQGQPVGVEIFHYRDDLSLESYIYARSATIEDDKTWILHGVNYKKWLNGKETLETLDNLAWQSAFTSMNLEELSMPGNTFSVRQLNHYIHYLQDTGQPSSEYHLALWEKLGQPILTLAMILLAVPFTFSVPRSPGMGSRLAVGVIVGLLTWISYQIMVNLGLLFALSAPVTALGLPVAFVLVALSLVYWYDRQH

SEQ ID NO: 7079 - DNA, 1071 bp, Escherichia coli
atgaagctggttgaacactacatcatgcgtggtacgcgccgtctggtgctgattatcgtcggttttctgatctttattttcgccagctactccgcacagcgttatctgaccgaagcggcaaatgggacattagctcttgatgttgtgctggatatcgttttctacaaagtgctgattgcactggagatgctgttacctgttggactgtatgcgtcagttggcgtgacgctagggcaaatgtataccgactcggaaattaccgctatctccgcggcggggggcagtccgggacgtttgtacaaagccgtcctttatctggcgataccgctaagtatttttgtcacccttctgtcgatgtatggtcgtccctgggcttatgcgcagatttatcaactggagcaacaatcgcagtcggagctggatgttcgtcagttgcgggcaaagaaatttaacactaacgataacggacgaatgatcctttcgcagacggttgatcaggataataatcgcctgactgacgcgctgatttatacttctactgccaatcgaacccgcattttccgcgcccgttcggttgatgtggttgacccatcacccgagaaaccgaccgttatgttgcataacggtaccgcctatcttctcgatcatcaggggcgtgacgacaacgaacagatctaccgtaatctgcaattgcatctcaatccgctggatcaaagccctaacgtcaaacgcaaagcaaaatcggtcacggagctggcacgctccgtctttccagccgatcatgccgaactgcaatggcgacaaagccgtggcctgacagcattgttgatggcgctgctggccatttcattaagtcgggtaaaaccgcggcaggggcgattttcaacgctactgccactgacgttgctgtttgttgccattttttatggcggcgacgtctgtcgtacgctggtggctaacggcgcgattcccctcattcctggtttgtggttagtgcccggactcatgctaatgggcctgttgatgctggtcgcacgcgacttctccttgctgcagaaatttccccgatga

SEQ ID NO: 7080 - protein, 356 aa, Escherichia coli
MKLVEHYIMRGTRRLVLIIVGFLIFIFASYSAQRYLTEAANGTLALDVVLDIVFYKVLIALEMLLPVGLYASVGVTLGQMYTDSEITAISAAGGSPGRLYKAVLYLAIPLSIFVTLLSMYGRPWAYAQIYQLEQQSQSELDVRQLRAKKFNTNDNGRMILSQTVDQDNNRLTDALIYTSTANRTRIFRARSVDVVDPSPEKPTVMLHNGTAYLLDHQGRDDNEQIYRNLQLHLNPLDQSPNVKRKAKSVTELARSVFPADHAELQWRQSRGLTALLMALLAISLSRVKPRQGRFSTLLPLTLLFVAIFYGGDVCRTLVANGAIPLIPGLWLVPGLMLMGLLMLVARDFSLLQKFPR

SEQ ID NO: 7081 - DNA, 561 bp, Escherichia coli
atgccatctcgttggattgtcgctctgatcatcgcactcttagcgccaggcgcggcggcacacaatttcgtcactggcaaaacggttactcctgtttatatccaggaaggcggcgagctgcttctgaatagcgacgacgaaattcactaccaaaagtggaacagcacacaattgacgggaaaagtccgcattattcagtatatcgccggacgtaagtctgcgaagaaaaagaactcactgttaattaaagcggttgaagcggcaaacttttcgcaggatcgttttcagcccaccactattgtgaacaccgatgatgccatctttggtactggctattttgtcgttggcaaaatcgaaaaaaataaacgccgctatccgtgggcgcaattcgttattgacggcaatggtctgggacgcgttgcctggcaattgccggagcagagttcaaccattctggtattgaataaagccgggcgaattcagtgggcaaaggacggcagcctgacaccggaagaggtagatcatgtcattgcgctggcgcagaaactgatcaatgaataa

SEQ ID NO: 7082 - protein, 186 aa, Escherichia coli
MPSRWIVALIIALLAPGAAAHNFVTGKTVTPVYIQEGGELLLNSDDEIHYQKWNSTQLTGKVRIIQYIAGRKSAKKKNSLLIKAVEAANFSQDRFQPTTIVNTDDAIFGTGYFVVGKIEKNKRRYPWAQFVIDGNGLGRVAWQLPEQSSTILVLNKAGRIQWAKDGSLTPEEVDHVIALAQKLINE

SEQ ID NO: 7083 - DNA, 837 bp, Escherichia coli
atgatgagaaaatatttcccgcttgaggcgagcgagcgtctatttgttgcgattgaagaagatgatgttgttgatgcacaggtcagtttgccgccgactatcgcactaagttgtaccaccgaaatcatccatgataattacgcgttatgcctgaaattctggctggatggtgttaatcgtcaggagttactgcgtttaatccgcaaacaggcgaaaggcgatgagctgacgacagacgagcgcaaacagtttaaatacatgcgagcgcgctacaagcatctgcgttttgcgcaacggctgtatttaaagaagcatcaggccggatttttattcggcaaaacgaccgtttttcttgggcattttcaggatggctttcgtaacggtaagaaaaatattgtgtcgttttacggtaacctgttacgtgtttatttgagctcccctgtctggtggctggtgaactattcattgcgccatggccagttagaaaccgtgaacggttttatcgcctaccgccagaagcaaatgtacatcctgaaagagattattgctaaaccgcaactaactggcagggaatttcatgatgtgcgaaaaatcatcagccagcaggtttcttattacgacaccttaagatcgcttgatcctgaaaataaagaggcgttactgatttcccgttttctcgccgccattaatggtctgatgggggataagcacgacgacatggtggcggatgatatggataaccgtcggtcatatgatgcaccggtggcgctggatagcgatattcgccagcgtttagaactgcttatttcgcgtttcccactctatccggagcaataa

SEQ ID NO: 7084 - protein, 278 aa, Escherichia coli
MMRKYFPLEASERLFVAIEEDDVVDAQVSLPPTIALSCTTEIIHDNYALCLKFWLDGVNRQELLRLIRKQAKGDELTTDERKQFKYMRARYKHLRFAQRLYLKKHQAGFLFGKTTVFLGHFQDGFRNGKKNIVSFYGNLLRVYLSSPVWWLVNYSLRHGQLETVNGFIAYRQKQMYILKEIIAKPQLTGREFHDVRKIISQQVSYYDTLRSLDPENKEALLISRFLAAINGLMGDKHDDMVADDMDNRRSYDAPVALDSDIRQRLELLISRFPLYPEQ

SEQ ID NO: 7085 - DNA, 1350 bp, Escherichia coli
ttggcggtttttaacatcaaacattggtttgcagatggcgcgtttcgcaccattattcgcaatagcgcctggttaggctccagtaatgttgtgagcgctttgctggggctgttggcgctctcgtgtgccggtaaagggatgacgcccgccatgtttggcgtactggtaattgtgcaatcgtacgccaagtcgatcagcgattttattaagtttcagacatggcagctggtagttcagtacggaacgccagctttgaccaacaatgatccgcagcaatttcgcaatgttgtctcattttccttctcgctggatatcgtcagcggcgcggtggcgattgtcggcggcattgccttactgccattcctttcccattcattaggtctggatgaccaaagcttttggctggcggcgctctattgcacgctcattccttcaatggcttcctccacgccgaccggcattctgcgtgcggtagatcgctttgatttgattgctgtacagcaggcgacgaaaccttttctgcgcgcagcggggagcgtcgtagcctggtattttgactttggttttgcgggttttgttattgcctggtacgtgtcgaatctggttggcggcaccatgtactggtggtttgccgcgcgcgaattacgccgcagaaatatccataacgccttcaaattgaatctgtttgagtctgcccgacacattaaaggcgcgtggagttttgtctggtcaaccaacattgcccactccatctggtcggcgcgtaactcgtgcagcacagtgttggtggggatcgtgttaggacccgctgccgccgggttatttaaaatcgccatgacattcttcgatgccgccggaacgccagcgggtttactgggcaaaagtttttatccagaggtgatgcgtttagatccacgcaccaccagaccgtggttgttaggcgtgaagtccggtttactggcgggcggaatcggtattctggtggcgctcgcggtgttgatcgtcggcaagccgctcatttcgctggtgtttggcgttaagtatctcgaagcgtatgacctgattcaggtgatgctgggcgcaattgtgatttcgatgctgggcttcccacaggagtcattgctattgatggcgggaaaacagcgcgcttttctcgtggcgcaaaccatcgcctcaatcggctacatcgtattgctgttcatgttctgtcatctgtttggcgtgctgggggctgcatttgcttacttcggtgggcaatgtctggatgtggtgctctcgctaattccgaccttaaaggcattttttcagcgccattccttgctttataactcaaccggagagaaatcctga

SEQ ID NO: 7086 - protein, 449 aa, Escherichia coli
MAVFNIKHWFADGAFRTIIRNSAWLGSSNVVSALLGLLALSCAGKGMTPAMFGVLVIVQSYAKSISDFIKFQTWQLVVQYGTPALTNNDPQQFRNVVSFSFSLDIVSGAVAIVGGIALLPFLSHSLGLDDQSFWLAALYCTLIPSMASSTPTGILRAVDRFDLIAVQQATKPFLRAAGSVVAWYFDFGFAGFVIAWYVSNLVGGTMYWWFAARELRRRNIHNAFKLNLFESARHIKGAWSFVWSTNIAHSIWSARNSCSTVLVGIVLGPAAAGLFKIAMTFFDAAGTPAGLLGKSFYPEVMRLDPRTTRPWLLGVKSGLLAGGIGILVALAVLIVGKPLISLVFGVKYLEAYDLIQVMLGAIVISMLGFPQESLLLMAGKQRAFLVAQTIASIGYIVLLFMFCHLFGVLGAAFAYFGGQCLDVVLSLIPTLKAFFQRHSLLYNSTGEKS

SEQ ID NO: 7087 - DNA, 759 bp, Escherichia coli
atggatgcactacaaacacaaactgttaagagtacaaccgcgccgcagcccaactacattccggggctgattgcggtggtcgggtgtgatggcaccggtaaatccacactgacaaatgacctggtgaaatcgctgcaacaacactggcaaaccgagcggcgctatctggggctgctctccggcgaagacggcgacaaaatcaaacgattgccgttggttggtgtctggctcgaacggcgactggcggccaaatcctcgaaaacccaaagcatgaaaaccaaatctccggcgctatgggcggcggtgattatgtactgcttctcgctgcgaagaatggcgaatctgcgcaaggttcagcgactggcgcaaagtggcgttctggtggtcagcgatcgcttcccgcaggctgaaatttcgggcttttattatgacggaccggggattggcgtcgaacgtgcgaccgggaaaatcagcaggtttctggcgcagcgtgaacggcgtttataccaaaaaatggcgcaataccgtcctgaattaatcattcgcttggggattgatattgatactgccatctcccgcaagcctgaccatgactatgccgagctgcaggacaaaatcggtgttatgtcgacgattggctataacggcacaaaaattcttgagattgattccagagcgccttacagcgaggtgctggaacaggcacagaaggcggtttctctggttgccatcgtttctgaccgccgaagtttaacttaa

SEQ ID NO: 7088 - protein, 252 aa, Escherichia coli
MDALQTQTVKSTTAPQPNYIPGLIAVVGCDGTGKSTLTNDLVKSLQQHWQTERRYLGLLSGEDGDKIKRLPLVGVWLERRLAAKSSKTQSMKTKSPALWAAVIMYCFSLRRMANLRKVQRLAQSGVLVVSDRFPQAEISGFYYDGPGIGVERATGKISRFLAQRERRLYQKMAQYRPELIIRLGIDIDTAISRKPDHDYAELQDKIGVMSTIGYNGTKILEIDSRAPYSEVLEQAQKAVSLVAIVSDRRSLT

SEQ ID NO: 7089 - DNA, 714 bp, Escherichia coli
gtgaatcaacgtaatatgtcaataattaattccacgccagtgcgtgttattgccattgtaggatgtgatggttcaggtaaatcgaccctcacggcaagcctggtaaatgaactggcatcaagaatgccaacagaacacatttatctcgggcaatcgtccgggcgaattggcgaatggatttcacagctacctgttattggcgcaccttttgggcgttatttgcgaagtaaagcggcacatgtgcacgaaaagccctcaacaccgcctggcaatattactgcgctggttatctatctgctttcctgctggcgggcgtacaagtttcgcaaaatgttgtgtaaaaaccagcaaggctatctgctcatcaccgaccgctacccgcaggttgaagtgccgggtttccgctttgatggcccgcaattggcaaaaaccacgggcggtaacggttggataaaaatgttaaggcagcgtgagctgaagctgtaccaatggatggcgtcttatttgcctgtattgttgattcgtcttggcattgatgaacaaaccgcgtttgcgcgtaaacctgaccaccaactggcagcgttacaggaaaaaatcgccgttacgccgcaactgacattcaatggcgccaggatccttgaactggatggtcggcaaccagccgatgaaattctgcaagcgtcactacgcgcaattcacgccgcgctttcctga

SEQ ID NO: 7090 - protein, 237 aa, Escherichia coli
MNQRNMSIINSTPVRVIAIVGCDGSGKSTLTASLVNELASRMPTEHIYLGQSSGRIGEWISQLPVIGAPFGRYLRSKAAHVHEKPSTPPGNITALVIYLLSCWRAYKFRKMLCKNQQGYLLITDRYPQVEVPGFRFDGPQLAKTTGGNGWIKMLRQRELKLYQWMASYLPVLLIRLGIDEQTAFARKPDHQLAALQEKIAVTPQLTFNGARILELDGRQPADEILQASLRAIHAALS

SEQ ID NO: 7091 - DNA, 147 bp, Escherichia coli
gtgggtatttactttaccggcggcgatttttctttctggtgggttgtactggatagcattgcagttgatttaaccttcctgaaaatgcccggtcctggcgatcgggcatttccatttttcactagtgataaccacgcgcggtcataa

SEQ ID NO: 7092 - protein, 48 aa, Escherichia coli
MGIYFTGGDFSFWWVVLDSIAVDLTFLKMPGPGDRAFPFFTSDNHARS

SEQ ID NO: 7093 - DNA, 693 bp, Escherichia coli
atgcagtcaataatacctccattaattgccgttattggtagcgatggttcaggcaagtcaacggtgtgtgaacatcttattaccgttgtcgaaaaatatggtgctgccgaaagggttcatttaggaaaacaggccggaaatgtcggtcgtgcagtgacaaaattaccgttgatgggaaaatccttacataaaacaattgaacgaaatcaggtaaaaacagcaaaaaaattgcctggaccagttccggcgctggtaattacagcgtttgtcgcccgtcgcttactgcgctttcgtcatatgcttgcctgtcgtcgtcgcgggttaattgttttaaccgaccgttatccgcaggaccagattcctggcgcttatgatggtacggtgtttccgcctaacgttgaaggtggtcgttttgtctcatggctggcaagtcaggaacgtaaagcatttcactggatggcgagccacaagcccgatctggtcatcaaactcaatgttgaccttgaagttgcctgcgcgcgtaaacccgaccataaacgggaatcgctggcgaggaagattgccataacgccacagttaacctttggtggtgcacaactggttgatatcgacgccaatcagccactggaaaaggtgctggttgatgcagaaaaagcgattacggattttatgaccgcgcgtggttatcactag

SEQ ID NO: 7094 - protein, 230 aa, Escherichia coli
MQSIIPPLIAVIGSDGSGKSTVCEHLITVVEKYGAAERVHLGKQAGNVGRAVTKLPLMGKSLHKTIERNQVKTAKKLPGPVPALVITAFVARRLLRFRHMLACRRRGLIVLTDRYPQDQIPGAYDGTVFPPNVEGGRFVSWLASQERKAFHWMASHKPDLVIKLNVDLEVACARKPDHKRESLARKIAITPQLTFGGAQLVDIDANQPLEKVLVDAEKAITDFMTARGYH

SEQ ID NO: 7095 - DNA, 1500 bp, Escherichia coli
atgctaaatttatttgttggccttgatatatatacggggcttttgttattacttgctctggcatttgtgttgttctatgaagcaatcaatggttttcatgacacggcgaatgcggtggcaaccgttatttatacccgtgccatgcaaccacagcttgctgtggtcatggcggcattttttaacttttttggcgtattgcttggcgggcttagcgttgcctatgccatcgtccatatgttgccaaccgatttgttgctgaatatggggtcaactcacggtctggcgatggtcttttccatgctgctggcggcgattatctggaacctgggaacgtggttctttggtttaccggcctccagttcgcacactttgattggtgcgattatcggcattggtttaaccaacgcgctgttaaccggctcgtcggtgatggatgcgttaaacctgcgcgaagtcaccaagattttctcttcactcattgtctctcccatcgtggggctggtgattgcgggggggctaatttttctgctacgccgtttctggagtgggacgaaaaagcgtgaccgtattcatcgtattcctgaagatcgcaaaaagaaaaaaggcaaacgtaagccgccattctggacgcgtattgccctcattgtttccgctgcgggcgtggcgttttcgcacggcgcgaacgacgggcagaaaggaattggtctggtgatgctggtgctggtggggattgctcccgccgggtttgtcgtcaatatgaatgcgtccggctatgaaattacccgtacccgcgatgccgtcaccaacttcgaacactacctgcaacagcatcctgaactgccgcagaagttgattacgatggaacctccattgcctgcggcatcgactgatggcgcgcaagtgacggagtttcactgtcatccggcaaatacctttgatgcgattgcgcgcgttaaaacgatgctgccaggcaatatggaaagttacgagccgttaagcgtgagtcagcgcagccagctgcgccgcattatgctgtgcatctctgatacctccgcgaagctggcgaaactgccaggcgtcagtaaagaagaccagaacctgctgaaaaaactgcgcagcgatatgttaagcaccattgagtacgcaccggtatggatcatcatggcggtagcactggcgctcggcatcggcaccatgattggctggcgtcgtgtagcgatgaccatcggtgagaagattggtaagcgcggcatgacgtatgcgcaaggcatggcggcacaaatgacggcggcagtgtctatcggccttgccagttatattgggatgcccgtctccacaacacacgtactctcatctgccgtagcaggaacgatggtggtggacggcggtgggttacagcgtaaaacggtaaccagcatcctgatggcgtgggtatttactttaccggcggcgatttttctttctggtgggttgtactggatagcattgcagttgatttaa

SEQ ID NO: 7096 - protein, 499 aa, Escherichia coli
MLNLFVGLDIYTGLLLLLALAFVLFYEAINGFHDTANAVATVIYTRAMQPQLAVVMAAFFNFFGVLLGGLSVAYAIVHMLPTDLLLNMGSTHGLAMVFSMLLAAIIWNLGTWFFGLPASSSHTLIGAIIGIGLTNALLTGSSVMDALNLREVTKIFSSLIVSPIVGLVIAGGLIFLLRRFWSGTKKRDRIHRIPEDRKKKKGKRKPPFWTRIALIVSAAGVAFSHGANDGQKGIGLVMLVLVGIAPAGFVVNMNASGYEITRTRDAVTNFEHYLQQHPELPQKLITMEPPLPAASTDGAQVTEFHCHPANTFDAIARVKTMLPGNMESYEPLSVSQRSQLRRIMLCISDTSAKLAKLPGVSKEDQNLLKKLRSDMLSTIEYAPVWIIMAVALALGIGTMIGWRRVAMTIGEKIGKRGMTYAQGMAAQMTAAVSIGLASYIGMPVSTTHVLSSAVAGTMVVDGGGLQRKTVTSILMAWVFTLPAAIFLSGGLYWIALQLI

SEQ ID NO: 7097 - DNA, 1863 bp, Escherichia coli
gtgatgagcaaaggaacgaccagccaggatgccccgttcgggacattattgggctacgccccaggtggggtagcaatctactcttcagattacagttctctcgatccgcaggaatacgaagatgacgccgtattccgtagctatatcgacgatgaatatatgggccacaaatggcaatgcgttgaatttgctcgccgttttctctttctgaactacggtgtagtcttcactgacgtgggtatggcatgggagattttctcactgcgcttcctgcgtgaagtggtcaatgacaacatcctgccattgcaggcatttcctaacggttcgccgcgtgcaccggtagcgggggcgcttcttatctgggataaaggcggtgaatttaaagacactggccatgtcgccatcattacccaattgcatggcaacaaagtccgtattgcggaacagaacgtgattcataccccgttgccgcaaggacaacagtggacacgcgagctggagatggtggtcgaaaacggcggctataccctgaaagacaccttcgatgacaccactattctgggctggatgatccagacggaagataccgaatacagcttgccacagccggaaattgcaggcgaactgctgaaaatcagcggggcgcgtctggaaaacaaaggccagtttgacggtaaatggctggatgaaaaagatccgctgcaaaacgcctatgtacaggccaacggtcaggtgatcaatcaggatccgtatcattactacaccattaccgagagcgccgagcaggagttgattaaagccaccaacgagctgcacctgatgtatcttcacgccaccgacaaggtgctgaaagatgacaacctgctggcgttgttcgacattccgaaaatcctctggccacgtttgcgtctctcctggcagcgtcgccgtcatcatatgatcactggtcgtatggatttctgcatggatgaacgtggcctgaaagtctacgaatacaacgccgattctgcctcctgtcataccgaagcgggcttgatcctcgaacgttgggcggagcagggctataaaggcaacggcttcaatcctgcggaaggactgattaacgaactggctggtgcctggaaacacagtcgtgcacgtccgtttgtccatatcatgcaggacaaagatatcgaggaaaactatcacgcgcagtttatggagcaggcgctgcaacaagcaggctttgaaacgcgtattttacgcgggttagaggaactgcgttgggatgctgccgggcaactgattgatggagaagggcgacaggttaactgcgtatggaaaacctgggcgtgggaaacggcatttgatcaaatccgcgaagtgagcgaccgtgaatttgccgcagtgccgattcggaccggtcatccgcaaaatgaagtgcgtcttatcgacgtattgctgcgcccggaagtgctggtctttgagccgctgtggacggtgatccccggcaacaaagcgattctgccgatcctctggtcgctgttcccgcaccatcgttatctgttggatactgacttcaccgtgaatgatgagctggttaaaaccggttatgccgttaaaccgattgccgggcgctgtggtagcaacattgacctggtcagccatcatgaagaggtgctggacaaaaccagtggtaaatttgccgaacagaaaaatatttaccagcaactgtggtgtttgccgaaagtggacggtaaatacattcaggtatgtactttcaccgttggcggcaactacggtgggacgtgtttgcgcggtgatgaatcactggtcatcaaaaaagagagtgatattgaaccgttaattgtggtgaaagagtaa

SEQ ID NO: 7098 - protein, 620 aa, Escherichia coli
MMSKGTTSQDAPFGTLLGYAPGGVAIYSSDYSSLDPQEYEDDAVFRSYIDDEYMGHKWQCVEFARRFLFLNYGVVFTDVGMAWEIFSLRFLREVVNDNILPLQAFPNGSPRAPVAGALLIWDKGGEFKDTGHVAIITQLHGNKVRIAEQNVIHTPLPQGQQWTRELEMVVENGGYTLKDTFDDTTILGWMIQTEDTEYSLPQPEIAGELLKISGARLENKGQFDGKWLDEKDPLQNAYVQANGQVINQDPYHYYTITESAEQELIKATNELHLMYLHATDKVLKDDNLLALFDIPKILWPRLRLSWQRRRHHMITGRMDFCMDERGLKVYEYNADSASCHTEAGLILERWAEQGYKGNGFNPAEGLINELAGAWKHSRARPFVHIMQDKDIEENYHAQFMEQALQQAGFETRILRGLEELRWDAAGQLIDGEGRQVNCVWKTWAWETAFDQIREVSDREFAAVPIRTGHPQNEVRLIDVLLRPEVLVFEPLWTVIPGNKAILPILWSLFPHHRYLLDTDFTVNDELVKTGYAVKPIAGRCGSNIDLVSHHEEVLDKTSGKFAEQKNIYQQLWCLPKVDGKYIQVCTFTVGGNYGGTCLRGDESLVIKKESDIEPLIVVKE

SEQ ID NO: 7099 - DNA, 915 bp, Escherichia coli
gtgacctgctacactgcttcaacactaccactcagaaggcaactcactatgacagacaatacttatcagcccgcgaaagtctggacgtgggataaatccgctggcggcgcgttcgccaatatcaatcgcccggtttctggtccgacgcatgaaaaaacgctgccggtgggcaaacatccattgcaactttattcgctgggaacgccgaacggtcagaaagtaacgattatgcttgaggagctgctggcactgggcgttactggtgcagagtacgacgcctggctgattcgcattggcgatggcgatcaattctccagcggctttgtcgaagtgaacccgaattcgaagatcccggcattgcgcgatcatacccataatccgccgatccgcgtgtttgagtcaggctcgattctgctttatctggcggagaaatttggctacttcttgccgcaggatctggcaaagcgtactgaaacgatgagctggctgttctggttacagggcgcggcaccgttcctcggcggtggttttggtcacttttaccattacgcgccggtgaaaattgagtacgccatcaaccgctttactatggaagccaagcgccttctcgacgtgctggataagcaactggcgcagcataagtttgttgcgggcgatgagtacaccattgcggatatggcgatttggccatggtttggcaatgtggtgttaggcggcgtatatgatgccgcagagtttcttgatgcgggcagttataagcatgtacaacgctgggcgaaagaagtgggcgaacgtccggcagtgaagcgtgggcgtattgttaaccgcatcaacggaccgctgaacgagcagttgcatgaacgccatgacgccagtgatttcgagacgaatacggaagataagcgtcaggggtaa

SEQ ID NO: 7100 - protein, 304 aa, Escherichia coli
MTCYTASTLPLRRQLTMTDNTYQPAKVWTWDKSAGGAFANINRPVSGPTHEKTLPVGKHPLQLYSLGTPNGQKVTIMLEELLALGVTGAEYDAWLIRIGDGDQFSSGFVEVNPNSKIPALRDHTHNPPIRVFESGSILLYLAEKFGYFLPQDLAKRTETMSWLFWLQGAAPFLGGGFGHFYHYAPVKIEYAINRFTMEAKRLLDVLDKQLAQHKFVAGDEYTIADMAIWPWFGNVVLGGVYDAAEFLDAGSYKHVQRWAKEVGERPAVKRGRIVNRINGPLNEQLHERHDASDFETNTEDKRQG

SEQ ID NO: 7101 - DNA, 249 bp, Escherichia coli
atgtgtattggcgttccaggccaggtgctggctgtcggtgaagatattcaccagcttgcgcaggttgaagtatgtggtatcaagcgcgacgtgaatatcgccctgatttgtgaaggtaaccctgccgatctgctgggccagtgggtactggtacacgtcggatttgccatgagcattatcgatgaagacgaagccaaagccacattagacgcactgcgccaaatggattacgacattaccagcgcgtga

SEQ ID NO: 7102 - protein, 82 aa, Escherichia coli
MCIGVPGQVLAVGEDIHQLAQVEVCGIKRDVNIALICEGNPADLLGQWVLVHVGFAMSIIDEDEAKATLDALRQMDYDITSA

SEQ ID NO: 7103 - DNA, 342 bp, Escherichia coli
atgcatgagttgtcgctttgccagagcgccgttgaaattatccaacggcaggcggagcagcacgatgttaagcgcgtcaccgccgtgtggctggaaattggtgcactctcctgcgttgaggagagcgccgtccgttttagttttgaaattgtctgccacggaacggtagcgcaagggtgcgatttacatatcgtctataaacccgcccaggcctggtgttgggattgcagccaggtggtggagattcatcagcacgatgcgcagtgtccgatctgtcatggcgagcggttgcgtgtcgataccggcgattcgctaatcgtcaaaagtattgaagttgaataa

SEQ ID NO: 7104 - protein, 113 aa, Escherichia coli
MHELSLCQSAVEIIQRQAEQHDVKRVTAVWLEIGALSCVEESAVRFSFEIVCHGTVAQGCDLHIVYKPAQAWCWDCSQVVEIHQHDAQCPICHGERLRVDTGDSLIVKSIEVE

SEQ ID NO: 7105 - DNA, 489 bp, Escherichia coli
atgactgaagagatagcaggtttccagacctccccgaaggtgcaagtacaggcagcttttgaagaaattgcccggcgttcgatgcatgatctctcttttctgcatccttcaatgccggtgtatgtttctgactttacgctgttcgaaggtcagtggacggggtgtgtgatcaccccgtggatgctgagtgcagttatcttccccggcccggatcaactctggccgctgcgcaaagtgagtgaaaaaattggtctgcaactgccgtatggcactatgacctttactgttggtgaactggatggtgtttcgcaatacctctcctgctcgctgatgtcgccgctttcgcacagcatgtcgattgaagagggccaacggctgacggatgactgcgcccgaatgatcctttcgctgccagtcaccaatccggatgtaccacacgcagggcgtcgtgccctgctatttggccgcaggagtggcgaaaatgcatga

SEQ ID NO: 7106 - protein, 162 aa, Escherichia coli
MTEEIAGFQTSPKVQVQAAFEEIARRSMHDLSFLHPSMPVYVSDFTLFEGQWTGCVITPWMLSAVIFPGPDQLWPLRKVSEKIGLQLPYGTMTFTVGELDGVSQYLSCSLMSPLSHSMSIEEGQRLTDDCARMILSLPVTNPDVPHAGRRALLFGRRSGENA

SEQ ID NO: 7107 - DNA, 462 bp, Escherichia coli
ttgctgaccgatgaagccatcggtgtgcggattgttgaagcgttagagcaacgatacattctgccggattatgttgagatcctcgatggcggcacggcgggaatggagctgcttggcgacatggcaaatcgcgatcatctgattattgcggatgccattgtctcgaaaaagaacgcgccgggaacgatgatgatcctgcgggatgaagaagttccggcgttgtttaccaacaaaatctctccgcatcagcttggcctggccgacgtattgtcggccctgcgcttcaccggcgagtttccgaaaaagctgaccctggtcggcgtgatcccggaatcactggagccgcacatcggtttgacgccgacggtcgaagcgatgattgaacctgcgcttgagcaggttctggctgcgctgcgcgaatcaggcgtggaagctatcccacgggaggcgactcatgactga

SEQ ID NO: 7108 - protein, 153 aa, Escherichia coli
MLTDEAIGVRIVEALEQRYILPDYVEILDGGTAGMELLGDMANRDHLIIADAIVSKKNAPGTMMILRDEEVPALFTNKISPHQLGLADVLSALRFTGEFPKKLTLVGVIPESLEPHIGLTPTVEAMIEPALEQVLAALRESGVEAIPREATHD

SEQ ID NO: 7109 - DNA, 1704 bp, Escherichia coli
atgagccagagaattactattgatccggtaacccgtattgaagggcatttacgcatcgattgcgaaatcgaaaatggcgtcgtttcgaaagcatgggcttccggtaccatgtggcgcggcatggaagagatcgtgaaaaaccgcgatccgcgcgatgcatggatgattgtgcaacgtatctgtggcgtatgtactaccactcacgcgctgtcttccgttcgtgcggcagaaagtgcgctgaatatcgacgttccggttaacgcgcaatacatccgtaacatcattctggctgcgcacaccacgcatgaccatattgttcatttctatcagctttcggcgctggactgggtggacatcacttctgcactgcaagccgatccgaccaaagcctccgaaatgctgaaaggcgtttcgacctggcatctgaacagcccggaagagttcaccaaagttcagaacaagatcaaagatctggttgccagcggtcagttgggtattttcgccaatggctactggggtcacccggcaatgaaactgccgccggaagtgaacctgattgcggtagcgcactacctgcaggcgctggagtgccagcgtgacgctaaccgcgttgtggcgctgctgggcggtaaaacgccgcatattcagaacctggcggtaggtggtgtcgcgaacccgatcaacctcgacggtctgggtgtgctgaaccttgagcgcctgatgtacatcaagtccttcatcgacaagctgagcgactttgttgagcaggtttacaaggttgatactgcagttatcgctgcgttctacccggaatggctgacgcgcggtaaaggtgcggtgaactacctgagcgtgccggaattcccgaccgacagtaaaaatggcagcttcctgttcccgggcggctacattgagaatgcggatctgtcctcgtatcgtccgatcacttctcattccgatgaatacctgatcaaagggattcaggaaagcgcgaagcactcctggtataaagacgaagcgccgcaggcaccgtgggaaggtaccaccattccggcttatgatggttggtctgacgacggtaaatattcctgggtgaaatcaccgactttctacggcaaaacggtagaagtgggtccgctggctaatatgctggtgaaactggcggcaggacgcgagtctacccagaacaaactgaatgaaatcgttgcgatttatcagaaactgactggcaacacgctggaagtggcgcagttgcactccacgctgggccgtattattggtcgtaccgttcactgctgtgaattgcaggatatcctgcaaaatcaatacagtgcactgatcaccaatatcggcaaaggcgatcacaccacctttgtgaagccgaacattccggcaacgggtgagttcaaaggcgtaggcttcctcgaagcaccgcgcggtatgctctctcactggatggtgatcaaagacggtatcatcagcaactaccaggcagttgttccatcaacctggaactctggcccgcgtaacttcaatgatgacgtcggtccttacgagcagtcgctggtgggtacaccggttgccgatccgaataaaccgctggaagtggtgcgtaccattcactccttcgacccgtgcatggcctgtgcggtacacgtagtggatgccgacggcaacgaagtggtttcagtgaaggttctgtaa

SEQ ID NO: 7110 - protein, 567 aa, Escherichia coli
MSQRITIDPVTRIEGHLRIDCEIENGVVSKAWASGTMWRGMEEIVKNRDPRDAWMIVQRICGVCTTTHALSSVRAAESALNIDVPVNAQYIRNIILAAHTTHDHIVHFYQLSALDWVDITSALQADPTKASEMLKGVSTWHLNSPEEFTKVQNKIKDLVASGQLGIFANGYWGHPAMKLPPEVNLIAVAHYLQALECQRDANRVVALLGGKTPHIQNLAVGGVANPINLDGLGVLNLERLMYIKSFIDKLSDFVEQVYKVDTAVIAAFYPEWLTRGKGAVNYLSVPEFPTDSKNGSFLFPGGYIENADLSSYRPITSHSDEYLIKGIQESAKHSWYKDEAPQAPWEGTTIPAYDGWSDDGKYSWVKSPTFYGKTVEVGPLANMLVKLAAGRESTQNKLNEIVAIYQKLTGNTLEVAQLHSTLGRIIGRTVHCCELQDILQNQYSALITNIGKGDHTTFVKPNIPATGEFKGVGFLEAPRGMLSHWMVIKDGIISNYQAVVPSTWNSGPRNFNDDVGPYEQSLVGTPVADPNKPLEVVRTIHSFDPCMACAVHVVDADGNEVVSVKVL

SEQ ID NO: 7111 - DNA, 1179 bp, Escherichia coli
atgagtcatgatccacaaccgctgggcggcaaaatcatcagtaaaccggtcatgatttttggaccgttaatcgtcatctgtatgctcctgattgtgaagcgtctggtgttcggtctgggctctgtctccgacctgaacggcggcttcccgtggggcgtgtggatcgcgtttgacctgctgatcggtaccggctttgcctgtggcggctgggcgctggcgtgggcagtatacgtctttaaccgtgggcaataccatccgctggtgcgtccggcgctgttggcgagtctgtttggttattcactgggtggcttgtcgatcactatcgacgtgggtcgctactggaacctgccgtacttctacattccgggtcacttcaacgtgaactcggtactgttcgagacggcggtctgtatgaccatctacatcggtgtgatggcactggagtttgctccggcattgtttgaacgtctgggctggaagctgtcactcaaacgtctgaacaaggtgatgttctttatcatcgcgcttggtgcgctgctgccaactatgcaccagtcttcaatgggatcgctgatgatctcggcgggctacaaggtgcatccgctgtggcaaagctatgaaatgttgccgctgttctcgctgctgacggcgttcatcatgggcttctcgattgtcatctttgaaggttcgttggtgcaggcgggtctgcgtggcaacggtccggatgaaaagagtctgttcgttaagctgaccaataccatcagtgtgttgctggcgattttcatcgtgctgcgctttggcgagcttatctatcgcgacaagctgtcgttagcgtttgccggtgacttctactccgtgatgttctggattgaagtcctgctgatgctcttcccgctggtcgttctgcgtgtggcgaagttgcgtaatgattcccgcatgctgttcctgtcagcactgagtgcactgttaggttgtgcaacctggcgtctgacctattcgctggtggcattcaacccgggtggcggttacgcctacttcccgacctgggaagaactgttgatttctattggttttgtggctattgagatttgcgcttatatcgtactcattcgtctactgccgatacttcctcctttaaaacaaaacgatcataatcgtcatgaggcgagcaaagcatga

SEQ ID NO: 7112 - protein, 392 aa, Escherichia coli
MSHDPQPLGGKIISKPVMIFGPLIVICMLLIVKRLVFGLGSVSDLNGGFPWGVWIAFDLLIGTGFACGGWALAWAVYVFNRGQYHPLVRPALLASLFGYSLGGLSITIDVGRYWNLPYFYIPGHFNVNSVLFETAVCMTIYIGVMALEFAPALFERLGWKLSLKRLNKVMFFIIALGALLPTMHQSSMGSLMISAGYKVHPLWQSYEMLPLFSLLTAFIMGFSIVIFEGSLVQAGLRGNGPDEKSLFVKLTNTISVLLAIFIVLRFGELIYRDKLSLAFAGDFYSVMFWIEVLLMLFPLVVLRVAKLRNDSRMLFLSALSALLGCATWRLTYSLVAFNPGGGYAYFPTWEELLISIGFVAIEICAYIVLIRLLPILPPLKQNDHNRHEASKA

SEQ ID NO: 7113 - DNA, 987 bp, Escherichia coli
gtgaacagacgtaattttattaaagcagcctcctgcggggcattgctgacgggcgcgctgccgtctgtcagtcatgcggctgctgaaaaccgcccgccaattccgggatcgctggggatgttgtacgactcgaccttgtgcgtaggctgccaggcttgcgtcaccaagtgtcaggatatcaacttccctgaacgtaacccgcaaggggaacagacctggtcgaacaacgacaaactgtcgccgtataccaataacatcattcaggtgtggaccagcggcacaggggtcaacaaagaccaggaggagaatggctacgcgtacattaagaaacagtgtatgcactgcgtcgatccgaactgtgtctctgtgtgcccggtctctgcgctgaaaaaagatccgaaaaccggcattgtccattacgacaaagatgtgtgcaccggctgccgttactgcatggtcgcctgcccatacaacgtgccgaagtacgactacaacaacccgtttggtgcgctgcataagtgcgagttgtgcaaccagaaaggtgtggaacgtctcgataaaggcggtctgcctggctgcgtagaagtgtgcccggcgggcgcggtgatttttggtacgcgtgaagagctgatggcggaggcgaaaaaacgtctggcgctgaagccgggcagcgaataccactatccgcgtcagacgctgaaatctggcgacacttacctgcatacggtgccgaaatattatccgcatctgtacggcgagaaagagggcggcggtactcaggttctggtactgacgggtgtgccttatgaaaatctcgacctgccgaaactggacgatctttctactggtgcgcgttccgaacatgtccaacacaccctgtataaaggcatgatgctaccactggctgtgctggcgggcttaaccgtgctggttcgtcgcaacactaaaaacgaccatcacgacggaggagacgatcatgagtcatga

SEQ ID NO: 7114 - protein, 328 aa, Escherichia coli
MNRRNFIKAASCGALLTGALPSVSHAAAENRPPIPGSLGMLYDSTLCVGCQACVTKCQDINFPERNPQGEQTWSNNDKLSPYTNNIIQVWTSGTGVNKDQEENGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKSGDTYLHTVPKYYPHLYGEKEGGGTQVLVLTGVPYENLDLPKLDDLSTGARSEHVQHTLYKGMMLPLAVLAGLTVLVRRNTKNDHHDGGDDHES

SEQ ID NO: 7115 - DNA, 1119 bp, Escherichia coli
atgactggagataacaccctcatccattctcacggcattaaccgtcgtgatttcatgaagctttgtgcagcattagccgccaccatggggttaagtagcaaagccgctgcagagatggccgaatcggttactaacccgcagcgtccgccagttatctggattggcgcgcaggagtgcaccggttgtacggaatctctgcttcgtgcaacgcatccaacggtagaaaacctcgtgctggagactatctctctggagtatcacgaagtgctttccgccgccttcggtcatcaggtcgaagagaacaaacataacgctctcgagaagtacaaagggcagtatgtgttagtggtggatggttccatcccattaaaagataacggtatttattgcatggttgccggtgagccgattgtggatcacatccgcaaagcggcggaaggcgcagcagccattatcgctatcggttcctgctctgcgtggggcggtgttgccgcagctggagttaacccaactggcgcagtcagcctgcaagaagttctaccgggcaaaaccgttatcaatattcctggctgcccgccgaacccgcacaacttcctcgcgaccgttgcgcacatcatcacttacggcaaaccgccgaaactggatgacaaaaaccgtccgactttcgcctatggtcgtctgattcacgaacactgtgaacgtcgcccgcacttcgatgctggtcgttttgccaaagagttcggtgatgaaggtcaccgcgaaggctggtgcctgtaccacctcggctgtaaagggccagaaacttacggcaactgctcaacgctgcaattctgcgatgttggcggcgtgtggccggtagcgattggtcacccgtgctatggctgtaacgaagaaggtatcggcttccataaaggcatccatcagcttgccaacgtcgaaaaccagactccgcgttcacagaaaccggacgttaacgctaaagaaggcggcaacgtctcggcaggcgctattggtttgctcggcggtgtggttgggctggttgccggtgtcagcgtgatggcggtgcgtgaactgggtcgtcagcaaaagaaagataacgctgactcacggggagaataa

SEQ ID NO: 7116 - protein, 372 aa, Escherichia coli
MTGDNTLIHSHGINRRDFMKLCAALAATMGLSSKAAAEMAESVTNPQRPPVIWIGAQECTGCTESLLRATHPTVENLVLETISLEYHEVLSAAFGHQVEENKHNALEKYKGQYVLVVDGSIPLKDNGIYCMVAGEPIVDHIRKAAEGAAAIIAIGSCSAWGGVAAAGVNPTGAVSLQEVLPGKTVINIPGCPPNPHNFLATVAHIITYGKPPKLDDKNRPTFAYGRLIHEHCERRPHFDAGRFAKEFGDEGHREGWCLYHLGCKGPETYGNCSTLQFCDVGGVWPVAIGHPCYGCNEEGIGFHKGIHQLANVENQTPRSQKPDVNAKEGGNVSAGAIGLLGGVVGLVAGVSVMAVRELGRQQKKDNADSRGE

SEQ ID NO: 7117 - DNA, 288 bp, Escherichia coli
atgaataaccattttggtaaaggcttaatggcgggattaaaagcaacgcatgctgacagtgcggttaatgtgacaaaattctgtgccgattataaacgcggttttgtattaggctactcacaccggatgtacgaaaagaccggagatcgccagcttagcgcctgggaagcgggtattctgacgcgccgttatggactggataaagagatggtaatggatttctttcgtgagaataattcctgttctacgttgcgcttttttatggccggttatcgcctagaaaattga

SEQ ID NO: 7118 - protein, 95 aa, Escherichia coli
MNNHFGKGLMAGLKATHADSAVNVTKFCADYKRGFVLGYSHRMYEKTGDRQLSAWEAGILTRRYGLDKEMVMDFFRENNSCSTLRFFMAGYRLEN

SEQ ID NO: 7119 - DNA, 888 bp, Escherichia coli
atgccgcgtttaaccgccaaagatttcccacaagagttgctggattactacgactattacgctcacgggaaaatctcgaaacgtgagttcctcaaccttgcggcgaagtatgcagtgggcgggatgacggcattagcgctgtttgatttgctcaagccaaattatgcgctggcgactcaggtagagtttaccgacccggaaattgttgcagagtacatcacgtatccctcgccaaatggtcacggcgaggtacggggttatctggtgaagcccgcaaaaatgagcggcaaaacgccagccgtggtagtggtgcatgagaatcgagggctgaatccgtatatcgaagatgtgacgcggcgagtggcgaaggcggggtacatcgccctggcgccagacggtttaagctcagtaggtggctatcctggtaacgatgataaaggccgcgaactgcaacagcaggttgatccaaccaaactgatgaatgatttctttgccgcaattgagtttatgcaacgctatccgcaagcgacaggcaaagtgggtattagcggattttgctatggcgggggcgtatcgaacgcggcagcagtcgcgtatccggaactggcctgcgcggtgccgttttatgggcgtcaggcacccactgccgatgtggcgaagattgaagcgcctttactgctccactacgctgaactggatagccgaatcaacgagggctggcccgcttacgaggcggcgttgaaagccaataataaggtctatgaggcgtatatatatccggaggttaatcacggattccataatgattccacgccccgttatgacaaatctgccgccgatcttgcctggcaaaggacgctgaaatggttcgataaatatctctcctga

SEQ ID NO: 7120 - protein, 295 aa, Escherichia coli
MPRLTAKDFPQELLDYYDYYAHGKISKREFLNLAAKYAVGGMTALALFDLLKPNYALATQVEFTDPEIVAEYITYPSPNGHGEVRGYLVKPAKMSGKTPAVVVVHENRGLNPYIEDVTRRVAKAGYIALAPDGLSSVGGYPGNDDKGRELQQQVDPTKLMNDFFAAIEFMQRYPQATGKVGISGFCYGGGVSNAAAVAYPELACAVPFYGRQAPTADVAKIEAPLLLHYAELDSRINEGWPAYEAALKANNKVYEAYIYPEVNHGFHNDSTPRYDKSAADLAWQRTLKWFDKYLS

SEQ ID NO: 7121 - DNA, 1041 bp, Escherichia coli
atggtctggttagcgaatcccgaacgttacgggcggatgcagtaccgctattgcggaaaaagtggtttacgcctgcccgcgttatcgctcggtttatggcacaatttcggtcacgttaacgcgctggaatcacagcgtgcgatcctgcgtaaagcgtttgatttaggcattacgcactttgatttagccaacaattacgggccgcctccaggaagcgcagaagaaaactttggtcgcctgctgcgcgaggattttgccgcttatcgcgatgaactgattatctctaccaaagccggatacgatatgtggcccggtccatacggctctggcggctcacgtaaatacctgctcgccagcctcgaccaaagcctgaagcgtatggggcttgagtatgtcgatatcttttactctcatcgcgtcgatgaaaatacgccgatggaagaaaccgcctctgcgctggctcattcggtacaaagcggtaaggcgctgtatgtcgggatctcctcttactcgccagagcggacgcaaaaaatggtcgagttgctgcgcgagtggaaaattccgctgttaattcatcaaccttcgtacaatttactgaaccgctgggtggataaaagcggcctgctggataccctgcaaaataacggcgtgggctgcattgcctttactccactggctcagggattgctgaccggaaaatatctcaacggtattccgcaagattcacggatgcatcgtgaagggaataaagttcgtggtctgacgccgaaaatgctcaccgaagccaacctcaacagcctgcgcttattgcatgaaatggcacagcagcgtggacaatcaatggcgcaaatggcgttaagctggttgctgaaagatgagcgagtgacgtcggtattgattggtgccagccgcgcggagcaacttgaggagaacgtgcaggcgctgaataatctgacatttagcaccgaggagctggcgcagattgatcagcatatcgccgatggagagctgaatctgtggcaggcgtcttccgataaatga

SEQ ID NO: 7122 - protein, 346 aa, Escherichia coli
MVWLANPERYGRMQYRYCGKSGLRLPALSLGLWHNFGHVNALESQRAILRKAFDLGITHFDLANNYGPPPGSAEENFGRLLREDFAAYRDELIISTKAGYDMWPGPYGSGGSRKYLLASLDQSLKRMGLEYVDIFYSHRVDENTPMEETASALAHSVQSGKALYVGISSYSPERTQKMVELLREWKIPLLIHQPSYNLLNRWVDKSGLLDTLQNNGVGCIAFTPLAQGLLTGKYLNGIPQDSRMHREGNKVRGLTPKMLTEANLNSLRLLHEMAQQRGQSMAQMALSWLLKDERVTSVLIGASRAEQLEENVQALNNLTFSTEELAQIDQHIADGELNLWQASSDK

SEQ ID NO: 7123 - DNA, 525 bp, Escherichia coli
ttgcccgttttaactacacgacaggaatgtatggaacgttttcttgaaaatgcaatgtatgcttctcgctggctgcttgcccccgtgtactttggcctttcgctggcgttagttgccctggcgctgaagttcttccaggagattattcacgtactgccgaatatcttctcgatggcggaatcagatttgatcctcgtgttgctgtcgctggtggatatgacgctggttggcggtttgctggtgatggtgatgttttccggttacgagaatttcgtctcacaactcgatatctccgagaacaaagagaagctgaactggctggggaaaatggacgcaacgtcgctgaaaaacaaagtagcagcgtcgattgtggcaatttcttccattcacttactgcgcgtctttatggatgcgaaaaatgtccctgataacaaactgatgtggtacgtcattatccatctgacgtttgtgctctctgcatttgtgatgggctatcttgaccgactgactcgtcataatcactga

SEQ ID NO: 7124 - protein, 174 aa, Escherichia coli
MPVLTTRQECMERFLENAMYASRWLLAPVYFGLSLALVALALKFFQEIIHVLPNIFSMAESDLILVLLSLVDMTLVGGLLVMVMFSGYENFVSQLDISENKEKLNWLGKMDATSLKNKVAASIVAISSIHLLRVFMDAKNVPDNKLMWYVIIHLTFVLSAFVMGYLDRLTRHNH

SEQ ID NO: 7125 - DNA, 885 bp, Escherichia coli
atgtctcatttaaaagacccgaccacgcagtattacactggtgaatatcccaaacagaaacaaccgacgccaggcatccaggcgaagatgacaccggtaccggattgcggcgagaaaacctatgttggtagcggtcgcctgaaagatcgtaaagcactggtgacagggggcgattccggaatcggtcgcgctgccgccattgcttacgcgcgtgaaggggctgacgtggcgatcagttatcttcccgtggaagaagaagacgctcaggatgtgaaaaagatcattgaagaatgcggacgcaaagccgttctgctgccaggcgatttaagcgatgagaaattcgcccgttcgctggttcacgaagcacacaaggcgttaggcgggctggatattatggcgctggtagccgggaaacaggttgccattcctgatattgcagacctcaccagcgaacagtttcaaaagacctttgccattaacgttttcgcgttgttctggctaacccaggaagcgatccccctgctaccgaaaggtgcaagtatcatcaccacttcctcaatccaggcataccagccaagcccgcatttactggactatgcggctacgaaggcggcaattctgaactatagccgtggcctggcaaaacaggtcgcggagaaaggtattcgggtgaatattgtcgcgccaggcccgatctggacagcactgcaaatttctggcggacaaacgcaggataagatcccgcagtttggtcagaaaacgccgatgaagcgtgcggggcaaccggcggagctggcccctgtatatgtttacctggcaagtcaggagtcgagctacgtcaccgcagaagtgcacggtgtctgcggcggcgagcatttaggttaa

SEQ ID NO: 7126 - protein, 294 aa, Escherichia coli
MSHLKDPTTQYYTGEYPKQKQPTPGIQAKMTPVPDCGEKTYVGSGRLKDRKALVTGGDSGIGRAAAIAYAREGADVAISYLPVEEEDAQDVKKIIEECGRKAVLLPGDLSDEKFARSLVHEAHKALGGLDIMALVAGKQVAIPDIADLTSEQFQKTFAINVFALFWLTQEAIPLLPKGASIITTSSIQAYQPSPHLLDYAATKAAILNYSRGLAKQVAEKGIRVNIVAPGPIWTALQISGGQTQDKIPQFGQKTPMKRAGQPAELAPVYVYLASQESSYVTAEVHGVCGGEHLG

SEQ ID NO: 7127 - DNA, 426 bp, Escherichia coli
atggcgatgcatcttaacgaaaacctcgacgataacggcgaaatgcatgatatcaacgtgacgccgtttatcgacgtgatgttggttttgctgattatctttatggtggcggcaccgttagcgacggtagatgtgaaggtgaatttgcctgcttctaccagcacgccgcagccgcgcccggaaaaaccggtttatctgtcggtgaaagcagacaactcgatgtttattggtaacgatccggtcaccgatgaaacaatgattacggcgttgaatgcgttaaccgaaggcaagaaagacaccaccatcttcttccgtgcggataaaactgtcgattacgagacgttgatgaaggtaatggatacgctgcatcaggcgggttacctgaaaataggtctggtcggcgaagaaactgcgaaagcgaaataa

SEQ ID NO: 7128 - protein, 141 aa, Escherichia coli
MAMHLNENLDDNGEMHDINVTPFIDVMLVLLIIFMVAAPLATVDVKVNLPASTSTPQPRPEKPVYLSVKADNSMFIGNDPVTDETMITALNALTEGKKDTTIFFRADKTVDYETLMKVMDTLHQAGYLKIGLVGEETAKAK

SEQ ID NO: 7129 - DNA, 735 bp, Escherichia coli
gtgggtaataatttaatgcagacggacctctccgtctggggtatgtatcagcacgccgatattgtcgttaagtgcgtgatgattgggcttattttggcctccgtagtcacctgggcaattttcttcagtaagagcgtggagttcttcaatcagaagcgtcgtcttaagcgcgagcagcaactgctggctgaagcgcgttccttaaaccaggccaacgatatcgccgctgattttggtagcaaaagcttgagcctgcatttgctcaatgaagcgcagaatgagctggaactgtcagaaggcagcgacgataacgaaggtattaaagaacgtaccagcttccgtctggagcgtcgggtcgccgcagtaggtcgtcaaatgggccgtggtaacggctatctggcaaccatcggcgcgatttcgccgttcgttggtctgtttggtacggtctggggcatcatgaacagctttattggtatcgcgcaaacgcagaccactaacctggcagtcgttgcgccaggtattgcagaagctctgttagcaacggcaatcggcctcgtggcagcgattcctgcggtcgttatctataacgtatttgcacgccagattggcggctttaaagcgatgctgggtgatgttgcagcgcaggtattgttgctgcaaagccgtgacctggatctggaagccagcgccgctgcgcatccggttcgtgtcgcacaaaaattacgtgcaggataa

SEQ ID NO: 7130 - protein, 244 aa, Escherichia coli
MGNNLMQTDLSVWGMYQHADIVVKCVMIGLILASVVTWAIFFSKSVEFFNQKRRLKREQQLLAEARSLNQANDIAADFGSKSLSLHLLNEAQNELELSEGSDDNEGIKERTSFRLERRVAAVGRQMGRGNGYLATIGAISPFVGLFGTVWGIMNSFIGIAQTQTTNLAVVAPGIAEALLATAIGLVAAIPAVVIYNVFARQIGGFKAMLGDVAAQVLLLQSRDLDLEASAAAHPVRVAQKLRAG

SEQ ID NO: 7131 - DNA, 1356 bp, Escherichia coli
ttgcatactgccgtacctttgctttcttttccttgcgtttacgcagtaaaaaaagtaaccagcacgccatttgcgaaaattttctgctttatgccaattcttcaggatgcgcccgcgaatattcatgctagtttagacatccagacgtataaaaacaggaatcccgacatggcggacaaaaagcttgatactcaactggtgaatgcaggacgcagcaaaaaatacacgctcggtgcggtaaatagcgtgattcagcgcgcgtcttcgctggtctttgacagtgtggaagccaaaaaacacgcgacacgtaatcgcgccaatggcgagttgttctatggacggcgtggaacgttaacccatttctccttacaacaagcgatgtgtgaactggaaggtggcgcaggctgtgtgctatttccctgcggggcggcagcggttgctaattccattcttgcttttgtcgaacagggcgatcatgtgttgatgaccaacaccgcctatgaaccgagtcaggatttctgtagcaaaatcctcagcaaactgggcgtaacgacatcgtggtttgatccgctgattggtgccgatatcgttaatcatctgcagccaaacactaaaatcgtgtttctggaatcgccaggttccatcaccatggaagtccacgatgttccggcgattgttgccgccgtacgcagtgtggtcccggatgccatcattatgatcgacaacacctgggcagccggtgtgctgtttaaggcgctggattttggcatcgatgtttctattcaggccgccaccaaatatctggttgggcattcagatgcgatgattggcactgccgtgtgcaatgcccgttgctgggagcagctgcgagagaatgcctatctgatgggccagatggtcgatgccgataccgcctatataaccagccgtggcctgcgcactttgggggttcgcctgcgtcaacatcatgaaagcagtctgaaagtggctgaatggctggcagaacatccccaagtagcacgagttaaccaccctgctctgcctggcagtaaaggatacgaattctggaaacgagactttacaggcagcagcgggctattttcctttgtgcttaagaaaaaactcaatgatgaagagctggcgaactatctggataacttcagtttattcagcatggcctactcgtggggcgggtatgaatcgttgatcctggcaaatcaaccagaacatatcgccgccattcgcccacaaggcaagatcgattttagcgggaccttgattcgcctgcatattggtctggaagatgtcgacgatctgattgccgatctggacgccggttttgcgcgaattgtataa

SEQ ID NO: 7132 - protein, 451 aa, Escherichia coli
MHTAVPLLSFPCVYAVKKVTSTPFAKIFCFMPILQDAPANIHASLDIQTYKNRNPDMADKKLDTQLVNAGRSKKYTLGAVNSVIQRASSLVFDSVEAKKHATRNRANGELFYGRRGTLTHFSLQQAMCELEGGAGCVLFPCGAAAVANSILAFVEQGDHVLMTNTAYEPSQDFCSKILSKLGVTTSWFDPLIGADIVNHLQPNTKIVFLESPGSITMEVHDVPAIVAAVRSVVPDAIIMIDNTWAAGVLFKALDFGIDVSIQAATKYLVGHSDAMIGTAVCNARCWEQLRENAYLMGQMVDADTAYITSRGLRTLGVRLRQHHESSLKVAEWLAEHPQVARVNHPALPGSKGYEFWKRDFTGSSGLFSFVLKKKLNDEELANYLDNFSLFSMAYSWGGYESLILANQPEHIAAIRPQGKIDFSGTLIRLHIGLEDVDDLIADLDAGFARIV

SEQ ID NO: 7133 - DNA, 660 bp, Escherichia coli
atggctgttattcaagatatcatcgctgcgctctggcaacacgactttgccgcgctggcggaccctcatattgttagcgttgtttactttgttatgtttgccacgctgtttttagaaaacggcttgctgcccgcctcatttttgccaggcgacagcttgttgatactggcaggcgcattgattgcccagggggttatggattttctgcctacgattgcgattctgaccgccgcagcaagtctgggctgctggctaagttatattcaggggcgctggttagggaataccaaaacggtgaaaggctggctggcacagcttcctgctaaatatcaccagcgcgccacctgcatgtttgaccgccacggtctgctggcgctgctggctggacgttttcttgcatttgtccgtacgctgctgccaaccatggcgggaatttccggtctgccaaaccgccgcttccagtttttcaactggttaagcggattgctgtgggtcagcgtggtaaccagtttcggctatgccttaagtatgattccgttcgttaaacgacatgaagatcaggtaatgacgttcctgatgatcctgccaattgccttgttaaccgctggcttgttgggcacgctgtttgtggtgattaaaaaaaaatactgtaacgcctga

SEQ ID NO: 7134 - protein, 219 aa, Escherichia coli
MAVIQDIIAALWQHDFAALADPHIVSVVYFVMFATLFLENGLLPASFLPGDSLLILAGALIAQGVMDFLPTIAILTAAASLGCWLSYIQGRWLGNTKTVKGWLAQLPAKYHQRATCMFDRHGLLALLAGRFLAFVRTLLPTMAGISGLPNRRFQFFNWLSGLLWVSVVTSFGYALSMIPFVKRHEDQVMTFLMILPIALLTAGLLGTLFVVIKKKYCNA

SEQ ID NO: 7135 - DNA, 1128 bp, Escherichia coli
atgcgggttggggtgtgcagattaaagttgttcattacttgctccctttgctgggtcaatatgagggcagagatcggtctgcctgatgtttttcattgtggtcgccagcgccgtacctctcaatgctcatttctgccaatgtcttgcctatttctccagagtgctggagaaatgctacaaaattgcgcacaatcaaattgccgcattattcctaagaaattacgcgatatgaaacgtgaagagatttgccgcttgctggcggataaagttaataaactgaaaaataaagaaaatagtttgtcagagctgttgcccgatgtgcgtttgttgtatggcgagacgcctttcgcacgcacaccggtgatgtacgagcctggcatcataattctcttttccggacataaaatcggttatatcaatgaacgcgtgtttcgttatgacgctaatgaatatctcctgctgacggtgccgttgccgtttgagtgcgaaacctatgccacgtcagaggtgccgttggcagggttgcgtctcaatgtcgatattttgcagttacaggaactgttgatggacattggcgaagatgaacattttcagccgtcaatggcagccagcggtattaactccgccacgttatcagaagagattttatgcgcggcagagcggttactggatgtgatggagcgaccgctggatgcgcgcattctcggcaaacagattatccgcgaaattctgtactacgtgctgaccggaccttgcggcggcgcgttactggcactggtcagccgccagactcacttcagcctgattagtcgcgtgctgaaacggattgagaataaatacaccgaaaacctgagcgtcgagcaactggcggcagaagccaacatgagcgtatcggcgttccaccataattttaagtctgtcaccagcacctcgccgttgcagtatttgaagaattaccgtctgcataaggcgcggatgatgatcatccacgacggcatgaaggccagcgcggcggcgatgcgcgtcggctatgaaagcgcatcgcaatttagccgtgagtttaaacgttacttcggtgtgacgccgggggaagatgcggcaagaatgcgggcgatgcaggggaattaa

SEQ ID NO: 7136 - protein, 375 aa, Escherichia coli
MRVGVCRLKLFITCSLCWVNMRAEIGLPDVFHCGRQRRTSQCSFLPMSCLFLQSAGEMLQNCAQSNCRIIPKKLRDMKREEICRLLADKVNKLKNKENSLSELLPDVRLLYGETPFARTPVMYEPGIIILFSGHKIGYINERVFRYDANEYLLLTVPLPFECETYATSEVPLAGLRLNVDILQLQELLMDIGEDEHFQPSMAASGINSATLSEEILCAAERLLDVMERPLDARILGKQIIREILYYVLTGPCGGALLALVSRQTHFSLISRVLKRIENKYTENLSVEQLAAEANMSVSAFHHNFKSVTSTSPLQYLKNYRLHKARMMIIHDGMKASAAAMRVGYESASQFSREFKRYFGVTPGEDAARMRAMQGN

SEQ ID NO: 7137 - DNA, 1164 bp, Escherichia coli
atgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgaaccaaacccggcttatgaaacgctgatgaacgccgtgaaactggttcgcgaacaaaaagtgacttttctgctggcggttggcggcggttctgtactggacggcaccaaatttatcgccgcagcggctaactatccggaaaatatcgatccgtggcacattctgcaaacgggcggcaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagcccgtatttgccgtgctcgatccggtttatacctacaccctgccgtcgcgtcaggtggctaacggcgtagtggacgcctttgtacacaccgtggaacagtatgttaccaaaccggttgatgccaaaattcaggaccgtttcgcagaaggcattttgctgacgctgatcgaagatggtccgaaagccctgaaagagccagaaaactacgatgtgcgcgccaacgtcatgtgggcggcgactcaggcgctgaacggtttgatcggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttcagacgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgctggatgtcagccgccgtatatacgaagccgcccgctaa

SEQ ID NO: 7138 - protein, 387 aa, Escherichia coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPSRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 7139 - DNA, 828 bp, Escherichia coli
atggctaatccaaccgttattaagctacaggatggcaatgtcatgccccagctgggactgggcgtctggcaagcaagtaatgaggaagtaatcaccgccattcaaaaagcgttagaagtgggttatcgctcgattgataccgccgcagcctacaagaacgaagaaggtgtcggcaaagccctgaaaaatgcctcagtcaacagagaagaactgttcatcaccactaagctgtggaacgacgaccacaagcgcccccgcgaagccctgctcgacagcctgaaaaaactccagcttgattatatcgacctctatttaatgcactggcccgttcccgctatcgaccattatgtcgaagcatggaaaggcatgatcgaattgcaaaaagagggattaatcaaaagcatcggcgtgtgcaacttccagatccatcacctgcaacgcctgattgatgaaactggcgtgacgcctgtgataaaccagatcgaacttcacccgctgatgcaacaacgccagctacatgcctggaacgcgacacacaaaatccagaccgaatcctggagcccattagcgcaaggagggaaaggcgttttcgatcagaaagtcattcgcgatctggcagataaatacggcaaaacccctgcgcagattgttatccgctggcatctggatagcggcctggtggtgatcccaaaatcggtcacaccttcacgcattgtcgaaaactttgatgtctgggatttccgtctcgacaaagacgaacttggcgaaattgcaaaactcgatcagggcaagcgtctcggtcccgatcctgaccagttcggcggctaa

SEQ ID NO: 7140 - protein, 275 aa, Escherichia coli
MANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIVENFDVWDFRLDKDELGEIAKLDQGKRLGPDPDQFGG

SEQ ID NO: 7141 - DNA, 927 bp, Escherichia coli
atgaaaataatacttctgtttttagcagccctggcaagttttaccgtacacgcacagcccccctcacagaccgtagaacaaacagtccggcatatttatcagaactataaatcagatgccactgccccttattttggtgaaaccggagagcgagcgataacttctgcgcgtattcaacaggcgcttaccctgaacgacaatcttacgctgccgggcaatattggctggctggattatgatccggtttgtgattgtcaggattttggcgatctggtgttagaaagcgtagcgataacccaaactgacgccgatcatgccgatgccgttgtgcgctttcgtatctttaaagacgataaagaaaagacctcgcagacactgaaaatggtggcggaaaatggtcgttgggtcattggcgatattgtcagcaatcatggcagcgtcttacaagcggttaatagcgagaatgaaaaaacgctggccgctatagcttcgttgcaaaaagaacagccggaagcctttgttgccgaactctttgaacatattgctgattatagctggccgtggacgtgggtggtttccgactcttaccgccaggcggtcaatgccttctataaaaccaccttcaagacggccaacaatcccgatgaagatatgcaaatagaacggcaatttatttacgacaatccgatctgttttggcgaagagtcgttattttcacgcgttgatgaaattcgagtcctggagaaaaccaccgattccgcccgcattcatgttcgctttacgctgaccaatggcaacaacgaagagcaagaactgattttacagcggcgcgaaggtaagtgggaaatcgctgattttatccgcccgaacagcggcagcctacttaagcagattgaggcaaaaaccgccgccagattaaaacaatga

SEQ ID NO: 7142 - protein, 308 aa, Escherichia coli
MKIILLFLAALASFTVHAQPPSQTVEQTVRHIYQNYKSDATAPYFGETGERAITSARIQQALTLNDNLTLPGNIGWLDYDPVCDCQDFGDLVLESVAITQTDADHADAVVRFRIFKDDKEKTSQTLKMVAENGRWVIGDIVSNHGSVLQAVNSENEKTLAAIASLQKEQPEAFVAELFEHIADYSWPWTWVVSDSYRQAVNAFYKTTFKTANNPDEDMQIERQFIYDNPICFGEESLFSRVDEIRVLEKTTDSARIHVRFTLTNGNNEEQELILQRREGKWEIADFIRPNSGSLLKQIEAKTAARLKQ

SEQ ID NO: 7143 - DNA, 258 bp, Escherichia coli
atgaaaacgattttcaccgtgggagctgttgttctggcaacctgcttgctcagtggctgcgtcaatgagcaaaagatcaatcagctggcgagcaatgtgcaaacattaaatgccaaaatcgcccggcttgagcaggatatgaaagcattacgcccacaaatctatgctgccaaatccgaagctaacagagccaatacgcgtcttgatgcacaggactatttcgactgcctgcgctgcttgcgtatgtacgcagaatga

SEQ ID NO: 7144 - protein, 85 aa, Escherichia coli
MKTIFTVGAVVLATCLLSGCVNEQKINQLASNVQTLNAKIARLEQDMKALRPQIYAAKSEANRANTRLDAQDYFDCLRCLRMYAE

SEQ ID NO: 7145 - DNA, 2220 bp, Escherichia coli
atgagctctatctccctgatccaaccggatcgcgacctgttctcctggccgcagtactgggccgcctgttttggaccggcaccgtttttgccgatgtcacgtgaagagatggatcaacttggctgggatagctgcgacatcattttggtaacaggtgatgcgtatgttgatcacccaagcttcgggatggcgatttgtggtcgtatgctggaagcgcagggctttcgcgtggggatcatcgctcagccagactggagcagtaaagacgatttcatgcgtctgggtaaaccgaatctgtttttcggtgttactgctggcaacatggactcgatgatcaaccgctataccgccgatcgccgtttacgtcatgacgatgcctacacgccagataatgtcgcgggtaagcgtccggatcgcgccacactggtttatacccaacgttgtaaagaggcgtggaaagatgtgccggtgatcctcggcggtattgaggccagcctgcgccgtaccgcgcactatgattactggtcggataccgtgcgccgttccgtgctggtggattcgaaagccgacatgctgatgtttggtaacggtgagcgtccgctggtggaagtggcgcaccgtctggcgatgggcgagccgattagtgaaatccgcgatgtgcgtaataccgcgattatcgtaaaagaggcgttgcctggctggagcggtgtggattccacccgtcttgataccccagggaaaatcgacccaatcccgcatccgtatggcgaagatttgccgtgcgcggataacaaaccggtagctccgaaaaagcaggaagccaaagctgtaaccgtgcagccaccacgcccgaaaccgtgggaaaaaacctacgtgttgctgccttctttcgagaaagtgaagggcgataaagtgctgtacgcccatgcttcgcgcattctgcaccacgaaactaacccaggctgcgcccgcgcattgatgcaaaaacatggcgaccgctatgtatggatcaacccgcctgctattccgctttctaccgaagagatggatagcgtctttgcgctgccgtacaagcgcgtgccgcatccggcttacggtaatgcccgaattccggcttacgaaatgattcgtttctcggtcaacattatgcgtggctgctttggcggctgctctttctgttctattaccgagcacgaagggcgcattattcagagccgttccgaagattcgattattaatgagatcgaagcgatccgcgacactgttccaggttttacgggcgtgatttccgatctcggtgggcctactgccaacatgtatatgttgcgttgcaaatcgccacgcgctgagcaaacctgccgtcgtttgtcgtgcgtttatccggatatttgtccgcatatggacactaaccacgaaccgacgattaacctctatcgccgtgcgcgcgatctgaaaggcattaaaaagatcctgattgcctctggtgtgcgttatgacatcgccgtagaagatccgcgctatatcaaagagctggcgacccatcacgttggcggttatctgaagattgccccggaacataccgaagaagggccgttatcgaagatgatgaagccgggcatgggcagctatgaccgctttaaagagctgttcgatacttactcgaaacaggcaggtaaagaacagtatctgatcccgtatttcatctccgcgcacccgggtacgcgtgatgaagatatggtgaatctggcgctatggctgaaaaagcatcgcttccgcctcgaccaggtgcagaacttctatccgtcgccgctggctaactcgaccaccatgtattacaccggcaaaaacccgctggcgaagattggttataagagtgaagacgtcttcgtaccgaagggcgacaagcagcgtcgcctgcataaagcgttgttgcgttaccacgatccggcaaactggccgttaatccgccaggcgctggaagcgatgggcaaaaagcatctgattggcagccgtcgcgattgcttagtgcctgcgccaaccattgaagagatgcgtgaggctcgccgccagaaccgcaatacccgtccggcgttgactaaacatacgccgatggcgacccagcgtcagacgcctgctacggcaaaaaaagcgtcgtctacgcaatctcgcctgcagaatgctggtgcgaagaaacgccctaaagcggcggttggacgttaa

SEQ ID NO: 7146 - protein, 739 aa, Escherichia coli
MSSISLIQPDRDLFSWPQYWAACFGPAPFLPMSREEMDQLGWDSCDIILVTGDAYVDHPSFGMAICGRMLEAQGFRVGIIAQPDWSSKDDFMRLGKPNLFFGVTAGNMDSMINRYTADRRLRHDDAYTPDNVAGKRPDRATLVYTQRCKEAWKDVPVILGGIEASLRRTAHYDYWSDTVRRSVLVDSKADMLMFGNGERPLVEVAHRLAMGEPISEIRDVRNTAIIVKEALPGWSGVDSTRLDTPGKIDPIPHPYGEDLPCADNKPVAPKKQEAKAVTVQPPRPKPWEKTYVLLPSFEKVKGDKVLYAHASRILHHETNPGCARALMQKHGDRYVWINPPAIPLSTEEMDSVFALPYKRVPHPAYGNARIPAYEMIRFSVNIMRGCFGGCSFCSITEHEGRIIQSRSEDSIINEIEAIRDTVPGFTGVISDLGGPTANMYMLRCKSPRAEQTCRRLSCVYPDICPHMDTNHEPTINLYRRARDLKGIKKILIASGVRYDIAVEDPRYIKELATHHVGGYLKIAPEHTEEGPLSKMMKPGMGSYDRFKELFDTYSKQAGKEQYLIPYFISAHPGTRDEDMVNLALWLKKHRFRLDQVQNFYPSPLANSTTMYYTGKNPLAKIGYKSEDVFVPKGDKQRRLHKALLRYHDPANWPLIRQALEAMGKKHLIGSRRDCLVPAPTIEEMREARRQNRNTRPALTKHTPMATQRQTPATAKKASSTQSRLQNAGAKKRPKAAVGR

SEQ ID NO: 7147 - DNA, 750 bp, Escherichia coli
atggaacaggttattacaaagcgccgctattacgatattggtctacagattgaagagctgctgtattcaggcgtatttaaggccggagaacgcttaccttcagaacgtgaactgagcgagcggtttaataccagccgaactaccattcgtgaagccatcattatgctggaactgaaaggcgtattgaatgtgaagcaagggtcagggattttctttgtcgactccaccgataagctcaaccagaaatcattaatgccctattcagaaattggcccgtttgaactgttacaggcacgtcaggtaattgagagcaatattaccggttttgcagccagccagattagctttaacgagttacaagagttaaagaaaatcattagtttgcaggaaaacgctatcgctgcggaaagtgatagatttgaagacctggatcaccgatttcatagcattattgccgaagcgacgcaaaatcgggtactcatcaaacaagctgctgaattatggcgggcagttcgtacagaaaacccccgctggaagaaacttaactacaagtacctgcatgaaaagcatttgcgtctgcaatggctggaagatcaccgggctattttcctggctctgcaacagaaagattcagagctcgccagggaagcgtcctggagacatctggaaaacagcaaaaatgaactgatcaaaatcttcaaacaagacgcttccatcagcgattttgatgactttttcttcgctcgttaa

SEQ ID NO: 7148 - protein, 249 aa, Escherichia coli
MEQVITKRRYYDIGLQIEELLYSGVFKAGERLPSERELSERFNTSRTTIREAIIMLELKGVLNVKQGSGIFFVDSTDKLNQKSLMPYSEIGPFELLQARQVIESNITGFAASQISFNELQELKKIISLQENAIAAESDRFEDLDHRFHSIIAEATQNRVLIKQAAELWRAVRTENPRWKKLNYKYLHEKHLRLQWLEDHRAIFLALQQKDSELAREASWRHLENSKNELIKIFKQDASISDFDDFFFAR

SEQ ID NO: 7149 - DNA, 1473 bp, Escherichia coli
atgtcagggaacgaaagtatcgctgccgcccactatgatcaggtaaccacctggcctcgggacgggttacaggcagatattgtccatattggttttggcgcttttcatcgcggacaccaggctgtctacacggatctcgctaatcaactttcggacacccgctgggggatctttgagatcaacctgtttggtgatgctcaactgatcgaaaacttaaatgcgcaaaatgggctgttttcggttgtggaaacatctgcatcgcaatctacctcacgccttgtgcgttcggtggctggcggtattcatacccccagagatggcattgccgcagcaatccataaactggctgaacctcaggtaaaaatcgtttcattaactatcaccgagaaaggctattgtctcgatccgcaaacgcgatcacttgatctcaccaatggattaatcaaccacgatctacaaaatccggatgcgcctcagtcggctattggcgtgatcgtctgtgctttgcaacaacgtaaagcggcaggactcgccgcttttagtgtgctctcctgtgacaacttgccagacaatgggcatctgacgcgcaatgccgttctcggttttgcccgacaactggaccagcccctggctcagtggatcgaagaaaatgtctcatttccaggcacgatggtcgatcgcattgttccggcaatgactgaatcgcaattcgccttactggaaactaaaaccggttatgccgatccctgcgggatcgtctgcgaatcatttcgtcagtgggttatcgaagataattttgtgcgcggacgaccggaatgggataaagccggcgcgatgtttgtcagcaatgttcagccttatgaagagatgaagttacgcatgttaaatggtagccattcatttctggcttataacggctcactggctggctatgagtttatctggcaatgcatggaagacgctaattttcgttccattacccaccaactgatgattaatgaacaagcccgaacacttaatccagacttaaatatcaacatccaggaatacgccgacctgttaattgaacgctttagcaaccgtaacgttgcacaccgtaccgggcaaatagccatggacggttcacaaaagcttccccagcgtgcactgacgccctggctgaaattgcatcagcaaaaacaaaacaatgctgttctgtcactgctcgttgctggttggttgcattatgtcattgatgctgttgagaaaagccagtctgtcgctgatccaatgaatgaccaatttcaggcgctaataaaggaacaacaagacgcatggcaacaggcgctcgcattactgcaccttagcgccatatttggtgatttaagcaaccatcagccatttataaatgaaataaaaatcgcctttgcgaatataaaaaacaaaggcatcaaggccaccatcagccaattattatcggatgagcagaaatga

SEQ ID NO: 7150 - protein, 490 aa, Escherichia coli
MSGNESIAAAHYDQVTTWPRDGLQADIVHIGFGAFHRGHQAVYTDLANQLSDTRWGIFEINLFGDAQLIENLNAQNGLFSVVETSASQSTSRLVRSVAGGIHTPRDGIAAAIHKLAEPQVKIVSLTITEKGYCLDPQTRSLDLTNGLINHDLQNPDAPQSAIGVIVCALQQRKAAGLAAFSVLSCDNLPDNGHLTRNAVLGFARQLDQPLAQWIEENVSFPGTMVDRIVPAMTESQFALLETKTGYADPCGIVCESFRQWVIEDNFVRGRPEWDKAGAMFVSNVQPYEEMKLRMLNGSHSFLAYNGSLAGYEFIWQCMEDANFRSITHQLMINEQARTLNPDLNINIQEYADLLIERFSNRNVAHRTGQIAMDGSQKLPQRALTPWLKLHQQKQNNAVLSLLVAGWLHYVIDAVEKSQSVADPMNDQFQALIKEQQDAWQQALALLHLSAIFGDLSNHQPFINEIKIAFANIKNKGIKATISQLLSDEQK

SEQ ID NO: 7151 - DNA, 1017 bp, Escherichia coli
atgaaaacattaatttgtcagcagcctggcgttatggaatatgtggaaaaggatattcccacaccagcagataatgaagtgctgttaaaaatcaaagctgtgggtatttgtggtacggatattcacgcttttgccggcagacagcctttttttagctacccacgtgtattaggtcatgaaatatgcgccgaagcggtttcgcgaggcagccagtgccaaacagcacaatcaggccagcgctattccgtcatcccatgcattccgtgtggcgagtgcgcagcctgtcgggaagagaaaacgaactgttgcgaacgtgtttcgctgtatggcgtgcatcaggatgggggttttagtgagtaccttgcggtacgtgaagacaaccttgtgcctctccctgacgaggtcagcgacagtgccggagcattggttgaatgtttcgccattggtgcacatgccgttcgtcgggcagagatcaaggctgaacaaaacgtactggtgattggcgctgggccaatcggtctggctaccgcagccatcgccagggctaaaggggcacatgttgttgttgctgatattgactgtcaacgtcgccagcacgttgtggatcatctggcaattaatgtcttcgacccaacacaggaaggttttattgccgcgcttagtgaagtgtttggcggcgaactggcttgcgtagtcctggatgcgacgggaaataaagcttcaatgagtcatgatgtcaatcttattcgtcatggcggcaaaattgttttcatcggtttgtatattggtgaacttgttattgacgatccgaccttccataaaaaagagacaacgttactcagcagccgcaatgccacacgggaagattttgcgttggtgattgaactgatgcgcagcaataaaattcacgaaaatttaatgaaaaaccaggcgttcaatttctttagtgttggcgaagattaccagcgtaacgttgtagaaaataaaaatatggtcaagggtgtgatcactttttaa

SEQ ID NO: 7152 - protein, 338 aa, Escherichia coli
MKTLICQQPGVMEYVEKDIPTPADNEVLLKIKAVGICGTDIHAFAGRQPFFSYPRVLGHEICAEAVSRGSQCQTAQSGQRYSVIPCIPCGECAACREEKTNCCERVSLYGVHQDGGFSEYLAVREDNLVPLPDEVSDSAGALVECFAIGAHAVRRAEIKAEQNVLVIGAGPIGLATAAIARAKGAHVVVADIDCQRRQHVVDHLAINVFDPTQEGFIAALSEVFGGELACVVLDATGNKASMSHDVNLIRHGGKIVFIGLYIGELVIDDPTFHKKETTLLSSRNATREDFALVIELMRSNKIHENLMKNQAFNFFSVGEDYQRNVVENKNMVKGVITF

SEQ ID NO: 7153 - DNA, 1011 bp, Escherichia coli
atgacaactgtttatgtcagtgaagaaaatttaaaatcactggtgcaccacaaattacataccgccgggctggataccgacaccatacaacaggtgacagatgttttagtacatgccgatattaccggtgtgcattcacatggtgttatgcgtgtcgaacattattgcacccgccttgctgccggagggttaaataaagccccgcagtttagcattgagcaaatttcaccgtcagtggccattctcgactctgacgacggaatggggcattccgcattaattagcgccactgagcacgctattaaactggcccagcaagagggcctcggttttgttagcgttaaaaacacgtctcactgtggtgcgttatcttattttgcagagatgatcacccacaaagggttggttgctatcgtaatgacgcaaaccgatacctgtgtggctccccatggcggcgccgagcgctttttgggaactaaccccatcgcctttggtttcccggtggaaaacagccatccgatgattgttgatatggcgaccagtgccacggctttcggcaaaatacttcatgcaaaggaaaccggaaaacatattggtgaagggctggcgatagataaaaacggttatggcaccactgatccgtataagattgaaaacctgctacctttcggccaacacaaaggttcaggcattgcactggctattgatgcactgactggcgtgctgatgaatgcgaattttggcaaccatattgttcgcatgtatggtgattatgacaagatgcgtaagctggcaagtttggttattgccatcgatccgaaaaagctcggcaatcctgtttttgcaaaaactatggcgaaaatggtcacggagctgcatgccgttaaaccggctcctggtgtcgaaaaagtgttagcgccgaacgatccgcaaatgcactacaaagaaaaatgccaacaggaaggtattccggttccggcaggaatattccattatctggcagagaattaa

SEQ ID NO: 7154 - protein, 336 aa, Escherichia coli
MTTVYVSEENLKSLVHHKLHTAGLDTDTIQQVTDVLVHADITGVHSHGVMRVEHYCTRLAAGGLNKAPQFSIEQISPSVAILDSDDGMGHSALISATEHAIKLAQQEGLGFVSVKNTSHCGALSYFAEMITHKGLVAIVMTQTDTCVAPHGGAERFLGTNPIAFGFPVENSHPMIVDMATSATAFGKILHAKETGKHIGEGLAIDKNGYGTTDPYKIENLLPFGQHKGSGIALAIDALTGVLMNANFGNHIVRMYGDYDKMRKLASLVIAIDPKKLGNPVFAKTMAKMVTELHAVKPAPGVEKVLAPNDPQMHYKEKCQQEGIPVPAGIFHYLAEN

SEQ ID NO: 7155 - DNA, 984 bp, Escherichia coli
atgaaagcacttcgtcctctgacggcatcgcttatgctgttaaccagttgtttattaatatctaataccacactggcaaaaacaacattaaaactgagtcataatcaggataaaagccatgctgtccataaagcattaagctatttagcggataaaaccaaagagtattctaatggtgaattagttattcgcatttacccaaatgcgacattaggtaatgagcgtgaatcactggaattaatgaactccggtgcattacagatggttaaggttaatgccgcatcactagaatcatttgctccggattacagccttttcagtctgccgttcttattccgcgaccgtgatcactattatcgtgttctgcaaagtgatttaggtaaaaaaatacttaattcatcagaaagaaaaggttttgttggtattacgtactatgacggcggtgcgagaagtttttattccaataaaccgattacaaaacctgaagatttagcgggaatgaaaatcagggttcaacaaagccccagcgccattgcaatgatgaaagcactcggtggtgtcgctaccccgatggcgcaaggcgaactctacaccgcacttcagcaaggtgtggttgatggcggagagaacaataccgttgtctatgccgatatgcgtcacgccgaagtcgcaaaagtctattcacgtgatgaacacaccatggtacctgatgtgttaattatcagcaccgacgtgttgaataaacttggtgataaagagcgcacggcattattaaaagcagccgatgagtcaatgatgcagatgaaggacgtcatttggcctgcggctgaaaaagaagcctacgacaaaatgaaagggatgaacgcaacagttgttgatgttgataaatccgctttcaaagaacgcgtcaaaccgttatacgatgaattcaaggcgaaagatgcacaatcagccaaaaaccttgagctagtagaaagtatgtaa

SEQ ID NO: 7156 - protein, 327 aa, Escherichia coli
MKALRPLTASLMLLTSCLLISNTTLAKTTLKLSHNQDKSHAVHKALSYLADKTKEYSNGELVIRIYPNATLGNERESLELMNSGALQMVKVNAASLESFAPDYSLFSLPFLFRDRDHYYRVLQSDLGKKILNSSERKGFVGITYYDGGARSFYSNKPITKPEDLAGMKIRVQQSPSAIAMMKALGGVATPMAQGELYTALQQGVVDGGENNTVVYADMRHAEVAKVYSRDEHTMVPDVLIISTDVLNKLGDKERTALLKAADESMMQMKDVIWPAAEKEAYDKMKGMNATVVDVDKSAFKERVKPLYDEFKAKDAQSAKNLELVESM

SEQ ID NO: 7157 - DNA, 483 bp, Escherichia coli
atgcgaacactcactcatattcttaataagatccttgccggatgttgctgcattattctcgccattatggtgttctgcgtaacctggcaagttattgcacgttttatttttaacgctcccagcactgtgcttgatgagttcacccagattttatttatgtggatgattttgcttggcggtgtatatactgcgggtttaaaaaaacatctggccattgatttgttggctcaaaaacttccggctgcatctgttctgacgcttgacagttttatccaaattattattacggtctttgcggttattttcatgatctatggcgggaatattgttgttgaaaaagcacaacatgttggacaaatctctccagtattaaaatggccaatggataaagtatattgggttatgcctgtcagtgggcttattctggtctggtattcagtaatgaatattattgacaactatcgtaaacggaattctcattaa

SEQ ID NO: 7158 - protein, 160 aa, Escherichia coli
MRTLTHILNKILAGCCCIILAIMVFCVTWQVIARFIFNAPSTVLDEFTQILFMWMILLGGVYTAGLKKHLAIDLLAQKLPAASVLTLDSFIQIIITVFAVIFMIYGGNIVVEKAQHVGQISPVLKWPMDKVYWVMPVSGLILVWYSVMNIIDNYRKRNSH

SEQ ID NO: 7159 - DNA, 1305 bp, Escherichia coli
atggaatttgaatatatctaccccgtcttaattttatttggcagttttgccgtcatgctggcaataggtgtgccaattacttttgcgattggtctttcttcgctgttatctattattactgccttgccacccgatgccgccatttctgttatttcacaaaaaatgactgtagggctggatggctttacgctattagccattcccttcttcgtgttagccggaaacattatgaataccggtggtatagccagacgactggttaacctggcgcaagcattagttgggcgtcttcctggctcactggctcattgtaatatcctcgcgaatacactgtttggtgcgatttcaggttcagccgttgcgtcagccgcagcggtaggtgggattatgtcaccactgcaagaaaaagagggatatgatccggcgttttcagcagcggttaatattgcctctgcccccattggcctgatgatcccaccgagcaatgtgttgattgtttattccctcgccagtggcgggacttctgtcgctgcgttgttcttagctggatatctgccgggcatcctcaccgctgttgccttaatgtttgtagctgcactttatgcacgacgtcaccattacccagtggccgaacgcatcaattaccgtcagtttttacaggtattccgcgaatcaattcctagcctgatgcttatttttatcattattggcggtattatcgcaggggtatttacgcccacagaagcatcagcaatagcggtaatttatagtttagccctggcgatgatttaccgggaaatcactcttaagaagctcaatgatattctgttagattcggtagtaaccagttcaattgttctgttactggtaggctgttcaatgggaatgtcatgggccatgacgaatgctgatgttcctgagttgatcaacgaactgattacccgcgtttcggataacaaatgggtcattctgtttattatcaatatcattctgttgatcgtcggtacctttatggatatcacgccggcgatcctgatatttacacctattttcctgccgatcgcccagcatctggggattgatccgattcacttcggcataattatggttttcaacttaaccattggcctttgcacaccacctgtcggcaccattctgtttgtggggtgcagcattggtaaggtcagtatcgacagggcaataaaaccattactgccgatgtttctggcattgtttgtagtaatggcaattatttgttatttcccgcagcttagtctgatgctgccaggattattttcgacctga

SEQ ID NO: 7160 - protein, 434 aa, Escherichia coli
MEFEYIYPVLILFGSFAVMLAIGVPITFAIGLSSLLSIITALPPDAAISVISQKMTVGLDGFTLLAIPFFVLAGNIMNTGGIARRLVNLAQALVGRLPGSLAHCNILANTLFGAISGSAVASAAAVGGIMSPLQEKEGYDPAFSAAVNIASAPIGLMIPPSNVLIVYSLASGGTSVAALFLAGYLPGILTAVALMFVAALYARRHHYPVAERINYRQFLQVFRESIPSLMLIFIIIGGIIAGVFTPTEASAIAVIYSLALAMIYREITLKKLNDILLDSVVTSSIVLLLVGCSMGMSWAMTNADVPELINELITRVSDNKWVILFIINIILLIVGTFMDITPAILIFTPIFLPIAQHLGIDPIHFGIIMVFNLTIGLCTPPVGTILFVGCSIGKVSIDRAIKPLLPMFLALFVVMAIICYFPQLSLMLPGLFST

SEQ ID NO: 7161 - DNA, 1413 bp, Escherichia coli
atgtcactcagtcggcgtcagttcattcaggcatcggggattgcactttgtgcaggcgctgttcccctgaaggccagcgcagccgggcaacagcaaccgctacccgttccgccgctgcttgaatctcgccgtgggcaaccgctgtttatgactgtacaacgtgcgcactggtcatttacgccagggacacgcgcgtcggtttggggaatcaatggtcgttacctggggccgactatccgcgtctggaagggcgacgatgttaagcttatttacagcaaccgcctgacagaaaatgtctcaatgacggtggccgggctacaggtacctggcccgctgatgggcggtccggcacggatgatgtcgccaaatgctgactgggcacccgtactgcccattcgccagaacgcagctactctgtggtatcacgccaatactcccaaccgcacggctcagcaggtttataacggccttgccggaatgtggctggtggaagatgaagtcagtaaatcgctgcctatccccaaccattatggtgtggatgattttcctgtcattattcaggataaacggctggataactttggtacgccagaatataacgaaccgggaagcggcggctttgttggcgatacgctactggttaacggtgtacaaagcccgtacgttgaagtctcgcgtggctgggtgcgcttgcgtctgttgaacgcgtcgaactctcgtcgctatcaactacagatgagcgatggtcgcccgttacatgtgatttctggcgatcaaggattcctgcccgctcctgtatcggtgaagcaactttcgctggcaccgggcgagcgtcgtgagattctggtggatatgagcaacggtgatgaagtgtcgattacctgtggcgaagcggcgagcattgttgatcgtattcgtggcttctttgagccatccagcattctggtttctacgctggtgctaacgctgcgcccaaccggccttctgccgctggtcacagacagtcttccgatgcgcttgctgccaactgaaatcatggccggttcgccgattcgaagtcgtgatatcagcctgggtgatgacccggggattaatgggcagttgtgggacgtcaaccgtattgatgttactgcgcagcaaggaacgtgggaacgctggacggtgcgcgcggacgagccgcaagcgttccatattgaaggcgtgatgttccagatccgtaacgtgaatggcgcgatgccgttcccggaagacagaggctggaaagataccgtttgggttgacggacaagtggagctgcttgtttatttcggtcagccttcctgggcgcacttcccgttctacttcaacagtcagacgctggaaatggcggaccgtggctcgattgggcaactgttggtcaatccggtaccgtaa

SEQ ID NO: 7162 - protein, 470 aa, Escherichia coli
MSLSRRQFIQASGIALCAGAVPLKASAAGQQQPLPVPPLLESRRGQPLFMTVQRAHWSFTPGTRASVWGINGRYLGPTIRVWKGDDVKLIYSNRLTENVSMTVAGLQVPGPLMGGPARMMSPNADWAPVLPIRQNAATLWYHANTPNRTAQQVYNGLAGMWLVEDEVSKSLPIPNHYGVDDFPVIIQDKRLDNFGTPEYNEPGSGGFVGDTLLVNGVQSPYVEVSRGWVRLRLLNASNSRRYQLQMSDGRPLHVISGDQGFLPAPVSVKQLSLAPGERREILVDMSNGDEVSITCGEAASIVDRIRGFFEPSSILVSTLVLTLRPTGLLPLVTDSLPMRLLPTEIMAGSPIRSRDISLGDDPGINGQLWDVNRIDVTAQQGTWERWTVRADEPQAFHIEGVMFQIRNVNGAMPFPEDRGWKDTVWVDGQVELLVYFGQPSWAHFPFYFNSQTLEMADRGSIGQLLVNPVP

SEQ ID NO: 7163 - DNA, 738 bp, Escherichia coli
atgctatatatctttcgtcttattattaccgtgatttacagcatcttagtctgtgtattcggctccatttactgccttttcagcccgcgtaacccgaaacatgtggccacctttgggcatatgtttggccgtcttgcgccgcttttcggcctgaaagtggagtgccgcaaacctgcagacgctgaaagctacggcaatgctatctatattgctaaccaccagaacaattatgacatggtgacggcatcgaacattgtgcagccgccgacagtgacggtaggtaaaaagagcttgctgtggatccccttcttcgggcagttgtactggttaaccggcaacttattgatcgacagaaacaatcgcactaaagctcacggcactattgcggaagtagtgaatcacttcaaaaaacgccgtatttccatctggatgttcccggaaggaacccgcagccgtggtcgcggcctgctgccgttcaagaccggggcatttcacgcggcaattgcggcgggcgtcccgattatacccgtgtgcgtctctacaacttcgaataagattaatcttaatcggctacacaacggtctggtgattgtcgaaatgctgccgccaattgacgtcagtcagtatggcaaagatcaggttcgcgagttggctgcccattgtcgttcgataatggaacaaaaaatcgccgagctcgataaagaagtcgcagaacgcgaagccgccggaaaagtttaa

SEQ ID NO: 7164 - protein, 245 aa, Escherichia coli
MLYIFRLIITVIYSILVCVFGSIYCLFSPRNPKHVATFGHMFGRLAPLFGLKVECRKPADAESYGNAIYIANHQNNYDMVTASNIVQPPTVTVGKKSLLWIPFFGQLYWLTGNLLIDRNNRTKAHGTIAEVVNHFKKRRISIWMFPEGTRSRGRGLLPFKTGAFHAAIAAGVPIIPVCVSTTSNKINLNRLHNGLVIVEMLPPIDVSQYGKDQVRELAAHCRSIMEQKIAELDKEVAEREAAGKV

SEQ ID NO: 7165 - DNA, 2259 bp, Escherichia coli
atgagcgatatggcagagcgccttgcgctacatgaatttacggaaaacgcctacttaaactactccatgtacgtgatcatggaccgtgcgttgccgtttattggtgatggtctgaaacccgttcagcggcgcattgtgtatgcgatgtctgaactgggcctgaatgccagcgccaaatttaaaaaatcggcccgtaccgtcggtgacgtactgggtaaataccatccgcacggcgatagtgcctgttatgaagcgatggtcctgatggcgcagccgttctcttaccgttatccgctggttgatggtcaggggaactggggggcgccggacgatccgaaatcgttcgcggcaatgcgttacaccgaatcccggttgtcgaaatattccgagctgctattgagcgagctggggcaggggacggctgactgggtgccaaacttcgacggcactttgcaggagccgaaaatgctacctgcccgtctgccaaacattttgcttaacggcaccaccggtattgccgtcggcatggcgaccgatattccaccgcataacctgcgtgaagtggctcaggcggcaatcgcattaatcgaccagccgaaaaccacgctcgatcagctgctggatatcgtgcaggggccggattatccgactgaagcggaaattatcacttcgcgcgccgagattcgtaaaatctacgagaacggacgtggttcagtgcgtatgcgcgcggtttggaagaaagaagatggcgcggtggttatcagcgcattgccgcatcaggtttcaggtgcgcgcgtactggagcaaattgctgcgcaaatgcgcaacaaaaagctgccgatggttgacgatctgcgcgatgaatctgaccacgagaacccgacccgtctggtgattgtgccgcgctccaaccgcgtggatatggatcaggtgatgaaccacctcttcgctaccaccgatctggaaaagagctatcgcattaacctcaatatgatcggtctggatggtcgtccggcggtgaaaaacctgctggaaatcctctccgaatggctggtgttccgccgcgataccgtgcgccgccgactgaactatcgtctggagaaagtcctcaagcgcctgcatatcctcgaaggtttgctggtggcgtttctcaatatcgacgaagtgattgagatcattcgtaatgaagatgaaccgaaaccggcgctgatgtcgcggtttggccttacggaaacccaggcggaagcgatcctcgaactgaaactgcgtcatcttgccaaactggaagagatgaagattcgcggtgagcagagtgagctggaaaaagagcgcgaccagttgcagggcattttggcttccgagcgtaaaatgaataacctgctgaagaaagaactgcaggcagacgcgcaagcctacggtgacgaacgtcgttcgccgttgcaggaacgcgaagaagcgaaagcgatgagcgagcacgacatgctgccgtctgaacctgtcaccattgtgctgtcgcagatgggctgggtacgcagcgctaaaggccatgatatcgacgcgccgggcctgaattataaagcgggcgatagcttcaaagcggcggtgaaaggtaagagcaaccaaccggtagtgtttgttgattccaccggtcgtagctatgccatcgacccgattacgctgccgtcggcgcgtggtcagggcgagccgctcaccggcaaattaacgttgccgcctggagcgaccgttgaccatatgctgatggaaagcgacgatcagaaactgctgatggcttccgatgcgggttacggtttcgtctgcacctttaacgatctggtggcgcgtaaccgtgcaggtaaggctttgatcaccttaccggaaaatgcccatgttatgccgccggtggtgattgaagatgcttccgatatgctgctggcaatcactcaggcaggccgtatgttgatgttcccggtaagcgatctgccgcagctgtcgaagggcaaaggcaacaagattatcaacattccatcggcagaagccgcgcgtggcgaggatggcctggcgcaactgtacgttctgccgccgcaaagcacgctgaccattcatgttgggaaacgcaaaattaaactgcgtccggaagagctacagaaagtcgctggcgaacgtggacgccgcggtacgttgatgcgcggtttgcagcgtatcgatcgtgttgagatcgactctcctcgccgtgccagcagcggtgatagcgaagagtaa

SEQ ID NO: 7166 - protein, 752 aa, Escherichia coli
MSDMAERLALHEFTENAYLNYSMYVIMDRALPFIGDGLKPVQRRIVYAMSELGLNASAKFKKSARTVGDVLGKYHPHGDSACYEAMVLMAQPFSYRYPLVDGQGNWGAPDDPKSFAAMRYTESRLSKYSELLLSELGQGTADWVPNFDGTLQEPKMLPARLPNILLNGTTGIAVGMATDIPPHNLREVAQAAIALIDQPKTTLDQLLDIVQGPDYPTEAEIITSRAEIRKIYENGRGSVRMRAVWKKEDGAVVISALPHQVSGARVLEQIAAQMRNKKLPMVDDLRDESDHENPTRLVIVPRSNRVDMDQVMNHLFATTDLEKSYRINLNMIGLDGRPAVKNLLEILSEWLVFRRDTVRRRLNYRLEKVLKRLHILEGLLVAFLNIDEVIEIIRNEDEPKPALMSRFGLTETQAEAILELKLRHLAKLEEMKIRGEQSELEKERDQLQGILASERKMNNLLKKELQADAQAYGDERRSPLQEREEAKAMSEHDMLPSEPVTIVLSQMGWVRSAKGHDIDAPGLNYKAGDSFKAAVKGKSNQPVVFVDSTGRSYAIDPITLPSARGQGEPLTGKLTLPPGATVDHMLMESDDQKLLMASDAGYGFVCTFNDLVARNRAGKALITLPENAHVMPPVVIEDASDMLLAITQAGRMLMFPVSDLPQLSKGKGNKIINIPSAEAARGEDGLAQLYVLPPQSTLTIHVGKRKIKLRPEELQKVAGERGRRGTLMRGLQRIDRVEIDSPRRASSGDSEE

SEQ ID NO: 7167 - DNA, 1671 bp, Escherichia coli
ttgagcaaacaatgccacaggcgtattgttgtcgggcttataatttctccggtaaggaataccatgtatacgcgaaatttattatggctggtcagcctggtaagtgcggctcctctctacgctgctgacgttcccgccaacacaccgctcgccccgcaacaagtctttcgttacaacaatcatagcgacccaggcacgctcgacccgcaaaaggtagaggagaatactgccgcgcagattgtgctggatctgtttgaaggtctggtatggatggacggtgaaggccaggtgcagcccgctcaggctgaacgctgggagatacttgacgacggcaagcgctatattttccatctgcgtagcggtttgcagtggtcagacggtcagcctctgacggcagaggattttgtcctcggctggcagcgcgcggttgacccgaaaacggcaagcccttttgctggctatctggcacaggcgcacattaacaatgccgcggctattgttgcgggtaaagcagatgttacatcgctgggtgtcaaagcgacggatgatcgtactcttgaagttacgcttgagcagccagttccttggttcacgacgatgctcgcctggccgacgctgttcccggttcctcatcatgtcatcgctaaacatggcgatagctggagtaagccagagaacatggtttacaacggtgcctttgtgcttgataaatgggtagttaacgaaaagattactgcacgcaaaaatccaaagtaccgcgatgcgcaacatacagtattgcaacaggttgagtatctggcgctggataattcggtcaccggctataaccgctatcgcgcgggagaggtcgatctcacctgggttccggcgcagcaaattcccgccattgaaaaatcacagcctggcgagctacgaattatcccgcgtctgaacagcgaatattacaactttaaccttgagaaaccgccatttaacgatgtgcgggtgcgtcgggcgctatatcttacggttgatcgacagcttattgcgcaaaaggtactggggttgagaacgcccgcaaccacgctgacgccgccagaggtaaaaggctttagcgcgacgacgttcgatgaactgcaaaagccaatgagtgagcgcgtcgcgatggcaaaagtcttgctgaaacaggcgggatacgacgcctctcatccgctacgctttgagctgttctacaacaagtacgatctgcatgaaaagaccgcgatagcgttgtcttccgaatggaaaaaatggctgggtgcacaggtgacgctgcgcacaatggagtggaaaacctatcttgatgcccgacgagccggtgattttatgctgtctcggcagtcgtgggatgcgacgtacaatgatgcctccagcttcctgaacacgctcaaaagcgatagtgaagaaaacgtcggtcactggaaaaatgcgcagtatgacgccttactaaaccaggccacgcagatcactgatgcgacaaagcgtaatgcgttgtatcagcaggcagaagtgatcatcaaccagcaggcaccgctgattcccatctactatcagccgttaatcaaactgcttaaaccctacgttggcggttttccgctgcataatccccaggattatgtctacagcaaagagttgtatatcaaggcacattga

SEQ ID NO: 7168 - protein, 556 aa, Escherichia coli
MSKQCHRRIVVGLIISPVRNTMYTRNLLWLVSLVSAAPLYAADVPANTPLAPQQVFRYNNHSDPGTLDPQKVEENTAAQIVLDLFEGLVWMDGEGQVQPAQAERWEILDDGKRYIFHLRSGLQWSDGQPLTAEDFVLGWQRAVDPKTASPFAGYLAQAHINNAAAIVAGKADVTSLGVKATDDRTLEVTLEQPVPWFTTMLAWPTLFPVPHHVIAKHGDSWSKPENMVYNGAFVLDKWVVNEKITARKNPKYRDAQHTVLQQVEYLALDNSVTGYNRYRAGEVDLTWVPAQQIPAIEKSQPGELRIIPRLNSEYYNFNLEKPPFNDVRVRRALYLTVDRQLIAQKVLGLRTPATTLTPPEVKGFSATTFDELQKPMSERVAMAKVLLKQAGYDASHPLRFELFYNKYDLHEKTAIALSSEWKKWLGAQVTLRTMEWKTYLDARRAGDFMLSRQSWDATYNDASSFLNTLKSDSEENVGHWKNAQYDALLNQATQITDATKRNALYQQAEVIINQQAPLIPIYYQPLIKLLKPYVGGFPLHNPQDYVYSKELYIKAH

SEQ ID NO: 7169 - DNA, 483 bp, Escherichia coli
atgacaaacctgacactggatgtaaatattatcgatttcccatcaatccctgtggcgatgttgccgcaccgctgtagccctgagttgctcaactatagcgtggcgaaatttatcatgtggcgtaaagagacggggctttctcctgttaaccaaagccagacttttggcgtcgcctgggacgaccctgccaccaccgcaccggaagcgtttcgctttgatatctgcggcagcgttagcgaaccgatccccgataatcgttatggcgtgagtaatggcgaacttaccggtgggcgttatgctgttgcccgccatgttggcgagctggacgatatttcacacacgatatggggcatcattcgccactggctacctgcaagcggcgaaaaaatgcgcaaagccccgatcctgtttcactacaccaatcttgccgaagggatgacagagcggcgactggaaacggatatttatgtgccgttggcgtga

SEQ ID NO: 7170 - protein, 160 aa, Escherichia coli
MTNLTLDVNIIDFPSIPVAMLPHRCSPELLNYSVAKFIMWRKETGLSPVNQSQTFGVAWDDPATTAPEAFRFDICGSVSEPIPDNRYGVSNGELTGGRYAVARHVGELDDISHTIWGIIRHWLPASGEKMRKAPILFHYTNLAEGMTERRLETDIYVPLA

SEQ ID NO: 7171 - DNA, 393 bp, Escherichia coli
atgaaaaaattcgcagcagtaatcgcagtaatggccctgtgcagtgcaccggttatggcagcagagcagggaggtttttctggcccatcggcaacgcaaagtcaggccggaggattccaggggccgaacggcagcgtaacgaccgtagaaagcgcaaaatccctgcgtgacgacacctgggtaaccctacgcggcaatatcgttgaacgcatctctgacgatctctacgtgttcaaagatgccagcggtactatcaatgttgatatcgaccacaaacgctggaacggcgtgacggtgacgccgaaagatacggttgagattcagggggaagtcgataaagactggaattctgttgaaattgacgtcaaacagatccgcaaagtaaatccgtaa

SEQ ID NO: 7172 - protein, 130 aa, Escherichia coli
MKKFAAVIAVMALCSAPVMAAEQGGFSGPSATQSQAGGFQGPNGSVTTVESAKSLRDDTWVTLRGNIVERISDDLYVFKDASGTINVDIDHKRWNGVTVTPKDTVEIQGEVDKDWNSVEIDVKQIRKVNP

SEQ ID NO: 7173 - DNA, 633 bp, Escherichia coli
atgctgattggcgacggcatcaaaacgggccttagtaaaatgggttttagcgtcgactggtttacacaaggtcgtcagggaaaagaggcgctatatagcgcaccttatgatgcggtgatcctggatttaaccttaccgggcatggatggtcgcgatattttgcgcgaatggcgagaaaaaggtcagcgtgagccggtactgatcctgaccgcgcgcgatgcgctggcggaacgtgtagaagggctgcgtctgggagctgacgattatctgtgtaaaccttttgcgttgatagaagtcgccgccaggctggaagctctgatgcgccgaaccaacggccaggccagcaacgagctgcgccacggcaacgtcatgctcgaccccggcaaacgtatcgccacgctggctggcgaacccttaacgctgaaaccaaaagaatttgccctgctggaattactgatgcgtaacgctggtcgggtactgccgcgcaaactgattgaagagaaactgtatacctgggacgaagaggtcaccagtaatgccgttgaagtgcatgtgcatcatctgcgacgcaaactcggcagtgattttattcgtaccgtgcatggtattggctacacattaggtgagaaatga

SEQ ID NO: 7174 - protein, 210 aa, Escherichia coli
MLIGDGIKTGLSKMGFSVDWFTQGRQGKEALYSAPYDAVILDLTLPGMDGRDILREWREKGQREPVLILTARDALAERVEGLRLGADDYLCKPFALIEVAARLEALMRRTNGQASNELRHGNVMLDPGKRIATLAGEPLTLKPKEFALLELLMRNAGRVLPRKLIEEKLYTWDEEVTSNAVEVHVHHLRRKLGSDFIRTVHGIGYTLGEK

SEQ ID NO: 7175 - DNA, 1350 bp, Escherichia coli
atgaaatttacccaacgtcttagtctgcgagtcaggctgacgctaatctttttaattctggcctcggtgacctggctgctttccagctttgtcgcctggaaacaaacaacggataacgtcgatgagttgttcgacacccaactgatgctgtttgccaaacggttaagtacgctcgatctcaacgaaatcaacgcggcggatcgcatggcacagacgccaaataaattaaaacacggtcatgttgatgacgatgcgctgacttttgccatctttacccacgacggcagaatggtccttaacgatggcgataacggagaagatattccctatagctatcagcgggaaggttttgctgacgggcaactggtcggtgaagacgatccctggcgttttgtctggatgacctcacctgatggcaaatatcgcatcgttgtgggtcaggaatgggaataccgtgaagacatggcgctggcgattgttgccggacaattgatcccgtggctggtcgcactgccgattatgttaatcatcatgatggtactactgggtcgtgaactcgcgccgctgaacaaattggcgctggcactacgtatgcgtgacccagactcggaaaaaccactaaacgcgacgggcgtacccagcgaagtgcgcccactggttgagtcgctaaatcaactgttcgcccgcacacatgcgatgatggttcgtgaacgacgctttacctccgacgcagctcacgaacttcgtagcccgttaacggcgctgaaagtgcaaaccgaagttgctcagctctctgacgatgatccgcaggcgcggaaaaaagcgctgctccaattacattccgggatcgatcgcgctactcgtctggttgatcaactgctcacgctatcgcggctggactcactggataaccttcaggacgtcgcggagatcccgcttgaagatctcctgcaatcgtcggtgatggatatttaccacacggcgcagcaggcgaacattgacgtgcgactgacactcaatgccaacggcatcaaacgcaccggacaaccgctattgctaagtttgttggtgcgaaatttgctggataacgccgtgcgttacagtccacaaggtagcgtggtagacgtcacgctgaatgccgataatttcatcgtgagggataacggccccggtgtgacgccagaggcactggcgcgaattggcgaacgcttctatcgcccacccggacaaaccgctaccggcagtggacttgggctatcgattgtccagcgaatcgccaagctgcatgacatgaatgttgaatttgggaatgcggaacaaggtggatttgaggcgaaggtaagctggtaa

SEQ ID NO: 7176 - protein, 449 aa, Escherichia coli
MKFTQRLSLRVRLTLIFLILASVTWLLSSFVAWKQTTDNVDELFDTQLMLFAKRLSTLDLNEINAADRMAQTPNKLKHGHVDDDALTFAIFTHDGRMVLNDGDNGEDIPYSYQREGFADGQLVGEDDPWRFVWMTSPDGKYRIVVGQEWEYREDMALAIVAGQLIPWLVALPIMLIIMMVLLGRELAPLNKLALALRMRDPDSEKPLNATGVPSEVRPLVESLNQLFARTHAMMVRERRFTSDAAHELRSPLTALKVQTEVAQLSDDDPQARKKALLQLHSGIDRATRLVDQLLTLSRLDSLDNLQDVAEIPLEDLLQSSVMDIYHTAQQANIDVRLTLNANGIKRTGQPLLLSLLVRNLLDNAVRYSPQGSVVDVTLNADNFIVRDNGPGVTPEALARIGERFYRPPGQTATGSGLGLSIVQRIAKLHDMNVEFGNAEQGGFEAKVSW

SEQ ID NO: 7177 - DNA, 471 bp, Escherichia coli
atgatatacttatcaattaaagggaaaatacaaggtttgatctctgagggttgtggttcgtatgcatctattggtaataaatatcaaataaatcatgtggatgaaatttttgttttacagttcgaccattctttaagtcgagagtataatgtagtgcatcaccccataaaattttacaagccaatagataaatcctcccctttattaaatgccgctctttctgaaaatgaagagttatcagctgtatttaatttttatagaattaattctggcggttgtattgaaaggttttacacaattgaattgcaaggagcacatttatcgaatattctgacatgttatccacactcaattacacatgcgggtaatcagccggaagatgtcattgttcttaattataaaaatataacatggaagcaccatatcgcgagtacggaatcatatagttgttgggaagaaaggattttttaa

SEQ ID NO: 7178 - protein, 156 aa, Escherichia coli
MIYLSIKGKIQGLISEGCGSYASIGNKYQINHVDEIFVLQFDHSLSREYNVVHHPIKFYKPIDKSSPLLNAALSENEELSAVFNFYRINSGGCIERFYTIELQGAHLSNILTCYPHSITHAGNQPEDVIVLNYKNITWKHHIASTESYSCWEERIF

SEQ ID NO: 7179 - DNA, 375 bp, Escherichia coli
  n 356, 357, 358, 359, 360: n is any nucleotide
atgagcaacatcctgattatcaacggcgcgaaaaaattcgcccactccaatggtcaactgaacgacaccctgaccgaagtcgcggatggcacactgcgcgacctcgggcatgatgtccgcattgttcgcgccgacagcgactacgatgtcaaagcggaagtacaaaactttctctgggctgatgtggtgatctggcagatgccaggctggtggatgggcgcgccgtggacagtgaaaaaatatattgatgatgtattcaccgaaggtcacgggactctgtatgccagcgatggtcgtacccgcaaagatccatcaaaaaaatacggttccggcggcctggtacagggcaaaaaatnnnnncattccattcattaa

SEQ ID NO: 7180 - protein, 124 aa, Escherichia coli
  Xaa 119, 120: Xaa is any amino acid
MSNILIINGAKKFAHSNGQLNDTLTEVADGTLRDLGHDVRIVRADSDYDVKAEVQNFLWADVVIWQMPGWWMGAPWTVKKYIDDVFTEGHGTLYASDGRTRKDPSKKYGSGGLVQGKKXXHSIH

SEQ ID NO: 7181 - DNA, 219 bp, Escherichia coli
  n 8, 9, 10, 11, 12: n is any nucleotide
atgaatgnnnnntgccacggctatgcgccaatggtggattgcgctgctggcgtgagtttccagtctatggcaccggattctatcgtaatgattgagcagtgggaaagcatcgcgcatcttgaagcgcatctgcaaaccccgcacatgaaagcatatagcgaagccgtaaaaggtgacgtgctggagatgaatattcgtatcctgcagccggggctttga

SEQ ID NO: 7182 - protein, 72 aa, Escherichia coli
  Xaa 3, 4: Xaa is any amino acid
MNXXCHGYAPMVDCAAGVSFQSMAPDSIVMIEQWESIAHLEAHLQTPHMKAYSEAVKGDVLEMNIRILQPGL

SEQ ID NO: 7183 - DNA, 888 bp, Escherichia coli
atgatccagaaagataaagcgcgggttgatatttttggtgagcgttttcgcactcgcgcgagtcagttaacgcctgggttaagagctgtcgccagctacattaatgagcatcgtgaagtggtactcgagcaaacggcgatggaaattgcggccacgttgaacacttccgatgccacagttatcagggctatacaggccctggggtttgccgggctgcgtgatctgaaacgcactctggaacagtggcttggtccagcccttagttccagcgaaaagatgtctacgacggtgagtaacttgacgagcgatgttaacaccgcaatcgactttgttcttgaagggcatttgtatacctgtaatgtcctgtcagagcctgaaaaccgccacgcgcttgcgcaagctgtagcgttgttggtgcaggcacggcaagtcgcaatttttggcattggcgcttcgggtattctggcggactataccgcacgactattcaaccgcataggtttgcctgccacggcactaaaccgtacgggtattggccttgccgagcaactgatcgcgcttcaacgtggcgatgttctgatcatgatggcgcaaaaatctgcgcaccgggaagggctgacaacgcttcgtgaggcgaggcggctggggatccctgttattttgctgacaaacgcgctggattcacgttttagcaaagacgccagtatcgtgattcatgttccgcgcggggatgaaaaagggaaaacgccgctacatggtacggtattgttgtgtctggaaatgattgtctggtcggtagcttccgcagtgccgcagcgtgcggttaaaaccattaagcgaattaacgatttccatcgaggactgaaaacgggaagaaagaatggctaa

SEQ ID NO: 7184 - protein, 295 aa, Escherichia coli
MIQKDKARVDIFGERFRTRASQLTPGLRAVASYINEHREVVLEQTAMEIAATLNTSDATVIRAIQALGFAGLRDLKRTLEQWLGPALSSSEKMSTTVSNLTSDVNTAIDFVLEGHLYTCNVLSEPENRHALAQAVALLVQARQVAIFGIGASGILADYTARLFNRIGLPATALNRTGIGLAEQLIALQRGDVLIMMAQKSAHREGLTTLREARRLGIPVILLTNALDSRFSKDASIVIHVPRGDEKGKTPLHGTVLLCLEMIVWSVASAVPQRAVKTIKRINDFHRGLKTGRKNG

SEQ ID NO: 7185 - DNA, 948 bp, Escherichia coli
atgcgtttatttttttctctgctgatactgttgtcatttttttcccgtgcaacagaacctgttcaggtatttactgatgatttagggcgcaaagtcactgttcctgctcatccaaagagaattgtctctttacacgatcttgatatcactattcctctgattgagctcggtgtacctcctgtcgccagccacgggcgaactcggcctgacggtagccatttcattcgatctggcgcgttattgacaggtgtcgactttgataattcatcgatcgcctttattggtaccgctgatattgatattgaagcgattgtggcggcaaagcctgacctgatcatcacagaaccgacccgtaatacgcccattgaacaacttgaaaaaattgcgcccacggtgagcattgatcatctcaaagggggtgcgccagaaatctatcgcaagctggcagaacttacaggaacgcagtcgcagctggcgatacttgaacgccgctatcaggcacaaatcaatgcgctgaaggcgacgctggacagccaaaaaataacggtatcggtgattcaggcaaaccagggaaaaattaatgtgatgcatagctatcattcgctggggcgggtattacgcgatgctggttttcgttttccgccgctgattgagagcattcctgaaggtgggcgaatggatgtgagcgcggagcgtttacctgaactggatgccgattttgtttttgcaacctggcgcggtgacaccggtggtaaacctcaggatgagctggcagcaatggaaaaagtcatgccgggatggtgtcagtttctgactgcctgtcgttccgggcgttatgtgctgatttctcgtgaagaggcaatttctaactcctttgcatctctggggctgatggctgcgcagatacaatcacaaattgcagggcgacctctaccggaggctaaatga

SEQ ID NO: 7186 - protein, 315 aa, Escherichia coli
MRLFFSLLILLSFFSRATEPVQVFTDDLGRKVTVPAHPKRIVSLHDLDITIPLIELGVPPVASHGRTRPDGSHFIRSGALLTGVDFDNSSIAFIGTADIDIEAIVAAKPDLIITEPTRNTPIEQLEKIAPTVSIDHLKGGAPEIYRKLAELTGTQSQLAILERRYQAQINALKATLDSQKITVSVIQANQGKINVMHSYHSLGRVLRDAGFRFPPLIESIPEGGRMDVSAERLPELDADFVFATWRGDTGGKPQDELAAMEKVMPGWCQFLTACRSGRYVLISREEAISNSFASLGLMAAQIQSQIAGRPLPEAK

SEQ ID NO: 7187 - DNA, 1038 bp, Escherichia coli
atgaacgtcgggctacgcccactacgtgttggtaagttttcgacactggtgcgccctaaaaatctgctgttgcttggtgggctgttcctgcttgcggttggaatactgatattcggtctgatgcagggttctttctctgttccggcatcggaagtaggacgagcgttgtttgctccagaaaacgtaagcacagacgcacgttatattgtgcaggatattcgcttgccgagagtcatcatggcattgctatgcggggccatgttaggtatggcgggggccgcgatgcaatccattgcgcgtaacggccttgccgatcctggtttaatcggcgtcaaagaaggatgtagcgtggcggtgctgtggctgattttccagtttccaatgctgggaatgttctggcgtccagtggctggtcttgctggtggtctgttggtggctttaatcgtgattttttgtgcgcgcgatatttcccgcccgcgatttgttctgattggtattggtgtttcctggtttttcgccgccggtatcggtgtatttatgaccactgcagatgttcgagatgtacaaactgcattgatgtggttatcgggaagcctgcatgcagctaactggatgttagtcggtatttcagcctgttggatgttgccagccgctcttttattgctgttcaccgccaggactgcggatatcgctctgcttggtcatcaggttgcaaccgggttaggggtgaatagttctcgtctggcgttgttacgtgtcgccgcacccataatcctgacagccgtctgcgtttcgtgtgttggtaacatcggttttgtcggattgatagcaccccatatatcacgttttattctacgtggcgggcagacgacattactgctggggagcgcggtatcgggggcgttgttagttattctggcggatagcattggtcgtttggcttttttgcctttgcaactgcctgccggaatcattatctcactgattggtggaccattttttttgctactgctctggcagcgcaggaacagtttttaa

SEQ ID NO: 7188 - protein, 345 aa, Escherichia coli
MNVGLRPLRVGKFSTLVRPKNLLLLGGLFLLAVGILIFGLMQGSFSVPASEVGRALFAPENVSTDARYIVQDIRLPRVIMALLCGAMLGMAGAAMQSIARNGLADPGLIGVKEGCSVAVLWLIFQFPMLGMFWRPVAGLAGGLLVALIVIFCARDISRPRFVLIGIGVSWFFAAGIGVFMTTADVRDVQTALMWLSGSLHAANWMLVGISACWMLPAALLLLFTARTADIALLGHQVATGLGVNSSRLALLRVAAPIILTAVCVSCVGNIGFVGLIAPHISRFILRGGQTTLLLGSAVSGALLVILADSIGRLAFLPLQLPAGIIISLIGGPFFLLLLWQRRNSF

SEQ ID NO: 7189 - DNA, 984 bp, Escherichia coli
atgatgcgcacagggctggttactgtaattttcctcgccttactgctggtgggatgcgtggtatatccagggattggtgcccgatttattgcaccacaaacggtgttgcaggcatttcttcattttgatccgcaaaacttcgatcacaacgtaattgtaagactccgtttgccgcgtttagcggcagcattgcttaccggtgcttctcttggtgttgctggtgctttgttgcaggctgtcattcgtaacccattgggggagccacatattttaggcttaaatgccggagccgctcttgctgtcgttgccgctagtgcgcttggactggcctttccggttggacgcccactgctggcatctacggggggcgcgttattgttcctgttgatattgctgctttcctccgcagggcgttcagggttaacgccaatgaaagttactttatgcggcgtggcgctatcggcgttcgtgtcctcaataacggctgcaatcctgattcttgacgaacaaacactgctggcgatgcggacatggctagcaggtgatttagcggggcaggattgggcgacgctgggtacgtccgcctggttttctctggggggatttgtgttagccctttaccttgcaccctcccttaacatgttggcactgggcgatcgcatggcgcaggggctgggcgtctctgtactccgcacgcgaacattcaccctgcttgcgatcgcgttgctctgtggcgcagccgtatcgattgctggccccattggttttgtcggcctgctagtaccgcagattgtccggcgtctggtatcagcggatctgcgcgttctgctccctctttcagcttgtgtcggcgcgcttttgttattactggcagatattattgcccggacgcttttcacgccccatgagttagcgaccggtgtcatgacggcgttagttggtgcgcctgtttttgtcattatggcgacgaggatgttcaaatga

SEQ ID NO: 7190 - protein, 327 aa, Escherichia coli
MMRTGLVTVIFLALLLVGCVVYPGIGARFIAPQTVLQAFLHFDPQNFDHNVIVRLRLPRLAAALLTGASLGVAGALLQAVIRNPLGEPHILGLNAGAALAVVAASALGLAFPVGRPLLASTGGALLFLLILLLSSAGRSGLTPMKVTLCGVALSAFVSSITAAILILDEQTLLAMRTWLAGDLAGQDWATLGTSAWFSLGGFVLALYLAPSLNMLALGDRMAQGLGVSVLRTRTFTLLAIALLCGAAVSIAGPIGFVGLLVPQIVRRLVSADLRVLLPLSACVGALLLLLADIIARTLFTPHELATGVMTALVGAPVFVIMATRMFK

SEQ ID NO: 7191 - DNA, 810 bp, Escherichia coli
gtggcacataacgcaaaagggcaggggctgatcctcgacaatgtttctgccgggtatcacaagaagatcattgttgatggtgtttctttctccgttcccacagaaaaaatgaccgttctggttggggcaaacggctgtggaaagtcgacgttgctcagcaccattgcacgtatcttgcaacccatgggcggttcgatattgcttgatggcaaagcgattcacgagcaaccaacgaaagcgttatcccgtagacttgggatcttgccgcagtcgccattattgccggagggcttaaccgtttatgaactggtatcgcgtgggcgttttccctggcaaaatttcatacgtcaatggagcgacgccgatgagctggcggtggaagaggccctgaaattaacgggtacgcaggagtttgcacatttacctgttgaaaaactctctggtgggcagcgccagcgttgctggattgcgatggtgttggcgcaaaagacgccttatatcctgctggatgaacccacaacctggcttgatttacgttatcaggttgaaattcttgagttattacatgatttaacgcgtcatcacgggcgtacagtcgtcgtggtgttgcatgatctgaattttgccgtcaattatggtgatacgttgatatttttacgccaggggaaagtggtgcgtgtgttgaatgagggggagcattgcacgcctgagctggtaaaagcggtctttgacgttgatgttcacgcatcaataaatcctctgacgggaaagccgtacttcatgccgtttcgtggtgtagaaaaagtatga

SEQ ID NO: 7192 - protein, 269 aa, Escherichia coli
MAHNAKGQGLILDNVSAGYHKKIIVDGVSFSVPTEKMTVLVGANGCGKSTLLSTIARILQPMGGSILLDGKAIHEQPTKALSRRLGILPQSPLLPEGLTVYELVSRGRFPWQNFIRQWSDADELAVEEALKLTGTQEFAHLPVEKLSGGQRQRCWIAMVLAQKTPYILLDEPTTWLDLRYQVEILELLHDLTRHHGRTVVVVLHDLNFAVNYGDTLIFLRQGKVVRVLNEGEHCTPELVKAVFDVDVHASINPLTGKPYFMPFRGVEKV

SEQ ID NO: 7193 - DNA, 2142 bp, Escherichia coli
atggctatgttcacaccttcattctcaggactcaaaggtcgggcgctcttttcactgctttttgcggcaccgatgattcatgcaacagactctgtaacgaccaaagatggcgaaacaatcactgttacagcagatgcaaataccgcaactgaggcaaccgatggttatcaacctctgagcacctccacggcgacattaaccgatatgccgatgctggatatcccgcaggtggtcaatacggttagcgatcaggttctggaaaaccagaatgcgacaacgctggatgaggcgctttataacgtcagtaacgtggtacagaccaatacattaggcgggactcaggatgcttttgtacgccgtgggtttggcgcaaaccgggatggctccatcatgaccaacggtctgcgaaccgtacttcctcgtagtttcaacgccgcaacagagcgtgtggaagtgctaaaaggcccggcctccacgctgtatggcattctcgatcctggcggactgattaacgtcgtgaccaagcgcccggaaaaaacattccatggttcggtttcagccacctcctccagttttggtggcggcactgggcaacttgatatcacaggtcccattgaaggcactcagctggcgtatcgccttaccggggaagtgcaggatgaagattactggcgaaacttcggtaaagagcgcagtacatttattgccccgtcactcacctggtttggtgataatgcaacagtaaccatgctctattcccatcgggactataaaactccattcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgataatcaggcgcgtgttaccgcgtatgatgcaacgacaggaacactgacacggcgtgttgatgcaactcagggatctacccagcgtatgcatgctactcgtgcggatctgcaagggaatgttgatattgccggattctataatgagattctgggtggggtgtcatatgaatattatgatcttctgcgtacagatatgattcgctgtaaaaaagctaaagatttcaatatatacaaccctgtttatggtaataccagcaaatgtacaacggtttcggcgtcggacagcgatcagacgatcaaacaggagaactactcagcttatgcacaggacgcgctctatctgaccgataactggattgccgtcgccgggatccgctatcagtattacacgcaatatgcgggtaaaggccgtccttttaatgtcaatactgacagccgcgatgaacaatggacgcccaaactggggttagtctacaaactgacgccatcggtatccttatttgccaattattcgcaaacatttatgccgcagtcgtcaattgccagctacattggcgatcttccaccagaatcatctaatgcttacgaagtcggggcaaaattcgagctattcgatggtatcaccgcagatattgcgctgtttgatatccataaacgtaatgtgttgtataccgaaagtattggtgatgaaaccatcgccaaaacggcaggccgcgttcgttcaagaggggtagaagtcgaccttgcgggagcattaactgaaaacattaatatcattgccagctacggctataccgatgcaaaggttctggaagatcctgattatgcagggaaaccattgccgaatgttcctcgtcataccggttcgctattcctgacctatgatattcataacatgccaggcaataacacactgacgtttggcggtggcggacatggtgtaagccgtcgttcggcaaccaatggggctgactattatctgcctggctatttcgttgccgatgccttcgccgcatacaaaatgaaattgcagtatccggtcactctgcaattaaacgtcaaaaacctgtttgataaaacgtattacacctcttccatcgccacaaataatctgggcaaccagattggcgatccgcgtgaagtgcaattcacggtgaaaatggaattttga

SEQ ID NO: 7194 - protein, 713 aa, Escherichia coli
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQENYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 7195 - DNA, 1893 bp, Escherichia coli
atgacgcaaacttataacgctgatgccattgaggtactcaccgggcttgagccggttcgccgccgtccggggatgtataccgataccactcgccctaaccatttggggcaagaagttattgataacagtgtcgatgaagcactggcgggccacgcaaaacgcgtggatgtaatcttacatgccgaccagtcgttagaagtgattgacgatgggcgcgggatgccggtagatattcacccggaagagggggtaccggcggttgaactgattctttgccgtctgcacgcgggcggtaaattctctaacaaaaattaccagttctctggcggcctgcatggcgtggggatttcggtagttaacgccctgtcgaagcgcgtagaagttaacgtacgccgcgatggtcagatctataacatcgcctttgaaaatggcgaaaaggtgcaagatttacaggttgtcggcacttgcggtaaacgcaataccggtaccagcgtgcacttctggccggatgaaaccttctttgacagcccgcgtttttctgtttcacgcctgacgcatgtgctgaaagccaaagcggtactgtgcccgggcgttgagatcacttttaaagatgagatcaacaacaccgaacagcgctggtgctatcaggacggtctgaatgattacctggcggaagcggtaaacggtttaccgacgctgccagaaaaaccgtttatcggtaatttcgctggcgatactgaagcggtggactgggcgctactgtggctgccggaaggcggtgaactgctgaccgaaagctacgtcaacctgatcccaacgatgcagggcggtacccatgttaatggcctgcgtcagggcctgctggacgcgatgcgtgagttctgtgaataccgcaacattctgccgcgtggtgtaaagctgtcggcggaagatatctgggatcgctgcgcctatgtgctgtcagtaaaaatgcaggatccgcagtttgccgggcagaccaaagaacgtctctcttcgcgtcagtgtgcggcattcgtttcgggcgtggtgaaagatgccttcatcctgtggctgaaccagaacgttcaggcggcggagctgttggcagagatggcgatttccagcgcccagcgtcgtatgcgtgcggctaaaaaagtggtgcgtaaaaagctaaccagcggcccggcgctgcctggtaaattggctgactgtaccgcgcaggatcttaaccgtaccgaactattccttgtggaaggtgactccgcaggcggatctgccaagcaggcgcgcgatcgcgaatatcaggcgatcatgccactgaaaggtaagatccttaacacctgggaagtctcttccgacgaagtgctggcttcgcaggaagtgcacgatatttcggtagctatcggtatcgatcctgacagcgacgatttgagccagcttcgttacggcaagatctgtatcctggcggatgctgactccgatggtctgcacattgccacgctgctctgcgctttgtttgtaaaacacttccgcgcattggtgaaacacggtcacgtttacgttgcactgccaccgctctaccgtattgacctcgggaaagaggtttattacgcgctgacggaagaagagaaagagggcgtacttgagcaattaaaacgcaagaaaggcaagccaaacgtccagcgttttaaaggtctcggggaaatgaacccgatgcaattgcgcgaaaccacgcttgatccgaacactcgccgtctggtgcagttgactatcgatgatgaagacgatcagcgtactgacgcgatgatggatatgctgctggcgaagaaacgctcggaagatcgccgcaattggttgcaagaaaaaggcgacatggcagagattgaggtctga

SEQ ID NO: 7196 - protein, 630 aa, Escherichia coli
MTQTYNADAIEVLTGLEPVRRRPGMYTDTTRPNHLGQEVIDNSVDEALAGHAKRVDVILHADQSLEVIDDGRGMPVDIHPEEGVPAVELILCRLHAGGKFSNKNYQFSGGLHGVGISVVNALSKRVEVNVRRDGQIYNIAFENGEKVQDLQVVGTCGKRNTGTSVHFWPDETFFDSPRFSVSRLTHVLKAKAVLCPGVEITFKDEINNTEQRWCYQDGLNDYLAEAVNGLPTLPEKPFIGNFAGDTEAVDWALLWLPEGGELLTESYVNLIPTMQGGTHVNGLRQGLLDAMREFCEYRNILPRGVKLSAEDIWDRCAYVLSVKMQDPQFAGQTKERLSSRQCAAFVSGVVKDAFILWLNQNVQAAELLAEMAISSAQRRMRAAKKVVRKKLTSGPALPGKLADCTAQDLNRTELFLVEGDSAGGSAKQARDREYQAIMPLKGKILNTWEVSSDEVLASQEVHDISVAIGIDPDSDDLSQLRYGKICILADADSDGLHIATLLCALFVKHFRALVKHGHVYVALPPLYRIDLGKEVYYALTEEEKEGVLEQLKRKKGKPNVQRFKGLGEMNPMQLRETTLDPNTRRLVQLTIDDEDDQRTDAMMDMLLAKKRSEDRRNWLQEKGDMAEIEV

SEQ ID NO: 7197 - DNA, 582 bp, Escherichia coli
atgtctacgcttctttatttacacggtttcaacagctcgccgcgctctgcaaaagcgagcttgttaaaaaactggctggcggaacatcaccctgacgttgagatgatcattccgcagttgcccccgtatccttctgacgcggcagaactgctggaatctattgtcctggaacatggcggcgattcgctgggtattgtcggttcgtcactggggggatattacgccacctggttgtcgcaatgttttatgctgcccgcagtggtggtcaacccggcggtgcgcccgtttgaactgctgacggactatctcggtcagaacgagaacccctacaccgggcagcaatatgtgctagagtcacgccatatttacgatctcaaagtcatgcagattgacccgctggaagcgccggatttgatctggctgctgcaacagacgggagatgaagtgctggattaccgccaggcggtggcgtactacgcttcctgccgccagactgtcatagaaggcggcaaccacgcattcacgggcttcgaagattatttcaacccgatcgtcgattttcttggtctgcaccatctctga

SEQ ID NO: 7198 - protein, 193 aa, Escherichia coli
MSTLLYLHGFNSSPRSAKASLLKNWLAEHHPDVEMIIPQLPPYPSDAAELLESIVLEHGGDSLGIVGSSLGGYYATWLSQCFMLPAVVVNPAVRPFELLTDYLGQNENPYTGQQYVLESRHIYDLKVMQIDPLEAPDLIWLLQQTGDEVLDYRQAVAYYASCRQTVIEGGNHAFTGFEDYFNPIVDFLGLHHL

SEQ ID NO: 7199 - DNA, 828 bp, Escherichia coli
ttggaaagcctgttaacccttcctctggctggtgaggccagagtcaggattttacaaattaccgacactcacctgtttgcacaaaagcacgaagccctgttaggggtaaacacctgggaaagctaccaggcggtgctggaggcgattcggccacaccagcacgaattcgacctgattgtcgcgacaggtgatttagcgcaggatcaatcctctgcggcctatcagcatttcgctgaaggcatcgcaagttttcgtgcgccctgcgtctggctgccgggcaaccacgatttccagcccgcgatgtacagtgcgttacaggatgcgggtatctccccggcgaagcgcgtgtttattggtgagcaatggcaaatcctgttgctggatagccaggtgtttggcgtgccgcacggtgagctgagcgagtttcagcttgagtggctggaacgtaaactggccgatgcgccagaacgccatacgttgctgctgctgcatcatcatccgctacctgcaggttgtagttggcttgatcaacacagcctgcgtaacgcgggcgaactggataccgtgctggcgaagtttccgcacgtcaaatacttgctgtgcggtcacattcatcaggagctggatctcgactggaacggtcgccgcttgctggcaacgccgtcgacctgtgtgcagtttaagccgcattgttctaactttacgctggacaccatcgcgcccggctggcgtactctcgagttacatgctgatggcacgctgaccaccgaggtgcatcgcctggcggacgcacgcttccaacctgataccgcttcagaaggctactga

SEQ ID NO: 7200 - protein, 275 aa, Escherichia coli
MESLLTLPLAGEARVRILQITDTHLFAQKHEALLGVNTWESYQAVLEAIRPHQHEFDLIVATGDLAQDQSSAAYQHFAEGIASFRAPCVWLPGNHDFQPAMYSALQDAGISPAKRVFIGEQWQILLLDSQVFGVPHGELSEFQLEWLERKLADAPERHTLLLLHHHPLPAGCSWLDQHSLRNAGELDTVLAKFPHVKYLLCGHIHQELDLDWNGRRLLATPSTCVQFKPHCSNFTLDTIAPGWRTLELHADGTLTTEVHRLADARFQPDTASEGY

SEQ ID NO: 7201 - DNA, 423 bp, Escherichia coli
atgaagcgttacacacctgactttcctgaaatgatgcgcctgtgcgagatgaacttttcacaattgcgccgtttgttaccgcgcaatgacgcacccggcgaaactgtaagctatcaggtggcaaacgcacaatatcggctgacgattgtggaatcgacccgatacactaccctggtgacaatagaacagactgcgcccgcgatcagttactggagccttccgtcaatgacggtgcgtctgtatcatgacgcgatggtggctgaagtgtgttcaagccagcagatttttcgcttcaaagcgcggtatgattatcctaataaaaagttgcatcaacgcgacgaaaagcatcaaattaatcagtttttagcggactggttgcgatactgtttagcacatggagcgatggcgattccggtttattag

SEQ ID NO: 7202 - protein, 140 aa, Escherichia coli
MKRYTPDFPEMMRLCEMNFSQLRRLLPRNDAPGETVSYQVANAQYRLTIVESTRYTTLVTIEQTAPAISYWSLPSMTVRLYHDAMVAEVCSSQQIFRFKARYDYPNKKLHQRDEKHQINQFLADWLRYCLAHGAMAIPVY

SEQ ID NO: 7203 - DNA, 630 bp, Escherichia coli
atgcttaagccagacaacctgcccgttacatttggcaaaaacgatgtagaaattattgcacgagaaacactttatcgcggctttttttcattagatctttatagatttcgtcatcgtctattcaacgggcaaatgagtcatgaggtacggcgggaaatttttgagcgcggtcacgccgcagtcttgctaccctttgacccagtacgtgatgaagttgtgctgattgagcagattcggattgccgcgtacgacaccagcgaaaccccctggctactggagatggttgccgggatgattgaagagggggaaagtgtggaagatgttgcccgtcgcgaagcgattgaagaggcgggactgatagtcaaacggaccaaaccggtgttaagtttcctggcaagcccggggggcaccagtgagcgttcgtcaattatggtgggcgaagtggacgccacgaccgcaagcggtattcacggtctggctgatgaaaacgaagatattcgcgttcatgtggtaagccgggaacaggcataccagtgggtagaagaggggaaaatcgacaacgcagcgtcggtcatcgctttgcaatggctgcagctgcatcatcaagcgttaaaaaatgagtgggcataa

SEQ ID NO: 7204 - protein, 209 aa, Escherichia coli
MLKPDNLPVTFGKNDVEIIARETLYRGFFSLDLYRFRHRLFNGQMSHEVRREIFERGHAAVLLPFDPVRDEVVLIEQIRIAAYDTSETPWLLEMVAGMIEEGESVEDVARREAIEEAGLIVKRTKPVLSFLASPGGTSERSSIMVGEVDATTASGIHGLADENEDIRVHVVSREQAYQWVEEGKIDNAASVIALQWLQLHHQALKNEWA

SEQ ID NO: 7205 - DNA, 1482 bp, Escherichia coli
atgaagaaattgctccccattcttatcggcctgagcctctctgggttcagttcgttgagccaggccgagaacctgatgcaagtttatcagcaagcacgccttagtaacccggaattgcgtaagtctgccgccgatcgtgatgctgcctttgaaaaaattaatgaagcgcgcagtccattactgccacaactaggtttaggtgcagattacacctatagcaacggctaccgcgacgcgaacggcatcaactctaacgcgaccagtgcgtccctgcagttaactcaatccatttttgatatgtcgaaatggcgtgcgttaacgctgcaggaaaaagcagctgggattcaggacgtcacgtatcagaccgatcaacaaaccttgatcctcaacaccgcgaccgcttatttcaacgtgttgaatgcgattgacgttctttcctatacacaggcgcaaaaagaagcgatctaccgtcaattagatcaaaccacccaacgttttaacgtgggcctggtagcgatcaccgacgtgcagaacgcccgcgcacagtacgataccgtgctggcgaacgaagtgaccgcacgtaataaccttgataacgcggtagagcagctgcgccagatcaccggtaactactatccggaactggcggcgctgaatgtcgaaaactttaaaaccgacaaaccacagccggttaacacgctgctgaaagaagccgaaaaacgtaacctgtcgttgttacaggcgcgcttgagccaggacctggcgcgcgagcaaattcgccaggcgcaggacggtcacttaccgactctggatttgacggcctctaccggaatttctgacacctcttacagcggttcaaaaacccgtggtgccgctggtacccagtatgacgatagcaatatgggccagaacaaagttggcctgagcttctcgctgccgatttatcagggcggaatggttaactcgcaggtgaaacaggcccagtacaactttgttggtgccagcgagcaactggaaagcgcgcatcgtagcgtcgtgcaaaccgtacgttcctccttcaacaacattaatgcttctatcagtagcattaacgcctacaaacaagccgtagtttccgctcaaagctcattagacgcgatggaagcgggttactcggttggtacgcgtaccattgttgatgtgttggatgcgaccaccacgctgtacaacgctaagcaagagctggcaaatgcgcgttataactacctgattaaccagttgaatattaagtcagctctgggtacgttgaacgagcaggatctgctggcactgaacaatgcgctgagcaaaccggtttccactaatccggaaaacgttgccccgcaaacgccggaacagaatgctattgctgatggttatgcgcctgatagcccggcacccgtcgttcagcaaacatccgcacgcactaccaccagtaacggtcataaccctttccgtaactga

SEQ ID NO: 7206 - protein, 493 aa, Escherichia coli
MKKLLPILIGLSLSGFSSLSQAENLMQVYQQARLSNPELRKSAADRDAAFEKINEARSPLLPQLGLGADYTYSNGYRDANGINSNATSASLQLTQSIFDMSKWRALTLQEKAAGIQDVTYQTDQQTLILNTATAYFNVLNAIDVLSYTQAQKEAIYRQLDQTTQRFNVGLVAITDVQNARAQYDTVLANEVTARNNLDNAVEQLRQITGNYYPELAALNVENFKTDKPQPVNTLLKEAEKRNLSLLQARLSQDLAREQIRQAQDGHLPTLDLTASTGISDTSYSGSKTRGAAGTQYDDSNMGQNKVGLSFSLPIYQGGMVNSQVKQAQYNFVGASEQLESAHRSVVQTVRSSFNNINASISSINAYKQAVVSAQSSLDAMEAGYSVGTRTIVDVLDATTTLYNAKQELANARYNYLINQLNIKSALGTLNEQDLLALNNALSKPVSTNPENVAPQTPEQNAIADGYAPDSPAPVVQQTSARTTTSNGHNPFRN

SEQ ID NO: 7207 - DNA, 705 bp, Escherichia coli
atgggtatttaccactggtcccggaagacaaaaatgaaacggacaaaatccatacgccacgcatcgttccgcaaaaactggagcgcacgccatctgacaccagtcgctctcgcggttgccactgtttttatgctggctggctgtgaaaagagtgatgaaacagtgtctctctatcaaaatgctgacgactgttcagctgcaaacccaggcaaaagcgccgaatgtaccaccgcgtacaacaatgcgctgaaagaagccgaacgtactgcgccgaaatacgccacccgtgaagactgtgttgctgaatttggtgaaggtcagtgccagcaggcaccagcccaggcaggcatggcaccagaaaaccaggcgcaggcccagcaatccagcgggagtttctggatgccgctgatggccggttacatgatgggacgtctgatgggcggcggcgcgggatttgcacagcagccgctgttctcctcgaaaaacccggccagcccggcttacggtaaatataccgacgcgaccggtaaaaactatggcgcagcccagccaggccgcaccatgaccgtaccgaagacggcaatggcaccaaaaccggcgaccactactactgttacccgtggcggttttggtgaatctgttgccaaacaaagcactatgcagcgtagcacaaccggcacctcttctcgttcaatgggtggctga

SEQ ID NO: 7208 - protein, 234 aa, Escherichia coli
MGIYHWSRKTKMKRTKSIRHASFRKNWSARHLTPVALAVATVFMLAGCEKSDETVSLYQNADDCSAANPGKSAECTTAYNNALKEAERTAPKYATREDCVAEFGEGQCQQAPAQAGMAPENQAQAQQSSGSFWMPLMAGYMMGRLMGGGAGFAQQPLFSSKNPASPAYGKYTDATGKNYGAAQPGRTMTVPKTAMAPKPATTTTVTRGGFGESVAKQSTMQRSTTGTSSRSMGG

SEQ ID NO: 7209 - DNA, 1161 bp, Escherichia coli
atggaaagagtcagtattaccgagcgcccggactggcgcgaaaaagcccacgaatacggtttcaattttcacaccatgtacggcgagccgtactggtgtgaagatgcttactacaagttgaccctcgcccaggttgaaaagctggaagaagtcaccgccgaactgcaccagatgtgcctgaaagtggtggaaaaagtgatcgccagcgatgagctgatgaccaaattccgcattccaaaacacacctggagttttgtgcgccagtcatggctgacgcaccagccatcgctttattcgcgtcttgatctggcgtgggatggcactggcgaacctaaacttctggaaaataacgccgatacgccaacgtcactatacgaggcggcgttctttcagtggatctggctggaagatcagcttaacgccggtaacttgccggagggcagcgaccagtttaacagtttgcaagaaaagctgatcgatcgcttcgttgagctgcgtgaacagtatggcttccagttgctgcatctcacctgctgtcgcgacacggtggaagatcgcggaaccattcagtatttgcaggactgcgcgacggaagctgaaatcgctaccgagttcctctacatcgacgatatcgggttaggtgaaaaaggtcagttcacggatttacaggatcaggtgatttccaacctgttcaagctgtatccgtgggaatttatgttgcgtgagatgttctccaccaagctggaggatgcaggcgtacgctggctggaaccggcgtggaagagcattatctccaacaaagcgcttctaccgctactgtgggagatgttcccgaatcacccgaacctgctgcccgcttattttgcggaagatgatcatccgcaaatggaaaaatatgtggttaaaccgatcttctcccgtgaaggcgcaaacgtgtcgatcattgagaacggcaaaaccattgcagcagcggaaggtccgtatggcgaagaagggatgattgttcagcaattccacccgttaccgaaattcggcgacagctatatgctgattggtagctggctggtgaacgatcaacctgccggaattggcattcgtgaagaccgtgcattgatcacccaggatatgtctcggttttatccgcatatttttgttgagtaa

SEQ ID NO: 7210 - protein, 386 aa, Escherichia coli
MERVSITERPDWREKAHEYGFNFHTMYGEPYWCEDAYYKLTLAQVEKLEEVTAELHQMCLKVVEKVIASDELMTKFRIPKHTWSFVRQSWLTHQPSLYSRLDLAWDGTGEPKLLENNADTPTSLYEAAFFQWIWLEDQLNAGNLPEGSDQFNSLQEKLIDRFVELREQYGFQLLHLTCCRDTVEDRGTIQYLQDCATEAEIATEFLYIDDIGLGEKGQFTDLQDQVISNLFKLYPWEFMLREMFSTKLEDAGVRWLEPAWKSIISNKALLPLLWEMFPNHPNLLPAYFAEDDHPQMEKYVVKPIFSREGANVSIIENGKTIAAAEGPYGEEGMIVQQFHPLPKFGDSYMLIGSWLVNDQPAGIGIREDRALITQDMSRFYPHIFVE

SEQ ID NO: 7211 - DNA, 1797 bp, Escherichia coli
atgtttgataaatatagaaaaacactcgtagccggaactgtggcgataaccctgggtttgtcagcatcgggggtgatggctgcgggttttaaaccagcgccacctgccgggcaactgggtgcggtcattgtcgatccctacggcaatgcaccactgaccgctttggttgacttagatagccatgttatttctgacgtcaaagttaccgtccatgggaagggcgaaaaaggcgtagaaatcagctatcccgtgggtcaggaatcactaaaaacttacgatggtgtaccgatttttggtctttatcagaaatttgctaacaaagtgaccgttgagtggaaagaaaacggcaaggtcatgaaagatgattatgtggtgcacacttcggccatcgtcaataattacatggataaccgctctatctccgatttacaacagaccaaagttattaaagtcgcaccgggttttgaagatcgcctctatctggttaatacccacacctttaccgcccaaggttccgatctccactggcatggtgagaaagataaaaatgccggtatccttgatgcgggtccggcaaccggcgcactcccttttgatatcgcgccctttactttcatcgtcgataccgaaggtgaataccgctggtggctggatcaagacactttctacgatggtcgtgaccgcgatatcaacaagcgtggttatctgatgggtatccgcgaaacgccacgcggcacctttaccgctgtacaaggtcagcactggtacgagttcgacatgatggggcaggtgctcgaagatcacaaactaccgcgcggatttgctgacgccactcatgagtccattgagacgccaaatggcacggtactgttgcgcgtaggtaagagtaactatcgtcgcgatgacggcgtacacgtcaccaccattcgtgaccatatcctcgaagtcgataaatctggtcgcgttgtcgatgtatgggatctgaccaagatcctcgatccgaaacgcgatgcactgctcggcgcgctggatgcaggtgcagtttgcgttaacgttgaccttgcccatgcaggacaacaggcaaaactggaaccagatacaccgttcggcgacgcgctgggtgtagggccaggccgcaactgggcgcacgtgaactctatcgcctatgacgcaaaagatgactctatcatcctctcctctcgccaccagggtgttgtgaagattggtcgtgataagcaagtgaaatggatccttgcgccctctaaaggttgggaaaaaccgctggccagcaagctgctgaaaccggttgatgctaacggtaagccaattacctgtaacgaaaatggcctgtgcgaaaactcagacttcgactttacctacacccagcataccgcctggatttccagcaaaggaacgctcaccatttttgataatggcgatgggcgtcatctggaacaacctgccttaccaaccatgaaatactctcgctttgtggaatataagattgatgagaagaaaggcaccgttcagcaagtgtgggaatacggtaaagaacgtggctacgatttctatagcccgattacctccatcattgaatatcaagccgaccgtaacaccatgtttggcttcggtggttctattcatttgttcgatgtcgggcagccaaccgtcggtaagttgaacgaaatcgattacaaaaccaaagaagtgaaagtggaaatcgacgtgctgtcagataaacccaatcagactcactaccgtgcgctgttagtccgtccacaacagatgttcaaataa

SEQ ID NO: 7212 - protein, 598 aa, Escherichia coli
MFDKYRKTLVAGTVAITLGLSASGVMAAGFKPAPPAGQLGAVIVDPYGNAPLTALVDLDSHVISDVKVTVHGKGEKGVEISYPVGQESLKTYDGVPIFGLYQKFANKVTVEWKENGKVMKDDYVVHTSAIVNNYMDNRSISDLQQTKVIKVAPGFEDRLYLVNTHTFTAQGSDLHWHGEKDKNAGILDAGPATGALPFDIAPFTFIVDTEGEYRWWLDQDTFYDGRDRDINKRGYLMGIRETPRGTFTAVQGQHWYEFDMMGQVLEDHKLPRGFADATHESIETPNGTVLLRVGKSNYRRDDGVHVTTIRDHILEVDKSGRVVDVWDLTKILDPKRDALLGALDAGAVCVNVDLAHAGQQAKLEPDTPFGDALGVGPGRNWAHVNSIAYDAKDDSIILSSRHQGVVKIGRDKQVKWILAPSKGWEKPLASKLLKPVDANGKPITCNENGLCENSDFDFTYTQHTAWISSKGTLTIFDNGDGRHLEQPALPTMKYSRFVEYKIDEKKGTVQQVWEYGKERGYDFYSPITSIIEYQADRNTMFGFGGSIHLFDVGQPTVGKLNEIDYKTKEVKVEIDVLSDKPNQTHYRALLVRPQQMFK

SEQ ID NO: 7213 - DNA, 669 bp, Escherichia coli
atgtcgaaattagggatctcatcactatttaaaaccatactgcttaccgcagctctggcggtttcatttaccgcttctgcatttaccgaaggcacggattacatggttctggaaaaaccaattccgaatgccgacaaaacgctgattaaggtatttagctacgcctgcccgttctgttacaagtacgacaaagcggttaccggtccggtatcggaaaaagtgaaagatatcgttgctttcacgccattccatctggaaacaaaaggtgaatacggcaaacaagcaagcgaagtctttgcggtcttgatcaataaagataaagcagcaggcatttccttatttgatgctaactctcagtttaagaaagccaagtttgcctactacgcggcttatcacgacaaaaaagaacgctggtctgacggtaaagatccggctgcttttatcaaaaccggtctggatgccgcaggtatgagtcaggcggattttgaagcggcactgaaagaaccagcggttcaagaaacactgaaaaaatggaaagcctcttatgatgtcgccaaaatccagggagttccagcctatgtcgttaatggtaagtacttgatctacaccaagagcatcaaatccatcgacgcgatggcagaccttatccgtgagttagcaagcaaataa

SEQ ID NO: 7214 - protein, 222 aa, Escherichia coli
MSKLGISSLFKTILLTAALAVSFTASAFTEGTDYMVLEKPIPNADKTLIKVFSYACPFCYKYDKAVTGPVSEKVKDIVAFTPFHLETKGEYGKQASEVFAVLINKDKAAGISLFDANSQFKKAKFAYYAAYHDKKERWSDGKDPAAFIKTGLDAAGMSQADFEAALKEPAVQETLKKWKASYDVAKIQGVPAYVVNGKYLIYTKSIKSIDAMADLIRELASK

SEQ ID NO: 7215 - DNA, 570 bp, Escherichia coli
atgggcgcgttaattatcctggcgcactctttcttccagatctatctctacatggcaccctgtgagcaatgtgtatacattcgctacgccatgtttgtgatggttattggaggattggttgcagcgatcaacccaaagaacatcatcctaaagctaattggctgcgtgatggcattttacggcagcattttgggactgaagttttcgctcaaactgaacgatatccaccatgcagtacataatccggatcccgattcactgtttggcgtacagggttgctctaccgatcccacttttccctttaacctgccgctggcacagtgggcaccaaattggttcaagcctaccggggattgtggctatgacgcaccaatcgttcctgatggcgtcacactgagcagcacgcaacagtggtttgtggaaatgtatcagcaatctgaaggctggtatctgctaccaccatggcattttatgaatatggctcaggcttgtatgctggcttttggtatgtgtctggtgctgctggtcattatgagtggcgcatgggcgcttaaaatcatcagaggctaa

SEQ ID NO: 7216 - protein, 189 aa, Escherichia coli
MGALIILAHSFFQIYLYMAPCEQCVYIRYAMFVMVIGGLVAAINPKNIILKLIGCVMAFYGSILGLKFSLKLNDIHHAVHNPDPDSLFGVQGCSTDPTFPFNLPLAQWAPNWFKPTGDCGYDAPIVPDGVTLSSTQQWFVEMYQQSEGWYLLPPWHFMNMAQACMLAFGMCLVLLVIMSGAWALKIIRG

SEQ ID NO: 7217 - DNA, 615 bp, Escherichia coli
atggagacgccgcccacgattcatgattttggtggcttcccgcaggcactgtacgatacgcattatcctgctccgggttcgcctgcgctggcacagcgtctggttgagctgttagcgccggttcctgtggcgctggataaagaagcctggggctttgaccacggttcctggggagtgctgattaagatgtaccctgacgccgatatcccgatggtgcagttgagtatcgacagtagcaaacctgccgcctggcatttcgaaatggggcgcaaactcgcggcgctgcgtgatgaagggataatgttggtcgccagtggcaacgtggtgcataacctgcgtacagtgaagtggcacggtgatagttcaccgtatccgtgggcgacgtcgtttaatgagtatgtgaaagcgaatctgacgtggcaagggccagtggaacaacatcctctggtgaattatctcgaccatgaaggtggcgcgttatcgaacccaacgccagagcactatctgccgttgttgtatgtcttaggggcgtgggatgggcaggagccaattaccattccggtcgatggtatagaaatgggcagtttaagtatgctgtcggtgcagataggttaa

SEQ ID NO: 7218 - protein, 204 aa, Escherichia coli
METPPTIHDFGGFPQALYDTHYPAPGSPALAQRLVELLAPVPVALDKEAWGFDHGSWGVLIKMYPDADIPMVQLSIDSSKPAAWHFEMGRKLAALRDEGIMLVASGNVVHNLRTVKWHGDSSPYPWATSFNEYVKANLTWQGPVEQHPLVNYLDHEGGALSNPTPEHYLPLLYVLGAWDGQEPITIPVDGIEMGSLSMLSVQIG

SEQ ID NO: 7219 - DNA, 102 bp, Escherichia coli
ttgaaaagcatcaataatacctttaataacgatacagatgttgcctttagcaatgggcaacatctgtcattatcgtctttaaccaattcccgccgtttgtag

SEQ ID NO: 7220 - protein, 33 aa, Escherichia coli
MKSINNTFNNDTDVAFSNGQHLSLSSLTNSRRL

SEQ ID NO: 7221 - DNA, 774 bp, Escherichia coli
atgtcagtacctctcattctgaccatactggcgggggcagccacgtttattggcgcgtttctcggcgttctcgggcaaaaaccctcgaaccgcttactggcgttttcgctaggatttgcggcggggatcatgttgctcatctcattaatggaaatgcttcctgccgcattagccgccgaaggaatgtcgcctgtgttgggttatggaatgtttatcttcggtctgcttggctattttggcctggaccgcatgttgccacatgcgcatccgcaggatttaatgcaaaaatcggtgcagccgttgccaaaatcgatcaagcgcacagccattctgctcactctcggcatcagtctgcataacttcccggaagggattgccacctttgtcacggcgagcagcaacctggagctgggatttggcatcgccctggccgtagcgttgcacaatattcctgaaggtctggcggttgcaggcccggtttacgctgcaacaggatcgaaacgtaccgcgattctgtgggcgggcatttccggactggctgaaattctcggtggcgttctggcgtggttaattcttggcagcatgatttctccggtggtcatggcggcaatcatggcggcggttgcaggaattatggtggcgctctccgttgatgaattaatgccgctcgccaaagagattgaccccaataataaccccagctatggcgtgctatgtggaatgtcagtgatgggattcagtttagtgctgctacaaacggcgggaattggttaa

SEQ ID NO: 7222 - protein, 257 aa, Escherichia coli
MSVPLILTILAGAATFIGAFLGVLGQKPSNRLLAFSLGFAAGIMLLISLMEMLPAALAAEGMSPVLGYGMFIFGLLGYFGLDRMLPHAHPQDLMQKSVQPLPKSIKRTAILLTLGISLHNFPEGIATFVTASSNLELGFGIALAVALHNIPEGLAVAGPVYAATGSKRTAILWAGISGLAEILGGVLAWLILGSMISPVVMAAIMAAVAGIMVALSVDELMPLAKEIDPNNNPSYGVLCGMSVMGFSLVLLQTAGIG

SEQ ID NO: 7223 - DNA, 186 bp, Escherichia coli
ttgaaggtgaaaaggatgtttattgcctggtactggattgtattaattgttctactggctggtggctattttcttcatcttaaacgttactgtaaagcttttcgccatgacagagatgcgctgttagctgcccgaagtaaattagataaacgctccgataaagaagtgtttgaaaagcatcaataa

SEQ ID NO: 7224 - protein, 61 aa, Escherichia coli
MKVKRMFIAWYWIVLIVLLAGGYFLHLKRYCKAFRHDRDALLAARSKLDKRSDKEVFEKHQ

SEQ ID NO: 7225 - DNA, 564 bp, Escherichia coli
atgttaaaaaaaacattgttatctatgttcgcaaccgcattgttatcaggcgttgcttttaacgctcttgctgacgatgctaatcagggttcaggtaaaattacttttaaaggtgaagttatcgatgcaccttgttctattgctcctggtgatgaagatcagacaataaacctcggtgaagttgctgataccgtattaaaaagcggtcagaaatcactgcctgtagatgtcaccattcatttgcaggattgtattttatctgacggcactaacactgttgataaagtcaaaatcacctttagttctgccagtgttgacgctaccgactccaacctgcttaaaaacactctggaaggtaacatcggcggcgcaactgatgtaggcgtacgtctggtgaaatcagacaacaccaacgtgactcttggcactccaatcactatcaacttcccgacgactaactcttaccaggagttgaactttaaagcccgtatggagtctctgggacgcaccgcgaccccgggtaacgtgcaggcacaggctaattacgtactcgactacaagtaa

SEQ ID NO: 7226 - protein, 187 aa, Escherichia coli
MLKKTLLSMFATALLSGVAFNALADDANQGSGKITFKGEVIDAPCSIAPGDEDQTINLGEVADTVLKSGQKSLPVDVTIHLQDCILSDGTNTVDKVKITFSSASVDATDSNLLKNTLEGNIGGATDVGVRLVKSDNTNVTLGTPITINFPTTNSYQELNFKARMESLGRTATPGNVQAQANYVLDYK

SEQ ID NO: 7227 - DNA, 1074 bp, Escherichia coli
atgaacaataaaaacacgttttcccgggataagttatcccatgcaattaaaaatgccctgtctggcgttgtgtgttccctactcttcgttttgccagtccacgccgtagaattcaacgtcgatatgattgacgcagaagaccgtgagaatatcgacatctctcgttttgagaaaaaaggctatatcccccctggtagatacctcgttcgtgtgcaaataaataaaaatatgttgccacaaacgttaatactggaatgggtaaaagccgataatgaaagtggttcgttactctgcttaaccaaagaaaatttgactaatttcggtcttaatacggaatttattgaatcattgcaaaacatagctggcagcgaatgtctcgatttaagccaacgtcaggagttaacgacacgacttgataaagctacgatgatattatcgctaagtgttccccaggcatggttaaaataccaggcaacaaactggacgccaccagagttttgggataccggtatcgccgggtttatccttgattacaacgtgtacgccagccagtatgccccacatcacggagacagcacccaaaacgtcagctcctatggtacgttaggctttaacctcggcgcatggcgcttacgtagcgattaccaatataatcagaattttgctgatggacgctcggtaaaccgcgacagcgaatttgcgcgaacttatctgtttcgccctatcccctcctggtcgtcaaaattcactatgggccagtacgacctgagctccaatctttacgataccttccactttactggcgcatcgctggaaagtgatgaaagcatgctgccgccagatttacagggttatgcgccacaaattaccggcatcgcgcagaccaacgcgaaagtaactgtggcacaaaatggtcgtgtactttatcaaaccactgtcgcgccaggcccttttactatttctgatttggggcaatcgtttcaggggctgctggatgtcacagtggaagaagaagatggccgcaccagcaccttcccaggttggctccgcatccattccctatttaacccgtaa

SEQ ID NO: 7228 - protein, 357 aa, Escherichia coli
MNNKNTFSRDKLSHAIKNALSGVVCSLLFVLPVHAVEFNVDMIDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDTGIAGFILDYNVYASQYAPHHGDSTQNVSSYGTLGFNLGAWRLRSDYQYNQNFADGRSVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGLLDVTVEEEDGRTSTFPGWLRIHSLFNP

SEQ ID NO: 7229 - DNA, 1530 bp, Escherichia coli
atgtcacagtggaagaagaagatggccgcaccagcaccttcccaggttggctccgcatccattccctatttaacccgtaaagggcaagtgcgctataaaacgtcactgggaaaaccgacatccgtcgggcataacgatatcaataatccctttttctggacggcggaagcctcctggggctggctgaacaatgtgtcgttgtatggtggtggcatgttcaccgctgatgattatcaggctatcactaccggtattggctttaaccttaaccaattcggttcgctttcttttgatgtcactggagcagacgcgtctttacagcaacaaaatagcggcaatctgcgtggttacagctatcgcttcaactatgcaaagcatttcgaatcgacaggcagtcagattaccttcgcgggttatcgcttctcagataaagattacgtgtcgatgagtgagtacctcagctcgcgtaatggcgatgagtcaatcgataatgaaaaagagagttatgtcatttccttgaaccagtactttgaaacgctggaattaaactcttatctcaacgttacacgcaatacttattgggacagcgccagcaataccaactactccgtatctgtaagcaaaaactttgatattggcgatttcaaaggtatatctgcatcgctggcagtaagtcgaatccgctgggatgacgacgaagagaatcaatattacttctctttctctctacctttacaacaaaaccgcaacatctcctacagtatgcagcgaacgggaagcagtaatacttcgcagatgatttcctggtacgattcatcagatcgcaacaatatctggaatatttcagcgtcggcaacggacgacaatatacgtgatggcgaaccaacactgcgcggcagctaccagcactattcgccgtggggacgtctgaacattaatggcagtgtacagccgaatcagtacaattctgttaccgcaggctggtacggttcacttaccgctacacgtcatggtatcgcccttcacgattatagctatggcgataacgcccgcatgatggtcgataccgatggcatctccggcattgaaatcaactctaaccgtaccgttaccaacgggctgggcatcgccgtgataccttcgttatcgaactacaccacctccatgttgcgggtgaacaataacgatctgccagaaggtgtcgatgtcgaaaactcggttattcgcaccacgctcacccagggtgccatcggctacgcaaaactgaatgccaccaccggttaccaaatcgtcggcgttattcgtcaggaaaatgggcgcttccctccactaggtgtgaatgtcacggataaagcgacaggtaaagatgtgggcctggtcgcggaagacggcttcgtttatctcagcggtattcaggaaaatagtactctgcatttaacctggggtgataatacctgtgaagtcacgccgccaaaccaaagtaacattagcgaaagcgcaataattttaccttgtaaaacagtcaaataa

SEQ ID NO: 7230 - protein, 509 aa, Escherichia coli
MSQWKKKMAAPAPSQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGIALHDYSYGDNARMMVDTDGISGIEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSTLHLTWGDNTCEVTPPNQSNISESAIILPCKTVK

SEQ ID NO: 7231 - DNA, 741 bp, Escherichia coli
atgaaatcaccattaatcacaacaggaatgatttgtttactggggatctgcaactttgcccaggcgactgtctctcccgacagaacacgcatcatttttaatgcttcgaataaaagcgcaacggttcgcctgaccaaccaaagtaaaatcgatccctatctggctcagtcgtggattgaagatgccagcggtaaaaaaacgcgtgattacatctcgacattgccgccgatggaacgtattgagcctgatgaacagatacaaattcgcctgatggcactggcctcgttaaacgacttaccacaggaccgagaaacgttgttctactataacgtgcgagaaattccgccgcgcgccaaagaacagaatgtaatgcaaatcgccatgcaaagccgcctgaagctattctggcggccaaaagcgattgagttaaaagagggggagatgattcctctgcaaaaagtaacgattacccgcaccgccgccggtctgaccctgaataacccgacgccttatcatattaccgtcggttatatcggcactaatggcaagacactgatgcccggtgcggacagtattatggtggtaccatttacttctgcaactcaacacctaagcagcctgccctctaccttccagttaggctttgtggcggactacggcgggctggagatgtttaaagtcgaatgtaattccatccaatccctctgccaaagctctcctgctaagaaggggaaaatatga

SEQ ID NO: 7232 - protein, 246 aa, Escherichia coli
MKSPLITTGMICLLGICNFAQATVSPDRTRIIFNASNKSATVRLTNQSKIDPYLAQSWIEDASGKKTRDYISTLPPMERIEPDEQIQIRLMALASLNDLPQDRETLFYYNVREIPPRAKEQNVMQIAMQSRLKLFWRPKAIELKEGEMIPLQKVTITRTAAGLTLNNPTPYHITVGYIGTNGKTLMPGADSIMVVPFTSATQHLSSLPSTFQLGFVADYGGLEMFKVECNSIQSLCQSSPAKKGKI

SEQ ID NO: 7233 - DNA, 1050 bp, Escherichia coli
atgattacgctttttcgtttactggcgattctttgcctgttttttaacgtttcagcttttgctgttgattgctatcaggatgggtacagaggaacaaccctcataaatggagatttaccagcgttcaaaattccagagaacgcgcaacctgggcaaaaaatttgggagagtggagatattaatatcacggtttattgtgacaatgcaccaggatggacaacagacaatccatcagaaaatatctatgcctggatcaaattaccccaaataaatagtgccgacatgttgaataatccatatttaacctttggcgtgacttataatggtgtagattatgaagggataaatgaaagaattgatactcatgcatgcctggataaatatgagcaatactataatgggtattattatgaccctgtatgcaatggcagtacccttcaaaaaaatgtaacatttaatgcccattttcgcgtctatgtaaaattcaaaagccgcccagcaggagatcagacggtgaactttggcatagtcaacgtgttacaattcgatggcgaaggaggggcaaacatgtcctctaacgcgaagaatttacgctatgtgattacgggattagataatatttcattccttgactgtagtgtcgacgtccggatttttccagaaagccagatagttaatttcgggcaaattgctgcaaactctattgctacttatcgaccaaaagctgcatttagcgtatctactataaaagatgttgctgccgattgtaccgagcaatttgatgttgccaccagcttttatacgacagatacgttacatgatgatacgcatctggaaatgggtaatggtttgttgatgcgtattactgatcaaaaaacacaagaagacattaagtttaatcagtacaaacgcttcaccacatatattccaggtcagactggagcgatggttacccgtgattaccaggctgaactttcacaaaaaccgggggagactctcgtttatgggcctttcaaaaaagatcccatcgtaaaaataaactataactga

SEQ ID NO: 7234 - protein, 349 aa, Escherichia coli
MITLFRLLAILCLFFNVSAFAVDCYQDGYRGTTLINGDLPAFKIPENAQPGQKIWESGDINITVYCDNAPGWTTDNPSENIYAWIKLPQINSADMLNNPYLTFGVTYNGVDYEGINERIDTHACLDKYEQYYNGYYYDPVCNGSTLQKNVTFNAHFRVYVKFKSRPAGDQTVNFGIVNVLQFDGEGGANMSSNAKNLRYVITGLDNISFLDCSVDVRIFPESQIVNFGQIAANSIATYRPKAAFSVSTIKDVAADCTEQFDVATSFYTTDTLHDDTHLEMGNGLLMRITDQKTQEDIKFNQYKRFTTYIPGQTGAMVTRDYQAELSQKPGETLVYGPFKKDPIVKINYN

SEQ ID NO: 7235 - DNA, 654 bp, Escherichia coli
atgaatcagacgctactttcctcttttggtacgcctttcgaacgtgttgaaaatgcactggctgcgctgcgtgaaggacgcggtgtgatggtgcttgatgatgaagaccgtgaaaacgaaggcgatatgatcttcccggcagaaaccatgaccgttgagcagatggcgctgaccattcgccacgggagtggtattgtttgcctgtgcattactgacgatcgccgtaaacaactcgatctgccaatgatggtagaaaataacaccagcgcctatggcaccggttttaccgtgaccattgaagcggctgaaggtgtgactaccggtgtttctgccgctgaccgtattacgaccgttcgcgcagcgattgccgatggcgcaaaaccttcagatctgaatcgtccgggccacgttttcccacttcgcgcgcaggcaggtggtgtactgacgcgtggcggtcatactgaagcgactatcgatctgatgacgctggcaggctttaaaccagctggtgtgctgtgtgagctgactaatgacgatggcacgatggcgcgtgcaccagagtgcattgagtttgccaataaacacaatatggcgctcgtgactattgaagacctggtggcataccgtcaggcacatgagcgtaaagccagctaa

SEQ ID NO: 7236 - protein, 217 aa, Escherichia coli
MNQTLLSSFGTPFERVENALAALREGRGVMVLDDEDRENEGDMIFPAETMTVEQMALTIRHGSGIVCLCITDDRRKQLDLPMMVENNTSAYGTGFTVTIEAAEGVTTGVSAADRITTVRAAIADGAKPSDLNRPGHVFPLRAQAGGVLTRGGHTEATIDLMTLAGFKPAGVLCELTNDDGTMARAPECIEFANKHNMALVTIEDLVAYRQAHERKAS

SEQ ID NO: 7237 - DNA, 360 bp, Escherichia coli
atgacttacccttatcgcactacaatggcactcaacacctatcagtacagggaaactacaatgattgacccgaaaaaaattgagcaaatcgctcgccaggttcacgaatcaatgcctaaaggaatcagggagttcggggaagatgtggagaaaaaaatccgccaaaccctacaagcgcagctgacgcgtctcgatctggtaagccgcgaagaattcgacgttcagacgcaagtcctgttacggactcgtgaaaaactggcgttactggagcagcgcatcagcgaactggaagcgcgcaataatccgatagcagaacttcaatctcctccggctatcccgccagttgataaagcagaataa

SEQ ID NO: 7238 - protein, 119 aa, Escherichia coli
MTYPYRTTMALNTYQYRETTMIDPKKIEQIARQVHESMPKGIREFGEDVEKKIRQTLQAQLTRLDLVSREEFDVQTQVLLRTREKLALLEQRISELEARNNPIAELQSPPAIPPVDKAE

SEQ ID NO: 7239 - DNA, 201 bp, Escherichia coli
atggatcatagtcttaattctttaaataatttcgattttctcgcgcgtagttttgccagaatgcacgcagaaggtcgcccggtcgatattctggccgttactggtaacatggatgaagaacatagaacctggttttgcgcgcgttatgcctggtattgccaacagatgatgcaaaccagagaacttgaattagaacactga

SEQ ID NO: 7240 - protein, 66 aa, Escherichia coli
MDHSLNSLNNFDFLARSFARMHAEGRPVDILAVTGNMDEEHRTWFCARYAWYCQQMMQTRELELEH

SEQ ID NO: 7241 - DNA, 621 bp, Escherichia coli
ttcgccgactataacaccccttatcttttcgctatttcctttgtactcttgatcggccttttagaaatttttgcacttatctgcggtcacatgctctccggtgctcttgatgcacatcttgaccattatgattccataaccacaggtcatattagccaggcacttcattatctcaatattggaagattaccagctctcgtcgtcctctgcttactcgctggtttttttggtcttattggcatcctgttgcaacatgcctgcgttacgctctggcaatcaccactccccaacctgttcgtggttcctgtcagtttactgtttacaattattgcagtgcattataccggtaaagtcgttgcaccctggattccacgcgaccatagttcagctattacagaagaagaatatgttggtagcatggcattaattaccggccatcaagccacttcaggtaacccttgcgaaggaaaactcaccgatcaatttggccaaatacattatttgctactggagcctgaagaaggaaaaactttcactaaaggagacaaagtgttaattatttgccgactttctgcaacgcgatatttggcggaaaataatccctggccccagatattgtga

SEQ ID NO: 7242 - protein, 206 aa, Escherichia coli
FADYNTPYLFAISFVLLIGLLEIFALICGHMLSGALDAHLDHYDSITTGHISQALHYLNIGRLPALVVLCLLAGFFGLIGILLQHACVTLWQSPLPNLFVVPVSLLFTIIAVHYTGKVVAPWIPRDHSSAITEEEYVGSMALITGHQATSGNPCEGKLTDQFGQIHYLLLEPEEGKTFTKGDKVLIICRLSATRYLAENNPWPQIL

SEQ ID NO: 7243 - DNA, 1662 bp, Escherichia coli
atggatgatatcgttaattctgtgccctcctggatgtttaccgcgattatcgccgtatgcattctgtttattattggaattattttcgccaggctctatcgtcgcgcttcggcagagcaagcatttgttcgtactggtttaagtgggcaaaaagtggtgatgagcggtggcgcaatcgtgatgccgatctttcatgaaataattcccatcaatatgaataccctgaagctggaagtcagccgctcaaccattgatagcctgattacgaaagatcgtatgcgtgttgatgttgtagtggctttctttgtacgggtaaaaccgtcagtagaaggcatcgccactgcggcccagacgctggggcaacgcaccctgtcgcctgaagacttacgtatgctggtggaagataaatttgtcgatgccctccgtgcaacagcggcacaaatgaccatgcatgagttacaggatacccgcgagaacttcgtgcagggagtacaaaataccgtagctgaagatctgtcgaaaaatggcctggaactggaaagcgtttcacttaccaactttaaccagacctcgaaagaacatttcaatccgaacaatgcctttgacgccgaaggtttaaccaaactgactcaggagacggagcgccgtcgtcgcgaacgtaacgaagttgaacaggatgtggaagtcgcagtgcgtgagaaaaaccgtgatgcactttcgcgcaagttggagattgaacaacaagaagcgtttatgacgcttgagcaggagcagcaggttaaaacccgtaccgctgagcagaatgcgaaaattgcggcttttgaagctgaacgtcgtcgtgaagcagagcagacgcgaattctggctgaacgacagattcaggaaacggaaatcgaccgcgaacaggccgtccgctcaagaaaggttgaggccgaacgtgaagttcgcattaaagagatcgaacagcagcaggtcaccgaaatcgctaaccagacgaaatcgatcgctattgccgccaaatcggaacaacagtcccaggcagaagcgcgtgctaaccttgcactcgcagaagcagtaagcgcccaacaaaacgtagaaaccactcgccagactgccgaagccgatcgtgctaaacaagtggcgttgatcgccgcagcgcaggatgcagaaaccaaagcggttgaactgaccgtgcgggcgaaagcagaaaaagaagccgcagagatgcaggcggcggctatcgttgagttagccgaagctacacgtaaaaagggtctggcggaagcagaagcacaacgtgcgctgaacgatgctatcaacgtactttctgatgaacaaaccagccttaaattcaaactggcattattgcaggcgctgcctgcggtaattgagaaatccgttgagcctatgaaggctatcgacggcatcaaaattattcaggtcgatgggctgaatcgtggtggcgctacgggtgatgcaaacacggggaatgtggggggcggaaacctggcagaacaagcgttatcagccgcactctcttaccgcacacaggcaccgctgattgactccttgctcaatgaaattggcgtttcaggcggctcactggcggcattgacttcatccttaagctcaacaactcccgtcgaagaaaaagcagagtaa

SEQ ID NO: 7244 - protein, 553 aa, Escherichia coli
MDDIVNSVPSWMFTAIIAVCILFIIGIIFARLYRRASAEQAFVRTGLSGQKVVMSGGAIVMPIFHEIIPINMNTLKLEVSRSTIDSLITKDRMRVDVVVAFFVRVKPSVEGIATAAQTLGQRTLSPEDLRMLVEDKFVDALRATAAQMTMHELQDTRENFVQGVQNTVAEDLSKNGLELESVSLTNFNQTSKEHFNPNNAFDAEGLTKLTQETERRRRERNEVEQDVEVAVREKNRDALSRKLEIEQQEAFMTLEQEQQVKTRTAEQNAKIAAFEAERRREAEQTRILAERQIQETEIDREQAVRSRKVEAEREVRIKEIEQQQVTEIANQTKSIAIAAKSEQQSQAEARANLALAEAVSAQQNVETTRQTAEADRAKQVALIAAAQDAETKAVELTVRAKAEKEAAEMQAAAIVELAEATRKKGLAEAEAQRALNDAINVLSDEQTSLKFKLALLQALPAVIEKSVEPMKAIDGIKIIQVDGLNRGGATGDANTGNVGGGNLAEQALSAALSYRTQAPLIDSLLNEIGVSGGSLAALTSSLSSTTPVEEKAE

SEQ ID NO: 7245 - DNA, 1434 bp, Escherichia coli
atgaaagtaacgctgccagagtttgaacgtgcaggagtgatggtggttggtgatgtgatgctggatcgttactggtatggtcccaccagccgtatctcgccggaagcgccggtgcccgtggttaaagtgaataccatcgaagaacgtccgggcggcgcggctaacgtggcgatgaatatcgcttctctcggtgctaatgcacgcctggtcgggttgacgggcattgacgatgcggcgcgcgcgctcagtaaatctctggccgacgtcaacgtcaaatgcgactttgtttctgtaccgacgcatccgaccatcaccaaattacgggtactttcccgcaaccaacagctgatccgtctggatttcgaagaaggtttcgaaggggttgatccgcagccgctgcacgagcggattaatcaggcactgagttcgattggcgcgctggtgctttctgactacgccaaaggtgcgctggcaagcgtacagcagatgatccaactggcgcgtaaagcgggtgttccggtgctgattgatccaaaaggtaccgattttgagcgctaccgcggcgctacgctgttaacgccgaatctctcggaatttgaagctgttgtcggtaaatgtaagaccgaagaagagattgttgagcgcggcatgaaactgattgccgattacgaactctcggctctgttagtgacccgttccgaacagggtatgtcgctgctgcaaccgggtaaagcgccgctgcatatgccaacccaggcgcaggaagtgtatgacgttaccggtgcgggcgacacggtgattggcgtcctggcggcaacgctggcagcgggtaattcgctggaagaagcctgcttctttgccaatgcggcggctggtgtggtggtcggcaaactggggacatccacggtttcgccgatcgagctggaaaacgcagtacgtggacgtgcagataccggctttggtgtgatgaccgaagaggaactgaagcttgctgtagcggcagcgcgtaaacgcggtgaaaaagtggtgatgaccaacggtgtctttgacatcctgcacgctgggcacgtctcttatctggcaaatgcccgtaaactgggtgaccgtttgattgtcgctgtgaacagcgatgcctccaccaaacggctgaaaggggattcccgccccgttaacccgctcgaacagcgtatgattgtgctgggcgcactggaagcggtcgactgggtggtgtcgtttgaagaggacacgccgcagcgcttgatcgccgggatcttgccagatctgctggtgaaaggcggcgactataaaccagaagagattgccgggagtaaagaagtctgggccaacggtggcgaagtgctggtgctcaactttgaagacggttgctcgacgaccaatatcatcaagaagatccaactggataaaaaaggctaa

SEQ ID NO: 7246 - protein, 477 aa, Escherichia coli
MKVTLPEFERAGVMVVGDVMLDRYWYGPTSRISPEAPVPVVKVNTIEERPGGAANVAMNIASLGANARLVGLTGIDDAARALSKSLADVNVKCDFVSVPTHPTITKLRVLSRNQQLIRLDFEEGFEGVDPQPLHERINQALSSIGALVLSDYAKGALASVQQMIQLARKAGVPVLIDPKGTDFERYRGATLLTPNLSEFEAVVGKCKTEEEIVERGMKLIADYELSALLVTRSEQGMSLLQPGKAPLHMPTQAQEVYDVTGAGDTVIGVLAATLAAGNSLEEACFFANAAAGVVVGKLGTSTVSPIELENAVRGRADTGFGVMTEEELKLAVAAARKRGEKVVMTNGVFDILHAGHVSYLANARKLGDRLIVAVNSDASTKRLKGDSRPVNPLEQRMIVLGALEAVDWVVSFEEDTPQRLIAGILPDLLVKGGDYKPEEIAGSKEVWANGGEVLVLNFEDGCSTTNIIKKIQLDKKG

SEQ ID NO: 7247 - DNA, 2928 bp, Escherichia coli
ttgaacatttccgtaatgaggcaaacaatcaggaaccgttctggttgcacagcggaaaacgttaatcaggcaaggataaaatcgcttatgaagccgctctcttcaccgttacagcagtactggcagaccgttgttgagcggctgccagagcctttagccgaggaatcacttagcgcacaggcgaagtcagtacttactttcagtgattttgtgcaggacagcgtgattgcgcatccagagtggctgacggaactggaaagccaaccgccgcaggccgacgaatggcagcattacgctgcatggttgcaggaggcgctcagtaatgtgagtgacgaagccgggttaatgcgcgagctgcggctattccggcggcgcattatggtgcgcatcgcctgggcgcaaacgctggctctggttactgaagagagcatattgcagcagctcagccatctggcggagacgctgattgttgcggcgcgtgactggctgtatgacgcctgctgccgcgaatggggaacgccgtgcaatgcgcagggcgaagcgcaaccgctgctgattttaggcatgggtaagctgggcggcggggaactgaatttctcctctgatatcgatctgatttttgcctggccggaacatggttgtacccagggtggacgccgggaactggataacgcgcagttttttacccgcatggggcagcggctgattaaagtgctggatcaaccaacgcaggatggcttcgtctatcgcgtggatatgcggctgcgtccgtttggtgaaagtggcccgctggtgctgagttttgcggcgctggaagattattaccaggagcaggggcgcgactgggagcgttacgcgatggtcaaggcgcggattatgggggatagcgacggcgtctatgctaacgagttgcgtgcgatgctgcgtccgtttgttttccgtcgttacatcgatttcagcgtgattcagtcgctgcgcaacatgaaaggaatgattgcccgtgaagtgcgtcgacgcggtttgaccgacaacatcaaacttggcgcaggcggcattcgcgaaattgaatttatcgtccaggtgttccagctcattcgcggcgggcgcgaaccgtcgctgcaatcgcgcgctttactgccaacgctcagcgccattgccgcgctgcatctgctttctgaaaacgatgctgaacaattgcgagtggcgtatctgttcctgcggcgtctggaaaacctgctgcaaagcattaacgacgaacaaacccagacgcttccttctgatgagcttacccgtgcgcggctggcgtgggcgatggactttgctgactggccgcaattgaccggggtgctgaccgcacatatggccaatgtgcgccgggtgtttaatgaattgattggcgacgacgaaagtgaaactcaggaagagtcgctgtcggaacagtggcgtgagctgtggcaggatgcgttgcaggaagatgacaccacgccagtgctggcgcatcttagcgaggatgagcgcaaacaggtgctaatgctgattgctgattttcgcaaagagctggataagcgcaccatcgggccgcgaggacgtcaggtgctcgaccatctgatgccacatctgctaagtgatgtctgtgcgcgtgaagacgctgctgtcacgctgtcgcgcattaccgccttgctggtggggattgttactcgcaccacttatcttgagctgcttagtgaattccctgcggcgcttaaacatttgatttctctgtgtgctgcatcgccgatgattgccagccagctagcgcgttatccattattgctggatgaattgctcgatccaaataccctctaccaaccaacggcgacggatgcctaccgtgatgaactgcgccagtatttgctgcgcgtgccggaagatgacgaagaacaacagcttgaggcgctgcgtcagttcaaacaggcgcagctgttacgcattgcggcagcggatatcgccggtacgctaccggtaatgaaagtgagcgatcacttaacctggctggcagaagccatgattgatgccgtcgttcagcaggcgtgggttcaaatggttgcccgctacggtaagccaaatcacctgaacgaacgcgaagggcgtggttttgcggtggtcggctacggcaagctgggtggctgggagttaggctacagttccgatcttgacctgatcttcctccatgattgcccaatggatgcgatgactgacggcgagcgggaaatcgacgggcgacagttttatctgcgtctggcgcaacgcatcatgcatctgttcagtacgcgaacctcttccggcattttgtatgaagtggatgcacgactgcgtccgtccggggcggcgggaatgctggtgacatccgcagaagcatttgctgattatcagaaaaacgaggcctggacgtgggagcatcaggcgctggtgcgtgcgcgtgtagtgtacggcgatccgcagctcaccgcgcactttgacgcagtacgccgggagattatgacgctgccgcgcgaaggcaaaaccctgcaaacagaagtgcgggaaatgcgcgagaaaatgcgtgcccatctcggcaataaacatcgcgatcgctttgatatcaaagccgatgaaggcggaattaccgatatcgaatttattactcaatatctggtgttgcgctacgctcatgaaaaaccgaagttaacgcgctggtcagacaacgtgcgcattctggaactactggcgcaaaacgacattatggaagagcaggaagcgatggcgctgacccgtgcttacacaacgctgcgcgatgaacttcatcatctggcattacaggaattgccgggccatgtgtcggaggattgcttcaccgcagagcgtgaactggtgcgggcaagctggcagaagtggctggtggaagaatga

SEQ ID NO: 7248 - protein, 975 aa, Escherichia coli
MNISVMRQTIRNRSGCTAENVNQARIKSLMKPLSSPLQQYWQTVVERLPEPLAEESLSAQAKSVLTFSDFVQDSVIAHPEWLTELESQPPQADEWQHYAAWLQEALSNVSDEAGLMRELRLFRRRIMVRIAWAQTLALVTEESILQQLSHLAETLIVAARDWLYDACCREWGTPCNAQGEAQPLLILGMGKLGGGELNFSSDIDLIFAWPEHGCTQGGRRELDNAQFFTRMGQRLIKVLDQPTQDGFVYRVDMRLRPFGESGPLVLSFAALEDYYQEQGRDWERYAMVKARIMGDSDGVYANELRAMLRPFVFRRYIDFSVIQSLRNMKGMIAREVRRRGLTDNIKLGAGGIREIEFIVQVFQLIRGGREPSLQSRALLPTLSAIAALHLLSENDAEQLRVAYLFLRRLENLLQSINDEQTQTLPSDELTRARLAWAMDFADWPQLTGVLTAHMANVRRVFNELIGDDESETQEESLSEQWRELWQDALQEDDTTPVLAHLSEDERKQVLMLIADFRKELDKRTIGPRGRQVLDHLMPHLLSDVCAREDAAVTLSRITALLVGIVTRTTYLELLSEFPAALKHLISLCAASPMIASQLARYPLLLDELLDPNTLYQPTATDAYRDELRQYLLRVPEDDEEQQLEALRQFKQAQLLRIAAADIAGTLPVMKVSDHLTWLAEAMIDAVVQQAWVQMVARYGKPNHLNEREGRGFAVVGYGKLGGWELGYSSDLDLIFLHDCPMDAMTDGEREIDGRQFYLRLAQRIMHLFSTRTSSGILYEVDARLRPSGAAGMLVTSAEAFADYQKNEAWTWEHQALVRARVVYGDPQLTAHFDAVRREIMTLPREGKTLQTEVREMREKMRAHLGNKHRDRFDIKADEGGITDIEFITQYLVLRYAHEKPKLTRWSDNVRILELLAQNDIMEEQEAMALTRAYTTLRDELHHLALQELPGHVSEDCFTAERELVRASWQKWLVEE

SEQ ID NO: 7249 - DNA, 1302 bp, Escherichia coli
atggctcaggaaatcgaattaaagtttattgttaatcacagtgccgttgaggcgctgcgtgaccatctcaatacgctggacggcgagcaccatgaccccgtgcagttgctgaatatttactacgaaacgccggataactggctgcgtgggcacgatatgggcttgcgtattcgtggcgaaaacggtcgctatgagatgaccatgaaagttgcaggaagagtgacaggcggcttacaccagcgcccggaatataacgtggcgttgagcgcaccgacgctcgacctggcgcagttaccgacggaagtctggccgaacggcgaattgcctgccgatctcgcttcccgcgtacaaccgctgttcagcaccgatttttatcgcgaaaagtggctggtagaggttgatggtagccaaattgaaatcgccctcgaccagggggaagtgaaagcgggtgaatttgctgaacctatctgtgagctggaactggaactgcttagcggcgacatgcgtgcggtgctgaaactggcgaaccaactggtatcgcaaaccggattacgccagggcagcctgagcaaagcagcgcgtggctatcatctggcgcagggcaatccggcgcgtgaaatcaaaccgaccaccattttgcatgttgcggcaaaagctgatgtggaacaggggctggaagcggcgctcgagctggcgttagcgcaatggcagtatcatgaagaactgtgggtacgcggcaacgatgcggcgaaagagcaggtgctggcagccattggcctggtccgtcatacactgatgctgttcggcggtatcgtgccgcgtaaagcgagcactcacttacgtgatctgctgactcaatgcgaggcgaccattgcttctgcggtttctgccgtaacggcggtctactctaccgaaacggcaatggcgaagctggcgttgaccgaatggctggtaagcaaagcctggcagccgtttttagatgccaaagcgcagggtaaaatgagcgattccttcaaacgctttgccgatatccatctttcccgccatgctgctgaacttaaaagcgttttctgccagccgttaggcgatcgctaccgtgaccaattgccacgcctgacgcgtgatattgactcaatactgttgctggcgggttactacgatcctgtcgtcgcgcaagactggctggagaactggcaggggctgcgtcacgctattgcgaccgggcaacgcattgaaattgaacatttccgtaatgaggcaaacaatcaggaaccgttctggttgcacagcggaaaacgttaa

SEQ ID NO: 7250 - protein, 433 aa, Escherichia coli
MAQEIELKFIVNHSAVEALRDHLNTLDGEHHDPVQLLNIYYETPDNWLRGHDMGLRIRGENGRYEMTMKVAGRVTGGLHQRPEYNVALSAPTLDLAQLPTEVWPNGELPADLASRVQPLFSTDFYREKWLVEVDGSQIEIALDQGEVKAGEFAEPICELELELLSGDMRAVLKLANQLVSQTGLRQGSLSKAARGYHLAQGNPAREIKPTTILHVAAKADVEQGLEAALELALAQWQYHEELWVRGNDAAKEQVLAAIGLVRHTLMLFGGIVPRKASTHLRDLLTQCEATIASAVSAVTAVYSTETAMAKLALTEWLVSKAWQPFLDAKAQGKMSDSFKRFADIHLSRHAAELKSVFCQPLGDRYRDQLPRLTRDIDSILLLAGYYDPVVAQDWLENWQGLRHAIATGQRIEIEHFRNEANNQEPFWLHSGKR

SEQ ID NO: 7251 - DNA, 621 bp, Escherichia coli
atgccaaaattacgcctgatcggattaactttactcgcacttagcgccactgccgtctcacacgctgaagaaacgcgctatgtttctgatgaactgaatacctgggtccgtagcggtccgggagatcattatcgcctcgtgggcacggttaacgccggcgaggaagtgaccttattacaaactgacgccaacaccaattatgcccaggtgaaagacagctctggccgtaccgcctggatcccgttgaaacaacttagcactgagccaagcctgcgctcccgtgtgccagatctggaaaatcaggtcaaaaccctgaccgataaactcaccaatatcgataacacctggaatcagcgcaccgcagaaatgcagcaaaaagtggcgcagagcgacagcgtgatcaacgggttaaaagaagaaaatcagaaactgaaaaacgagctgattgtcgcgcagaaaaaggtcgatgccgccagcgtacagctggatgacaaacagcgcaccatcatcatgcagtggtttatgtatggcggtggcgtgctggggcttggcttgctgctcggtctggtactgccgcacctgatcccaagccgcaaacgcaaagatcgctggatgaactaa

SEQ ID NO: 7252 - protein, 206 aa, Escherichia coli
MPKLRLIGLTLLALSATAVSHAEETRYVSDELNTWVRSGPGDHYRLVGTVNAGEEVTLLQTDANTNYAQVKDSSGRTAWIPLKQLSTEPSLRSRVPDLENQVKTLTDKLTNIDNTWNQRTAEMQQKVAQSDSVINGLKEENQKLKNELIVAQKKVDAASVQLDDKQRTIIMQWFMYGGGVLGLGLLLGLVLPHLIPSRKRKDRWMN

SEQ ID NO: 7253 - DNA, 1140 bp, Escherichia coli
atgctcgacgcgggctaccagcaggtaggccgcgattttcctgtgtttctgcatccgcaaacgcatgaagagtatgcactggcacgtaccgaacggaaatccggttccggttacaccggttttacctgctatgccgcaccggatgtcacgctggaagatgatcttaagcgtcgcgatctgaccattaatgcgctggcccaggacgataacggcgagattatcgacccgtacaacggtctgggcgatctgcaaaatcgtctgttgcgccatgtttcccccgcttttggcgaagatccgttacgcgtgttgcgcgtagcgcgttttgctgcgcgttatgcccacctctgtttccgtattgccgatgaaactctggcgctgatgcgcgagatgacccatgcgggtgaactggaacacctgacgcctgaacgggtatggaaagagacggaaaacgccctcaccacccgcaatccccaggtgttcttccaggtactgcgcgattgcggcgcactgcgcgttttattcccggaaattgacgccctgtttggcgttccggcccctgccaggtggcatccggaaatcgacaccggtattcataccttaatgacgctctcaatggcggcgatgctgagtccgcaggtcgatgtccgtttcgcaacgttatgccacgatctcggtaaaggactgacgccaccagaactttggccgcgtcatcatggtcatggcccggcgggtgtgaagttagtggaacaactatgccagcgtctgcgcgtgccaaatgaaattcgcgatttagccagactggtggctgagtttcacgatctcatccacaccttcccaatgctgaacccaaaaaccatcgtcaaactatttgattccatcgacgcctggcgtaaaccgcagcgtgtcgagcaactggcgctgaccagcgaggctgatgtgcgcggcagaaccggttttgaatcagccgactacccgcaaggccgctggttgcgcgaagcctgggaagtggcacagtcagtgccgacaaaagccgtcgttgaagcgggatttaaaggtgtggagattcgcgaggagctgacccgacggcggattgcggcggtggctggctggaaggaacagcgttgcccaaaacctgagtga

SEQ ID NO: 7254 - protein, 379 aa, Escherichia coli
MLDAGYQQVGRDFPVFLHPQTHEEYALARTERKSGSGYTGFTCYAAPDVTLEDDLKRRDLTINALAQDDNGEIIDPYNGLGDLQNRLLRHVSPAFGEDPLRVLRVARFAARYAHLCFRIADETLALMREMTHAGELEHLTPERVWKETENALTTRNPQVFFQVLRDCGALRVLFPEIDALFGVPAPARWHPEIDTGIHTLMTLSMAAMLSPQVDVRFATLCHDLGKGLTPPELWPRHHGHGPAGVKLVEQLCQRLRVPNEIRDLARLVAEFHDLIHTFPMLNPKTIVKLFDSIDAWRKPQRVEQLALTSEADVRGRTGFESADYPQGRWLREAWEVAQSVPTKAVVEAGFKGVEIREELTRRRIAAVAGWKEQRCPKPE

SEQ ID NO: 7255 - DNA, 822 bp, Escherichia coli
atgagcgatatgcactcgctgctgatagcggcaatattgggtgtggtcgaaggattgacagaatttctgccggtatccagcacgggccatatgattattgtcggtcacttgttggggtttgagggcgacacggcgaaaacctttgaagtcgtgatccagttaggatcaattctggcggtagtagtgatgttctggcggcgtctgtttggcctgattggcatccactttggtcgcccgttgcagcacgaaggagaaagcaaaggtcgtttaacgctgatccacatcttgctggggatgattccggcggtggtactggggctgttgttccacgacacgattaaatcattgtttaacccgataaatgtcatgtatgcactggtcgttggcggtctgttgctgattgccgccgaatgcctgaagccgaaagagccgcgtgcgccgggtcttgatgatatgacctatcgtcaggcgtttatgattggctgtttccagtgtctggcgctgtggccgggtttctcccgttccggggcgaccatttcaggtgggatgctgatgggggtgagccgttacgctgcttccgagttctcgttcctgctggcggtgccgatgatgatgggcgcaacggcgctcgatctctacaaaagctggggcttcctgactaccggcgatatcccgatgtttgccgttgggtttatcaccgcttttgtggtggcgctgatagcgattaaaaccttcctgcaattgattaagcgcatttcgtttatcccgttcgccatttatcgctttattgtggcggctgcggtgtacgttgtgttcttttga

SEQ ID NO: 7256 - protein, 273 aa, Escherichia coli
MSDMHSLLIAAILGVVEGLTEFLPVSSTGHMIIVGHLLGFEGDTAKTFEVVIQLGSILAVVVMFWRRLFGLIGIHFGRPLQHEGESKGRLTLIHILLGMIPAVVLGLLFHDTIKSLFNPINVMYALVVGGLLLIAAECLKPKEPRAPGLDDMTYRQAFMIGCFQCLALWPGFSRSGATISGGMLMGVSRYAASEFSFLLAVPMMMGATALDLYKSWGFLTTGDIPMFAVGFITAFVVALIAIKTFLQLIKRISFIPFAIYRFIVAAAVYVVFF

SEQ ID NO: 7257 - DNA, 369 bp, Escherichia coli
atggatattgtatttatagagcaactttcggtaatcaccactattggtgtttacgactgggaacagaccatcgaacagaagttagtgttcgatatcgaaatggcgtgggataaccgtaaagcggcgaaaagtgatgatgtggcggattgcctcagttacgctgacattgcagaaacggtggtcagccacgtcgagggagcgcgttttgcgctggtggaacgcgtggctgaagaggtggcggagctgctgttagcacgcttcaactcgccgtgggtgcgtatcaaactcagcaagccaggcgcagtggcgcgggcggcgaatgttggcgtaatcattgagcgtggcaataatctgaaagaaaataattaa

SEQ ID NO: 7258 - protein, 122 aa, Escherichia coli
MDIVFIEQLSVITTIGVYDWEQTIEQKLVFDIEMAWDNRKAAKSDDVADCLSYADIAETVVSHVEGARFALVERVAEEVAELLLARFNSPWVRIKLSKPGAVARAANVGVIIERGNNLKENN

SEQ ID NO: 7259 - DNA, 618 bp, Escherichia coli
atgagtgcaatcgcgcctggaatgatcctcatcgcgtacctctgcggctccatttccagtgccattctggtttgccgcttgtgtgggttgcccgatccgcgaaccagcggctccggcaatccaggcgcaaccaatgtgttacgtatcggtggcaagggagcagccgtagcagtactgattttcgacgttctgaaaggaatgttgcccgtctggggcgcgtatgaattaggtgtcagccccttctggctaggcttaattgccatcgccgcctgtcttggacacatctggcccgttttcttcggttttaaaggaggaaaaggcgttgctaccgcttttggtgccatcgcacccattggctgggatctcactggagtaatggcgggaacctggttactgaccgtgctattgagtggttactcgtcgctgggagcgattgtcagtgcactgattgctccgttttatgtctggtggtttaagccacaattcaccttcccggtttcgatgctctcttgcctgatcctgctgcgtcatcatgacaacatccagcgtctgtggcgtcgtcaggagacaaaaatctggacgaaattcaaaagaaagcgcgaaaaggatcccgagtga

SEQ ID NO: 7260 - protein, 205 aa, Escherichia coli
MSAIAPGMILIAYLCGSISSAILVCRLCGLPDPRTSGSGNPGATNVLRIGGKGAAVAVLIFDVLKGMLPVWGAYELGVSPFWLGLIAIAACLGHIWPVFFGFKGGKGVATAFGAIAPIGWDLTGVMAGTWLLTVLLSGYSSLGAIVSALIAPFYVWWFKPQFTFPVSMLSCLILLRHHDNIQRLWRRQETKIWTKFKRKREKDPE

SEQ ID NO: 7261 - DNA, 933 bp, Escherichia coli
atgctaaatagctggcctttagccaaagacttgcaggtactggtggaaatcgtccatagcgggagttttagtgctgcagcggcgacgcttgggcaaacgcctgcatttgtcaccaagcggatccaaatccttgaaaatacgctggcaacaactctgctgaaccgctccgctcgcggcgtggcgctgactgaaagtggccagcgttgttacgaacatgcgctggaaatcctcacccaatatcagcgactggtcgatgacgtcacgcaaatcaaaacgcgcccggaggggatgatccgcattggttgcagttttggttttgggcgcagccatattgcgccagctattaccgaactgatgcgcaattatcctgagttacaggtgcattttgaattgttcgatcgacaaattgatttagtgcaggataatattgatctggatattcgtattaatgacgcaattcctgattattatattgcgcatcttttgacaaaaaataaaagaatattatgcgcagcacctgagtatctgcaaaaatatccgcagccacaatccttacaggaattaagtcgtcatgactgcctggtgaccaaagagcgcgatatgacccacggaatatgggagttggggaacggtcaggagaaaaaatcggtgaaggtaagcggacatctttcctccaatagcggcgagattgtgctgcaatgggcgctggagggcaaagggattatgctgcgttccgagtgggatgtgttgccgtttctggagagtggcaaactggtgcgagtattgccggagtatgcacaaagcgccaatatctgggctgtttaccgggagccgctctatcgcagcatgaaattacgtgtctgtgtggaatttctggcggcatggtgccagcaacggctgggcaagcccgacgaaggctatcaggtcatgtag

SEQ ID NO: 7262 - protein, 310 aa, Escherichia coli
MLNSWPLAKDLQVLVEIVHSGSFSAAAATLGQTPAFVTKRIQILENTLATTLLNRSARGVALTESGQRCYEHALEILTQYQRLVDDVTQIKTRPEGMIRIGCSFGFGRSHIAPAITELMRNYPELQVHFELFDRQIDLVQDNIDLDIRINDAIPDYYIAHLLTKNKRILCAAPEYLQKYPQPQSLQELSRHDCLVTKERDMTHGIWELGNGQEKKSVKVSGHLSSNSGEIVLQWALEGKGIMLRSEWDVLPFLESGKLVRVLPEYAQSANIWAVYREPLYRSMKLRVCVEFLAAWCQQRLGKPDEGYQVM

SEQ ID NO: 7263 - DNA, 96 bp, Escherichia coli
ttgttaaatatccgcagttttgataaacgcagtgtatttcgcaaaacattaccattccctgctctggcgcaatattcgttcttattttcgcgttga

SEQ ID NO: 7264 - protein, 31 aa, Escherichia coli
MLNIRSFDKRSVFRKTLPFPALAQYSFLFSR

SEQ ID NO: 7265 - DNA, 912 bp, Escherichia coli
atgatgagcgaaagtaataagcaacaggcagtgaataagttgacggagattgtcgctaactttaccgccatgatttctacccgaatgcctgatgacgtggtggataaactaaaacagctaaaggatgccgaaacatcgtcgatgggaaaaatcatctaccacacgatgttcgataacatgcaaaaagcgatcgacctgaatcgtcctgcctgtcaggacaccggcgaaatcatgttttttgttaaggtcggttcccgtttcccactgcttggcgagctgcaaagcatactcaaacaagccgtggaagaggcaaccgtcaaagcgccactgcgtcacaatgcggtagaaatttttgacgaagtaaacaccggcaaaaataccggcagtggcgtaccgtgggtcacctgggatatcgtccccgacggtgacgatgcggaaatcgaagtttacatggcaggcggcggctgcacgctacctggccgatcgaaagtgttaatgccgtcagaaggctacgaaggcgtagtgaaattcgtcttcgaaaatatctccaccctcgccgtaaacgcctgtccgccggtacttgtgggcgttggcatcgctacctcggtggaaaccgccgcagtgctctcgcgtaaagccattttgcgcccgattggcagccgccatcccaatccaaaagcggcagagctggagctacgcctggaagaaggactcaaccgtctggggattggtccacaagggctgactggcaacagttcagtgatgggcgtgcatatcgaatctgccgctcgccatccgtcaaccatcggcgttgctgtttctaccggctgctgggcgcatcgtcgcggcacactgcgagttcatgccgatctcacctttgaaaatctgtctcatacccggagcgcgttatga

SEQ ID NO: 7266 - protein, 303 aa, Escherichia coli
MMSESNKQQAVNKLTEIVANFTAMISTRMPDDVVDKLKQLKDAETSSMGKIIYHTMFDNMQKAIDLNRPACQDTGEIMFFVKVGSRFPLLGELQSILKQAVEEATVKAPLRHNAVEIFDEVNTGKNTGSGVPWVTWDIVPDGDDAEIEVYMAGGGCTLPGRSKVLMPSEGYEGVVKFVFENISTLAVNACPPVLVGVGIATSVETAAVLSRKAILRPIGSRHPNPKAAELELRLEEGLNRLGIGPQGLTGNSSVMGVHIESAARHPSTIGVAVSTGCWAHRRGTLRVHADLTFENLSHTRSAL

SEQ ID NO: 7267 - DNA, 606 bp, Escherichia coli
atgaaaaagatcctgacaaccccgatcaaagctgaagatctgcaagatattcgcgtcggcgatgtgatctacctgaccggtacgctggtgacctgccgtgacgtttgtcaccgccgattgatcgaactgaaacgtccgatcccttacgatctcaacggcaaagcgattttccacgctggccccatcgtgcgcaaaaacggcgacaaatgggagatggtgtccgtcggcccgacaaccagtatgcgtatggaaagttttgaacgtgaatttatcgagcagaccggcgtgaaactggtggtcggcaaaggcggaatggggccgctgaccgaagaaggctgccagaaattcaaggcgctgcatgtgattttcccggctggctgtgcggtactggcggcaactcaagtggaagagattgaagaggtacactggacagaactcgggatgccagagtcgctgtgggtctgccgggtcaaagagtttggcccgctgattgtctctatagatacccacggcaacaacctgatagccgaaaacaaaaagctgttcgccgaacgccgcgatcccatcgtggaagagatctgcgagcacgtccactacatcaaataa

SEQ ID NO: 7268 - protein, 201 aa, Escherichia coli
MKKILTTPIKAEDLQDIRVGDVIYLTGTLVTCRDVCHRRLIELKRPIPYDLNGKAIFHAGPIVRKNGDKWEMVSVGPTTSMRMESFEREFIEQTGVKLVVGKGGMGPLTEEGCQKFKALHVIFPAGCAVLAATQVEEIEEVHWTELGMPESLWVCRVKEFGPLIVSIDTHGNNLIAENKKLFAERRDPIVEEICEHVHYIK

SEQ ID NO: 7269 - DNA, 1464 bp, Escherichia coli
atgaaaccttccactgaatggtggcgataccttgcgccgctggcggtcatcgccattattgctctacttccgcttcccgcagggctggagagtcatacctggctctactttgccgtttttactggcgtgatcgttggactgatcctcgaacccgtgccgggtgccgtggtggcgatggtgggtatatccatcatcgccattctttcgccgtggctgctgtttagcccggagcagctcgcccagccaggttttaagttcaccgccaaatccctctcctgggcggtttctggtttttctaattcagttatctggcttattttcgccgcctttatgtttggtacgggctatgaaaaaaccgggcttggacgtcgcatcgctctgattctggtgaaaaaaatggggcatcgcacgctgtttctcggctatgcagtgatgttctccgagctgatactcgcgcctgtaacaccgtccaactcggcgcgtggtgcggggattatctatcccatcatccgtaacctgccaccgctctatcaatcacaaccaaacgacagcagttcgcgcagcattggctcgtacatcatgtggatggggattgttgccgattgcgtgaccagcgccattttcctgacggcgatggctccaaatttgctgttaattggactgatgaaaagcgcatctaacgccacgctgagctggggcgactggttcctcgggatgttgccgctcagtattttactggttctgctggttccctggctggcttacgtgctgtacccgccgatactgaagtctggcgatcaggtgccgcgctgggcagagacggaactgcaggcaatgggcccgctctgttcgcgtgaaaaacggatgctggggctgatggtaggcgcactggtgctgtggatttttggcggtgattatatcgatgccgcgatggtcggttacagcgtggtggcgctgatgctgcttctgcgcattatctgctgggacgacattgtcagtaataaagcggcgtggaacgttttcttctggctggcctcgcttatcaccctcgctaccggactcaacaacaccggttttattagctggtttggcaaactgttagcaggcagcttaagcggttattcgccaacgatagtgatggtggcgttgattgtggtcttttatctgctgcgctacttttttgccagcgccacagcgtatacctccgctctcgcaccgatgatgattgccgccgcgctggcgatgccggaaatcccgctgccggtgttctgcctgatggttggtgcggcaattggtctggggagcattcttacaccatacgccaccggacccagtccgatttactacggtagtggttatctgccaacggtggattactggcgactgggggcaatttttgggctgatattcctcgtgttgctggtgattaccggcttactgtggatgcccatggtgttgctttaa

SEQ ID NO: 7270 - protein, 487 aa, Escherichia coli
MKPSTEWWRYLAPLAVIAIIALLPLPAGLESHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASNATLSWGDWFLGMLPLSILLVLLVPWLAYVLYPPILKSGDQVPRWAETELQAMGPLCSREKRMLGLMVGALVLWIFGGDYIDAAMVGYSVVALMLLLRIICWDDIVSNKAAWNVFFWLASLITLATGLNNTGFISWFGKLLAGSLSGYSPTIVMVALIVVFYLLRYFFASATAYTSALAPMMIAAALAMPEIPLPVFCLMVGAAIGLGSILTPYATGPSPIYYGSGYLPTVDYWRLGAIFGLIFLVLLVITGLLWMPMVLL

SEQ ID NO: 7271 - DNA, 1014 bp, Escherichia coli
atgcgtgtactgggtattgaaacttcctgcgatgaaaccggcatcgccatttacgacgatgaaaaaggtttgttagccaaccaattgtatagtcaggtgaaattgcacgctgactacggcggcgtcgtgcctgaactggcctcccgcgatcacgtgcgtaaaaccgtaccgttgatccaggaggcgctaaaggagtctggtttaacggcaaaagacattgatgctgtggcctataccgcaggcccaggattagtcggcgcactgctggttggcgcgaccgtggggcgttctctggcgtttgcctgggacgttccggcaatcccggtacatcatatggaaggacatctgttagcgccgatgctggaagataacccaccggaatttccgtttgtcgcgctgctggtttccggcggtcatacgcagttaatcagcgtgactggcattggtcagtacgagctgctcggagagtctatcgatgatgcggctggtgaagcgtttgataaaaccgcgaagctgctggggctggattatcctggcgggccattactgtcgaaaatggcggctcagggtactgccgggcgctttgtcttcccgcgcccgatgaccgaccgtccggggctggatttcagcttttctggtctgaaaaccttcgcggcaaataccatacgtgacaacggcactgacgatcagacgcgtgccgatatcgcccgcgcctttgaagatgcagtggtcgatacgttgatgattaagtgtaagcgagcactggatcagacgggctttaagcgactggtcatggcaggcggcgtgagtgctaaccgcacactgcgggcgaagctggctgaaatgatgaaaaagcgtcgtggcgaagtgttctacgcgcgtccggaattttgcactgataacggtgcgatgatcgcctatgccggaatggtgcggtttaaagcaggcgcgacggcggatctcggcgttagcgtgcgtccgcgctggccgctggcagagttaccggccgcgtaa

SEQ ID NO: 7272 - protein, 337 aa, Escherichia coli
MRVLGIETSCDETGIAIYDDEKGLLANQLYSQVKLHADYGGVVPELASRDHVRKTVPLIQEALKESGLTAKDIDAVAYTAGPGLVGALLVGATVGRSLAFAWDVPAIPVHHMEGHLLAPMLEDNPPEFPFVALLVSGGHTQLISVTGIGQYELLGESIDDAAGEAFDKTAKLLGLDYPGGPLLSKMAAQGTAGRFVFPRPMTDRPGLDFSFSGLKTFAANTIRDNGTDDQTRADIARAFEDAVVDTLMIKCKRALDQTGFKRLVMAGGVSANRTLRAKLAEMMKKRRGEVFYARPEFCTDNGAMIAYAGMVRFKAGATADLGVSVRPRWPLAELPAA

SEQ ID NO: 7273 - DNA, 150 bp, Escherichia coli
  n 8, 9, 10, 11, 12: n is any nucleotide
atgaatgnnnnnggtgttctggcggaagttcgtcgtcgtgagttctatgaaaaaccgactaccgaacgtaagcgcgctaaagcttctgcagtgaaacgtcacgcgaagaaactggctcgcgaaaacgcacgccgcactcgtctgtactaa

SEQ ID NO: 7274 - protein, 49 aa, Escherichia coli
  Xaa 3, 4: Xaa is any amino acid
MNXXGVLAEVRRREFYEKPTTERKRAKASAVKRHAKKLARENARRTRLY

SEQ ID NO: 7275 - DNA, 1746 bp, Escherichia coli
atggctggacgaatcccacgcgtattcattaatgatctgctggcacgcactgacatcgtcgatctgatcgatgcccgtgtgaagctgaaaaagcagggcaagaatttccacgcgtgttgtccattccacaacgagaaaaccccgtcattcaccgttaacggtgagaaacagttttaccactgctttggatgtggcgcgcatggcaacgcgatcgacttcctgatgaactacgacaagctcgagttcgtcgaaacggtcgaagagctggcagcaatgcacaatcttgaagtgccatttgaagcaggcagcggccccagccagatcgaacgccatcagcggcaaacgctttatcagttgatggacggtctgaatacgttttaccaacaatctttacaacaacctgttgccacgtctgcgcgccagtatctggaaaaacgcggattaagccacgaggttatcgcccgctttgcgattggttttgcgccccccggctgggacaacgtcctgaagcggtttggcggcaatccagaaaatcgccagtcattggttgatgcgggcatgttggtcactaacgatcagggtcgcagttacgatcgtttccgcgagcgggtgatgttccccattcgtgataaacgcggtcgggtgattggttttggcggacgcgtgctgggcaacgatacccccaaatacctgaactcgccggaaacggacattttccataaaggccgccagctttacggtctttatgaagcgcagcaggataacgctgaacccaatcgtctgcttgtggtcgaaggctatatggacgtggtggcgctggcgcaatacggcattaattacgccgttgcgtcgttaggtacgtcaaccaccgccgatcacatacaactgttgttccgcgcgaccaacaatgtcatttgctgttatgacggcgaccgtgcaggccgcgatgccgcctggcgagcgctggaaacggcgctgccttacatgacagacggtcgtcagctacgctttatgtttttgcctgatggcgaagaccctgacacgctggtacgaaaagaaggtaaagaagcgtttgaagcgcggatggagcaggcgatgccactctccgcatttctgtttaacagtctgatgccgcaagttgatctgagtacccctgacgggcgcgcacgtttgagtacgctggcactgccactgatatcgcaagtgccgggcgaaacgctgcgaatatatctacgtcaggaattaggcaacaaattaggcatacttgatgacagccagcttgaacgattaatgccaaaagcggcagagagcggcgtttctcgccctgttccgcagctaaaacgcacgaccatgcgtatacttatagggttgctggtgcaaaatccagaattagcgacgctggtcccgccgcttgagaatctggatgaaaataagctccctggacttggcttattcagagaactagtcaacacttgtctctcccagccaggtctgaccaccgggcaacttttagagcactatcgtggtacaaataatgctgccacccttgaaaaactgtcgatgtgggacgatatagcagataagaatattgctgagcaaaccttcaccgactcactcaaccatatgtttgattcgctgcttgaactacgccaggaagagttaatcgctcgtgagcgcacgcatggtttaagcaacgaagaacgcctggagctctggacattaaaccaggagctggcgaaaaagtga

SEQ ID NO: 7276 - protein, 581 aa, Escherichia coli
MAGRIPRVFINDLLARTDIVDLIDARVKLKKQGKNFHACCPFHNEKTPSFTVNGEKQFYHCFGCGAHGNAIDFLMNYDKLEFVETVEELAAMHNLEVPFEAGSGPSQIERHQRQTLYQLMDGLNTFYQQSLQQPVATSARQYLEKRGLSHEVIARFAIGFAPPGWDNVLKRFGGNPENRQSLVDAGMLVTNDQGRSYDRFRERVMFPIRDKRGRVIGFGGRVLGNDTPKYLNSPETDIFHKGRQLYGLYEAQQDNAEPNRLLVVEGYMDVVALAQYGINYAVASLGTSTTADHIQLLFRATNNVICCYDGDRAGRDAAWRALETALPYMTDGRQLRFMFLPDGEDPDTLVRKEGKEAFEARMEQAMPLSAFLFNSLMPQVDLSTPDGRARLSTLALPLISQVPGETLRIYLRQELGNKLGILDDSQLERLMPKAAESGVSRPVPQLKRTTMRILIGLLVQNPELATLVPPLENLDENKLPGLGLFRELVNTCLSQPGLTTGQLLEHYRGTNNAATLEKLSMWDDIADKNIAEQTFTDSLNHMFDSLLELRQEELIARERTHGLSNEERLELWTLNQELAKK

SEQ ID NO: 7277 - DNA, 123 bp, Escherichia coli
gtgccgaagagcgatcgggaagcccccgacagccgcactgagaggcagcggcaaatatataagtacgccctcgtaattatcgttggcggtaaacaaccgttggatttcagcgttaacggctga

SEQ ID NO: 7278 - protein, 40 aa, Escherichia coli
MPKSDREAPDSRTERQRQIYKYALVIIVGGKQPLDFSVNG

SEQ ID NO: 7279 - DNA, 1842 bp, Escherichia coli
atggagcaaaacccgcagtcacagctgaaacttcttgtcacccgtggtaaggagcaaggctatctgacctatgccgaggtcaatgaccatctgccggaagatatcgtcgattcagatcagatcgaagacatcatccaaatgatcaacgacatgggcattcaggtgatggaagaagcaccggatgccgatgatctgatgctggctgaaaacaccgcggacgaagatgctgccgaagccgccgcgcaggtgctttccagcgtggaatctgaaatcgggcgcacgactgacccggtacgcatgtacatgcgtgaaatgggcaccgttgaactgttgacccgcgaaggcgaaattgacatcgctaagcgtattgaagacgggatcaaccaggttcaatgctccgttgctgaatatccggaagcgatcacctatctgctggaacagtacgatcgtgttgaagcagaagaagcgcgtctgtccgatctgatcaccggctttgttgacccgaacgcagaagaagatttggcacctaccgccactcacgtcggttctgagctttcccaggaagatctggacgatgacgaagatgaagacgaagaagatggtgacgacgataccgccgatgatgacaacagcatcgacccggaactggctcgcgaaaaatttgcggaactgcgcgctcagtacattgtaacgcgtgacaccatcaaagcgaaaggccgcagtcacgctgccgctcaggaagagatcctgaaactgtctgaagtattcaaacagttccgcctggtgccgaagcagtttgactacctggtcaacagcatgcgcgtcatgatggaccgcgttcgtacgcaagaacgtctgatcatgaagctctgcgttgagcagtgcaaaatgccgaagaaaaacttcattaccctgtttaccggcaacgaaaccagcgatacctggttcaacgcggcaattgcgatgaacaagccgtggtcggaaaaactgcacgatgtctctgaagaagtgcatcgcgccctgcagaaactgcagcagattgaagaagaaaccggcctgaccatcgagcaggttaaagatatcaaccgtcgtatgtccatcggtgaagcgaaagcccgccgtgcgaagaaagagatggttgaagcgaacttgcgtctggttatttctatcgctaagaaatacaccaaccgtggcttgcagttccttgacctgattcaggaaggtaacatcggtctgatgaaagcggttgataaattcgaataccgccgtggttacaagttctccacctacgcaacctggtggatccgtcaggcgatcacccgttctatcgcggatcaggcgcgcaccatccgtattccggtgcatatgattgagactatcaacaagctcaaccgtatttctcgccagatgctgcaagagatgggccgtgaaccaacgccggaagaactggctgaacgcatgctgatgccggaagacaagatccgcaaagtgctgaagatcgccaaagagccaatctccatggaaacgccgatcggtgatgatgaagattcgcatctgggggatttcatcgaggataccaccctcgagctgccgctggattctgcgaccaccgaaagcctgcgtgcggcaacgcacgacgtgctggctggcctgaccgcgcgtgaagcgaaagttctgcgtatgcgtttcggtatcgatatgaacaccgaccacacgctggaagaagtgggtaaacagttcgacgttacccgcgaacgtatccgtcagatcgaagcgaaggcgctgcgcaaactgcgtcacccgagccgttctgaagtgctgcgtagcttcctggacgattaa

SEQ ID NO: 7280 - protein, 613 aa, Escherichia coli
MEQNPQSQLKLLVTRGKEQGYLTYAEVNDHLPEDIVDSDQIEDIIQMINDMGIQVMEEAPDADDLMLAENTADEDAAEAAAQVLSSVESEIGRTTDPVRMYMREMGTVELLTREGEIDIAKRIEDGINQVQCSVAEYPEAITYLLEQYDRVEAEEARLSDLITGFVDPNAEEDLAPTATHVGSELSQEDLDDDEDEDEEDGDDDTADDDNSIDPELAREKFAELRAQYIVTRDTIKAKGRSHAAAQEEILKLSEVFKQFRLVPKQFDYLVNSMRVMMDRVRTQERLIMKLCVEQCKMPKKNFITLFTGNETSDTWFNAAIAMNKPWSEKLHDVSEEVHRALQKLQQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDHTLEEVGKQFDVTRERIRQIEAKALRKLRHPSRSEVLRSFLDD

SEQ ID NO: 7281 - DNA, 507 bp, Escherichia coli
atggttgaggatattttggctccagggttacgggtcgtgttttgcggtatcaaccctgggctttcatccgccgggactggttttccctttgctcatccggcaaatcgcttctggaaggtgatatatcaggccgggtttaccgaccgtcagttgaagccgcaggaggcacagcatctgctggattatcgttgtggcgtcaccaaactggtagaccgtccaacggtgcaagccaatgaagtttcaaagcaagaactacacgcaggcgggcgtaagctgattgaaaaaattgaagattatcagccgcaggcgttggcgattctgggcaaacaagcatatgaacagggattcagccagcgcggtgcacagtgggggaaacaaactctcaccattggttcgacgcagatttgggtgctgccaaatcccagcggtttaagtcgcgtttcactggagaaactggttgaagcgtatcgcgagctggaccaggcgctggtagtgcgtgggcgataa

SEQ ID NO: 7282 - protein, 168 aa, Escherichia coli
MVEDILAPGLRVVFCGINPGLSSAGTGFPFAHPANRFWKVIYQAGFTDRQLKPQEAQHLLDYRCGVTKLVDRPTVQANEVSKQELHAGGRKLIEKIEDYQPQALAILGKQAYEQGFSQRGAQWGKQTLTIGSTQIWVLPNPSGLSRVSLEKLVEAYRELDQALVVRGR

SEQ ID NO: 7283 - DNA, 765 bp, Escherichia coli
atgaataactccccccgctacccgcagcgcgttcgcaatgatctgcgcttccgtgaattgactgtgctacgcgctgagcgtattagcgccggttttcagcgcattgtccttggcggcgaggcgctggacggttttacatcgcgcggctttgacgatcacagcaaactcttctttcctcaatctgatgctcactttgtgccgccaacggtaacggaagagggcatcgtctggccggaaggaccacgcccaccgtcgcgtgactatacgccgctgtatgacgaactacgccatgaactggcgattgatttctttattcacgacggtggcgtcgccagcggctgggcgatgcaggcgcaaccgggcgataaactcacggtggcaggtccgcgcggttcgctggtggtgccagaggattacgcgtatcagctgtatgtctgcgatgaatccggaatgcccgcactgcgccgccgcctggaaacgttgagcaaacttgccgttaaaccgcaagttagcgcgctggttagcgtgcgggataacgcctgtcaggattatctcgcgcaccttgatggttttaatatcgaatggctggcacatgatgagcaggcggtagatgagcgtctggcgcagatgcaaatccctgccgatgattacttcatctggataaccggcgaaggcaaagtcgttaagaatttaagccgccgctttgaagcggaacagtatgacccacagcgggtacgtgcagcggcttactggcacgcaaagtaa

SEQ ID NO: 7284 - protein, 254 aa, Escherichia coli
MNNSPRYPQRVRNDLRFRELTVLRAERISAGFQRIVLGGEALDGFTSRGFDDHSKLFFPQSDAHFVPPTVTEEGIVWPEGPRPPSRDYTPLYDELRHELAIDFFIHDGGVASGWAMQAQPGDKLTVAGPRGSLVVPEDYAYQLYVCDESGMPALRRRLETLSKLAVKPQVSALVSVRDNACQDYLAHLDGFNIEWLAHDEQAVDERLAQMQIPADDYFIWITGEGKVVKNLSRRFEAEQYDPQRVRAAAYWHAK

SEQ ID NO: 7285 - DNA, 624 bp, Escherichia coli
atgagctatcatcacgaagggtgttgtaaacatgaaggccagccacgccatgaaggctgctgcaaaggtgagaagtcagaacatgagcactgcggacacggtcaccagcatgaacacggtcaatgctgcggtggtcgccacggtcgcggcggcggtcgtcggcagcgtttctttggtcacggtgaattgcgtctggtgattctggatattctctcgcgcgatgacagccacggttacgagttgattaaagcgattgaaaatctgacccaggggaattacaccccaagcccgggcgtcatctacccgacgctggattttctgcaggagcagtcgctgattaccatccgcgaagaggaaggtggtaagaagcagattgcgctgaccgaacagggcgcgcagtggctggaagaaaaccgcgaacaggtggagatgattgaagaacgcatcaaagcgcgttgcgttggcgcggcgctacgccagaacccgcaaatgaagcgggcgctggataattttaaagcggtgctggatttacgcgtcaaccagagcgatatcactgatgcacaaataaaaaagatcattgcggtgatcgaccgcgccgcttttgatattacgcaactggattaa

SEQ ID NO: 7286 - protein, 207 aa, Escherichia coli
MSYHHEGCCKHEGQPRHEGCCKGEKSEHEHCGHGHQHEHGQCCGGRHGRGGGRRQRFFGHGELRLVILDILSRDDSHGYELIKAIENLTQGNYTPSPGVIYPTLDFLQEQSLITIREEEGGKKQIALTEQGAQWLEENREQVEMIEERIKARCVGAALRQNPQMKRALDNFKAVLDLRVNQSDITDAQIKKIIAVIDRAAFDITQLD

SEQ ID NO: 7287 - DNA, 1521 bp, Escherichia coli
atgtcttctcatccgtatgtcacccagcaaaataccccgctggcggacgacaccactctgatgtccactaccgatctgcaaagctatatcactcatgctaatgacacttttgtgcaggtgagcggctataccttgcaggagttacagggtcaaccgcacaacatggtgcgtcacccggatatgccaaaagcggcgtttgcggatatgtggttcaccctgaaaaaaggggagccctggagcggcatcgtgaaaaatcgccgcaaaaatggcgaccattattgggtgcgggccaatgcggtaccgatggtgcgcgagggaaaaatcagtggctatatgtcgattcgtacccgggcgacggatgaagagatcgcggcggtggagccgctgtacaaagcgttgaacgccggacgtaccagtaagcgtattcataaaggcctggtggtgcgtaaaggctggctgggtaaactgccttcattaccgcttcgctggcgggcgcgtggcgtgatgaccctgatgtttatcttgctggcggtcatgctttggtttgttgctgccccggtggtgacgtatatcctctgtgcgttagtggtattgttggcaagcgcctgttttgaatggcagattgtccgcccgatagaaaatgtcgcccgtcaggcactgaaggtggcgaccggagagcgtaatagtgttgagcatctgaatcgcagcgatgagctggggctgacattacgcgcggtagggcagcttggcctgatgtgccgttggctaattaacgatgtctcaagccaggtgtccagtgtcagaaatggcagtgagacgctggcgaaaggcaccgatgaactgaacgaacatacccagcagacagttgataacgttcagcaaacggtggcgaccatgaaccaaatggcggcgtcggtgaaacagaactctgccacggcgtcggctgccgataaactttctatcaccgccagtaatgcggcagtgcagggcggggaggcgatgactacggtgatcaagacaatggacgatattgccgacagtacccagcgcattggcaccattacttcgctgattaacgatattgcgtttcagaccaatattctggccctgaatgcggcggtggaagcggcgcgtgccggcgaacagggcaaaggttttgcagtggtggcgggggaagtgcgtcatttagccagccgcagcgccaatgctgccaacgatattcgcaagctgattgatgccagtgctgataaggtgcaatctggttcgcagcaggtacacgccgccggacggacgatggaagatattgtggcgcaggtaaaaaacgtcacccagttgatagctcagattagccattcaacgctggaacaggccgatgggctttccagcctgacccgtgcagtggatgagcttaatctcatcacccagaaaaacgccgagttagtggaagagagtgcgcaggtgtcggcgatggtgaaacaccgcgccagccgactggaagacgcggtgacggtgctgcattaa

SEQ ID NO: 7288 - protein, 506 aa, Escherichia coli
MSSHPYVTQQNTPLADDTTLMSTTDLQSYITHANDTFVQVSGYTLQELQGQPHNMVRHPDMPKAAFADMWFTLKKGEPWSGIVKNRRKNGDHYWVRANAVPMVREGKISGYMSIRTRATDEEIAAVEPLYKALNAGRTSKRIHKGLVVRKGWLGKLPSLPLRWRARGVMTLMFILLAVMLWFVAAPVVTYILCALVVLLASACFEWQIVRPIENVARQALKVATGERNSVEHLNRSDELGLTLRAVGQLGLMCRWLINDVSSQVSSVRNGSETLAKGTDELNEHTQQTVDNVQQTVATMNQMAASVKQNSATASAADKLSITASNAAVQGGEAMTTVIKTMDDIADSTQRIGTITSLINDIAFQTNILALNAAVEAARAGEQGKGFAVVAGEVRHLASRSANAANDIRKLIDASADKVQSGSQQVHAAGRTMEDIVAQVKNVTQLIAQISHSTLEQADGLSSLTRAVDELNLITQKNAELVEESAQVSAMVKHRASRLEDAVTVLH

SEQ ID NO: 7289 - DNA, 1380 bp, Escherichia coli
ttgaacaggttaccttcgagcgcatcagctttagcgtgcagcgcccacgccctgaatctcattgaaaagcgaacgttggatcatgaggagatgaaagcacttaaccgggaggtgattgaatacttcaaagagcatgtcaatccggggtttttagagtatcgcaaatctgttaccgccggcggggattacggagccgtagagtggcaagcgggaggtttaaatacgcttgtcgacacccagggacaggagtttatcgactgcctgggaggttttggaattttcaacgtggggcaccgtaatccagttgtggtttccgccgtacagaatcaacttgcgaaacaaccgcttcacagccaggagctgcttgatccgttacgggcgatgctggcgaaaacccttgcggcgctaacgcccggtaaactgaaatacagcttcttctgtaatagcggcaccgaatccgttgaagcggcgctgaagctggcgaaggcttatcagtcaccgcgcggcaagtttacttttattgccaccagcggcgcgttccacggtaaatcacttggcgcgctgtcggccacggcgaaatcgaccttccgcaaaccttttatgccactgctgccagggtttcgtcatgtaccgtttggcaatatcgaagccatgcgcacggctcttaacgagtgcaaaaaaaccggtgatgatgttgctgcggtgatcctcgaaccgattcagggcgaaggtggcgtaattctgccgccgccaggctatctcaccgccgtgcgtaagctgtgcgatgagttcggcgcactgatgatcctcgatgaagtacaaacgggcatggggcgcacgggcaagatgttcgcctgcgagcatgagaacgtacagccggatatcctttgtctggcaaaagccctcggcggcggcgtgatgccgattggcgcaaccatcgccactgaagaggtattctctgtcctgttcgacaatccgttcctgcacactaccacctttggcggcaacccgctggcctgtgcggcggcgctggcgaccatcaatgtgttgctggagcagaacttaccggctcaggctgaacaaaaaggcgatatgttgctggacggttttcgtcaactggcgcgggaatatcccgatctggtacaggaagcgcgtggtaaagggatgttgatggcgattgagtttgttgataacgaaatcggctataactttgccagcgagatgttccgccagcgcgtactggtggccggaacactcaacaacgctaaaacgatccgcattgaaccgccactgacactgaccattgaacagtgtgaactggtgatcaaagcggcgcgtaaggcgctggcggccatgcgagtcagtgtcgaagaagcgtaa

SEQ ID NO: 7290 - protein, 459 aa, Escherichia coli
MNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 7291 - DNA, 333 bp, Escherichia coli
atggaaaccgtggcttacgctgattttgcacgtctggaaatgcgcgtcggaaagattgtggaagtgaaacgccatgaaaacgccgacaagctgtacatcgtacaggttgatgtgggggaaaaaactctgcaaaccgtgaccagtctggtgccgtactacagcgaagaagagctgatgggaaaaacagtggtggtcttatgcaatctgcaaaaagcgaaaatgcgcggtgaaacgtcggaatgcatgctgttgtgtgcggaaaccgatgacggcagtgaaagcgtgctgttaacgccggagcggatgatgcctgcgggcgtacgtatcgtataa

SEQ ID NO: 7292 - protein, 110 aa, Escherichia coli
METVAYADFARLEMRVGKIVEVKRHENADKLYIVQVDVGEKTLQTVTSLVPYYSEEELMGKTVVVLCNLQKAKMRGETSECMLLCAETDDGSESVLLTPERMMPAGVRIV

SEQ ID NO: 7293 - DNA, 984 bp, Escherichia coli
atggcaacactaaaagacatcgcaatcgaagctggcgtatccctggcgacagtatccagggtcttgaatgacgatccgacattgaatgtgaaagaagagacgaaacatcgcattctcgagatcgccgaaaagctggagtacaagaccagtagcgcccgtaaactccagacaggcgcagtcaaccaacaccatattctggctatctacagctaccaacaggagctggagatcaacgatccttactatctggcgatccgccacggcattgaaactcagtgcgaaaagctggcgatcgaactgaccaactgttatgaacacaacggcttaccagacattaaaaacgtcaccggtattttaattgtcggcaaacccacgtccgccctgcgcgccgccgcctgtgcgttgaccgacaatatctgttttatcgactttcacgaacccggcagcggttacgatgcggtggatatcgatctggcacgtatcagtaaagaaatcatcgatttctatatcaatcagggcgttaatcgtattggttttattggcggtgaagacttacccggcaaggcggatattcgtgaggtcgcctttgcggaatatggtcgtctgaaacacgtggtacgcgaagaggatatctggcgcggcggtttttccagttcgtcgggctatgaactggcaaaacagatgctggcgcgggaagactatccgaaggcactgtttgttgcttccgattccattgctatcggcgtactgcgggcaattcatgaacgtggcctgaacatcccacaggatatttcgcttatcagcgttaacgatatccccaccgcgcgatttacctttccgccgctctccaccgtgcgcatccattccgaaatgatgggaagtcagggcgttaacctagtgtatgaaaaagcccgcgatggtcgcgcgctgccgctgttggtcttcgttcccagcaaattaaaactgcgcggcacgacccgttaa

SEQ ID NO: 7294 - protein, 327 aa, Escherichia coli
MATLKDIAIEAGVSLATVSRVLNDDPTLNVKEETKHRILEIAEKLEYKTSSARKLQTGAVNQHHILAIYSYQQELEINDPYYLAIRHGIETQCEKLAIELTNCYEHNGLPDIKNVTGILIVGKPTSALRAAACALTDNICFIDFHEPGSGYDAVDIDLARISKEIIDFYINQGVNRIGFIGGEDLPGKADIREVAFAEYGRLKHVVREEDIWRGGFSSSSGYELAKQMLAREDYPKALFVASDSIAIGVLRAIHERGLNIPQDISLISVNDIPTARFTFPPLSTVRIHSEMMGSQGVNLVYEKARDGRALPLLVFVPSKLKLRGTTR

SEQ ID NO: 7295 - DNA, 3093 bp, Escherichia coli
atgaatcgctgggaaaacattcagctcacccacgaaaaccgacttgcgccgcgtgcgtactttttttcatatgattctgttgcgcaggctcgtacttttgcccgtgaaaccagcagcctgtttctgctcttaagcggtcagtggaatttccacttttttgaccatccgctgcaagtgccagaagccttcacctctgagttaatggctgactgggggcatattaccgtccccgccatgtggcaaatggaaggtcacggcaaactgcaatataccgacgaaggttttccgttccccatcgatgtgccgtttgtccccagcgataacccaaccggtgcctatcaacgtattttcaccctcagcgacggctggcagggtaaacagacgctgattaaatttgacggcgtcgaaacctattttgaagtctacgttaacggtcagtatgtggggttcagcaagggcagtcgcctgaccgcagagtttgacatcagcgcgatggttaaaaccggcgacaacctgttgtgtgtgcgtgtgatgcaatgggcggactctacctacgtggaagaccaggatatgtggtggtcggcggggattttccgcgatgtttatctgatcggaaaacaactcacgcatattaacgatttcaccgttcgtaccgactttgacgaagcctattgcgatgccacactttcctgcgaagtggtgctggaaaatctcgccgcctcccctgtcgtcacgacgctggaatataccctgtttgatggcgaacacgtggtgcacagcagcgccattgatcatttggcaattgaaaaactgaccagcgccagttttgcttttactgtcgaacagccgcagcaatggtcagcagaatccccttatctttaccatctggtcatgacgctgaaagacgccgacggcaacgttctggaagtggtgccacaacgcgttggcttccgtgatatcaaagtgcgcgacggtctgttctggatcaataaccgttatgtgatgctgcatggcgtcaaccgccacgacaacgatcatcgcaaaggccgcgccgttgggatggatcgcgtcgagaaagatctccagttgatgaagcagcacaacatcaactccgtgcgtaccgctcactacccgaacgatccacgtttttacgaactgtgcgatatctacggcctgtttgtgatggcggaaaccgacgtcgaatcgcacggctttgctaatgtcggcgatatcagccgtattaccgacgatccgcagtgggaaaaagtctacgtcgagcgcattgttcgccatattcacgcgcagaaaaaccatccgtcgatcatcatctggtcgctgggcaatgaatccggctatggctgtaacatccgcgcgatgtaccatgcggcgaaggcgctggatgacacgcgactggtgcattacgaagaagatcgcgatgctgaagtggtcgatattatttccaccatgtacacccgcgtgcctctgatgaatgagtttggtgaatacccgcatccgaagccgcgcatcatctgtgaatatgctcatgcgatggggaacggaccgggcgggctgacggagtaccagaacgtcttctataagcacgattgcattcagggacattatgtctgggaatggtgcgaccacgggatccaggcgcaggatgacaacggcaacgtctggtacaaattcggcggcgactacggcgactatcccaacaactataacttctgtcttgatggtttgatctattccgatcagacgccgggaccaggcctgaaagagtacaaacaggttattgcgccggtaaaaatccacgcgctggatctgactcgcggcgagttgaaagtcgaaaataaactgtggtttaccacgcttgatgactacaccctgcacgcagaggtgcgcgccgaaggtgaaacgctcgcgacgcaacagattaaactgcgcgacgttgcgccgaacagcgaagcccccttacagatcacgctgccgcagctggacgcccgcgaagcgttcctcaacattacggtgaccaaagattcccgcacccgctacagcgaagccgggcattctatcgccacttatcagttcccgctgaaggaaaacaccgcgcagcctgtacctttcgcaccgaataacgcccgtccgctgacgctggaagacgatcgtttgagctgtactgttcgcggctacaactttgcgatcaccttctcaaaaacgagtggtaaaccgacatcctggcaagtgaatggcgagtcgctgctgacccgcgagccaaagatcaacttcttcaagccgatgatcgacaaccataagcaggagtacgaagggctgtggcagccaaatcatttgcagatcatgcaggagcatctgcgcgattttgtcgttgagcaaagtgatgatgaagtgttgctagtcagccgcacggttattgccccaccggtgtttgacttcgggatgcgctgcacctacatctggcgcatcgctgccgatggccaggttaatgtggcgctttccggtgaacgttatggcgactatccgcacatcattccgtgcatcggtttcaccatgggaattaacggcgaatacgaccaggtggcgtattacggacgtggaccgggcgaaaactacgccgacagccagcaggctaacatcattgatatctggcgcagtaccgtcgatgccatgttcgagaactatcccttcccgcagaacaacggcaaccgtcagcatgtccgctggacggcactgactaatcgccacggcaacggtctgctggtggttccgcagcgaccaattaacttcagcgcctggcactatacccaggaaaacatccacgctgcacagcactgtaacgagcttcagcgcagtgatgacatcaccctgaatctcgaccaccagttgcttggcctcggctctaactcctggggcagcgaggtgctggactcctggcgcgtctggttccgtgacttcagctacggctttacgttgctgccggtttctggcggagaagctaccgcgcaaagcctggcgtcgtatgagttcggcgcagggttcttttccacgaatttgcacagcgagaataagcaatga

SEQ ID NO: 7296 - protein, 1030 aa, Escherichia coli
MNRWENIQLTHENRLAPRAYFFSYDSVAQARTFARETSSLFLLLSGQWNFHFFDHPLQVPEAFTSELMADWGHITVPAMWQMEGHGKLQYTDEGFPFPIDVPFVPSDNPTGAYQRIFTLSDGWQGKQTLIKFDGVETYFEVYVNGQYVGFSKGSRLTAEFDISAMVKTGDNLLCVRVMQWADSTYVEDQDMWWSAGIFRDVYLIGKQLTHINDFTVRTDFDEAYCDATLSCEVVLENLAASPVVTTLEYTLFDGEHVVHSSAIDHLAIEKLTSASFAFTVEQPQQWSAESPYLYHLVMTLKDADGNVLEVVPQRVGFRDIKVRDGLFWINNRYVMLHGVNRHDNDHRKGRAVGMDRVEKDLQLMKQHNINSVRTAHYPNDPRFYELCDIYGLFVMAETDVESHGFANVGDISRITDDPQWEKVYVERIVRHIHAQKNHPSIIIWSLGNESGYGCNIRAMYHAAKALDDTRLVHYEEDRDAEVVDIISTMYTRVPLMNEFGEYPHPKPRIICEYAHAMGNGPGGLTEYQNVFYKHDCIQGHYVWEWCDHGIQAQDDNGNVWYKFGGDYGDYPNNYNFCLDGLIYSDQTPGPGLKEYKQVIAPVKIHALDLTRGELKVENKLWFTTLDDYTLHAEVRAEGETLATQQIKLRDVAPNSEAPLQITLPQLDAREAFLNITVTKDSRTRYSEAGHSIATYQFPLKENTAQPVPFAPNNARPLTLEDDRLSCTVRGYNFAITFSKTSGKPTSWQVNGESLLTREPKINFFKPMIDNHKQEYEGLWQPNHLQIMQEHLRDFVVEQSDDEVLLVSRTVIAPPVFDFGMRCTYIWRIAADGQVNVALSGERYGDYPHIIPCIGFTMGINGEYDQVAYYGRGPGENYADSQQANIIDIWRSTVDAMFENYPFPQNNGNRQHVRWTALTNRHGNGLLVVPQRPINFSAWHYTQENIHAAQHCNELQRSDDITLNLDHQLLGLGSNSWGSEVLDSWRVWFRDFSYGFTLLPVSGGEATAQSLASYEFGAGFFSTNLHSENKQ

SEQ ID NO: 7297 - DNA, 450 bp, Escherichia coli
atgaggatcatcgataacttagaacagttccgccagatttacgcctctggcaagaagtggcaacgctgcgttgaagcgattgaaaatatcgacaacattcagcctggcgtcgcccactccatcggtgactcattgacttaccgcgtggagacggactccgcgaccgatgcgctatttaccgggcatcgacgctattttgaagtgcattactacctgcaagggcagcaaaaaattgaatatgcgccgaaagagacattacaggtagtggaatattatcgtgatgaaactgaccgtgaatatttaaaaggctgcggagaaaccgtagaggtccacgaagggcaaatcgttatttgcgatatccatgaagcgtatcggtttatctgcaataacgcggtcaaaaaagtggttctcaaagtcaccatcgaagatggttatttccataacaaataa

SEQ ID NO: 7298 - protein, 149 aa, Escherichia coli [sequence omitted]

SEQ ID NO: 7299 - DNA, 1434 bp, Escherichia coli
atgtctgataccaaacgtaatacaatcggcaaattcggcttgctctcgctgacttttgccgccgtttacagctttaacaacgttatcaataataatattgagcttggactggcctcggcaccgatgtttttcctcgcgacgattttttattttattcccttctgtctgatcattgcagaatttgtttcgttaaataaaaactcagaagccggtgtctacgcgtgggtaaaaagttcgctgggcggacgttgggcatttattactgcctatacctactggttcgtaaacctgttctttttcacctcgctgttaccgcgcgttattgcttatgcttcgtatgccttcctcggctacgaatatattatgacgccggttgccaccaccattatcagtatggtgctgttcgccttctccacctgggtttctaccaatggggcgaaaatgctggggccaattacctccgtcacttcaacgctgatgctgctgttaacgctctcctacattttactggcaggtacggcactggttggcggcgtacagcctgctgaccccatcactgttgacgcgatgatcccgaacttcaactgggcgttcctcggcgtgaccacctggatctttatggccgcaggtggcgcggagtccgtcgcggtgtacgttaacgacgtcaaaggcggttcgaaatcgttcgttaaagtgatcatcctcgccgggatttttatcggcgtactgtattccgtctcctcggtgctgattaacgtcttcgtcagcagcaaagagttgaaatttactggcggatcggtgcaggtattccacggcatggcggcgtattttggtctaccggaagcgttgatgaatcgctttgtcggtctggtgtcctttaccgcgatgttcggttccctgctgatgtggacggcaacgccggtgaaaattttcttctccgaaatcccggaaggcatctttggtaagaaaaccgtcgaactgaacgaaaacggcgttccggcgcgcgcagcgtggatccagttcctgatcgtcatcccgctgatgattatcccgatgctcggttccaataccgtgcaggatctgatgaatactattattaatatgactgccgcagcgtccatgcttccgccgttattcatcatgctggcttacctgaatttacgcgccaaattagatcacctgccacgcgatttccgtatgggctcccgccgcaccggtattatcgttgtttcaatgctgattgcgatatttgccgtagggtttgtcgcttcgacattcccgactggcgcgaatattctgaccatcattttttataacgtcggcggtattgttatcttcctcggctttgcgtggtggaaatacagtaaatatataaagggattaacggctgaagagcgccatattgaagcgacgccagccagaaatgttgattaa

SEQ ID NO: 7300 - protein, 477 aa, Escherichia coli
MSDTKRNTIGKFGLLSLTFAAVYSFNNVINNNIELGLASAPMFFLATIFYFIPFCLIIAEFVSLNKNSEAGVYAWVKSSLGGRWAFITAYTYWFVNLFFFTSLLPRVIAYASYAFLGYEYIMTPVATTIISMVLFAFSTWVSTNGAKMLGPITSVTSTLMLLLTLSYILLAGTALVGGVQPADPITVDAMIPNFNWAFLGVTTWIFMAAGGAESVAVYVNDVKGGSKSFVKVIILAGIFIGVLYSVSSVLINVFVSSKELKFTGGSVQVFHGMAAYFGLPEALMNRFVGLVSFTAMFGSLLMWTATPVKIFFSEIPEGIFGKKTVELNENGVPARAAWIQFLIVIPLMIIPMLGSNTVQDLMNTIINMTAAASMLPPLFIMLAYLNLRAKLDHLPRDFRMGSRRTGIIVVSMLIAIFAVGFVASTFPTGANILTIIFYNVGGIVIFLGFAWWKYSKYIKGLTAEERHIEATPARNVD

SEQ ID NO: 7301 - DNA, 1071 bp, Escherichia coli
atgaaattaatcactgcaccatgcagagcattacttgcgctgccgttttgctacgccttttctgtgaccgctgatgaagcacgtccggcagaacatgacgacacaaaaacccccgcaatgacctcgacatcttctccttcatttcgtttttacggcgaattaggggttggtgggtatatggatttagagggtgagaataaacataaatacagcgacggcacctatattgaaggtggcctggagatgaagtacggctcctggttcggcctgatttacggcgaaggctggaccgtgcaggccgaccacgacggtaatgcctgggtgcctgaccatagctggggtggtttcgaaggtgggattaaccgtttctatggcggttatcgtaccaatgatggcaccgaaatcatgctcagtctgcgtcaggattcctcgctggatgacctgcaatggtggggcgatttcacgcccgatctgggctacgtcattcccaatacccgcgacattatgactgcgctgaaggtacagaacttaagcggcaactttcgttatagcgttaccgccacacctgccggacatcatgacgaaagcaaagcctggctacattttggcaagtacgatcgctacgacgacaaatacacctatccggcaatgatgaacggttacatccagtatgaccttgcagaaggtatcacctggatgaacggtctggaaatcaccgacggcacaggccaactctatctcacgggcctgcttacccctaactttgccgctcgcgcctggcaccataccggacgcgccgacgggctggacgtatcgggaagtgaaagcgggatgatggtgagcgccatgtatgaagcgttaaagggcgtttatctctccaccgcttacacctacgccaaacatcgccctgaccacgctgacgatgaaaccacctctttcatgcagtttggtatctggtacgaatacggcggcggacgtttcgcaacggcttttgatagccgcttctacatgaaaaatgcctctcacgatcccagcgaccaactcttcctgatgcaatatttttactggtaa

SEQ ID NO: 7302 - protein, 356 aa, Escherichia coli
MKLITAPCRALLALPFCYAFSVTADEARPAEHDDTKTPAMTSTSSPSFRFYGELGVGGYMDLEGENKHKYSDGTYIEGGLEMKYGSWFGLIYGEGWTVQADHDGNAWVPDHSWGGFEGGINRFYGGYRTNDGTEIMLSLRQDSSLDDLQWWGDFTPDLGYVIPNTRDIMTALKVQNLSGNFRYSVTATPAGHHDESKAWLHFGKYDRYDDKYTYPAMMNGYIQYDLAEGITWMNGLEITDGTGQLYLTGLLTPNFAARAWHHTGRADGLDVSGSESGMMVSAMYEALKGVYLSTAYTYAKHRPDHADDETTSFMQFGIWYEYGGGRFATAFDSRFYMKNASHDPSDQLFLMQYFYW

SEQ ID NO: 7303 - DNA, 2352 bp, Escherichia coli
atgaaaataaaaaccattttaacgccagtagcctgtgctctgctgatgagcttttccgcccatgccgctaacgctgacaattataaaaacgtgattaaccgtactggcgcgccgcagtacatgaaggattacgattacgacgatcaccagcgttttaatccgtttttcgatctcggagcctggcatggtcatctgttgccagacggcccgaacactatgggcggctttcctggcgttgcgctgctgacggaagaatacatcaactttatggccagcaatttcgatcgcctgaccgtctggcaagacggcaagaaagtcgatttcacgctggaggcatacagtattcccggcgcgctggtgcaaaagttgatatcgaaagatgtacaggtcgaaatgattctgcgcttcgccacgccgcgcacatcactactggaaaccaaaatcaccagcgataaaccgctggatctggtgtgggatggcgaactgctggaaaaactggaagcgaaagaagggaaaccgctttccgataaaaccattgctggcgaataccctgactatcagcgcaaaatcagcgccacccgtgatggcctgaaagtcacctttggcaaagtgcgcgccacctgggatctgctgacctccggtgaatcagaatatcaggtgcataaatccctgccagtgcagactgaaatcaacggcaatcgctttaccagtaaggcgcatatcaacggttcgacgacgctctataccacctactcccatctgctgaccgctcaggaagttagcaaagagcaaatgcagatccgcgatattctggcgcgtccggcgttttatctcaccgcctcgcagcaacgctgggaagagtatctgaagaaagggttaaccaatccggatgcgacgccggaacagacgcgcgtcgcggtgaaagccatcgaaacgctcaacggtaactggcgatcgccgggcggtgcggtgaaatataacaccgtcacgccgtcggtgaccgggcgctggttctccggcaatcagacctggccgtgggatacctggaagcaggcgtttgcgatggcgcatttcaatccggatatcgccaaagagaatatccgcgcggtcttctcctggcagatccagccaggcgacagcgtgcgtccgcaggatgtgggctttgtccccgacctgattgcgtggaaccttagccccgagcgtggcggcgatggcggcaactggaacgaacgcaataccaagcccagccttgccgcctggtcggtgatggaagtgtacaacgtcacccaggataaaacctggctggcagagatgtacccgaaactggtggcctatcacgactggtggttacgtaaccgcgatcataacggcaacggcgtgccggaatatggcgcgacccgcgacaaagcccacaacaccgagagcggcgagatgctgtttacggtgaaaaaaggcgacaaagaagagacgcggtctgggctgaacaactacgcccgcgtggtggagaaaggccagtacgacagtctggaaattccggcacaggttgccgcgtcgtgggaatcgggtcgtgatgatgccgccgtttttgggtttatcgacaaggaacagttggataaatatgtcgctaacggcggcaaacgtagcgactggacggtgaaattcgccgagaaccgcagtcaggacggaacgttgctgggctactcgctattgcaggagtcggtggatcaggccagctatatgtacagcgataaccattatctggcggagatggcgacgattctcggtaagccggaagaggccaaacgctatcgtcagttagcacaacagctcgcggactacatcaacacttgtatgttcgacccgactacacagttctactatgacgtgcgtattgaagataaaccgctggcgaacggctgcgcgggcaaaccgattgttgagcgcggtaaagggccagaaggctggtcgccgctgtttaacggtgcggcaacgcaggccaacgccgacgcggtggtgaaggtgatgctcgatcctaaagagttcaacacctttgtaccgctgggaacggcagcgttaaccaacccggcttttggcgctgatatctactggcgcgggcgcgtatgggtagatcagttctggtttggtctgaaaggaatggagcgttacggttatcgtgatgatgccctgaaactggcggatacgttcttccagcatgccaaaggattaaccgccgatggcccaattcaggagaattacaacccgctgactggcgcacagcaaggcgcaccaaatttctcctggagtgccgcgcatttgtatatgttgtataacgattttttccgtaagcagtaa

SEQ ID NO: 7304 - protein, 783 aa, Escherichia coli
MKIKTILTPVACALLMSFSAHAANADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLISKDVQVEMILRFATPRTSLLETKITSDKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKYNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWLAEMYPKLVAYHDWWLRNRDHNGNGVPEYGATRDKAHNTESGEMLFTVKKGDKEETRSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFQHAKGLTADGPIQENYNPLTGAQQGAPNFSWSAAHLYMLYNDFFRKQ

SEQ ID NO: 7305 - DNA, 2019 bp, Escherichia coli
atgagctatccgtcgctgtttgccccgctggatttaggttttaccacgttaaaaaaccgcgtgttgatgggctcaatgcacaccgggctggaggaatacccggacggcgctgaacggctggcagcgttttatgccgaacgcgcccgtcacggcgtggcgttgattgtcagcggcggtatcgcaccagatttaacaggcgttggcatggaaggcggtgcaatgctcaatgacgccaaccagatcccacaccatcgcaccattaccgaagccgtacatcaggaaggcggcaaaatcgccctgcaaattttgcataccgggcgctacagctaccaaccgcatctggtcgcaccctccgcattgcaggcccccatcaaccgtttcgttcctcacgaactcacccatgaagagatcctgcaactgatcgacgatttcgcccactgcgcgcaattggcacgggaggcaggatacgacggtgtagaggtgatggggtccgaagggtatttgatcaacgaatttctgacgctgcgcaccaatcagcgtagtgaccagtggggcggcgattaccgcaaccggatgcggtttgccgtagaagtagtgggtgcggtgcgcgaacgtgtcggcaacgacttcattattatctaccgtttgtcgatgctcgacctggtcgaaggcggcggtacttttgccgaaacggtagagctggcgcaggccattgaagcggcgggcgcaacgattatcaacaccggcattggctggcatgaagcacgtattccgaccattgccacgcccgtgccgcgcggcgcatttagctgggtcacgcgcaaactgaaaggccacgtttcgctgccgctggtgaccaccaaccggattaacgatccgcaggttgccgacgacattctctcgcgcggtgatgcggacatggtatcgatggcgcgaccgtttctcgctgatgcggagctgctgtcaaaagcgcaatcgggacgagccgatgagatcaacacttgtattggctgcaaccaggcctgtctcgatcagatcttcgttggcaaagtcacctcgtgcctggtgaatcctcgcgcctgccatgaaaccaaaatgccaatccttccggccgtgcagaaaaaaaatctggcggtggtcggtgcgggacctgctgggctggcgtttgccattaacgcggcggcgcgtgggcatcaggtaacattgtttgatgcgcacagcgagatcggcgggcagtttaatatcgccaaacagatccccggcaaagaggagttttacgaaacgctgcgctattaccgccggatgatcgaagtgacgggtgtgacactgaaacttaatcacaccgtgaccgcagatcagttaaaggcgttcgatgaaacgatcctcgccagtgggatcgtaccgcgcattccgcccatcgacgggatcgatcatccgaaggtgttgagttatctcgacgtactgcgcgacaaagcgcaggtaggcaacaaagttgccatcatcggttgtggcgggattggttttgatacggcgatgtatttaagtcagccgggcgaatccaccagccagaatatcgccgggttctgtaatgaatgggggatcgacagcagcctgcaacaggctggtggcttaagcccgcagggaatgcagatcccgcgtagcccacggcagattgtgatgctccagcgcaaagccagcaaaccgggacaggggttaggcaaaaccaccggctggatccatcgcaccaccctgctctcgcgcggtgtgaaaatgatcccaggcgtaagttatcagaagattgacgatgacgggctgcatgtggtgatcaacggcgaaacgcaggtattagcagtggacaatgtggtgatctgcgcagggcaagagccaaaccgcgcattggcgcaaccgctgattgatagcgggaaaactgtgcatttaattggcggctgcgatgtagctatggagctggacgcacgacgggcaattgcccagggaacacggctggcgctggagatttaa

SEQ ID NO: 7306 - protein, 672 aa, Escherichia coli
MSYPSLFAPLDLGFTTLKNRVLMGSMHTGLEEYPDGAERLAAFYAERARHGVALIVSGGIAPDLTGVGMEGGAMLNDANQIPHHRTITEAVHQEGGKIALQILHTGRYSYQPHLVAPSALQAPINRFVPHELTHEEILQLIDDFAHCAQLAREAGYDGVEVMGSEGYLINEFLTLRTNQRSDQWGGDYRNRMRFAVEVVGAVRERVGNDFIIIYRLSMLDLVEGGGTFAETVELAQAIEAAGATIINTGIGWHEARIPTIATPVPRGAFSWVTRKLKGHVSLPLVTTNRINDPQVADDILSRGDADMVSMARPFLADAELLSKAQSGRADEINTCIGCNQACLDQIFVGKVTSCLVNPRACHETKMPILPAVQKKNLAVVGAGPAGLAFAINAAARGHQVTLFDAHSEIGGQFNIAKQIPGKEEFYETLRYYRRMIEVTGVTLKLNHTVTADQLKAFDETILASGIVPRIPPIDGIDHPKVLSYLDVLRDKAQVGNKVAIIGCGGIGFDTAMYLSQPGESTSQNIAGFCNEWGIDSSLQQAGGLSPQGMQIPRSPRQIVMLQRKASKPGQGLGKTTGWIHRTTLLSRGVKMIPGVSYQKIDDDGLHVVINGETQVLAVDNVVICAGQEPNRALAQPLIDSGKTVHLIGGCDVAMELDARRAIAQGTRLALEI

SEQ ID NO: 7307 - DNA, 1137 bp, Escherichia coli
atgagccacttagacaacggtttccgttcactgacactacaacgttttccggcgacggatgacgttaacccgctacaggcgtgggaagcggcggatgaatatttgctgcaacagttggacgacacagaaatccgcggcccggtgttgatcctgaatgatgcctttggtgcgttaagttgtgcgctggcggaacataagccgtacagcattggcgactcatacatcagtgaactggccacgcgcgagaatttacgcctcaacgggattgatgaatcgagcgtgaagtttctcgacagcaccgccgactacccgcaacagccgggcgtggtactgatcaaagtaccgaaaacactggcattgctggaacaacaactgcgtgcgctgcgcaaagtggtcacgccggatacacgtattattgccggtgccaaagcccgtgacatccacacttccacgctggaactgttcgaaaaagtgctcggcccgactaccaccacgctggcatggaagaaggcacgcttaattaactgtactttcaacgagccgccgctggccgatgcgccgcagaccgttagctggaaactggaaggtactgactggactatccacaaccatgcgaatgtcttctcccgcaccgggctggatattggcgcgcgcttctttatgcaacatctgccagagaatctcgagggtgagattgtcgatctcggctgcggtaatggcgttattggtctgacgctgcttgataaaaacccgcaggcgaaagtggtgtttgtcgatgaatcgccgatggcggttgcttccagccgtttgaacgttgaaaccaacatgcccgaggcgttggatcgctgcgagtttatgatcaacaacgcgctctccggcgtggagcctttccgttttaatgctgtgctctgcaacccgccgtttcatcagcaacatgcgctgaccgataacgtcgcctgggagatgttccaccatgcccgccgctgcctgaaaatcaacggcgagctgtatatcgttgccaaccgtcacctggattacttccataaactgaagaagattttcggcaactgcaccaccatcgccacgaataataaatttgtggtgctgaaagcagtgaagctggggcgtcgtcggtaa

SEQ ID NO: 7308 - protein, 378 aa, Escherichia coli
MSHLDNGFRSLTLQRFPATDDVNPLQAWEAADEYLLQQLDDTEIRGPVLILNDAFGALSCALAEHKPYSIGDSYISELATRENLRLNGIDESSVKFLDSTADYPQQPGVVLIKVPKTLALLEQQLRALRKVVTPDTRIIAGAKARDIHTSTLELFEKVLGPTTTTLAWKKARLINCTFNEPPLADAPQTVSWKLEGTDWTIHNHANVFSRTGLDIGARFFMQHLPENLEGEIVDLGCGNGVIGLTLLDKNPQAKVVFVDESPMAVASSRLNVETNMPEALDRCEFMINNALSGVEPFRFNAVLCNPPFHQQHALTDNVAWEMFHHARRCLKINGELYIVANRHLDYFHKLKKIFGNCTTIATNNKFVVLKAVKLGRRR

SEQ ID NO: 7309 - DNA, 540 bp, Escherichia coli
gtgagtataccctttttctctttttcgtgggcggttatgagcaatcttacttatcttcagggttatcccgagcagctactttcccaggtgcgaacgctgattaacgaacagcgtctgggcgatgtgctggcaaaacgttatccgggaacacacgactacgccaccgataaagccctctggcaatatacccaggatcttaaaaatcagtttctgcgcaatgccccgccgatcaataaagtgatgtatgacaataagatccacgtgctgaaaaacgcgctcggattacatactgccgtttcgcgtgtgcagggcggcaagctgaaagcaaaagcagagatccgcgtcgctaccgtgtttcgcaacgcgccggaaccgtttttgcgcatgatcgtggtgcacgagctggcgcacctgaaggagaaagagcataacaaagcgttttaccagttgtgctgccatatggagccgcagtaccaccagcttgagttcgacacccggctgtggctaacgcagttgtcgcttgggcaggacaaaatctga

SEQ ID NO: 7310 - protein, 179 aa, Escherichia coli
MSIPFFSFSWAVMSNLTYLQGYPEQLLSQVRTLINEQRLGDVLAKRYPGTHDYATDKALWQYTQDLKNQFLRNAPPINKVMYDNKIHVLKNALGLHTAVSRVQGGKLKAKAEIRVATVFRNAPEPFLRMIVVHELAHLKEKEHNKAFYQLCCHMEPQYHQLEFDTRLWLTQLSLGQDKI

SEQ ID NO: 7311 - DNA, 693 bp, Escherichia coli
atgctgcgcgcctttgcccgccttcttctccgtatttgtttttctcgccggactctaaagcttggctgtttattgttgcttatagcaggagcgaccatttttattgccgatcgcgttatggtcaacgccagcaagcagctgacctggagcgatgtcaacgccgttccggcgcggaacgtgggtttattgctgggggcgaggccgggtaatcgctactttacccgacgtattgataccgcagcagcgttgtaccacgccggaaaagtgaaatggctattggtgagcggcgataatggacgtaaaaattacgatgaagcgtcaggaatgcagcaagccttgatcgctaaaggcgtaccggcaaaagtgatcttctgcgactatgccggattctcaacgcttgattcggtggtgcgtgccaacaaggtgtttagtgaaaatcatatcaccattatctcgcaagaatttcataaccaacgcgccatctggctggcaaaacagtatggtatcgatgctatcggttttaacgcgccagacctcaatatgaagcacggtttatatactcaactgcgggaaaaacttgccagagtcagcgcggtgattgatgcgaaaatcctccatcgccagccgaaatatctcgggccgttggttatgattgggccgtttagtgagcatggctgtccggcgaaagaataa

SEQ ID NO: 7312 - protein, 230 aa, Escherichia coli
MLRAFARLLLRICFSRRTLKLGCLLLLIAGATIFIADRVMVNASKQLTWSDVNAVPARNVGLLLGARPGNRYFTRRIDTAAALYHAGKVKWLLVSGDNGRKNYDEASGMQQALIAKGVPAKVIFCDYAGFSTLDSVVRANKVFSENHITIISQEFHNQRAIWLAKQYGIDAIGFNAPDLNMKHGLYTQLREKLARVSAVIDAKILHRQPKYLGPLVMIGPFSEHGCPAKE

SEQ ID NO: 7313 - DNA, 987 bp, Escherichia coli
atgatacgtttcgctgtgattggtacgaactggatcactcgccagttcgtcgaggccgcccatgagagcggtaaatacaagttaaccgccgtttattcccgcagtcttgaacaggcccagcacttcgccaatgatttttctgtcgagcatctgtttacgtcgctggaagcgatggcagaaagcgatgccattgacgcggtgtatattgccagcccgaattccctgcacttttcccagacacaacttttccttagtcacaaaattcatgtgatttgcgagaaaccgctggcgtcaaatctggcggaagtggatgccgccattgcctgtgcgcgggaaaatcaggtggtgctgtttgaggcatttaaaacggcctacctgccgaactttcatttgctgcgccaggcgctgccgaaagtcggcaaactgcgtaaagtctttttcaactattgccagtattcctcgcggtatcagcgttacctggacggagagaatcccaacacctttaatccgacattctctaacggttcaattatggatatcggcttttactgcctggcgtcggcggtggcattattcggtgaaccgaaaagcgtgcaggcaaccgccagtttgctggcaagcggtgtggatgcccacggcgtggtggtgatggattacggtgatttcagcgttacgttgcagcactcaaaagtgagcgattctgtcctggcaagcgagattcagggcgaagcgggatcgctggtgattgaaaaactgtctgaatgccaggaagtttgctttgtaccgcgtggcagccagatgcaggatctcacccagccacagcatattaataccatgctctacgaagcagagctgttcgctaccctggtggatgagcatctggtgaatcatccagggctggcggtcagtcgtatcaccgccaaactgctgactgagatccgccgccagactggggtgatttttccggcagataacgtaaaactataa

SEQ ID NO: 7314 - protein, 328 aa, Escherichia coli
MIRFAVIGTNWITRQFVEAAHESGKYKLTAVYSRSLEQAQHFANDFSVEHLFTSLEAMAESDAIDAVYIASPNSLHFSQTQLFLSHKIHVICEKPLASNLAEVDAAIACARENQVVLFEAFKTAYLPNFHLLRQALPKVGKLRKVFFNYCQYSSRYQRYLDGENPNTFNPTFSNGSIMDIGFYCLASAVALFGEPKSVQATASLLASGVDAHGVVVMDYGDFSVTLQHSKVSDSVLASEIQGEAGSLVIEKLSECQEVCFVPRGSQMQDLTQPQHINTMLYEAELFATLVDEHLVNHPGLAVSRITAKLLTEIRRQTGVIFPADNVKL

SEQ ID NO: 7315 - DNA, 966 bp, Escherichia coli
atgaatactgtcggcacgccgttgctatggggcggattcgctgttgttgtcaccattatgctggctatcgacctgttgttgcaggggcgtcgtggggcacatgccatgaccatgaaacaggctgcggcctggtcgctggtctgggtgacgctgtcgttactgtttaacgccgctttctggtggtatctggtgcaaaccgaaggtcgcgccgttgccgatccacaggcactggcctttctcacgggttatctgattgagaaatcgctggcggtcgataacgtctttgtctggctgatgttgttcagctatttctctgttccggcggcattacaacgccgcgtgctggtgtatggcgtactcggggcgattgttctgcgtaccatcatgatcttcactggtagctggctgatttcacagttcgactggatcttgtatatcttcggtgccttcctgctgtttaccggcgtgaagatggcgctcgcccatgaagatgaatcaggcattggcgacaagccgctggtgcgctggctacgcggtcatttgcgcatgaccgacaccatcgacaacgagcatttctttgtgcgtaagaatggtttgttgtatgccacgccgctgatgctggtgctgattctggtggagttgagcgacgtgattttcgccgtggatagtattccggctatcttcgccgtgaccaccgatccgtttattgtgctgacctcaaacctgtttgcgatcctcggcctgcgtgcgatgtatttcctgctggcaggtgtggcagagcgtttctcgatgctcaaatatggtctggcggtgattctggtgtttatcggtatcaagatgctgattgtcgacttctaccatattccgatcgctgtctcgctgggcgtggtgtttggcattctggtgatgacgtttattatcaacgcctgggtgaattatcggcatgataagcagcgggtagaataa

SEQ ID NO: 7316 - protein, 321 aa, Escherichia coli
MNTVGTPLLWGGFAVVVTIMLAIDLLLQGRRGAHAMTMKQAAAWSLVWVTLSLLFNAAFWWYLVQTEGRAVADPQALAFLTGYLIEKSLAVDNVFVWLMLFSYFSVPAALQRRVLVYGVLGAIVLRTIMIFTGSWLISQFDWILYIFGAFLLFTGVKMALAHEDESGIGDKPLVRWLRGHLRMTDTIDNEHFFVRKNGLLYATPLMLVLILVELSDVIFAVDSIPAIFAVTTDPFIVLTSNLFAILGLRAMYFLLAGVAERFSMLKYGLAVILVFIGIKMLIVDFYHIPIAVSLGVVFGILVMTFIINAWVNYRHDKQRVE

SEQ ID NO: 7317 - DNA, 1245 bp, Escherichia coli
atgactacgcaacattcaccggggctattccggcgtctggctcatggcagcctggtaaaacaaatcctggccggccttattctggggattcttctggcatggatctcaaaacccgcggcggaagctgttggtctgttaggtactttgttcgtcggcgcactgaaagccgttgcccccatcctggtgttgatgctggtaatggcatctattgctaaccaccagcacgggcagaaaaccaatatccgccctattttgttcctctatctgctgggcaccttctctgctgctctggccgcagtaatcttcagttttgccttcccttctaccctgcacttgtccagtagcgcgggtgatatttcgccgccgtcaggcattgtagaagtgatgcgcgggctggtaatgagcatggtttccaaccccattgacgcgctgctgaaaggtaactatatcgggatcctggtgtgggcaattggcctcggtttcgcactgcgtcacggtaacgaaaccaccaaaaacctggtcaacgatatgtcgaatgccgttacctttatggtgaaactggtgattcacttcgcaccgatcggtatttttggtctggtttcttctaccctggcaaccaccggtttctccacgctgtggggctacgcgcaactgctggtggtactggttggctgtatgctgctggtggcgctggtggttaacccactgctggtatggtggaaaattcgtcgtaacccgttcccgctggtgctgctgtgcctgcgcgaaagcggcgtgtatgccttcttcacccgcagctctgcggcgaacattccggtgaatatggcgctgtgtgaaaagctgaatctggatcgcgatacctattccgtttctattccgctgggagccaccatcaatatggcgggcgcagcaatcaccattaccgtgttgacgctggctgcggttaatacgctgggtattccggttgatctgcccacagcgctgctgttgagcgtagtggcttctctgtgtgcctgtggcgcatccggcgtggcgggggggtctctgttgctgatcccactggcctgtaatatgttcggtatttcgaacgatatcgccatgcaggtggttgctgtcggctttattatcggcgtattgcaggactcctgtgaaaccgcgctgaactcgtcaactgacgtgctgttcactgcggcagcttgccaggcggaagacgatcgtctggcaaatagcgccctgcgtaactaa

SEQ ID NO: 7318 - protein, 414 aa, Escherichia coli
MTTQHSPGLFRRLAHGSLVKQILAGLILGILLAWISKPAAEAVGLLGTLFVGALKAVAPILVLMLVMASIANHQHGQKTNIRPILFLYLLGTFSAALAAVIFSFAFPSTLHLSSSAGDISPPSGIVEVMRGLVMSMVSNPIDALLKGNYIGILVWAIGLGFALRHGNETTKNLVNDMSNAVTFMVKLVIHFAPIGIFGLVSSTLATTGFSTLWGYAQLLVVLVGCMLLVALVVNPLLVWWKIRRNPFPLVLLCLRESGVYAFFTRSSAANIPVNMALCEKLNLDRDTYSVSIPLGATINMAGAAITITVLTLAAVNTLGIPVDLPTALLLSVVASLCACGASGVAGGSLLLIPLACNMFGISNDIAMQVVAVGFIIGVLQDSCETALNSSTDVLFTAAACQAEDDRLANSALRN

SEQ ID NO: 7319 - DNA, 552 bp, Escherichia coli
atgaccgcgtattggctggcccagggcgtgggtgtcatcgcctttctgattggtatcacaacatttttcaatcgtgacgaacgtcgcttcaaaaagcaactttcggtctatagcgccgttattggcgtacatttttttcttctgggcacctatcctgccggtgccagtgccatccttaatgccattcgtacattgattaccttacgcacgcgcagcttatgggtaatggcgatttttattgtgctgactggcggaattggcctcgcgaagttccatcatcctgtcgaactattgccggtaatcggcacgattgtcagtacctgggcgctgttccgctgtaaagggctgaccatgcgctgcgtaatgtggttttcaacgtgttgctgggtgattcacaacttctgggcggggtcgataggcggcacgatgattgaaggcagttttctgctgatgaatggcctgaatatcattcgtttctggcgtatgcagagaaggggaattgatccgtttaaagtggagaaaaccccttccgccgtagacgaaaggggctaa

SEQ ID NO: 7320 - protein, 183 aa, Escherichia coli
MTAYWLAQGVGVIAFLIGITTFFNRDERRFKKQLSVYSAVIGVHFFLLGTYPAGASAILNAIRTLITLRTRSLWVMAIFIVLTGGIGLAKFHHPVELLPVIGTIVSTWALFRCKGLTMRCVMWFSTCCWVIHNFWAGSIGGTMIEGSFLLMNGLNIIRFWRMQRRGIDPFKVEKTPSAVDERG

SEQ ID NO: 7321 - DNA, 1488 bp, Escherichia coli
atgcaatacatcaagatccatgcgctggataacgtcgcggttgctttagcggatttggctgaaggcacagaagtcagtgtcgataaccagactgttacgctgcgccaggatgttgctcgtggacataaatttgcgttaacggatatcgcaaaaggggccaacgtcattaaatatggcctgccgattggttatgcattggcggatattgcagcgggggaacacgttcacgcccacaatacgcgcacgaatctgagcgatctggatcagtatcgctatcaacctgattttcaggatctgcctgcgcaagcggcagatcgtgaagtgcagatctatcgtcgcgctaacggcgatgtcggggtgcgtaatgagctgtggatcctgccaaccgtgggctgtgtcaacggcatcgcgcggcagatccaaaatcgtttcctgaaagagaccaacaacgctgaaggtaccgacggcgtgttcctcttcagccacacctacggctgctcacaactgggcgacgatcacatcaatactcgcaccatgctgcaaaacatggtgcgccacccgaacgcgggcgcagtgctggtgattggtctgggctgtgaaaacaaccaggttgccgcattccgtgaaacgttgggcgatatcgatcctgaacgcgttcatttcatgatctgccaacagcaggatgatgaaatcgaggccgggatcgcgcatttgcatcagctgtatagcgtgatgcgcaacgataaacgcgagccgggcaaactcagcgaactgaagtttggtctggagtgcggtggttctgacggtctttctggtattactgctaacccgatgctggggcgtttctctgactacgtgattgctaacggcggtactaccgtactgaccgaagtgccggagatgtttggcgcagagcagttgctgatggaccattgtcgcgacgaagcaacgtttgaaaaactggtcaccatggtcaatgacttcaagcagtactttattgcccatgaccagccgatctacgaaaacccatcaccggggaacaaagcaggcggtatcaccacgctggaagacaaatcacttggctgtacccagaaagcgggtaccagtgtcgtggttgacgtgctgcgttacggcgagcgtctgaaaacgccggggctgaacttgttaagtgcgccgggtaacgatgccgtagcgaccagcgccctggcgggtgcgggctgccatatggtgctgttcagtactggtcgtggtacgccgtatggtggatttgtgccgacggtgaaaatcgccaccaacagtgaactggcggcgaagaaaaaacactggatcgactttgacgcgggtcagctgatccacggtaaagcgatgccgcagttgctggaagaatttatcgacaccatcgttgagtttgccaatggtaaacaaacctgcaacgagcgtaacgacttccgcgaactggcgatcttcaaaagcggcgtaacgctataa

SEQ ID NO: 7322 - protein, 495 aa, Escherichia coli
MQYIKIHALDNVAVALADLAEGTEVSVDNQTVTLRQDVARGHKFALTDIAKGANVIKYGLPIGYALADIAAGEHVHAHNTRTNLSDLDQYRYQPDFQDLPAQAADREVQIYRRANGDVGVRNELWILPTVGCVNGIARQIQNRFLKETNNAEGTDGVFLFSHTYGCSQLGDDHINTRTMLQNMVRHPNAGAVLVIGLGCENNQVAAFRETLGDIDPERVHFMICQQQDDEIEAGIAHLHQLYSVMRNDKREPGKLSELKFGLECGGSDGLSGITANPMLGRFSDYVIANGGTTVLTEVPEMFGAEQLLMDHCRDEATFEKLVTMVNDFKQYFIAHDQPIYENPSPGNKAGGITTLEDKSLGCTQKAGTSVVVDVLRYGERLKTPGLNLLSAPGNDAVATSALAGAGCHMVLFSTGRGTPYGGFVPTVKIATNSELAAKKKHWIDFDAGQLIHGKAMPQLLEEFIDTIVEFANGKQTCNERNDFRELAIFKSGVTL

SEQ ID NO: 7323 - DNA, 1413 bp, Escherichia coli
atgactccgtttatgactgaagatttcctgttagatactgaatttgcccgccgtctgtatcacgactacgcaaaagaccagccgattttcgattaccattgccatttgccgccgcagcagattgcggaagactatcgttttaaaaacctgtatgacatctggttgaagggcgatcactacaaatggcgcgctatgcgtaccaacggtgtggccgagcgtctgtgcaccggtgatgcgtctgaccgtgaaaaatttgacgcctgggcggcgactgttccgcacactatcggcaacccgttataccactggacgcacctcgaactgcgtcgtccgtttggtatcactggcaaattgctttctccgtcaactgccgatgaaatctggaacgaatgtaacgaactgctggcgcaggataatttctctgcacgcggcatcatgcagcagatgaacgtgaaaatggtcggcaccaccgatgacccgatcgattctctggagcatcacgcagagatcgccaaagacggctctttcaccattaaagtgctgccgagctggcgtccggacaaagcctttaacattgaacaggcgacctttaacgactacatggcgaagctgggcgaagtttccgataccgacattcgccgctttgctgacctgcaaactgccctgactaaacgtctggatcacttcgccgctcacggctgtaaagtgtctgaccacgcgctggatgtggtgatgtttgctgaagcgaacgaagcggaactggacagcatcctcgcgcgccgtctggcaggcgaaaccctgagcgagcacgaagtggcacagttcaaaactgcggtgctggtgttccttggtgccgaatatgcacgtcgcggctgggtacagcagtaccacattggcgcactgcgtaataacaacctgcgtcagtttaaactgctggggccggatgtcggctttgactccatcaacgaccgtccgatggcggaagagctgtctaagctgctgagcaagcagaatgaagaaaacctgctgccgaaaaccattctctactgcctgaacccgcgcgataacgaagtgctgggcaccatgatcggtaacttccagggcgaaggtatgccgggcaaaatgcagttcggttccggctggtggtttaacgaccagaaagacggtatggaacgtcagatgacccaactggcgcagctcggtctgctgagccgctttgtcggcatgctgactgacagccgtagcttcctgtcatacacccgtcacgaatacttccgccgcattctgtgccaaatgatcggtcgctgggtggaagcaggcgaagcaccggcggacatcaacctgctgggcgagatggtgaaaaatatttgctttaacaatgcgcgtgactacttcgccattgaactgaactaa

SEQ ID NO: 7324 - protein, 470 aa, Escherichia coli
MTPFMTEDFLLDTEFARRLYHDYAKDQPIFDYHCHLPPQQIAEDYRFKNLYDIWLKGDHYKWRAMRTNGVAERLCTGDASDREKFDAWAATVPHTIGNPLYHWTHLELRRPFGITGKLLSPSTADEIWNECNELLAQDNFSARGIMQQMNVKMVGTTDDPIDSLEHHAEIAKDGSFTIKVLPSWRPDKAFNIEQATFNDYMAKLGEVSDTDIRRFADLQTALTKRLDHFAAHGCKVSDHALDVVMFAEANEAELDSILARRLAGETLSEHEVAQFKTAVLVFLGAEYARRGWVQQYHIGALRNNNLRQFKLLGPDVGFDSINDRPMAEELSKLLSKQNEENLLPKTILYCLNPRDNEVLGTMIGNFQGEGMPGKMQFGSGWWFNDQKDGMERQMTQLAQLGLLSRFVGMLTDSRSFLSYTRHEYFRRILCQMIGRWVEAGEAPADINLLGEMVKNICFNNARDYFAIELN

SEQ ID NO: 7325 - DNA, 1419 bp, Escherichia coli
atggcaacgttcggggcgtgccggttttttttcggttacccggtcgtaactaacatcttcagcctctggcgggatgatggccgcgcttcctgcggatataacaaaacgatgaggttttacatgcgtaaaattaaagggttacgttggtatatgatcgcactggtgacgctcggcaccgtgcttggttacctgacgcgtaacactgtggcggcagctgcgccaactctgatggaagagttaaacatctccacccaacagtattcctatatcatcgcagcgtattctgctgcttatacggtcatgcaaccggtagcgggttatgtactggatgtgctgggtacgaaaatcggttatgcaatgtttgctgtactgtgggccgtgttctgtggtgcaactgcgctggcaggtagttggggtggcctggcggttgctcgtggtgcggtcggtgccgcggaagccgcgatgattccggcgggtctgaaagccagctccgaatggttcccggcgaaagagcgttccatcgcggtaggttactttaacgtaggttcttcgattggtgcgatgattgcgccgccgctggtggtatgggcaatcgtgatgcacagctggcagatggcatttatcatctccggtgcgttgagctttatctgggcgatggcatggctgattttctataaacatccgcgcgaccagaaacatctgaccgatgaagaacgcgactacattattaatggtcaggaagcccagcaccaggttgacacagcgaagaaaatgtccgttggtcagatcctgcgcaaccgtcagttctggggtatcgcgctgccgcgcttcctggcagaaccggcatggggtacttttaacgcgtggatcccgctgttcatgtttaaagtttacggctttaacctgaaagagatcgcgatgtttgcctggatgccgatgctgtttgctgacctcggttgtatcctcggtggttacctgccgccgctgttccagcgttggtttggtgtgaacctgatcgtttcccgtaagatggtcgtaacgctgggtgcggtgctgatgattggcccgggtatgatcggtctgttcaccaacccgtatgtcgcgattatgctgctgtgtatcggtggttttgctcaccaggcactgtctggcgcactgattacgctctcgtctgacgtgttcggtcgtaacgaagtggcgacggcgaacggtttaaccgggatgtccgcatggctggcaagtacgctgtttgcactggtagtcggtgcactggctgacaccatcggcttcagcccgctgttcgcagttctggcagtgttcgacctgttaggtgcgctggttatctggaccgtgttgcagaacaaaccggcgattgaggtggcgcaggaatcacataacgatcccgcaccgcaacattaa

SEQ ID NO: 7326 - protein, 472 aa, Escherichia coli
MATFGACRFFFGYPVVTNIFSLWRDDGRASCGYNKTMRFYMRKIKGLRWYMIALVTLGTVLGYLTRNTVAAAAPTLMEELNISTQQYSYIIAAYSAAYTVMQPVAGYVLDVLGTKIGYAMFAVLWAVFCGATALAGSWGGLAVARGAVGAAEAAMIPAGLKASSEWFPAKERSIAVGYFNVGSSIGAMIAPPLVVWAIVMHSWQMAFIISGALSFIWAMAWLIFYKHPRDQKHLTDEERDYIINGQEAQHQVDTAKKMSVGQILRNRQFWGIALPRFLAEPAWGTFNAWIPLFMFKVYGFNLKEIAMFAWMPMLFADLGCILGGYLPPLFQRWFGVNLIVSRKMVVTLGAVLMIGPGMIGLFTNPYVAIMLLCIGGFAHQALSGALITLSSDVFGRNEVATANGLTGMSAWLASTLFALVVGALADTIGFSPLFAVLAVFDLLGALVIWTVLQNKPAIEVAQESHNDPAPQH

SEQ ID NO: 7327 - DNA, 777 bp, Escherichia coli
atggaaatcactgaaccacgccgtttgtatcaacaacttgccgctgatctgaaagagcgcatcgaacagggcgtctatctggtgggtgataaactgcctgccgaacgctttattgccgatgaaaaaaacgtcagccgcaccgtggttcgtgaagccatcatcatgctggaagttgaaggctatgtcgaagtgcgtaaaggttcaggtattcatgtggtttccaaccagcctcgccatcagcaggcggctgacaataatatggaattcgccaattacggtccgtttgagttgctccaggctcgccagctcatcgaaagtaatattgccgagttcgcggcaactcaggtaacgaaacaggacatcatgaaattgatggccatccaggagcaggcgcgcggcgaacaatgcttccgtgattccgagtgggatttgcagttccatattcaggtagccctggcgacgcagaactccgccctggcggctatcgttgaaaaaatgtggacccagcgtagtcataacccgtactggaaaaaactgcacgaacacattgatgcccgtaccgtcgataactggtgtgatgaccacgatcaaatcctcaaggcgctgattcgcaaagatcctcatgctgctaagctggcaatgtggcagcacctggaaaacaccaagatcatgttatttaacgaaaccagcgacgatttcgagttcaatgccgaccgctatctgttcgccgaaaacccggtggtgcatctcgatacagccaccagcggcagtaaatga

SEQ ID NO: 7328 - protein, 258 aa, Escherichia coli
MEITEPRRLYQQLAADLKERIEQGVYLVGDKLPAERFIADEKNVSRTVVREAIIMLEVEGYVEVRKGSGIHVVSNQPRHQQAADNNMEFANYGPFELLQARQLIESNIAEFAATQVTKQDIMKLMAIQEQARGEQCFRDSEWDLQFHIQVALATQNSALAAIVEKMWTQRSHNPYWKKLHEHIDARTVDNWCDDHDQILKALIRKDPHAAKLAMWQHLENTKIMLFNETSDDFEFNADRYLFAENPVVHLDTATSGSK

SEQ ID NO: 7329 - DNA, 663 bp, Escherichia coli
atggaacttttgacccaattgctgcaagccctgtgggcgcaggattttgaaaccctggccaatccgtcgatgattggcatgttgtattttgtcttgtttgtcattttgttccttgaaaacggcttgcttccggcggcctttttaccgggcgacagtttactggtactggtcggcgtattgattgcgaaaggcgcgatgggctatccgcaaacgattctgctgctgaccgttgccgccagcctcggttgctgggtcagctatattcaggggcgatggctgggcaatacccgcaccgtacaaaactggctatctcatttacccgcgcattatcatcaacgcgcacaccatctttttcataaacacggtttatcggcgctgttaattggtcgctttattgcgtttgtcagaacactgctgccgacgattgccgggttatcagggctgaataacgcgcgctttcagttcttcaactggatgagtggtctgctgtgggtgttgatcctgacaactctgggttacatgctcggcaaaacgccggtatttttaaagtacgaggaccagctgatgtcatgcctgatgctgctcccggtggtgctgctggtgtttggcctggcaggttctctggtcgtgttatggaaaaagaaatatggaaatcgggggtaa

SEQ ID NO: 7330 - protein, 220 aa, Escherichia coli
MELLTQLLQALWAQDFETLANPSMIGMLYFVLFVILFLENGLLPAAFLPGDSLLVLVGVLIAKGAMGYPQTILLLTVAASLGCWVSYIQGRWLGNTRTVQNWLSHLPAHYHQRAHHLFHKHGLSALLIGRFIAFVRTLLPTIAGLSGLNNARFQFFNWMSGLLWVLILTTLGYMLGKTPVFLKYEDQLMSCLMLLPVVLLVFGLAGSLVVLWKKKYGNRG

SEQ ID NO: 7331 - DNA, 384 bp, Escherichia coli
atgcaaatacctcgcatgtcacttcgccagctagcctggtccggcgctgttttacttctggtcagcacactattgctggcctggtccgcggttcgccagcaagagtctacgctggcgattcgtgccgttcatcaagggacaacgatgccagacggtttttcaatctggcatcaccttgacgctcacggcattcctttcaaaagtatcacccccaaaaacgacactctgttaattacctttgactccagcgaccagagcgccgccgcaaaagcggtcctcgacagaacattgccccatggctacatcattgcgcagcaggacaataacagtcaggctatgcagtggctgacccggttgcgggataactctcatcgcttcggataa

SEQ ID NO: 7332 - protein, 127 aa, Escherichia coli
MQIPRMSLRQLAWSGAVLLLVSTLLLAWSAVRQQESTLAIRAVHQGTTMPDGFSIWHHLDAHGIPFKSITPKNDTLLITFDSSDQSAAAKAVLDRTLPHGYIIAQQDNNSQAMQWLTRLRDNSHRFG

SEQ ID NO: 7333 - DNA, 384 bp, Escherichia coli
atggaaggttcaagaatgaaataccgcatcgctttagctgtttctctctttgctcttagtgccggtagttatgccactaccctgtgtcaggaaaaggagcaaaatatccttaaggagatcagctatgccgaaaaacaccaaaaccagaatcgtattgacggtctgaataaagccctgagtgaagtccgggccaactgttcagatagccagctgcgtgccgatcatcagaagaaaatcgcaaagcagaaagatgaggtggcggaacgccagcaagatttagccgaggcgaagcaaaaaggcgatgcagataagattgccaaacgcgaacggaaactggcagaagcgcaggaagagctgaaaaagctgaaagcgcgcgactactaa

SEQ ID NO: 7334 - protein, 127 aa, Escherichia coli
MEGSRMKYRIALAVSLFALSAGSYATTLCQEKEQNILKEISYAEKHQNQNRIDGLNKALSEVRANCSDSQLRADHQKKIAKQKDEVAERQQDLAEAKQKGDADKIAKRERKLAEAQEELKKLKARDY

SEQ ID NO: 7335 - DNA, 306 bp, Escherichia coli
atgtcgaaagaacacactacggaacatctgcgtgctgagttgaaatccctttccgatacgctggaagaggtgcttagctcatctggcgagaagtcaaaagaagagttgagtaagattcgtagcaaagcggagcaggcactgaaacagagccgttatcgcctgggtgaaaccggtgatgccattgccaaacaaacccgtgtcgcggcggcgcgtgccgatgagtatgtgcgtgaaaatccgtggacgggcgtgggcattggcgcagcaatcggtgtagtgctcggcgttctgctgtcgcgtcgttaa

SEQ ID NO: 7336 - protein, 101 aa, Escherichia coli
MSKEHTTEHLRAELKSLSDTLEEVLSSSGEKSKEELSKIRSKAEQALKQSRYRLGETGDAIAKQTRVAAARADEYVRENPWTGVGIGAAIGVVLGVLLSRR

SEQ ID NO: 7337 - DNA, 405 bp, Escherichia coli
atggcggacactcatcacgcgcaagggcccggtaaaagcgttctgggcatcgggcagcgaattgtttccatcatggttgaaatggtggagacacgtctgcggctggcggtggtggagctggaagaggaaaaagcgaatctctttcaacttttactgatgctgggcctgacgatgcttttcgctgcatttggtcttatgagcctgatggtgctagttatctgggcggttgatccgcaatatcgcctgaatgcgatgattgccaccaccgtggtgttgctgctactggcactgattggcggcatctggacgttacgtaaatcgcgtaagtctacgttgctgcgccacacgcgccatgagctggcaaacgatcggcagctgctcgaggaggagtcccgtgagcagtaa

SEQ ID NO: 7338 - protein, 134 aa, Escherichia coli
MADTHHAQGPGKSVLGIGQRIVSIMVEMVETRLRLAVVELEEEKANLFQLLLMLGLTMLFAAFGLMSLMVLVIWAVDPQYRLNAMIATTVVLLLLALIGGIWTLRKSRKSTLLRHTRHELANDRQLLEEESREQ

SEQ ID NO: 7339 - DNA, 300 bp, Escherichia coli
gtgagcagtaaagtcgaacgtgaacgacgtaaggcgcaactgcttagccagatccagcaacaacggctggatctttccgccagtcgtcgtgaatggctggaggcaacaggcgcttacgatcgtcgctggaatatgctgttgagtctgcgctcctgggcgctggttggcagtagcgtgatggctatctggacgattcgccatcctaatatgctggtccgctgggccagacgcggttttggtgtatggagcgcctggcgtctggtgaaaacaaccctcaagcaacaacagcttcgcggttaa

SEQ ID NO: 7340 - protein, 99 aa, Escherichia coli
MSSKVERERRKAQLLSQIQQQRLDLSASRREWLEATGAYDRRWNMLLSLRSWALVGSSVMAIWTIRHPNMLVRWARRGFGVWSAWRLVKTTLKQQQLRG

SEQ ID NO: 7341 - DNA, 483 bp, Escherichia coli
atgattctctccatcgacagcaacgacgctaatagcgcgcccttgcacaaaaaaacaatcagcagcctgagcggcgcagtggagagtatgatgaaaaaattagaagatgttggtgtactggtagcgcgtattttaatgccgattctgtttattacggcaggctggggaaaaattactggctacgcgggtacccaacaatatatggaagcaatgggcgtccccggctttatgctgccgctggtgattctgcttgagtttggtggtggtctggcaatcctgttcggtttcctgacacgtaccacagccctgtttactgcgggctttacgctgctgacggcatttttatttcacagcaactttgcagaaggcatgaactcgctgatgtttatgaaaaacctgactatttctggcggattcctgctgctggcaattaccggtccaggcgcattcagcatcgaccgcctgctgaataaaaagtggtaa

SEQ ID NO: 7342 - protein, 160 aa, Escherichia coli
MILSIDSNDANSAPLHKKTISSLSGAVESMMKKLEDVGVLVARILMPILFITAGWGKITGYAGTQQYMEAMGVPGFMLPLVILLEFGGGLAILFGFLTRTTALFTAGFTLLTAFLFHSNFAEGMNSLMFMKNLTISGGFLLLAITGPGAFSIDRLLNKKW

SEQ ID NO: 7343 - DNA, 987 bp, Escherichia coli
atgggtcaactgattgacggcgtctggcatgacacctggtacgataccaaatccaccggcggtaaatttcaacgttcagcttccgcatttcgtaactggctcactgccgatggcgcgccaggccccactggcaaaggcggttttgccgcagagaaagatcgttatcatctctatgtttcactcgcctgcccgtgggcacaccgcacgctgatcatgcgtaagctcaaaggactggaaccgtttatttccgtttccgtagtgaacccgctgatgctggaaaacggctggacctttgatgacagttttccgggagcaaccggcgacacgctctatcaacatgaatttctgtatcagctttatctccacgccgatccacactacagcggacgagtgactgttcccgtgctgtgggacaaaaaaaaccacaccatcgtcagcaacgaatcagcagaaatcatacgcatgttcaataccgcgtttgatgcgctgggtgcgaaagctggagattactacccaccagccctgcaaccgaaaattgacgaacttaacggctggatttacgacaccgttaacaatggcgtgtataaagccggttttgccaccagccagcaagcctacgacgaggcggtggcgaaagtgtttgaatcgctggcgcgactggaacagattttaggtcagcaccgttacctgaccggcaaccagctaaccgaagccgatattcgcctgtggaccacgctggtgcgttttgatccagtgtatgtgacccacttcaagtgtgataagcaccgcatcagcgattacctgaatctgtatggcttcctgcgcgatatctaccagatgccgggaattgccgaaacagtcaatttcgatcacatccgtaatcattacttccgcagccataagaccatcaatcctacggggattatttcaattggtccgtggcaggatctcgatgaaccgcatggacgagatgttcgcttcggttaa

SEQ ID NO: 7344 - protein, 328 aa, Escherichia coli
MGQLIDGVWHDTWYDTKSTGGKFQRSASAFRNWLTADGAPGPTGKGGFAAEKDRYHLYVSLACPWAHRTLIMRKLKGLEPFISVSVVNPLMLENGWTFDDSFPGATGDTLYQHEFLYQLYLHADPHYSGRVTVPVLWDKKNHTIVSNESAEIIRMFNTAFDALGAKAGDYYPPALQPKIDELNGWIYDTVNNGVYKAGFATSQQAYDEAVAKVFESLARLEQILGQHRYLTGNQLTEADIRLWTTLVRFDPVYVTHFKCDKHRISDYLNLYGFLRDIYQMPGIAETVNFDHIRNHYFRSHKTINPTGIISIGPWQDLDEPHGRDVRFG

SEQ ID NO: 7345 - DNA, 390 bp, Escherichia coli
ttgagcaaaattgaggcaaaaatggactggtatctgaaagtactaaaaaattatgtcggtttccggggtcgtgcgcggcgcaaagagtactggatgtttattctggtcaacatcatctttacgttcgtgctggggctactggataaaatgttaggctggcaacgtgccggtggcgaaggcatcctgacgacaatctacggtattctggtgtttttaccatggtgggcagttcagttccgccgcctgcacgacaccgaccgctcggcgtggtgggcactgctattcttaatcccgttcatcggctggcttattatcatcgtctttaactgccaggcgggtacgccaggcgaaaaccgctttggaccagatccgaaactggaacaagaataa

SEQ ID NO: 7346 - protein, 129 aa, Escherichia coli
MSKIEAKMDWYLKVLKNYVGFRGRARRKEYWMFILVNIIFTFVLGLLDKMLGWQRAGGEGILTTIYGILVFLPWWAVQFRRLHDTDRSAWWALLFLIPFIGWLIIIVFNCQAGTPGENRFGPDPKLEQE

SEQ ID NO: 7347 - DNA, 897 bp, Escherichia coli
atggccaaagaaagggcattaacgctggaagcactacgggttatggatgcgatcgatcgccggggcagttttgcggcggcggcggatgagctgggacgcgtgccttccgcacttagctacaccatgcaaaaactggaagaagagctggatgtggtgctgtttgaccgctcgggccatcgcaccaaattcaccaatgtcgggaggatgttgctggaacgagggcgcgttttgctggaagccgcagataaactgactaccgatgcggaagccctcgcgcgtggttgggaaacgcatctcaccattgtgaccgaggcgctggtaccgacacctgcctttttcccgttaatcgacaaactggcggcaaaagccaatacccaactggcaatcatcaccgaagtgctggcgggggcgtgggaacggctggagcaggggcgggcggatatcgttatcgcgccggatatgcattttcgttcctcgtcggagatcaactcgcgcaaactctataccttaatgaacgcctatgttgccgcgccggatcacccgattcatcaggagccggaaccgttatctgaagtgacgcgcgtgaaatatcgtggaattgcggtggcggataccgctcgtgagcgcccggtgttgaccgtacagttgctggacaaacagccgcgcttaacggtgagcacgattgaagataaacgtcaggcattactggcggggcttggcgtggcgacgatgccgtatccgatggtcgaaaaagatattgcggaagggcggttgcgtgtcgtcagcccggaatcgaccagcgagatcgatattattatggcctggcgtcgtgacagtatgggggaggcgaaatcctggtgtctgcgggaaattcccaaactttttagcggaaaataa

SEQ ID NO: 7348 - protein, 298 aa, Escherichia coli
MAKERALTLEALRVMDAIDRRGSFAAAADELGRVPSALSYTMQKLEEELDVVLFDRSGHRTKFTNVGRMLLERGRVLLEAADKLTTDAEALARGWETHLTIVTEALVPTPAFFPLIDKLAAKANTQLAIITEVLAGAWERLEQGRADIVIAPDMHFRSSSEINSRKLYTLMNAYVAAPDHPIHQEPEPLSEVTRVKYRGIAVADTARERPVLTVQLLDKQPRLTVSTIEDKRQALLAGLGVATMPYPMVEKDIAEGRLRVVSPESTSEIDIIMAWRRDSMGEAKSWCLREIPKLFSGK

SEQ ID NO: 7349 - DNA, 702 bp, Escherichia coli
atgattactacccgaactgccaggcagtgtggacaagcagactacggatggttgcaggcccggtatactttttcctttggacactacttcgacccgaaattgttaggctatgcctccctgcgcgtgcttaaccaggaagtgctggccccaggtgccgcctttcagccgcgaacctatcccaaagtcgatattttaaatgtgattctggatggagaagctgagtatcgcgacagcgaaggcaatcatgttcaggccagcgctggtgaggcgttgctgctctctacccagccgggtgtcagctatagcgaacacaatctcagcaaagacaaatcgttaacgcgaatgcaactttggctggatgcctgcccacaacgagagaatccgctgattcaaaaactagcgcttaatatggacaagcagcaattaatcgcctcgccagaaggtgggatgggaagcctgcaattgcgccagcaagtatggctgcatcatattgtgctcgacaaaggcgaaagtgcgaatttccagttgcatgggccacgcgcgtatttgcaatcgattcacgggcaatttcatgcacttacgcatcatgaagagaaagcggcgctgacctgcggtgatggggcgtttattcgtgacgaggctaacattacgctggttgccgattccccactgcgcgctttgctgatagatttgcctgtctag

SEQ ID NO: 7350 - protein, 233 aa, Escherichia coli
MITTRTARQCGQADYGWLQARYTFSFGHYFDPKLLGYASLRVLNQEVLAPGAAFQPRTYPKVDILNVILDGEAEYRDSEGNHVQASAGEALLLSTQPGVSYSEHNLSKDKSLTRMQLWLDACPQRENPLIQKLALNMDKQQLIASPEGGMGSLQLRQQVWLHHIVLDKGESANFQLHGPRAYLQSIHGQFHALTHHEEKAALTCGDGAFIRDEANITLVADSPLRALLIDLPV

SEQ ID NO: 7351 - DNA, 165 bp, Escherichia coli
atgagtaaaaaatcggccaaaaagcgtcagccagtgaagcccgtggtggcgaaagaacctgctcgcaccgccaaaaattttggctatgaagagatgttgagcgagctggaagccatcgtcgcggatgctgaaacgcgtttagccgaggatgaagctaccgcgtaa

SEQ ID NO: 7352 - protein, 54 aa, Escherichia coli
MSKKSAKKRQPVKPVVAKEPARTAKNFGYEEMLSELEAIVADAETRLAEDEATA

SEQ ID NO: 7353 - DNA, 1311 bp, Escherichia coli
atgtttgattcgactttaaatccgttatggcagcgttacatcctcgccgttcaggaggaagtaaaaccggcgctggggtgtactgaaccgatttcactggcgctggcggcggcggttgctgcggctgaactggaaggtccggttgaacgtgtagaagcctgggtttcgccaaatctgatgaagaacggtctgggtgtcaccgttcctggtacaggaatggtggggctgccaattgcggcggcgctgggagcgttaggtggaaatgctaacgccgggctggaagtgctgaaagacgcaactgcgcaggcaatttccgatgccaaagcactgctggcggcggggaaagtctcagttaagatccaggaaccttgcgatgaaatcctcttctcacgcgccaaagtctggaacggtgagaagtgggcgtgtgtcaccatcgtcggcgggcataccaacattgtgcatattgagacgcacaatggtgtggtgtttacccagcaggcgtgtgtgacagagggcgagcaagagtcgccgctgacggtgctttccaggacgacgctggctgagatcctgaagttcgtcaatgaagtcccgtttgcggcgatccgctttattctcgattctgcgaagttaaattgtgcgttatcgcaggaaggtttgagcggtaactgggggctgcatattggtgcgacgctggaaaaacagtgcgcgcgcggtttgctggcgaaagatctctcttcatccattgtgattcgtaccagcgcggcatccgatgcgcgtatgggcggcgctacgcttccggcaatgagtaactccggctcgggtaaccaggggatcaccgcaacaatgcccgtggtggtggtagcagaacacttcggagcggatgatgaacggctggcgcgtgcgctgatgctttcgcatttgagcgcgatttacatccataaccagttaccgcgtttgtctgcgctgtgtgccgcaacgaccgcagcaatgggggccgctgccgggatggcatggctggtggatgggcgttatgaaaccatctcgatggcgatcagcagtatgatcggcgatgtcagtggcatgatttgcgatggtgcatcgaacagctgcgcgatgaaggtttcgaccagtgcttcggctgcgtggaaagcggtgttaatggcgctggatgataccgccgtgaccggcaatgaagggattgtggcgcatgatgttgagcagtcgattgccaacctgtgtgcgttagcaagccattcgatgcagcaaacggatcggcagattatcgagattatggcgagcaaggccagataa

SEQ ID NO: 7354 - protein, 436 aa, Escherichia coli
MFDSTLNPLWQRYILAVQEEVKPALGCTEPISLALAAAVAAAELEGPVERVEAWVSPNLMKNGLGVTVPGTGMVGLPIAAALGALGGNANAGLEVLKDATAQAISDAKALLAAGKVSVKIQEPCDEILFSRAKVWNGEKWACVTIVGGHTNIVHIETHNGVVFTQQACVTEGEQESPLTVLSRTTLAEILKFVNEVPFAAIRFILDSAKLNCALSQEGLSGNWGLHIGATLEKQCARGLLAKDLSSSIVIRTSAASDARMGGATLPAMSNSGSGNQGITATMPVVVVAEHFGADDERLARALMLSHLSAIYIHNQLPRLSALCAATTAAMGAAAGMAWLVDGRYETISMAISSMIGDVSGMICDGASNSCAMKVSTSASAAWKAVLMALDDTAVTGNEGIVAHDVEQSIANLCALASHSMQQTDRQIIEIMASKAR

SEQ ID NO: 7355 - DNA, 1332 bp, Escherichia coli
atggaaattgcatcgaataaaggcgtcattgcagacgcttcgaccccggcgggtcgtgctggaatgagtgagagcgagtggcgagaagcgatcaaattcgacagtactgacaccggctgggtgattatgagtatcgggatggcgattggcgcggggattgtttttctcccggtgcaggtcggtttgatgggattatgggtatttttgctctcatcggtgattggttacccggcaatgtatctgtttcagcggttgtttattaatacgctggcagaatcaccggagtgtaaagattacccgagcgtcatcagcggttatttaggtaaaaactggggcatcctgttaggtgcactctatttcgtaatgctggtgatttggatgttcgtctattccaccgccatcaccaacgatagtgcttcctacctgcataccttcggcgtgacggaagggttgctgtcagacagtcccttttatggtctggtactgatttgcattctggtggcgatctcctcacgcggcgagaaattgttattcaaaatttcgaccggcatggtgctgaccaagctgctggtggtcgcggcgctgggcgtgtcgatggtgggaatgtggcatctgtataacgtcggttcgctaccgccgctggggctgctggtgaaaaacgccattattacgctgccgtttaccctgacgtcgattctgtttatccagacgttaagcccgatggtgatctcttatcgttcgcgggaaaaatcaattgaagtggcgcggcataaagcattgcgggcaatgaatatcgcgtttggtattttgtttgtcaccgtctttttctacgccgtgtcgttcacgctggcgatgggacatgacgaagcggtaaaagcctacgagcagaatatttccgcgctggcgattgccgcacagtttattagcggtgatggcgcagcgtgggtgaaagtggtcagcgtcattctcaatatctttgctgtaatgactgcattctttggcgtctatttaggctttcgcgaagcaacgcaagggatcgtaatgaacatcctgcgtcgcaagatacctgccgagaagattaacgaaaatctcgttcagcgcggcatcatgattttcgccattttgctggcctggagcgccatcgtactgaacgccccggtgttgagcttcacctctatctgtagcccgattttcggcatggtagggtgcctgatcccggcgtggctggtttacaaagtaccggcattgcacaaatacaaagggatgtctctgtacctgattatcgtcactggtttgttgctttgtgtttctccgttcctggcattttcttga

SEQ ID NO: 7356 - protein, 443 aa, Escherichia coli
MEIASNKGVIADASTPAGRAGMSESEWREAIKFDSTDTGWVIMSIGMAIGAGIVFLPVQVGLMGLWVFLLSSVIGYPAMYLFQRLFINTLAESPECKDYPSVISGYLGKNWGILLGALYFVMLVIWMFVYSTAITNDSASYLHTFGVTEGLLSDSPFYGLVLICILVAISSRGEKLLFKISTGMVLTKLLVVAALGVSMVGMWHLYNVGSLPPLGLLVKNAIITLPFTLTSILFIQTLSPMVISYRSREKSIEVARHKALRAMNIAFGILFVTVFFYAVSFTLAMGHDEAVKAYEQNISALAIAAQFISGDGAAWVKVVSVILNIFAVMTAFFGVYLGFREATQGIVMNILRRKIPAEKINENLVQRGIMIFAILLAWSAIVLNAPVLSFTSICSPIFGMVGCLIPAWLVYKVPALHKYKGMSLYLIIVTGLLLCVSPFLAFS

SEQ ID NO: 7357 - DNA, 1365 bp, Escherichia coli
atgattagtgcattcgatattttcaaaattgggattggtccctccagttcgcatactgtggggccaatgaatgccggaaaaagttttattgatcggctggaaagtagcggcttattaaccgcgacgagccatattgtggtcgatctgtacgggtcgttgtcactgacgggcaaaggccatgccacggatgtcgccatcatcatgggactggcaggaaacagtccgcaggatgttgtcattgatgagatccctgcatttatagagttagtgacgcgcagcgggcggttgccggtggcttctggcgcgcatattgttgattttcctgtagcaaagaacattatcttccatcccgaaatgttgcctcgccatgagaacggaatgcggatcactgcctggaagggacaggaagaactattaagcaaaacctattactctgtcggcggcgggtttattgtcgaagaagaacacttcggcctgtcgcacgatgtcgaaacacccgtaccttacgatttccactcagcaggtgaactgctgaaaatgtgtgattacaacggcctgtctatatctggcctgatgatgcacaacgagctggcgctgcgcagtaaagcggaaattgacgcagggtttgcccgtatctggcaagtgatgcatgacggtattgaacgtggaatgaatactgaaggcgtgctgcctggtccgctcaatgtgccgcgccgtgccgtagcgctgcgtcgtcaactggtttccagcgataacatctctaacgatccgatgaatgtcatcgactggatcaacatgtacgcgctggcggttagtgaagaaaacgcagctggcgggcgcgtggtaacggcaccgactaacggtgcgtgcggcattattccggcagtgctggcttattacgataagttccgtcgtccggtaaatgagcggtcaattgcccgctattttctggcagcgggggcaattggcgcgctgtataaaatgaacgcctccatctctggcgcggaagtcggctgtcagggggagattggcgtggcctgttcaatggcggcggcagggttaactgaactactgggcggcagtccggcgcaggtatgcaatgcggcggaaatcgcgatggagcataaccttgggctgacctgcgatccggttgccggacaggtacaaatcccgtgcattgaacgtaatgccattaatgccgtgaaagcagtaaacgccgcgcggatggcgatgcgccgcacctcggcaccgcgtgtttcactcgataaagtgatcgagacgatgtatgaaaccggcaaagatatgaacgataaataccgcgaaacatcacgcggaggactggctattaaagtggtctgcggctga

SEQ ID NO: 7358 - protein, 454 aa, Escherichia coli
MISAFDIFKIGIGPSSSHTVGPMNAGKSFIDRLESSGLLTATSHIVVDLYGSLSLTGKGHATDVAIIMGLAGNSPQDVVIDEIPAFIELVTRSGRLPVASGAHIVDFPVAKNIIFHPEMLPRHENGMRITAWKGQEELLSKTYYSVGGGFIVEEEHFGLSHDVETPVPYDFHSAGELLKMCDYNGLSISGLMMHNELALRSKAEIDAGFARIWQVMHDGIERGMNTEGVLPGPLNVPRRAVALRRQLVSSDNISNDPMNVIDWINMYALAVSEENAAGGRVVTAPTNGACGIIPAVLAYYDKFRRPVNERSIARYFLAAGAIGALYKMNASISGAEVGCQGEIGVACSMAAAGLTELLGGSPAQVCNAAEIAMEHNLGLTCDPVAGQVQIPCIERNAINAVKAVNAARMAMRRTSAPRVSLDKVIETMYETGKDMNDKYRETSRGGLAIKVVCG

SEQ ID NO: 7359 - DNA, 390 bp, Escherichia coli
atgaaaaagattatcgaaacgcaacgtgccccaggcgcaatcggcccttatgttcagggcgttgatttaggcagcatggtcttcacctccgggcaaattccggtttgcccacagaccggtgagatcccggctgatgtgcaagatcaggcgcgtttaagcctcgaaaacgtcaaagcgatcgtggttgctgccgggctgagtgtgggcgatatcatcaagatgaccgtgttcatcaccgatctgaatgattttgccaccatcaatgaagtctataagcagttcttcgatgaacatcaggcgacctacccgacccggagctgtgtgcaggtcgcgcgtttgccgaaagatgtgaagttggaaattgaagccatcgcagtacgtagtgcgtaa

SEQ ID NO: 7360 - protein, 129 aa, Escherichia coli
MKKIIETQRAPGAIGPYVQGVDLGSMVFTSGQIPVCPQTGEIPADVQDQARLSLENVKAIVVAAGLSVGDIIKMTVFITDLNDFATINEVYKQFFDEHQATYPTRSCVQVARLPKDVKLEIEAIAVRSA

SEQ ID NO: 7361 - DNA, 2295 bp, Escherichia coli
atgaaggtagatattgataccagcgataagctgtacgccgacgcatggcttggctttaaaggtacggactggaaaaacgaaattaatgtccgcgattttattcaacataactatacaccttatgaaggcgatgaatcttttctcgccgaagcgacgcctgccaccacggaattgtgggaaaaagtcatggaaggcatccgtatcgaaaatgcgactcacgcgccattggatttcgataccaatattgccaccacaattaccgctcatgatgcaggatatattgaccagccgctggaaaaaatagtgggtctgcaaacggatgcgccattaaagcgtgcgctgcatccgttcggcggcattaatatgattagaagttcattccacgcgtatggtcgtgaaatggatagcgaatttgaatacatctttaccgatctgcgtaaaacccataaccagggcgtatttgatgtttactcaccggatatgctgcgctgccgtaaatctggtgtactgaccggtttaccagatggttatggtcgtgggcgtatcatcggtgactatcgccgtgtggcactgtacggcatcagttatctggtacgtgaacgcgaactgcagtttgccgatctccagtcccgtctggaaaaaggcgaagatcttgaagccaccattcgtctgcgtgaggaactggcagaacatcgccgtgcgctgttacagattcaggaaatggcggcgaaatatggctttgatatctcccgtccggcgcagaatgcacaagaagccgtgcagtggctctacttcgcttacctggcggcagtgaaatcgcaaaacggcggcgcgatgtcgctggggcgcacggcatcgttcctcgatatctacattgagcgcgactttaaagcaggcgtactcaatgagcagcaggcacaggaactgatcgaccacttcatcatgaagatccgtatggtgcgcttcttgcgtacgccggaatttgattcgctgttctccggcgacccgatctgggcgacggaagtgatcggcgggatggggctggacggtcgaaccctggtgaccaaaaactccttccgctatttgcacaccctgcacactatggggcctgcaccggaacctaacctgactattctgtggtcggaagccttgccgattgccttcaaaaaatatgccgcgcaggtgtctatcgtcacatcctctttgcagtatgaaaacgacgatctgatgcgtactgacttcaatagcgacgattacgcgattgcctgttgcgtcagcccaatggtgattggtaagcaaatgcagttctttggagcacgcgctaacctggcgaaaacgctactgtacgcaatcaacggcggaatggacgagaagctgaagattcaggttggcccgaaaacggctccgttgatggatgacgtgctggactacgacaaagtgatggatagcctcgaccacttcatggactggctggcggtacagtacatcagcgcgctgaatatcattcactacatgcacgacaagtacagctacgaagcttcgctgatggcgctacatgatcgtgatgtctatcgcaccatggcgtgcggcatcgcgggcctgtcggtggcaacggactccctgtctgccatcaaatatgctcgtgtgaaaccaatccgtgatgaaaacggcctggcggtggatttcgagattgacggcgaatatccgcagtatggcaacaacgacgagcgcgtagacagcattgcctgcgatctggttgaacgctttatgaagaaaattaaagctttgccaacctatcgcaatgctgtgccgacccaatcgattctgactatcacctctaacgtggtgtacggtcagaaaaccgggaacacgccggacggtcgccgcgccggaacaccgttcgcgccgggcgctaacccgatgcacggtcgtgatcgcaaaggcgccgtagcctcattgacgtcggtggcgaaactgccattcacctacgccaaagatgggatctcgtacaccttctccatcgtccctgcggcgctgggcaaagaagatccgatacgtaaaacgaaccttgtcggcctgctggatgggtatttccaccacgaagcggatgtcgaaggcggtcaacacctcaacgtcaacgtaatgaatcgggaaatgctgctggatgccatcgagcacccggaaaaatatcctaacctgacaatccgtgtctctggctacgccgtgcgctttaacgcactgacccgtgaacagcaacaggatgttatttcacgtacctttacccaggcgctctga

SEQ ID NO: 7362 - protein, 764 aa, Escherichia coli
MKVDIDTSDKLYADAWLGFKGTDWKNEINVRDFIQHNYTPYEGDESFLAEATPATTELWEKVMEGIRIENATHAPLDFDTNIATTITAHDAGYIDQPLEKIVGLQTDAPLKRALHPFGGINMIRSSFHAYGREMDSEFEYIFTDLRKTHNQGVFDVYSPDMLRCRKSGVLTGLPDGYGRGRIIGDYRRVALYGISYLVRERELQFADLQSRLEKGEDLEATIRLREELAEHRRALLQIQEMAAKYGFDISRPAQNAQEAVQWLYFAYLAAVKSQNGGAMSLGRTASFLDIYIERDFKAGVLNEQQAQELIDHFIMKIRMVRFLRTPEFDSLFSGDPIWATEVIGGMGLDGRTLVTKNSFRYLHTLHTMGPAPEPNLTILWSEALPIAFKKYAAQVSIVTSSLQYENDDLMRTDFNSDDYAIACCVSPMVIGKQMQFFGARANLAKTLLYAINGGMDEKLKIQVGPKTAPLMDDVLDYDKVMDSLDHFMDWLAVQYISALNIIHYMHDKYSYEASLMALHDRDVYRTMACGIAGLSVATDSLSAIKYARVKPIRDENGLAVDFEIDGEYPQYGNNDERVDSIACDLVERFMKKIKALPTYRNAVPTQSILTITSNVVYGQKTGNTPDGRRAGTPFAPGANPMHGRDRKGAVASLTSVAKLPFTYAKDGISYTFSIVPAALGKEDPIRKTNLVGLLDGYFHHEADVEGGQHLNVNVMNREMLLDAIEHPEKYPNLTIRVSGYAVRFNALTREQQQDVISRTFTQAL

SEQ ID NO: 7363 - DNA, 1209 bp, Escherichia coli
atgaatgaatttccggttgttttggttattaactgtggttcgtcttcgattaagttttccgtactcaatgccagcgactgtgaagtattaatgtcaggtattgccgacggtattaactcggaaaatgcattcttatccgtaaatgggggagagccagcaccgctggctcaccacagctacgaaggtgcattgaaggcaattgcatttgaactggaaaaacggaatttaaatgacaatgtggccttaattggccaccgcatcgctcacggcggcagtatttttaccgagtccgccattattaccgatgaagtcattgataatatccgtcgcgtttctccactggcacccctgcataattacgccaatttaagtggtattgaatcggcgcagcaattattcccgggcgtaactcaggtggcggtatttgataccagtttccaccagacgatggctccggaagcttatttatacggcctgccgtggaaatattatgaagagttaggtgtacgccgttatggtttccacggcacgtcgcaccgctatgtttcccagcgcgcgcattctctgctgaatctggcggaagatgactccggcctggttgtggcgcatcttggcaatggcgcgtcaatctgcgcggttcgcaacggtcagagtgttgacacttccatgggaatgacgccgctggaaggcttgatgatgggtacccgcagtggtgatgtcgacttcggggcgatgtcctgggtcgccagccaaaccaaccagagcctgggggacctggaacgcgtagtgaataaagagtcgggattattaggtatttccggcctttcttcggatttacgtgttctggaaaaagcctggcatgaaggtcacgaacgcgcgcaactggcaattaaaacctttgttcaccgaattgcccgtcatattgccggacacgctgcttcattacatcgcctggatggaattatattcaccggcggaataggagagaattcaagtttaattcgtcgtctggtcatggaacatttagctgtattaggcgtagagattgatacagaaatgaataatcgctctaactcttttggagagcgaattgtttccagtgaaaatgcgcgtgtcatttgcgccgtaattccgactaatgaagaaaaaatgattgctttggatgccattcatttaggcaaagtgaacgcgcccgcagaatttgcataa

SEQ ID NO: 7364 - protein, 402 aa, Escherichia coli
MNEFPVVLVINCGSSSIKFSVLNASDCEVLMSGIADGINSENAFLSVNGGEPAPLAHHSYEGALKAIAFELEKRNLNDNVALIGHRIAHGGSIFTESAIITDEVIDNIRRVSPLAPLHNYANLSGIESAQQLFPGVTQVAVFDTSFHQTMAPEAYLYGLPWKYYEELGVRRYGFHGTSHRYVSQRAHSLLNLAEDDSGLVVAHLGNGASICAVRNGQSVDTSMGMTPLEGLMMGTRSGDVDFGAMSWVASQTNQSLGDLERVVNKESGLLGISGLSSDLRVLEKAWHEGHERAQLAIKTFVHRIARHIAGHAASLHRLDGIIFTGGIGENSSLIRRLVMEHLAVLGVEIDTEMNNRSNSFGERIVSSENARVICAVIPTNEEKMIALDAIHLGKVNAPAEFA

SEQ ID NO: 7365 - DNA, 1332 bp, Escherichia coli
atgagtacttcagatagcattgtatccagccagacaaaacaatcgtcctggcgtaaatcagataccacatggacgttaggcttgtttggtacggcaatcggcgccggggtgctgttcttccctatccgcgcaggttttggcggactgatcccgattcttctgatgttggtattagcataccccatcgcgttttattgccaccgggcactggcgcgtctgtgtctttctggctctaacccttccggcaacattacggaaacggtggaagagcattttggtaaaactggcggcgtggttatcacgttcctgtacttcttcgcgatttgcccactgttgtggatttatggcgttaccattaccaatacctttatgacgttctgggaaaaccagctcggctttgcaccgctgaatcgcggctttgtggcgctgttcctgttgctgctgatggctttcgtcatctggtttggtaaggatctgatggttaaagtgatgagctatctggtatggccgtttatcgccagcctggtgctgatttctctttcgctgatcccttactggaactctgcagttatcgaccaggttgacctcggttcgctgtcgttaactggtcatgacggtatcctgatcaccgtctggctggggatttccatcatggttttctcctttaacttctcgccaatcgtctcttccttcgttgtttctaaacgtgaagagtacgagaaagattttggtcgcgacttcaccgagcgtaaatgttcacaaatcatctctcgcgccagtatgctgatggttgcagtggtgatgttctttgcctttagctgcctgtttacgctgtctccggcgaatatggctgaagcgaaagcgcagaatattccagtgctttcttatctggctaaccactttgcgtccatgaccggtaccaaaacaacgtttgcgattacactggaatatgccgcttccatcatcgcactcgtggctattttcaaatctttcttcggtcactatctggggacgctggaagggctgaatggtttgattctgaagttcggttataaaggtgacaaaaccaaagtgtcgctgggtaaactgaatactatcagcatgattttcattatgggctccacctgggttgttgcctacgccaacccgaacatcctcgacctgattgaagccatgggcgcaccgattatcgcatcactgctgtgcctgttgccgatgtatgccatccgtaaagcgccgtctctggcgaaataccgtggtcgtctggataacgtgtttgttaccgtgattggtctgctgaccatcctgaacatcgtatacaaactgttttaa

SEQ ID NO: 7366 - protein, 443 aa, Escherichia coli
MSTSDSIVSSQTKQSSWRKSDTTWTLGLFGTAIGAGVLFFPIRAGFGGLIPILLMLVLAYPIAFYCHRALARLCLSGSNPSGNITETVEEHFGKTGGVVITFLYFFAICPLLWIYGVTITNTFMTFWENQLGFAPLNRGFVALFLLLLMAFVIWFGKDLMVKVMSYLVWPFIASLVLISLSLIPYWNSAVIDQVDLGSLSLTGHDGILITVWLGISIMVFSFNFSPIVSSFVVSKREEYEKDFGRDFTERKCSQIISRASMLMVAVVMFFAFSCLFTLSPANMAEAKAQNIPVLSYLANHFASMTGTKTTFAITLEYAASIIALVAIFKSFFGHYLGTLEGLNGLILKFGYKGDKTKVSLGKLNTISMIFIMGSTWVVAYANPNILDLIEAMGAPIIASLLCLLPMYAIRKAPSLAKYRGRLDNVFVTVIGLLTILNIVYKLF

SEQ ID NO: 7367 - DNA, 990 bp, Escherichia coli
atgcatattacatacgatctcccggttgctattgatgacatcattgaagcaaaacaacgactggctgggcgaatttataaaacaggtatgcctcgctccaactattttagtgaacgttgcaaaggtgaaatattcctcaaattcgaaaacatgcagcgtaccggttcatttaaaattcgtggcgcatttaataaattaagttcactgactgatgcggaaaaacgtaaaggtgtagtggcctgctctgcgggcaaccatgcgcaaggggtttcgctctcctgcgcgatgctgggtattgacggtaaagtggtgatgccaaaaggtgcgccgaaatccaaagtcgcggcaacgtgcgactactccgcagaagtcgttttgcatggtgataacttcaacgacactattgctaaagtgagcgaaattgtcgaaatggaaggccgtatttttatcccaccttacgatgatccgaaagtgattgctggccagggaacgattggtctggaaattatggaagatctctatgatgtcgataacgtgattgtgccaattggcggcggcggtttaattgctggtattgcggtggcaattaaatctatcaacccgaccatccgtgttattggcgtacagtctgaaaacgttcacggcatggcggcttctttccactccggagaaataactacgcaccgaactaccggcaccctggcggatggttgtgatgtctcccgcccgggtaatttaacttacgaaatcgttcgtgaattagtcgatgacatcgtgctggtcagcgaagacgaaatcagaaacagtatgattgccttaattcagcgcaataaagtcgtcaccgaaggcgcaggcgctctggcatgtgctgcattattaagcggtaaattagaccaatatattcaaaacagaaaaaccgtcagtattatttccggcggcaatatcgatctttctcgcgtctctcaaatcaccggtttcgttgacgcttaa

SEQ ID NO: 7368 - protein, 329 aa, Escherichia coli
MHITYDLPVAIDDIIEAKQRLAGRIYKTGMPRSNYFSERCKGEIFLKFENMQRTGSFKIRGAFNKLSSLTDAEKRKGVVACSAGNHAQGVSLSCAMLGIDGKVVMPKGAPKSKVAATCDYSAEVVLHGDNFNDTIAKVSEIVEMEGRIFIPPYDDPKVIAGQGTIGLEIMEDLYDVDNVIVPIGGGGLIAGIAVAIKSINPTIRVIGVQSENVHGMAASFHSGEITTHRTTGTLADGCDVSRPGNLTYEIVRELVDDIVLVSEDEIRNSMIALIQRNKVVTEGAGALACAALLSGKLDQYIQNRKTVSIISGGNIDLSRVSQITGFVDA

SEQ ID NO: 7369 - DNA, 939 bp, Escherichia coli
atgagcactattcttcttccgaaaacgcagcacctggtagtctttcaggaagttattagaagtggttctatcggctcggctgcaaaagagttagggttaactcaaccggccgtcagtaaaatcattaacgatattgaagattattttggtgtggagttagtggtgcggaaaaataccggtgtaacattaacacctgccggtcaattgttactctcccgttccgaatccattacccgtgaaatgaaaaatatggttaatgagataagcggtatgtcttctgaggcggtggtggaagtctcatttggttttccttcattgattggttttacttttatgtcagggatgatcaacaagttcaaagaggtgttcccgaaagcgcaggtttctatgtatgaagcgcaactgtcttcgttcttaccggcaatccgcgacggccgactggattttgcgattggtacgttaagcgcagaaatgaagcttcaggatttacatgttgagccgctgttcgagtccgagtttgtgctggtagccagtaagtcccgaacatgcaccggcaccaccacgctggagtcgttgaagaacgaacagtgggtgttgccacaaaccaatatggggtactacagcgaactacttactacgttacaaagaaatggcatcagtattgaaaacatcgttaaaaccgactcagtcgtgacaatttataatcttgttctcaatgctgatttcttaactgtaattccttgtgatatgacatcaccttttggttctaatcaatttattactattccggttgaagaaacattacctgtggcacaatatgccgcggtatggtcgaaaaattatcgtattaaaaaagcagcatcggttttggtggaattagccaaagagtattcatcttataatgggtgtagacgaaggcaattaattgaagttgattag

SEQ ID NO: 7370 - protein, 312 aa, Escherichia coli
MSTILLPKTQHLVVFQEVIRSGSIGSAAKELGLTQPAVSKIINDIEDYFGVELVVRKNTGVTLTPAGQLLLSRSESITREMKNMVNEISGMSSEAVVEVSFGFPSLIGFTFMSGMINKFKEVFPKAQVSMYEAQLSSFLPAIRDGRLDFAIGTLSAEMKLQDLHVEPLFESEFVLVASKSRTCTGTTTLESLKNEQWVLPQTNMGYYSELLTTLQRNGISIENIVKTDSVVTIYNLVLNADFLTVIPCDMTSPFGSNQFITIPVEETLPVAQYAAVWSKNYRIKKAASVLVELAKEYSSYNGCRRRQLIEVD

SEQ ID NO: 7371 - DNA, 1227 bp, Escherichia coli
atggcgtattgcaatccgggcctggaatccaggccgaataagagaaacgccctccggcgtcatgtggtaacaggcataggtatgaaaatcgtaatcgccccagactcttataaagaaagtttatctgccagcgaggttgcgcaggcgatagaaaaaggatttcgggaaatttttcctgatgcacagtatgtttctgttccggttgccgacggtggtgaaggaacggtggaagcgatgattgcagccacccagggggctgaacgtcacgcctgggttacagggccgctgggcgagaaagtgaatgccagttgggggatctccggcgatggcaaaaccgcgtttatcgaaatggcggcggccagtgggctggaactggtacctgcggaaaaacgcgatccactcgtgaccacttcacgcggtactggtgagttaatcctgcaggcgctggagagcggtgcgacaaacattattatcggcattggcggcagcgccaccaacgacggcggcgcaggcatggtacaggcgctgggggcgaaattatgcgatgccaacggcaatgaaattggttttggcggcggtagtcttaatactctgaatgatattgatatttccggtctcgatccgcgcttaaaagattgtgtcatccgcgtcgcttgtgatgtcaccaacccgttagtcggcgacagtggtgcttcgcgcatctttggcccacaaaagggagccagtgaggcgatgattgtcgagctggataataacctctctcactatgccgatgtcattaaaaaagcgctgcatgttgatgtgaaagatgtccccggcgcaggagctgcgggcggtatgggcgcggcgctgatggcgtttcttggtgcagaactgaaaagtggtattgaaatcgtcactacggcgctgaatctggaggaacatattcacgattgtacgctggtgatcactggtgaagggcgtattgatagccagagtattcacggcaaggtaccgattggtgtcgcaaacgtggcgaagaagtaccataaaccggtgattggcattgcgggtagcctgaccaatgatgttggcgttgtacatcagcatggcattgatgcggtcttcagcgtactgaccagcattggtacgttagacgaagcattccgcggagcttatgacaatatctgccgtgcttcacgtaatatcgccgcgacactggcgattggaatgcgcaacgcggggtga

SEQ ID NO: 7372 - protein, 408 aa, Escherichia coli
MAYCNPGLESRPNKRNALRRHVVTGIGMKIVIAPDSYKESLSASEVAQAIEKGFREIFPDAQYVSVPVADGGEGTVEAMIAATQGAERHAWVTGPLGEKVNASWGISGDGKTAFIEMAAASGLELVPAEKRDPLVTTSRGTGELILQALESGATNIIIGIGGSATNDGGAGMVQALGAKLCDANGNEIGFGGGSLNTLNDIDISGLDPRLKDCVIRVACDVTNPLVGDSGASRIFGPQKGASEAMIVELDNNLSHYADVIKKALHVDVKDVPGAGAAGGMGAALMAFLGAELKSGIEIVTTALNLEEHIHDCTLVITGEGRIDSQSIHGKVPIGVANVAKKYHKPVIGIAGSLTNDVGVVHQHGIDAVFSVLTSIGTLDEAFRGAYDNICRASRNIAATLAIGMRNAG

SEQ ID NO: 7373 - DNA, 891 bp, Escherichia coli
atgactatgaaagttggttttattggccttgggattatgggtaaaccaatgagtaaaaaccttttgaaagcaggttactcgctggtggttgctgaccgtaacccagaagctatcgctgacgtgattgctgccggtgcagaaacagcctctacggctaaagcgatcgctgaacagtgcgacgtcatcatcaccatgctgccaaactcccctcatgtgaaagaggtggcgctgggtgagaatggcattattgaaggcgcgaagccaggtacggtattgatcgatatgagttcgatcgcaccgctggcaagccgtgaaatcagcgaagcgctgaaagcgaaaggcattgatatgctggacgccccggtgagcggcggtgaaccgaaagccatcgacggtacgctgtcagtgatggtgggcggcgacaaggctattttcgacaaatactatgatttgatgaaagcgatggcgggttccgtggtgcataccggggaaatcggtgcaggtaacgtcaccaaactggcaaatcaggtcattgtggcgctgaatattgctgcgatgtcagaagcgttaacgctggcaaccaaagcgggcgttaacccggatctggtgtatcaggcaattcgcggtgggctggcgggcagtaccgtgctggatgccaaagcgccgatggtgatggaccgcaacttcaaaccgggcttccgtattgatctgcatattaaggatctggcgaatgcgctggatacttctcacggcgtcggcgcgcaactgccgctcacagctgcggttatggagatgatgcaggcactgcgtgcagatggtttaggaatggcggatcatagcgccctggcgtgctactacgaaaaactggcgaaagtcgaagttactcgctaa

SEQ ID NO: 7374 - protein, 296 aa, Escherichia coli
MTMKVGFIGLGIMGKPMSKNLLKAGYSLVVADRNPEAIADVIAAGAETASTAKAIAEQCDVIITMLPNSPHVKEVALGENGIIEGAKPGTVLIDMSSIAPLASREISEALKAKGIDMLDAPVSGGEPKAIDGTLSVMVGGDKAIFDKYYDLMKAMAGSVVHTGEIGAGNVTKLANQVIVALNIAAMSEALTLATKAGVNPDLVYQAIRGGLAGSTVLDAKAPMVMDRNFKPGFRIDLHIKDLANALDTSHGVGAQLPLTAAVMEMMQALRADGLGMADHSALACYYEKLAKVEVTR

SEQ ID NO: 7375 - DNA, 771 bp, Escherichia coli
atgaataacgatgttttcccgaataaattcaaagccgcactggctgcgaaacaggtacaaattggttgctggtcagctctctctaacccgattagcactgaagttcttggtttggctgggtttgactggctggtgctggatggtgaacatgcgccaaacgatatctccacgtttattccgcagttaatggccctgaaaggcagcgccagcgcgccagtagtgcgagtgccgaccaacgagccggtaattattaagcgtcttctggatatcggtttctataacttcctgattccttttgtagaaacaaaagaggaagcagagcaggcggtggcatcaactcgttacccaccggaaggcattcgcggcgtctccgtttctcaccgcgccaatatgtttggcaccgtggcggattatttcgctcagtcgaacaagaacatcactattctggtccagatagaaagtcagcagggcgtagataacgtcgatgctattgccgctaccgaaggtgtagacggcatcttcgtcggccccagcgatctggctgcggcattaggccatctcggcaatgcctcgcatccggatgtacaaaaagcaattcagcacatttttaaccgtgccagcgcgcacggcaaacccagcggcatcctcgcaccagtcgaggctgatgcgcgtcgttatctggaatggggcgcgacgtttgtggccgtcggcagcgatctcggcgtcttccgctctgccactcagaaactggctgatacctttaaaaaataa

SEQ ID NO: 7376 - protein, 256 aa, Escherichia coli
MNNDVFPNKFKAALAAKQVQIGCWSALSNPISTEVLGLAGFDWLVLDGEHAPNDISTFIPQLMALKGSASAPVVRVPTNEPVIIKRLLDIGFYNFLIPFVETKEEAEQAVASTRYPPEGIRGVSVSHRANMFGTVADYFAQSNKNITILVQIESQQGVDNVDAIAATEGVDGIFVGPSDLAAALGHLGNASHPDVQKAIQHIFNRASAHGKPSGILAPVEADARRYLEWGATFVAVGSDLGVFRSATQKLADTFKK

SEQ ID NO: 7377 - DNA, 1335 bp, Escherichia coli
atgatgctggacaccgttgacgaaaaaaagaaaggcgtgcatacccgctatttaatattactgattatttttattgttaccgccgttaactacgccgatcgtgcaacactgtctattgctggtaccgaagtggcaaaagagttgcagttaagtgcggtttcgatgggttacatcttctctgcttttggctgggcctacttgctgatgcaaattcccggcggctggctgcttgataagtttggctcgaagaaagtttacacttacagcctctttttctggtcgctgttcaccttcctgcaaggctttgtcgatatgtttccgctggcctgggctgggatctccatgttctttatgcgatttatgctggggttctcggaagcgccatcattcccggcgaacgcccgtattgtcgccgcctggttcccgacgaaagaacgtggtactgcctccgccatctttaactcggcgcaatatttctcgttggcgctcttttcgccgctgcttggctggctgactttcgcctggggctgggagcacgtctttaccgttatgggggtgattggttttgtgctgacggcgctgtggatcaagttgattcataatccgacagatcacccacgtatgtctgcggaagagctgaagtttatctcggaaaatggcgcggtggtcgatatggaccacaaaaagccgggcagtgcggcagcaagcggacccaaactgcattacatcaagcaattgctctctaaccgcatgatgctgggcgtatttttcggacaatattttatcaacaccatcacctggttcttcctcacctggttcccaatttatctggtgcaggaaaaaggcatgtcgattctgaaagtgggtctggtcgcctcgattccggcactgtgtggctttgcgggcggcgtgctgggaggtgtcttctcggattatctgatcaaacgcggtttgtccctgaccctggctcgtaagctaccaattgtgctgggaatgttgctggcttccaccatcatcttatgtaactacaccaacaacaccacgctggtggtcatgctgatggcgctggctttctttggtaaaggatttggtgcgctgggctggccagtgatttctgacaccgcgccgaaagagattgttggcctctgcggcggcgtctttaacgtctttggcaatgttgcctccattgtcactccactggtgattggctacctggtaagtgaactgcactccttcaatgcagcactggtttttgtgggatgttcagcgctgatggcgatggtctgctacctcttcgtagtcggcgacattaaacgtatggaattgcagaaataa

SEQ ID NO: 7378 - protein, 444 aa, Escherichia coli
MMLDTVDEKKKGVHTRYLILLIIFIVTAVNYADRATLSIAGTEVAKELQLSAVSMGYIFSAFGWAYLLMQIPGGWLLDKFGSKKVYTYSLFFWSLFTFLQGFVDMFPLAWAGISMFFMRFMLGFSEAPSFPANARIVAAWFPTKERGTASAIFNSAQYFSLALFSPLLGWLTFAWGWEHVFTVMGVIGFVLTALWIKLIHNPTDHPRMSAEELKFISENGAVVDMDHKKPGSAAASGPKLHYIKQLLSNRMMLGVFFGQYFINTITWFFLTWFPIYLVQEKGMSILKVGLVASIPALCGFAGGVLGGVFSDYLIKRGLSLTLARKLPIVLGMLLASTIILCNYTNNTTLVVMLMALAFFGKGFGALGWPVISDTAPKEIVGLCGGVFNVFGNVASIVTPLVIGYLVSELHSFNAALVFVGCSALMAMVCYLFVVGDIKRMELQK

SEQ ID NO: 7379 - DNA, 1572 bp, Escherichia coli
atggccaacatcgaaatcagacaagaaacgccaactgcgttttatataaaagttcacgacacagataatgtggcaattattgttaatgataatggcctgaaagcaggaacgcgttttccggatgggctggaattaattgaacatattccccaggggcataaagtcgcattgctggacattccggctaatggtgaaattattcgttatggcgaggtgattggttacgccgtgcgcgcaatcccacgcggaagctggatcgacgaatcaatggttgtactaccggaagcgccgccgttacatacgctgccactggcaaccaaagtcccggaacccttaccgccgctggaaggatacacctttgagggctatcgcaatgccgatggcagcgtgggcaccaaaaacctgctcggcatcaccaccagcgtccactgtgtggcaggcgtggtggactacgtagtaaaaatcattgaacgcgatctgctaccgaaatacccgaacgtcgatggcgtggtggggctgaatcatttgtacggttgtggcgtggcgattaacgcacccgcggcagttgtacctattcgtaccattcacaatatttcgctgaaccctaactttggcggcgaagtaatggtgattggtctgggttgtgaaaagttgcagcctgaacgcctactgactggaacggatgatgtgcaagctattccagtagaaagcgccagcattgtcagtttgcaggatgaaaagcatgtcggttttcagtccatggtcgaggatattttgcaggtcgccgaatgccatctacaaaaactgaatcaacgtcagcgagaaacctgtccggcttcagaactggttgtcggcatgcagtgcggtggcagcgatgcgttttctggcgtaacggcaaacccggcggttgggtatgcgtctgatctattggtgcgctgcggcgcaacggtgatgttttcagaagtcacagaagtgcgtgacgcgatacatctgctgacaccacgcgcagtgaacgaagaggtcggcaaacggctgctggaggagatggagtggtacgataactatctcaatatgggaaaaaccgatcgcagcgccaacccttcgccggggaacaagaaaggcggtctggcaaatgtggtggagaaggcactcggctccattgctaaatcgggtaaaagtgcaattgttgaagtgctgtcgcccggccaacgcccgactaaacgcggattaatttacgccgcgacgccagccagcgattttgtctgtggcacgcaacaggtggcttcgggtatcaccgtgcaagtgtttacgaccggtcgtggtacgccgtacggcctgatggcggtacccgtcattaaaatggcgacccgcaccgagctggcgaaccgctggtttgatttaatggatattaacgcgggcactatcgctaccggcgaagaaaccattgaagaagtgggctggaagttgttccactttattctcgacgtcgccagcgggaagaagaaaactttctcggatcaatggggactgcataaccagctggcggtgtttaacccggcaccggtgacctga

SEQ ID NO: 7380 - protein, 523 aa, Escherichia coli
MANIEIRQETPTAFYIKVHDTDNVAIIVNDNGLKAGTRFPDGLELIEHIPQGHKVALLDIPANGEIIRYGEVIGYAVRAIPRGSWIDESMVVLPEAPPLHTLPLATKVPEPLPPLEGYTFEGYRNADGSVGTKNLLGITTSVHCVAGVVDYVVKIIERDLLPKYPNVDGVVGLNHLYGCGVAINAPAAVVPIRTIHNISLNPNFGGEVMVIGLGCEKLQPERLLTGTDDVQAIPVESASIVSLQDEKHVGFQSMVEDILQVAECHLQKLNQRQRETCPASELVVGMQCGGSDAFSGVTANPAVGYASDLLVRCGATVMFSEVTEVRDAIHLLTPRAVNEEVGKRLLEEMEWYDNYLNMGKTDRSANPSPGNKKGGLANVVEKALGSIAKSGKSAIVEVLSPGQRPTKRGLIYAATPASDFVCGTQQVASGITVQVFTTGRGTPYGLMAVPVIKMATRTELANRWFDLMDINAGTIATGEETIEEVGWKLFHFILDVASGKKKTFSDQWGLHNQLAVFNPAPVT

SEQ ID NO: 7381 - DNA, 825 bp, Escherichia coli
atgagtaataccgacgcttcaggtgagaagcgagtgacaggcaccagtgagcgacgagagcagatcattcaacgcctgcgccagcaaggaagtgtgcaagttaatgatctatcggcgttgtatggtgtatctactgtgacgatccgcaacgatctggcgtttctggaaaagcaggggatcgctgtgcgtgcctatggtggcgcgttgatctgcgatagcacaacgccgtcagtcgagccatcagtggaagataaaagcgcgctgaacaccgcgatgaaacgcagcgttgcgaaagctgccgttgagttgattcagcctggtcatcgggtgatcctcgactccgggaccaccacttttgagattgctcgtctgatgcgcaagcacaccgacgtaattgcgatgaccaacggtatgaacgtggctaatgcgttgctggaagcggaaggcgttgagctgctgatgaccggggggcatttgcgccgtcagtcgcaatctttttacggtgatcaggctgagcaatcgctgcaaaattaccacttcgatatgctgtttcttggtgtagatgcgatcgatctggagcgcggcgtcagcacgcataatgaagatgaagcccgtttaaaccgtcggatgtgcgaagttgcggaacggatcatcgtggtcaccgattccagtaagttcaatcgttctagtttacataagatcattgatactcaacgtatcgacatgatcattgttgatgaaggcattccttcggatagtctggaaggactgagaaaggctggggttgaagtgattctggtcggggatcacgcgtcttcgctgtga

SEQ ID NO: 7382 - protein, 274 aa, Escherichia coli
MSNTDASGEKRVTGTSERREQIIQRLRQQGSVQVNDLSALYGVSTVTIRNDLAFLEKQGIAVRAYGGALICDSTTPSVEPSVEDKSALNTAMKRSVAKAAVELIQPGHRVILDSGTTTFEIARLMRKHTDVIAMTNGMNVANALLEAEGVELLMTGGHLRRQSQSFYGDQAEQSLQNYHFDMLFLGVDAIDLERGVSTHNEDEARLNRRMCEVAERIIVVTDSSKFNRSSLHKIIDTQRIDMIIVDEGIPSDSLEGLRKAGVEVILVGDHASSL

SEQ ID NO: 7383 - DNA, 1281 bp, Escherichia coli
gtgaaacatctgacagaaatggtgagacagcacaaagcgggcaaaacaaatgggatttatgccgtttgttccgcacatccgctggtgctggaagctgcaatccgctacgccagtgcaaaccaaacgccgttactgattgaagcaacctccaatcaggtggaccagttcggcggttataccggaatgacgcccgccgattttcgcggctttgtttgtcagctcgccgactcgttgaatttcccgcaggatgcgctgattctgggtggtgaccatctggggccaaaccgctggcaaaacctgcctgccgctcaggcaatggccaatgccgatgatttgattaaaagctacgtggcggcaggattcaaaaaaattcaccttgattgcagcatgtcctgtcaggacgatccgattcccttaactgatgacatcgtggctgaacgcgccgcccgtctggcgaaagtggcggaagaaacctgtcgtgaacactttggcgaagccgatctggagtatgtcattggtaccgaagtgccggtacctggcggcgcgcatgaaaccttaagcgagctggcggtcaccacgccggatgccgcccgcgccacgctggaagcccatcgtcacgcctttgaaaagcagggtctgaatgccatctggccacgcatcattgccctggtggttcaacccggcgtcgaattcgatcacaccaacgttattgattatcagccagccaaagccgctgccttaagccagatggtcgaaaactacgaaacgctgattttcgaagcgcactctaccgattatcaaacgccgcaatcgctgcgccagctggtgattgaccactttgccattctgaaagttggcccggcgctgaccttcgccctgcgtgaagctctgttctctctggcggcgattgaagaagaactggtgccagcaaaagcctgttctggtctgcgtcaggtgctggaaaacgtgatgctcgaccgcccggaatactggcaaagccactaccacggtgacggcaacgcgcgtcgtctggcgcgtggttatagctactcggatcgcgtgcgctattactggccggacagccagattgatgacgctttcgctcatctggttcgtaatctggcggattcaccaattccgctgccgctgatcagtcagtatctgccgctgcagtacgtgaaagttcgctccggcgagctgcagccaacgccacgggaactcattatcaaccatattcaggacatcctggcgcagtaccacacagcctgtgaaggccaataa

SEQ ID NO: 7384 - protein, 426 aa, Escherichia coli
MKHLTEMVRQHKAGKTNGIYAVCSAHPLVLEAAIRYASANQTPLLIEATSNQVDQFGGYTGMTPADFRGFVCQLADSLNFPQDALILGGDHLGPNRWQNLPAAQAMANADDLIKSYVAAGFKKIHLDCSMSCQDDPIPLTDDIVAERAARLAKVAEETCREHFGEADLEYVIGTEVPVPGGAHETLSELAVTTPDAARATLEAHRHAFEKQGLNAIWPRIIALVVQPGVEFDHTNVIDYQPAKAAALSQMVENYETLIFEAHSTDYQTPQSLRQLVIDHFAILKVGPALTFALREALFSLAAIEEELVPAKACSGLRQVLENVMLDRPEYWQSHYHGDGNARRLARGYSYSDRVRYYWPDSQIDDAFAHLVRNLADSPIPLPLISQYLPLQYVKVRSGELQPTPRELIINHIQDILAQYHTACEGQ

SEQ ID NO: 7385 - DNA, 474 bp, Escherichia coli
atgccaaatattgttttaagtcggattgatgaacgcttgattcacggtcaggtcggcgttcagtgggtcggatttgcgggggcaaatctggtgctggtagccaacgacgaggttgccgaagatctggtacaacaaaacctgatggaaatggtactggcagaagggatcgccgtacgtttctggacgttgcaaaaagtcatcgataacattcatcgcgccgccgatcgacagaaaatcctgctggtttgtaaaacaccggccgatttcctgacgctggtgaaaggtggcgttccggtgaatcgcattaacgttggcaatatgcactacgccaatggcaagcaacaaatcgccaaaacggtttctgtggatgcgggtgatatcgcagcatttaacgacctgaaagccgctggggtggaatgcttcgttcagggcgtcccgacagagcctgcagtggacctctttaaattactttga

SEQ ID NO: 7386 - protein, 157 aa, Escherichia coli
MPNIVLSRIDERLIHGQVGVQWVGFAGANLVLVANDEVAEDLVQQNLMEMVLAEGIAVRFWTLQKVIDNIHRAADRQKILLVCKTPADFLTLVKGGVPVNRINVGNMHYANGKQQIAKTVSVDAGDIAAFNDLKAAGVECFVQGVPTEPAVDLFKLL

SEQ ID NO: 7387 - DNA, 780 bp, Escherichia coli
atggaaatcagtctgttgcaggcattcgcgttgggcattatcgcctttatcgctggcctggatatgtttaacggcttaacccatatgcaccgcccggtggttctcggcccgttggtcgggctggtacttggcgatctgcataccggtattttaaccggcggtacgctggaactggtgtggatggggctggcccctctggcgggcgcacagccgcctaacgtgattatcggtactatcgtcggcacggcgtttgccattactactggcgtgaaacccgatgtcgcggtcggtgtcgccgtacctttcgctgtcgcagtacagatggggattaccttcctgttctcggtgatgtccggcgtgatgtcccgatgcgaccggatggcggagaacgccgatactcgcggcattgaacgcgtgaactatctggcactgctggcactcggcacgttctattttctctgcgctttcctgcctatctacttcggcgcggaacatgcaaaaaccatcattgatgtcctgccgcaacgattaatcgacggcctcggcgtcgcgggcggcatcatgccagcaatcggttttgccgtgctgctgaaaatcatgatgaaaaacgtctacatcccctacttcatcctgggctttgttgccgcagcctggctcaagttaccggtgctggctattgctgccgccgcgctggcgatggcgctgatcgacctgctgcgtaaatctcctgaaccgactcaacctgcggcacagaaagaggaatttgaagatggcatctaa

SEQ ID NO: 7388 - protein, 259 aa, Escherichia coli
MEISLLQAFALGIIAFIAGLDMFNGLTHMHRPVVLGPLVGLVLGDLHTGILTGGTLELVWMGLAPLAGAQPPNVIIGTIVGTAFAITTGVKPDVAVGVAVPFAVAVQMGITFLFSVMSGVMSRCDRMAENADTRGIERVNYLALLALGTFYFLCAFLPIYFGAEHAKTIIDVLPQRLIDGLGVAGGIMPAIGFAVLLKIMMKNVYIPYFILGFVAAAWLKLPVLAIAAAALAMALIDLLRKSPEPTQPAAQKEEFEDGI

SEQ ID NO: 7389 - DNA, 879 bp, Escherichia coli
atggcatctaatcaaaccaccctgccgaacgtcagtgaaaacgaagaaacactgctgactggcgtcaatgaaaacgtgtatgaagatcagagcattggcgcagagctgacgaaaaaagatatcaaccgcgtcgcctggcgttccatgctgttacaggcttctttcaactacgaacgtatgcaggcttccggctggctgtacggcctgctgccagcactgaaaaagatccacactaataaacgcgacctggcgcgcgccatgaaggggcatatgggtttcttcaatacccatccgtttctggtgacgtttgttatcggcattatccttgcgatggagcgttctaagcaggacgttaacagtattcagagcaccaaaattgccgtcggtgcgccgctcggcgggattggcgatgcgatgttctggctaacgctactgccgatttgtggcgggataggtgcaagcctcgcgctacaaggctctattcttggcgctgtcgtctttattgtgctgttcaacgtggtgcacctggggctgcgttttggtctggcgcattatgcttaccgcatgggcgtggcggcgattccactcattaaagcaaataccaaaaaagtcggccatgcggcatctatcgttgggatgacggtaatcggcgcgctggtggcaacctatgttcgtttaagcaccacgctggaaatcaccgcgggcgacgcagtggttaagttacaggctgatgttatcgacaaactgatgccagccttcttaccgctggtctacaccctgaccatgttctggctggtacgccgcggctggagtccgctgcgcctgattgcgattaccgtggttctcggcatcgtcggtaaattctgccatttcctttaa

SEQ ID NO: 7390 - protein, 292 aa, Escherichia coli
MASNQTTLPNVSENEETLLTGVNENVYEDQSIGAELTKKDINRVAWRSMLLQASFNYERMQASGWLYGLLPALKKIHTNKRDLARAMKGHMGFFNTHPFLVTFVIGIILAMERSKQDVNSIQSTKIAVGAPLGGIGDAMFWLTLLPICGGIGASLALQGSILGAVVFIVLFNVVHLGLRFGLAHYAYRMGVAAIPLIKANTKKVGHAASIVGMTVIGALVATYVRLSTTLEITAGDAVVKLQADVIDKLMPAFLPLVYTLTMFWLVRRGWSPLRLIAITVVLGIVGKFCHFL

SEQ ID NO: 7391 - DNA, 435 bp, Escherichia coli
atgttaagtattattttgacagggcatggcggatttgccagcggcatggaaaaagcaatgaagcaaattctcggtgagcaatcgcagtttatcgccatcgattttccggaaacctcaagcaccgcgctgcttacatcgcagcttgaagaggccatcgcccaactggattgtgaagacggcattgtttttctgacggatttgctgggcggcacgccgtttcgcgtagcttcaacgctggcgatgcaaaaaccgggctgtgaagtgatcaccggcaccaatttgcaactgctactggaaatggtgctggagcgcgaagggttaagcggtgaagagttccgtgtgcaggcgctggagtgtggacaccgtgggctgaccagtctggtggacgagttaggccgctgccatgaagaatgtccggtcgaggaaggaatatga

SEQ ID NO: 7392 - protein, 144 aa, Escherichia coli
MLSIILTGHGGFASGMEKAMKQILGEQSQFIAIDFPETSSTALLTSQLEEAIAQLDCEDGIVFLTDLLGGTPFRVASTLAMQKPGCEVITGTNLQLLLEMVLEREGLSGEEFRVQALECGHRGLTSLVDELGRCHEECPVEEGI

SEQ ID NO: 7393 - DNA, 1134 bp, Escherichia coli
atgacacacgttctgcgcgccagaaggctgctgactgaagagggatggctcgatgaccatcagttgcgtattgctgacggtgtaatcgcagcaatcgaaccgattccagtgggcgtgactgaacgcgatgcggaactgctctgtcccgcttacatcgacacccatgtacacggtggtgcgggcgttgatgtaatggatgacgcgccggatgtgctcgacaagctggcaatgcacaaagcacgcgaaggtgtcggcagttggttaccgaccaccgtaaccgcgccgcttaataccattcatgcggcgctggaacgtattgctcaacgttgccaacgcggcggacctggtgcgcaagtgctggggagttatctcgaaggaccgtacttcacgccgcagaataaaggcgcgcatccaccggagctgttccgcgagctggaaattgccgagctggatcaattgattgccgtttctcagcataccttgcgcgtggtggcgctggcaccggaaaaagaaggggcattgcaggccatccgccatcttaaacagcaaaacgtacgggtgatgctggggcatagcgcggcgacctggcaacaaacccgtgccgcgtttgatgctggtgccgacggcctggtgcattgctataacgggatgacaggtttacatcaccgcgaaccgggaatggttggcgcgggattaacagacaagcgcgcctggctggaactgatagccgatggtcatcatgtacatccggcggcaatgtcgctctgttgttgctgtgcgaaagagaggatcgtactgatcaccgacgcgatgcaggcagccgggatgccggatggtcactatacgttatgtggtgaagaagtgcagatgcgcggtggcgttgtccgtaccgcgtccggtgggctggcgggcagtacgctgtctgtcgatgcggcagtgcgcaacatggtcgagttgacgggcgtaacgcctgcggaagccatccatatggcgtcgctgcatccggcgcgaatgctgggtgttgatggtgttctgggatcgcttaaaccgggcaaacgcgccagcgtcgttgcgctggatagcgggctgcatgtgcaacaaatctggattcagggtcaattagcttcgttttga

SEQ ID NO: 7394 - protein, 377 aa, Escherichia coli
MTHVLRARRLLTEEGWLDDHQLRIADGVIAAIEPIPVGVTERDAELLCPAYIDTHVHGGAGVDVMDDAPDVLDKLAMHKAREGVGSWLPTTVTAPLNTIHAALERIAQRCQRGGPGAQVLGSYLEGPYFTPQNKGAHPPELFRELEIAELDQLIAVSQHTLRVVALAPEKEGALQAIRHLKQQNVRVMLGHSAATWQQTRAAFDAGADGLVHCYNGMTGLHHREPGMVGAGLTDKRAWLELIADGHHVHPAAMSLCCCCAKERIVLITDAMQAAGMPDGHYTLCGEEVQMRGGVVRTASGGLAGSTLSVDAAVRNMVELTGVTPAEAIHMASLHPARMLGVDGVLGSLKPGKRASVVALDSGLHVQQIWIQGQLASF

SEQ ID NO: 7395 - DNA, 1155 bp, Escherichia coli
atgccagaaaattacacccctgctgctgccgcaaccggtacatggactgaagaagagatccgccatcagcctcgcgcatggatccgttcactcaccaacatcgacgcgctacgttccgcgctcaataacttccttgaaccgttactgcgcaaagagaatctgcggatcatcctgaccggagccggaacctcggcatttatcggtgacatcatcgcgccgtggctcgccagccataccggtaaaaacttcagcgccgtaccgaccaccgatctggtcactaatccgatggactacctgaatccagctcatccgctgctgttgatctccttcggtcgatccggcaacagcccggaaagcgtcgccgccgtggaactggcaaatcaatttgtaccagaatgctatcacctgccgatcacctgcaacgaagcgggcgctctttaccaaaacgcgatcaacagcgacaacgcgtttgccctgctgatgcccgcagaaacgcacgatcgcggcttcgcgatgaccagcagcattaccaccatgatggccagctgcctcgcggttttcgcacctgagacgatcaacagccaaaccttccgcgatgtggcggatcgttgccaggcgatcctgacctcactgggcgatttcagcgaaggtgtgtttggttacgcaccgtggaaacggatcgtttatctcggcagcggtggcttacagggcgcagcacgcgagtcggcgctgaaagtgctggaactgacagcgggtaaactggcggccttctatgattccccgaccggattccgtcatggcccgaaatcgctggtcgataacgaaacgctggtggtggtgtttgtctccagccacccttacacccgtcagtatgatcttgatctgctggcagaactccgccgcgataaccaggcaatgcgcgtaatcgccatcgccgcggaaagcaacgacgttattgccgccggtccacatatcatcctgccgccgtcccgtcactttatcgacgttgagcaggcattttgcttcctgatgtacgcccagacatttgcactgatgcagtcgctgcacatgggtaatacgccggataccccatcagccagtggcaccgttaaccgcgtggtgcaaggcgtaatcattcatccgtggcaggcataa

SEQ ID NO: 7396 - protein, 384 aa, Escherichia coli
MPENYTPAAAATGTWTEEEIRHQPRAWIRSLTNIDALRSALNNFLEPLLRKENLRIILTGAGTSAFIGDIIAPWLASHTGKNFSAVPTTDLVTNPMDYLNPAHPLLLISFGRSGNSPESVAAVELANQFVPECYHLPITCNEAGALYQNAINSDNAFALLMPAETHDRGFAMTSSITTMMASCLAVFAPETINSQTFRDVADRCQAILTSLGDFSEGVFGYAPWKRIVYLGSGGLQGAARESALKVLELTAGKLAAFYDSPTGFRHGPKSLVDNETLVVVFVSSHPYTRQYDLDLLAELRRDNQAMRVIAIAAESNDVIAAGPHIILPPSRHFIDVEQAFCFLMYAQTFALMQSLHMGNTPDTPSASGTVNRVVQGVIIHPWQA

SEQ ID NO: 7397 - DNA, 861 bp, Escherichia coli
atgagcattatctccaccaaatatctgttacaggacgcccaggccaatggctacgcggtgcctgcctttaacattcataacgccgagacgatccaggcgatcctcgaagtgtgcagtgaaatgcgatcgccggtgatcctcgccgggacgccggggacctttaagcatatcgcgctggaagagatctacgccctgtgtagcgcctattccacgacctataacatgccgctggcactgcatctcgatcaccacgaatcgctggatgatattcgccgtaaagtccacgcaggcgtgcgcagcgcgatgatcgacggcagtcatttcccgtttgccgagaacgtgaagctggtgaaatcggttgtcgacttctgccactcccaggattgcagcgtggaagcagaactgggccgcctcggcggtgttgaagatgacatgagcgttgacgccgaaagtgcattcctgaccgatccacaagaagctaaacgctttgtcgaactgactggcgtcgacagcctggcggtagcgattggtacggcgcacggcttatacagcaaaacgccgaagattgatttccagcggctggcggaaattcgtgaagtggtggatgttcctctggtgctgcatggtgccagcgatgtcccggatgaatttgtccgtcgcactattgaacttggcgtaacaaaagtgaacgttgccacagaattaaaaatagccttcgctggcgcggttaaagcctggtttgcggaaaatcctcagggtaatgatcctcgttattatatgcgcgtcggaatggatgcgatgaaagaagttgtcagaaataaaattaatgtctgtggttcagcgaatcgaatttcagcataa

SEQ ID NO: 7398 - protein, 286 aa, Escherichia coli
MSIISTKYLLQDAQANGYAVPAFNIHNAETIQAILEVCSEMRSPVILAGTPGTFKHIALEEIYALCSAYSTTYNMPLALHLDHHESLDDIRRKVHAGVRSAMIDGSHFPFAENVKLVKSVVDFCHSQDCSVEAELGRLGGVEDDMSVDAESAFLTDPQEAKRFVELTGVDSLAVAIGTAHGLYSKTPKIDFQRLAEIREVVDVPLVLHGASDVPDEFVRRTIELGVTKVNVATELKIAFAGAVKAWFAENPQGNDPRYYMRVGMDAMKEVVRNKINVCGSANRISA

SEQ ID NO: 7399 - DNA, 477 bp, Escherichia coli
atgagcagtccaaatattctcttaacccgtattgataaccgtctggttcacggtcaggttggcgtgacctggacatccaccatcggtgcgaatctgttagtagtcgtggatgatgttgtcgctaacgatgatattcaacagaaattaatgggtattaccgcagaaacctacggctttggcattcgtttctttactatcgaaaaaaccattaacgtcatcggcaaagctgcaccacatcagaagatcttcctgatttgccgtacgccacaaacggtacgtaaattggtagaaggtggtattgacctgaaagatgtcaacgtcggcaatatgcatttctcggaagggaaaaagcaaatcagcagtaaagtttatgtcgatgaccaggatctcacggatttacgttttattaaacaacgtggcgtaaatgttttcattcaggacgtccctggcgatcaaaaagaacaaatccctgactaa

SEQ ID NO: 7400 - protein, 158 aa, Escherichia coli
MSSPNILLTRIDNRLVHGQVGVTWTSTIGANLLVVVDDVVANDDIQQKLMGITAETYGFGIRFFTIEKTINVIGKAAPHQKIFLICRTPQTVRKLVEGGIDLKDVNVGNMHFSEGKKQISSKVYVDDQDLTDLRFIKQRGVNVFIQDVPGDQKEQIPD

SEQ ID NO: 7401 - DNA, 630 bp, Escherichia coli
ttggctttcgccggattaacccctgcaggtggtgttcagccgcccaaccctattatggcgggtctgatgaccactgtcattgcatggtctacgggcgttgatgccaaaacggcaattggtcttggcctgccgtttagtttgttaatgcagtacgtcattctgttcttctattccgctttctcattatttatgaccaaagccgataaatgcgcaaaagaggcggatacggcagcattttcccgacttaactgggcaacgatgctcatcgtcgcttcagcgtatgcggtgattgctttcctctgtacttacctggcacaaggggcgatgcaggcgctggtgaaagcgatgcccgcctggctgacccacggctttgaagtggctggcggtattctgcctgccgttggttttggcttgctgctgcgcgtgatgttcaaagcacaatatatcccttacctgatcgccggtttcctgtttgtttgctacatccaggtcagcaacctgttgccggttgccgtactgggcgcaggctttgcggtgtatgagtttttcaatgcgaaatcccggcagcaagcgcaaccgcagcccgttgccagtaaaaatgaagaagaggactacagcaatgggatctga

SEQ ID NO: 7402 - protein, 209 aa, Escherichia coli
MAFAGLTPAGGVQPPNPIMAGLMTTVIAWSTGVDAKTAIGLGLPFSLLMQYVILFFYSAFSLFMTKADKCAKEADTAAFSRLNWATMLIVASAYAVIAFLCTYLAQGAMQALVKAMPAWLTHGFEVAGGILPAVGFGLLLRVMFKAQYIPYLIAGFLFVCYIQVSNLLPVAVLGAGFAVYEFFNAKSRQQAQPQPVASKNEEEDYSNGI

SEQ ID NO: 7403 - DNA, 792 bp, Escherichia coli
atgggatctgaaatcagtaaaaaagatatcacccgtctgggctttcgttcgtcactgctacaagcaagctttaactacgaaaggatgcaggcgggcggttttacctgggcgatgttgccgatcctgaaaaagatttataaggacgacaaaccgggcctaagcgcggcgatgaaagataacctcgaatttattaatacccaccctaatctggtcggattcctgatggggttattaatttcgatggaagaaaaaggagaaaaccgcgacaccattaaaggcctcaaagtggcgctgtttggcccaatcgccgggattggcgatgcgattttctggtttaccttgttgccaattatggcggggatttgctcatcgtttgccagtcaggggaacctgttgggaccgattttgtttttcgccgtttacctgcttatctttttcctgcgcgtcggctggacccacgtcggttattcagtcggcgtgaaggctatcgataaagtgcgagagaactcgcagatgattgctcgttcggcaactatcctcgggatcacagtaatcggcgggctgatcgcttcgtatgtgcatattaacgtggtgacgtcgtttgccatcgacagtacccacagcgtcgcactgcaacaggatttcttcgataaagtcttcccgaatattttaccgatggcctacaccctgctgatgtattacttcctgcgggtgaaaaaagcgcatccggtgctgttaatcggcgtgacgtttgttctttctattgtttgttctgcattcggcattttgtaa

SEQ ID NO: 7404 - protein, 263 aa, Escherichia coli
MGSEISKKDITRLGFRSSLLQASFNYERMQAGGFTWAMLPILKKIYKDDKPGLSAAMKDNLEFINTHPNLVGFLMGLLISMEEKGENRDTIKGLKVALFGPIAGIGDAIFWFTLLPIMAGICSSFASQGNLLGPILFFAVYLLIFFLRVGWTHVGYSVGVKAIDKVRENSQMIARSATILGITVIGGLIASYVHINVVTSFAIDSTHSVALQQDFFDKVFPNILPMAYTLLMYYFLRVKKAHPVLLIGVTFVLSIVCSAFGIL

SEQ ID NO: 7405 - DNA, 768 bp, Escherichia coli
atggaacgaggcaccgcgtctggcggtgcctctttacttaaggaatttcatcctgtgcaaacccttcaacaagttgaaaactatacggcgttaagtgaacgtgccagcgaatatttattggccgtgatccgtcgcaaaccggatgccgtgatttgcctggcgaccggagccacgccattactgacgtatcattatctggtagaaaaaatccaccagcagcaggttgatgtcagccagctcaccttcgtgaagctcgacgaatgggtggatctgccattaacgatgcctggtacctgcgaaactttccttcaacagcatatcgtgcagccgctggggttacgtgaagaccagctcatcagctttcactccgaagagataaatgagacagagtgcgaacgggtaacgaacctgattgcgcgcaaaggcggtctggacttatgcgttctcggattggggaaaaacggtcatcttgggctgaacgaaccgggagaaagcctgcaaccggcctgccatatcagtcaacttgatgccagaacacagcaacatgagatgttaaaaaccgcggaccgtcccgtgactcgtgggatcaccttaggcctgaaggatattctcaatgcccgcgaagttttgttactggtgactggcgaaggaaaacaggatgcgacagaacgttttctcacggctaaagtctctaccgctatcccggcttcatttttatggctgcataactatttcacatgcatgattgatgagatgtgtcgtcgttaa

SEQ ID NO: 7406 - protein, 255 aa, Escherichia coli
MERGTASGGASLLKEFHPVQTLQQVENYTALSERASEYLLAVIRRKPDAVICLATGATPLLTYHYLVEKIHQQQVDVSQLTFVKLDEWVDLPLTMPGTCETFLQQHIVQPLGLREDQLISFHSEEINETECERVTNLIARKGGLDLCVLGLGKNGHLGLNEPGESLQPACHISQLDARTQQHEMLKTADRPVTRGITLGLKDILNAREVLLLVTGEGKQDATERFLTAKVSTAIPASFLWLHNYFTCMIDEMCRR

SEQ ID NO: 7407 - DNA, 864 bp, Escherichia coli
atgaaacaacaccaatcggcggataattctcagggccagctttacattgtaccgacgccaatcggcaatctggcggatatcacccagcgtgcgttggaggtattacaggccgttgatctgattgccgccgaggatacgcgtcacaccggtttattgctgcaacattttgggattaatgctcggttgtttgcgctgcacgaccataacgaacaacaaaaagccgaaacgctgctggcgaagctgcaagaggggcaaaacattgcgctggtttccgatgccggaacgccgctaattaacgatcctggctaccatctggtgcgtacctgccgtgaagcggggattcgcgtggtgccgctacccgggccgtgtgctgctatcactgcgttaagcgccgcgggtttaccatccgatcgtttttgttatgaaggctttttacctgccaaatcaaaaggccgccgtgatgcgctaaaagccattgaagcggagccgcgcacgctgattttttatgaatctacccaccgtctgttagatagcctggaagatatcgttgcggtattaggcgaatcccgctacgtcgttctggcgcgtgagctgaccaaaacctgggaaaccattcacggcgcgcccgttggcgagctgctggcgtgggtcaaagaagatgaaaaccgtcgcaaaggcgaaatggtactgattgtcgaaggccataaagcacaggaagaagacttacccgccgatgccctgcgcacgctggcgctgctacaggcagaactgccgctgaaaaaagcggcggcgctggcagcagaaattcacggcgtgaagaaaaatgcgctgtataagtatgcgctggagcagcagggagagtga

SEQ ID NO: 7408 - protein, 287 aa, Escherichia coli
MKQHQSADNSQGQLYIVPTPIGNLADITQRALEVLQAVDLIAAEDTRHTGLLLQHFGINARLFALHDHNEQQKAETLLAKLQEGQNIALVSDAGTPLINDPGYHLVRTCREAGIRVVPLPGPCAAITALSAAGLPSDRFCYEGFLPAKSKGRRDALKAIEAEPRTLIFYESTHRLLDSLEDIVAVLGESRYVVLARELTKTWETIHGAPVGELLAWVKEDENRRKGEMVLIVEGHKAQEEDLPADALRTLALLQAELPLKKAAALAAEIHGVKKNALYKYALEQQGE

SEQ ID NO: 7409 - DNA, 2067 bp, Escherichia coli
ttgcgtaaaaaaaatatcactggatacattatggtaccctcaacattttctcgtttgaaagccgcgcgttgtctgcctgttgttctggcagccctgattttcgccggttgtggcacccatactcccgatcagtccactgcttatatgcagggcacggcgcaggctgattctgccttttacctgcaacagatgcagcaaagttctgatgataccaggatcaactggcaattactcgccattcgtgcactggtgaaagaaggtaaaaccgggcaggcagttgagttgtttaaccaactaccgcaagaactgaatgatactcagcgtcgcgagaaaacactgctggcggcagagattaaactggcgcagaaagattttgctggcgcgcaaaacttgctggcgaaaatcacacctgccgatttagaacaaaaccagcaagcccgttactggcaggcaaaaatcgatgccagccaggggcgtccttccattgatttactgcgcgcgttaattgctcaggaaccgctgctcggtgcgaaagaaaagcagcagaatattgacgccacatggcaggcgctctcctccatgactcaggagcaggcgaatacgctggtgatcaacgccgacgaaaatattctgcaaggctggctggatttgcagcgcgtctggtttgataaccgtaacgatcctgacatgatgaaagctgggatcgccgactggcagaaacgttatccgaacaacccgggcgcgaaaatgctgccaacgcagttggttaacgtaaaagcgtttaaacccgcatcgaccaacaaaatcgccctgctgttgccgctgaatggccaggcagcggtatttggtcgcactattcagcaaggctttgaagcggcgaaaaatatcggcactcagccagtggtggcccaggtagcagccgcacctgccgcagacgtagcagaacaacctcagccgcaaaccgtggatggcgttgccagcccggcacaagcttcggttagcgatctgaccggtgaacagcctgcggctcagtcggtgcctgtaagcgccccggcgacaagcaccgcagcggtaagcgcacccgcaaatccatccgcagagctgaaaatctacgatacctcatcacaaccacttagccagatcttaagccaggttcagcaggatggcgcgagtattgtggtcggtccgttgctgaaaaataacgttgaagagttgctgaagagcaacactccgctgaacgtgctggcactgaaccagccggagaacatcgaaaaccgcgtcaatatttgttacttcgcgctttcaccggaagacgaagcgcgcgatgcagcgcgtcatattcgtgaccagggtaaacaagcgccgctggtgctgatcccacgcagttcattgggcgatcgcgtagccaatgcgtttgcgcaagagtggcagaaactgggcggcggcaccgttctgcaacaaaaatttggttccaccagcgagttacgcgcgggtgttaacggcggttcgggtatcgctttaacgggtagcccgattactcccagagaaacaaccgactccggcatgacgaccaacaatccaacgctgcaaaccacaccaaccgatgatcagttcaccaataatggcggtcgtgtcgatgcggtgtacattgtggcaacgccgggtgaaatcgcttttatcaaaccaatgatcgccatgcgtaacggtagccagagcggtgcaacgctgtacgccagctcccgcagtgcgcaagggaccgctggcccggatttccgcctggagatggaaggcttgcagtacagcgaaatcccgatgctggcaggcggtaatctgccgttaatgcagcaggcgctcagcgcggtgaacaacgattattcgctggctcgcatgtatgcgatgggcgtcgatgcctggtcgttggcaaatcatttctcacaaatgcgccaggttcagggttttgaaatcaacggtaataccggaagcctgacggcaaacccggattgcgtgattaacaggaagttatcatggctacagtaccaacaaggtcaggtagtccccgccagttaa

SEQ ID NO: 7410 - protein, 688 aa, Escherichia coli
MRKKNITGYIMVPSTFSRLKAARCLPVVLAALIFAGCGTHTPDQSTAYMQGTAQADSAFYLQQMQQSSDDTRINWQLLAIRALVKEGKTGQAVELFNQLPQELNDTQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVVAQVAAAPAADVAEQPQPQTVDGVASPAQASVSDLTGEQPAAQSVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 7411 - DNA, 270 bp, Escherichia coli
gtgaacgagcgtggcggcgagatcgatctgataatgcgtgaaggccggaccaccgtttttatcgaggtgcgttaccgccgctctgcgctttatggcggcgcggcagccagtgtgacccgcagcaaacaacacaaattattacagactgcccgcttgtggctcgcgcgtcataatgggagttttgatactgtggattgccggttcgatgtggtagccttcaccgggaatgaggttgagtggattaaggatgcctttaatgaccactcataa

SEQ ID NO: 7412 - protein, 89 aa, Escherichia coli
MNERGGEIDLIMREGRTTVFIEVRYRRSALYGGAAASVTRSKQHKLLQTARLWLARHNGSFDTVDCRFDVVAFTGNEVEWIKDAFNDHS

SEQ ID NO: 7413 - DNA, 591 bp, Escherichia coli
gtgcaagaaagaattaaagcttgcttcactgaaagcattcaaactcaaattgcggcggcagaggcgcttccggatgccatctcccgtgcagccatgacgctggttcagtctctgctcaatggcaacaaaatcctctgttgtggtaatggaacttccgctgccaatgcacagcattttgctgccagcatgatcaaccgtttcgaaacggagcggcccagcttacctgccattgcactaaatactgataatgttgtcttaacggcaattgccaacgatcgcttacatgatgaagtgtatgcaaaacaggtgcgggcgctgggccatgcgggagatgtattgttagccatttccacccgtggcaacagccgcgatattgtaaaagcggtagaagctgccgttacgcgtgatatgaccattgtggcattaaccggctatgacggcggtgaacttgcaggtttgttagggccacaggatgtggagatccgcattccttcgcatcgtagtgctcgcattcaggaaatgcatatgctgacggtaaattgcctgtgcgatctgatcgataacacgcttttccctcaccaggatgtttaa

SEQ ID NO: 7414 - protein, 196 aa, Escherichia coli
MQERIKACFTESIQTQIAAAEALPDAISRAAMTLVQSLLNGNKILCCGNGTSAANAQHFAASMINRFETERPSLPAIALNTDNVVLTAIANDRLHDEVYAKQVRALGHAGDVLLAISTRGNSRDIVKAVEAAVTRDMTIVALTGYDGGELAGLLGPQDVEIRIPSHRSARIQEMHMLTVNCLCDLIDNTLFPHQDV

SEQ ID NO: 7415 - DNA, 576 bp, Escherichia coli
atgaaggcattatcgccaatcgcagtccttatttccgcgctgctgttgcaaggttgtgttgccgctgccgtagtgggtactgctgctgtgggtaccaaagccgcaactgacccacgcagtgtcggcacccaggtagacgatggtaccctggaagtgcgcgtgaacagcgcattgtcgaaagacgaacaaattaagaaagaagcgcgcattaatgtaacggcctatcagggcaaagtgctgctggttgggcagtcaccaaacgctgaactttcggctcgcgccaaacagattgctatgggcgtagacggtgccaacgaagtgtataacgagattcgtcagggccagccgattggtctgggcgaagcgtctaacgatacgtggatcaccaccaaagtacgttcgcagctgttaaccagcgacctggtgaaatcgtccaacgtgaaagtgaccaccgaaaacggtgaagtgttcctgatggggctggtgactgaacgtgaagcgaaagcggcggcagatattgccagccgggtaagcggcgtgaagcgggtaactacggcgtttacgtttattaaatag

SEQ ID NO: 7416 - protein, 191 aa, Escherichia coli
MKALSPIAVLISALLLQGCVAAAVVGTAAVGTKAATDPRSVGTQVDDGTLEVRVNSALSKDEQIKKEARINVTAYQGKVLLVGQSPNAELSARAKQIAMGVDGANEVYNEIRQGQPIGLGEASNDTWITTKVRSQLLTSDLVKSSNVKVTTENGEVFLMGLVTEREAKAAADIASRVSGVKRVTTAFTFIK

SEQ ID NO: 7417 - DNA, 1041 bp, Escherichia coli
atgactggtcagtcttcatctcaggcggcaacgcccattcagtggtggaaacccgcgcttttctttctcgttgtcattgccggtctctggtatgtgaaatggcaaccttactacggcaaagcgtttactgctgccgaaacccacagtatcggtaaatctatccttgcgcaggcggatgctaatccgtggcaggcggcgttgaattacgcgatgatctattttctcgcggtatggaaagcggcggtgctgggggtgatcctcggttcgttgattcaggtgctgatcccgcgtgactggttgttgcgtacgcttgggcaatcgcgctttcgcggcacgctgctgggaacgctgttttcgctgccgggtatgatgtgtacctgctgtgcggctccggtcgcggcgggaatgcgtcgccaacaggtgtcgatgggcggtgcgctggcattctggatggggaatccgttgttaaacccggcgacgctggtgtttatggggttcgtcctcggctgggattttgcggcgattcgtctggtggcggggctggtgatggtgttgctgattgcgacgctggtgcaaaaatgggtgcgtgaaacaccgcaaacgcaggcaccggtcgaaattgacataccggaagcacagggaggattttttagccgctggggcagggcgctatggacgcttttctggagtacgatcccggtttacatccttgcagtactggtgttgggtgccgctcgcgtctggttattcccccatgccgatggtgctgtcgataacagcctgatgtgggtggtggcgatggcggtggcaggatgcttgtttgtcattcccacggcagcagaaattccgattgtacaaacgatgatgctggcaggtatgggaactgctccggcgctggcattgttgatgacgctcccggcggtgagtttgccgtcactgattatgctgcgcaaagcgttcccgacgaaagccttatggctgacgggggcgatggtggcagtgtctggtgtgattgtcggcgggctggcgctgttggtttga

SEQ ID NO: 7418 - protein, 346 aa, Escherichia coli
MTGQSSSQAATPIQWWKPALFFLVVIAGLWYVKWQPYYGKAFTAAETHSIGKSILAQADANPWQAALNYAMIYFLAVWKAAVLGVILGSLIQVLIPRDWLLRTLGQSRFRGTLLGTLFSLPGMMCTCCAAPVAAGMRRQQVSMGGALAFWMGNPLLNPATLVFMGFVLGWDFAAIRLVAGLVMVLLIATLVQKWVRETPQTQAPVEIDIPEAQGGFFSRWGRALWTLFWSTIPVYILAVLVLGAARVWLFPHADGAVDNSLMWVVAMAVAGCLFVIPTAAEIPIVQTMMLAGMGTAPALALLMTLPAVSLPSLIMLRKAFPTKALWLTGAMVAVSGVIVGGLALLV

SEQ ID NO: 7419 - DNA, 636 bp, Escherichia coli
atgagtcaggtactgattacaggcgcaacggggctggtgggcggtcacctgctgcggatgttgattaatgaaccgaaagttaacgccattgctgcgccgacgcgacgtccgttgggcgatatgcccggggtgtttaatccccatgatccgcaactgactgacgcgctggcgcaggtcaccgatcccatcgacattgtgttttgttgtctcggcaccacgcggcgagaagcggggagcaaagaggcgtttattcatgccgattacacgttggtggtggataccgcattaaccgggcggcggctcggtgcgcagcatatgctggtggtcagtgctatgggtgctaatgcccactcgccgtttttctataaccgcgtcaaaggggagatggaagaagcattaatcgcccagaactggccgaaattgaccattgctcgcccgtcgatgttactgggcgatcgtagcaaacagcggatgaacgaaacgctttttgcgccgctgttccgtttgttacccggtaactggaaatccattgatgcgagagacgtggcgcgggtcatgctggcagaggcgatgcggcctgagcatgaaggtgtgacgattttaagctcttcagaattacgcaaaagagctgaataa

SEQ ID NO: 7420 - protein, 211 aa, Escherichia coli
MSQVLITGATGLVGGHLLRMLINEPKVNAIAAPTRRPLGDMPGVFNPHDPQLTDALAQVTDPIDIVFCCLGTTRREAGSKEAFIHADYTLVVDTALTGRRLGAQHMLVVSAMGANAHSPFFYNRVKGEMEEALIAQNWPKLTIARPSMLLGDRSKQRMNETLFAPLFRLLPGNWKSIDARDVARVMLAEAMRPEHEGVTILSSSELRKRAE

SEQ ID NO: 7421 - DNA, 444 bp, Escherichia coli
atggaaacactcaccgccatcagccgttggctggcaaaacaacatgttgtcacctggtgtgtgcagcaggaaggggaactgtggtgcgccaatgccttttatctttttgatgcgcagaaagtcgccttctacattttgacggaagaaaaaacgcgtcatgcgcagatgagcgggccgcaggcggcaattgccggaacggtaaacggtcagccgaaaacggtagcgttaattcgcggcgtgcagtttaaaggtgagatccgcagactggaaggcgaggaaagcgacctcgcacgcaaggcgtacaatcgtcgctttccggttgccagaatgctgtcggccccggtatgggaaatccggctcgatgaaatcaaattcaccgacaacacgctgggctttggtaaaaaaatgatttggctacgtaactcaggcaccgagcaggcgtaa

SEQ ID NO: 7422 - protein, 147 aa, Escherichia coli
METLTAISRWLAKQHVVTWCVQQEGELWCANAFYLFDAQKVAFYILTEEKTRHAQMSGPQAAIAGTVNGQPKTVALIRGVQFKGEIRRLEGEESDLARKAYNRRFPVARMLSAPVWEIRLDEIKFTDNTLGFGKKMIWLRNSGTEQA

SEQ ID NO: 7423 - DNA, 519 bp, Escherichia coli
atgagtaagaaaatcgccgttttaatcactgatgaatttgaggattcagaatttacttcacccgcagacgagttccgtaaagccggacacgaagtgattaccattgaaaaacaagcgggtaaaacggtgaaaggcaaaaaaggagaagccagcgtggccatcgataaatccatcgatgaagtgacgcccgcagagttcgatgccctgctgctaccgggcggtcattcaccagattatctgcgtggtgacaaccgttttgtcaccttcacacgcgattttgtgaacagcggcaaacctgttttcgccatctgtcacggtccccagttgctgatcagcgccgatgtgatccttggtcgtaagctgaccgccgttaaaccgatcgtgattgatgttaaaaacgcgggcgcggaattttacgatcaggaagtggtggtcgataaagatcagctggttaccagccggacaccggacgatctgccagcgtttaaccgcgaggcgttacgcctgctcggtgcctga

SEQ ID NO: 7424 - protein, 172 aa, Escherichia coli
MSKKIAVLITDEFEDSEFTSPADEFRKAGHEVITIEKQAGKTVKGKKGEASVAIDKSIDEVTPAEFDALLLPGGHSPDYLRGDNRFVTFTRDFVNSGKPVFAICHGPQLLISADVILGRKLTAVKPIVIDVKNAGAEFYDQEVVVDKDQLVTSRTPDDLPAFNREALRLLGA

SEQ ID NO: 7425 - DNA, 504 bp, Escherichia coli
atgctaattcgagtagaaattcccattgatgcgccgggtattgatgccctgctgcgtcgttcattcgaaagtgatgcggaagcgaagctggttcacgatctgcgtgaagatggctttctgacgctggggctggtggcgacagatgacgaaggtcaggtcattggctatgtggcatttagtccggttgatgtgcagggcgaagacctgcaatgggtcggcatggcaccgctggcggtagatgaaaaataccgtggacaggggctggcacgccaactggtctatgaaggactcgattcgcttaatgagttcggctatgccgcagtggtgacgctgggcgatccggcgctgtacagccgtttcggctttgaactggcggcacatcacgatctgcgttgccgctggccgggcactgaaagtgccttccaggtacatcgtttagcggatgacgcgctgaacggtgtaactggtctggttgagtatcacgagcacttcaatcgcttttaa

SEQ ID NO: 7426 - protein, 167 aa, Escherichia coli
MLIRVEIPIDAPGIDALLRRSFESDAEAKLVHDLREDGFLTLGLVATDDEGQVIGYVAFSPVDVQGEDLQWVGMAPLAVDEKYRGQGLARQLVYEGLDSLNEFGYAAVVTLGDPALYSRFGFELAAHHDLRCRWPGTESAFQVHRLADDALNGVTGLVEYHEHFNRF

SEQ ID NO: 7427 - DNA, 303 bp, Escherichia coli
atgacaccctggtttctttacttgatccgtaccgccgacaataagctttataccgggatcaccacggatgtcgaacgccgctatcagcagcaccaaagcggcaaaggggcgaaagcactgcgcgggaagggagaactaacgctggcgttttccgcaccagtgggcgatcgttcgctggcgttacgggcagaatatcgcgttaagcaactgaccaaacggcaaaaagagcgtctggtagcggaaggtgcagtgtttgcagaactgttgagcagcctgcaaaccccggagattaaaagcgattga

SEQ ID NO: 7428 - protein, 100 aa, Escherichia coli
MTPWFLYLIRTADNKLYTGITTDVERRYQQHQSGKGAKALRGKGELTLAFSAPVGDRSLALRAEYRVKQLTKRQKERLVAEGAVFAELLSSLQTPEIKSD

SEQ ID NO: 7429 - DNA, 525 bp, Escherichia coli
gtgttggataaactgcgttcccgtattgtgcatttggggccatctctgttgagtgtaccggtaaaactgacgccatttgcgctaaaacgccaggttcttgagcaggtcttaagctggcaattccgtcaggcgctggatgatggcgagctggagtttcttgaaggtcgctggttaagtattcatgtgcgtgatattgacctgcaatggtttacctcggtggtgaatggcaaactggtcgttagccagaacgcgcaagctgatgtgagttttagtgccgacgccagcgatctgctgatgattgcggcgcgtaaacaagatccggatacgctcttcttccagcgtcggctggtgattgaaggcgatacggagctggggctgtatgtgaaaaacctgatggacgccattgaactggagcaaatgccgaaagccttacgcatgatgctgctgcaactggcggattttgttgaggcgggaatgaaaaccgcgcctgaaaccaaacagacatcggtaggtgaaccatgctaa

SEQ ID NO: 7430 - protein, 174 aa, Escherichia coli
MLDKLRSRIVHLGPSLLSVPVKLTPFALKRQVLEQVLSWQFRQALDDGELEFLEGRWLSIHVRDIDLQWFTSVVNGKLVVSQNAQADVSFSADASDLLMIAARKQDPDTLFFQRRLVIEGDTELGLYVKNLMDAIELEQMPKALRMMLLQLADFVEAGMKTAPETKQTSVGEPC

SEQ ID NO: 7431 - DNA, 996 bp, Escherichia coli
atggagctgctctgccctgccggaaatctcccggcgcttaaggcggccatcgaaaacggcgcagatgctgtttatatcgggctaaaagatgataccaatgcccgtcacttcgccggccttaactttaccgagaaaaaattgcaggaagcggtgagttttgtccatcaacatcgccgcaaacttcacatcgcgattaacacttttgcgcatccggacggttacgcccgttggcagcgcgccgtggatatggcggcgcaactgggtgccgacgcgctgatactcgccgacctcgccatgctggagtacgccgccgagcgttatccgcatattgagcgccacgtatcggtgcaggcttcggcgaccaatgaagaggcgattaacttttatcatcgccattttgacgttgcccgcgtggtgctgccgcgcgtgttgtcgattcatcaggtgaaacaactggcacgggtcacacctgtaccactggaagtctttgctttcggcagcctgtgcattatgtcggaaggtcgttgctatctgtcgtcgtatttgacgggtgagtcgcccaacaccgtgggcgcgtgttctccggcccgtttcgtgcgctggcaacaaacgccgcaggggctggaatcccgcctgaacgaagtgctgatcgaccgttatcaggacggcgaaaacgcaggttatccgacgctatgtaaagggcgttatctggtgaacggcgagcgctatcatgcgctggaagaaccaaccagtctcaataccctggaactgctgccggagttaatggcggcgaatatcgcttcggtgaaaattgaaggccgccagcgtagcccggcgtatgtcagccaggtggcgaaagtctggcgtcaggctatcgaccgttgtaaggccgatccgcaaaacttcataccgcaaagcgcgtggatggagacgctcgggtcgatgtccgaaggcacgcagaccacccttggcgcatatcaccgtaaatggcagtga

SEQ ID NO: 7432 - protein, 331 aa, Escherichia coli
MELLCPAGNLPALKAAIENGADAVYIGLKDDTNARHFAGLNFTEKKLQEAVSFVHQHRRKLHIAINTFAHPDGYARWQRAVDMAAQLGADALILADLAMLEYAAERYPHIERHVSVQASATNEEAINFYHRHFDVARVVLPRVLSIHQVKQLARVTPVPLEVFAFGSLCIMSEGRCYLSSYLTGESPNTVGACSPARFVRWQQTPQGLESRLNEVLIDRYQDGENAGYPTLCKGRYLVNGERYHALEEPTSLNTLELLPELMAANIASVKIEGRQRSPAYVSQVAKVWRQAIDRCKADPQNFIPQSAWMETLGSMSEGTQTTLGAYHRKWQ

SEQ ID NO: 7433 - DNA, 879 bp, Escherichia coli
atgaaatattccttagggccagtgctgtggtactggccaaaagagacgctggaagaattttatcagcaggccgccgccagcagcgccgacgtgatttatcttggtgaagcggtatgcagcaagcgccgggcaaccaaagttggcgactggctggagatggcaaaatcactcgccggaagtggcaagcagattgtgctctccacgctggcgctggtgcaggcatcctccgaactgggcgaactgaaacgctatgttgagaacggtgagtttctgattgaagccagcgatctcggcgtggtgaatatgtgcgctgaacgcaaactgccgttcgtcgccgggcacgcgctgaactgctacaacgcggtgacgctgaaaatattgctcaaacagggcatgatgcgctggtgtatgccggtggagctttcccgcgactggctggtgaatctgcttaatcagtgcgatgagctgggcattcgtaaccagtttgaagtggaagtcttgagctacggtcatctgccgctggcctactctgctcgctgctttaccgcgcgttcggaagaccgcccgaaagatgagtgcgaaacctgctgcattaagtatccgaacgggcgcaacgtgctgtcgcaggaaaaccaacaagtgtttgtactcaacggcattcagaccatgagcggctacgtttacaacctcggtaacgagctggcatccatgcaggggctggtcgatgtggtccgcctgtcaccgcagggtactgacactttcgcaatgctcgacgccttccgcgccaatgaaaatggcgctgcaccactgccgttgacggcaaacagcgattgtaacggctactggcggcggctggccgggctggagctgcaagcgtaa

SEQ ID NO: 7434 - protein, 292 aa, Escherichia coli
MKYSLGPVLWYWPKETLEEFYQQAAASSADVIYLGEAVCSKRRATKVGDWLEMAKSLAGSGKQIVLSTLALVQASSELGELKRYVENGEFLIEASDLGVVNMCAERKLPFVAGHALNCYNAVTLKILLKQGMMRWCMPVELSRDWLVNLLNQCDELGIRNQFEVEVLSYGHLPLAYSARCFTARSEDRPKDECETCCIKYPNGRNVLSQENQQVFVLNGIQTMSGYVYNLGNELASMQGLVDVVRLSPQGTDTFAMLDAFRANENGAAPLPLTANSDCNGYWRRLAGLELQA

SEQ ID NO: 7435 - DNA, 1008 bp, Escherichia coli
atgactgataaaaccattgcgttttcgttactcgatctggcccccattcccgaaggttcttcagcgcgagatgcgttctcccactctctcgatctcgcccgtctggctgaaaagcgcggctatcatcgctactggctggcggaacaccacaatatgaccggcattgccagtgctgcaacgtcggtgttaattggctatctggcggcgaataccaccacgctgcatctggggtctggcggcgtgatgttgcctaaccactcaccattggtgatcgccgaacagttcggcacgctcaatacgctctatccggggcgaatcgatttggggctgggtcgtgcaccgggtagcgatcagcgaaccatgatggcgctgcgtcgtcatatgagcggcgatattgataatttcccccgcgatgtcgcggaactggtggactggtttgacgcccgcgatcccaatccgcatgtgcgcccggtaccaggctatggcgagaaaatccccgtgtggttgttaggctccagcctttacagcgcgcaactggcggcgcagcttggtctgccgtttgcgtttgcctcacacttcgcgccggatatgttgttccaggcgctgcatctttatcgcagcaacttcaaaccgtcggcacggttggagaaaccgtatgcgatggtgtgcatcaatattatcgccgccgacagcaaccgcgatgccgaattcctgtttacctcaatgcagcaagcctttgtgaagctgcgccgcggcgaaaccgggcaactgccgccaccgattcaaaatatggatcagttctggtcgccgtccgaacagtatggtgtgcagcaggcgctgagtatgtcgctggtgggcgataaagcgaaagtgcgtcatggcttgcagtcgatcctgcgcgaaaccgacgccgatgagattatggttaacgggcagattttcgaccaccaggcgcgcctgcattcgtttgaactggcgatggatgttaaggaagagttgttgggatag

SEQ ID NO: 7436 - protein, 335 aa, Escherichia coli
MTDKTIAFSLLDLAPIPEGSSARDAFSHSLDLARLAEKRGYHRYWLAEHHNMTGIASAATSVLIGYLAANTTTLHLGSGGVMLPNHSPLVIAEQFGTLNTLYPGRIDLGLGRAPGSDQRTMMALRRHMSGDIDNFPRDVAELVDWFDARDPNPHVRPVPGYGEKIPVWLLGSSLYSAQLAAQLGLPFAFASHFAPDMLFQALHLYRSNFKPSARLEKPYAMVCINIIAADSNRDAEFLFTSMQQAFVKLRRGETGQLPPPIQNMDQFWSPSEQYGVQQALSMSLVGDKAKVRHGLQSILRETDADEIMVNGQIFDHQARLHSFELAMDVKEELLG

SEQ ID NO: 7437 - DNA, 1245 bp, Escherichia coli
atggcaacactaaccaccacccaaacgtcaccgtcgctgcttggcggcgtggtgattatcggcggcaccattattggcgcagggatgttttctctgcctgtggtcatgtccggggcgtggttcttctggtcaatggcggcgctgatctttacctggttctgtatgctgcattccggcttgatgattctggaagctaacctgaattatcgaatcggttctagctttgacaccatcaccaaagatttgctgggcaaaggctggaacgtagtcaacggcatttccattgcctttgtgctctatatcctgacttacgcctatatttctgccagcggttcgattctgcatcacaccttcgcggagatgtcgctgaacgtccctgcacgggcagctggatttggttttgcactgctggtagcgttcgtggtgtggttgagtacgaaagctgtcagccggatgacagcaattgtgctgggggcgaaagtcattactttcttcctcaccttcggcagcctgctggggcatgtgcagcctgcgacattgttcaacgtcgccgaaagcaatgcgtcttatgcgccgtatctgctgatgacactgccattctgtctggcatcgtttggttatcacggtaacgtaccgagcctgatgaagtattacggcaaagatccgaaaaccatcgtgaaatgcctggtgtacggtacgctgatggcgctggcgctgtataccatctggttgctggcgacgatgggtaacatcccgcgtccggagtttatcggtatcgccgagaagggcggtaatattgatgtgctggtacaggcgttaagcggcgtactgaacagccgtagtctggatcttctactggtcgtgttctcaaactttgcggtagcgagttcgttccttggcgtaacgctgggtttgtttgactatctggcagatctgtttggttttgacgactcggctatgggccgtttgaaaacagcgttgctgacctttgccccgcctgttgtgggtggtctgctgtttcctaacggattcctgtacgccattggttatgctggcttagcggctaccatctgggcggcaattgttccggcgctgttggcccgcgcatcgcgtaaacgctttggtagcccgaaattccgtgtatggggcggcaagccgatgattatgctgattctggtatttggcgttggcaacgcactggtccatatcttatcgagctttaatgtgctgccggtgtatcagtaa

SEQ ID NO: 7438 - protein, 414 aa, Escherichia coli
MATLTTTQTSPSLLGGVVIIGGTIIGAGMFSLPVVMSGAWFFWSMAALIFTWFCMLHSGLMILEANLNYRIGSSFDTITKDLLGKGWNVVNGISIAFVLYILTYAYISASGSILHHTFAEMSLNVPARAAGFGFALLVAFVVWLSTKAVSRMTAIVLGAKVITFFLTFGSLLGHVQPATLFNVAESNASYAPYLLMTLPFCLASFGYHGNVPSLMKYYGKDPKTIVKCLVYGTLMALALYTIWLLATMGNIPRPEFIGIAEKGGNIDVLVQALSGVLNSRSLDLLLVVFSNFAVASSFLGVTLGLFDYLADLFGFDDSAMGRLKTALLTFAPPVVGGLLFPNGFLYAIGYAGLAATIWAAIVPALLARASRKRFGSPKFRVWGGKPMIMLILVFGVGNALVHILSSFNVLPVYQ

SEQ ID NO: 7439 - DNA, 1956 bp, Escherichia coli
ttgctgatcaatttcatgatgagttatgtagactggccgccattaattttgaggcacacgtactacatggctgaattcgaaaccacttttgcagatctgggcctgaaggctcctatccttgaagcccttaacgatctgggttacgaaaaaccatctccaattcaggcagagtgtattccacatctgctgaatggccgcgacgttctgggtatggcccagacggggagcggaaaaactgcagcattctctttacctctgctgcagaatcttgatcctgagctgaaagcaccacagattctggtgttggcaccgacccgcgaactggcggtacaggttgctgaggcaatgacggatttctctaaacacatgcgcggcgtaaacgtggttgccctgtacggcggccagcgttatgacgtgcaattacgcgccctgcgtcaggggccgcagattgttgtcggtactccgggccgtctgctggaccacctgaaacgtggcactctggacctctctaaattgagcggtctggttctggatgaagctgacgaaatgctgcgcatgggcttcatcgaagacgttgaaaccattatggcgcagatcccggaaggtcatcagaccgctctgttctctgcaaccatgccggaagcgattcgtcgcattacccgccgctttatgaaagagccgcaggaagtgcgcattcagtccagcgtgactacccgtcctgacatcagccagagctactggactgtctggggtatgcgtaaaaacgaagcactggtacgtttcctggaagcggaagattttgatgcggcgattatcttcgttcgtaccaaaaacgcgactctggaagtggcagaagctcttgagcgtaacggctacaacagcgccgcgctgaacggtgacatgaaccaggcgctgcgtgagcagacactggaacgcctgaaagatggtcgtctggacatcctgattgcgaccgacgttgcagcccgtggcctggacgttgagcgtatcagcctggtggttaactacgatatcccgatggattctgagtcttacgttcaccgtatcggtcgtaccggtcgtgcaggtcgtgctggtcgtgcactgctgttcgttgagaaccgtgagcgtcgtctgctgcgcaacatcgaacgcaccatgaagctgaccattccggaagtagaactgccgaacgcagaactgctgggcaaacgtcgtctggaaaaatttgccgctaaagtacagcagcagctggaaagcagcgatctggatcaataccgtgcactgctgagcaaaattcagccgactgccgaaggtgaagagctggatctcgaaactctggcagccgcactactgaaaatggcacagggtgaacgtactctgattgttccgccagatgcgccgatgcgtccgaaacgtgaattccgtgaccgtgatgaccgtggtccgcgcgatcgtaacgaccgtggcccgcgtggcgaccgtgaagatcgtccgcgtcgtgaacgtcgtgatgttggcgatatgcagctgtaccgtattgaagtgggccgcgatgatggtgttgaagttcgtcatatcgttggcgcgattgctaacgaaggtgacatcagcagccgttacatcggtaacatcaagctgtttgcttctcactccaccatcgaactgccgaaaggtatgccgggtgaagtgctgcaacactttacgcgtactcgcattctcaacaagccgatgaacatgcagttgctgggcgatgcacagccgcatactggtggtgagcgtcgtggcggtggtcgtggtttcggtggcgaacgtcgtgaaggcggtcgtaacttcagcggtgaacgccgtgaagggggtcgtggtgatgggcgtcgttttagcggcgaacgtcgtgaaggccgcgcaccgcgtcgtgatgactctaccggtcgtcgtcgtttcggtggtgatgcgtaa

SEQ ID NO: 7440 - protein, 651 aa, Escherichia coli
MLINFMMSYVDWPPLILRHTYYMAEFETTFADLGLKAPILEALNDLGYEKPSPIQAECIPHLLNGRDVLGMAQTGSGKTAAFSLPLLQNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERNGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLSKIQPTAEGEELDLETLAAALLKMAQGERTLIVPPDAPMRPKREFRDRDDRGPRDRNDRGPRGDREDRPRRERRDVGDMQLYRIEVGRDDGVEVRHIVGAIANEGDISSRYIGNIKLFASHSTIELPKGMPGEVLQHFTRTRILNKPMNMQLLGDAQPHTGGERRGGGRGFGGERREGGRNFSGERREGGRGDGRRFSGERREGRAPRRDDSTGRRRFGGDA

SEQ ID NO: 7441 - DNA, 885 bp, Escherichia coli
atgaagccttttttgcgctggtgtttcgttgcgacagcacttacgcttgcaggatgcagtaatacttcctggcgtaaaagtgaagttctcgcggtaccattgcaaccgactttacagcaggaagtgattctggcacgtatggaacagatccttgccagtcgggctttaaccgatgacgaacgcgcacagcttttatatgagcgcggagtgttgtatgatagtctcggtctgagggcattagcgcgtaacgatttttcgcaagcgctggcaatccgaccggatatgcctgaagtattcaattacttaggcatatatttaacgcaggcaggcaattttgatgctgcctatgaagcgtttgattctgtacttgagcttgatccaacttacaactacgcgcacttgaatcgcgggatcgcattatattacggcggtcgtgacaagttagcgcaagatgatctgctggcgttttatcaagacgatcccaatgatcctttccgtagtctgtggctttatctcgccgagcagaagctcgatgagaagcaggctaaagaagtgttgaaacagcacttcgaaaaatcggataaggaacagtggggatggaacattgtcgagttctacctgggcaacattagcgaacaaacgttaatggaaaggctcaaggcggacgcaacggataacacctcgctcgctgagcatctcagtgaaaccaacttctatttaggtaagtactacctaagtctgggggatttggacagcgccacggcactgttcaaactggcggttgccaacaacgttcataactttgttgagcaccgatacgcattgttggaattatcgctcctgggccaggaccaagatgacctggcagaatcggaccagcaatag

SEQ ID NO: 7442 - protein, 294 aa, Escherichia coli
MKPFLRWCFVATALTLAGCSNTSWRKSEVLAVPLQPTLQQEVILARMEQILASRALTDDERAQLLYERGVLYDSLGLRALARNDFSQALAIRPDMPEVFNYLGIYLTQAGNFDAAYEAFDSVLELDPTYNYAHLNRGIALYYGGRDKLAQDDLLAFYQDDPNDPFRSLWLYLAEQKLDEKQAKEVLKQHFEKSDKEQWGWNIVEFYLGNISEQTLMERLKADATDNTSLAEHLSETNFYLGKYYLSLGDLDSATALFKLAVANNVHNFVEHRYALLELSLLGQDQDDLAESDQQ

SEQ ID NO: 7443 - DNA, 2223 bp, Escherichia coli
ttgtcattagtcgcgaggatgcgcagaagatcgggtattaacaccagtaccgtaaggtactgtctaagaaagagaaaggatattacattgcttaatccgatcgttcgtaaattccagtacggccaacacaccgtgactctggaaaccggcatgatggctcgtcaggctactgccgctgttatggttagcatggatgacaccgcggtatttgttaccgttgttggtcagaaaaaagccaaaccaggtcaggacttcttcccgctgaccgttaactatcaggagcgtacctacgctgctggtcgtatcccgggtagcttcttccgtcgtgaaggccgcccaagcgaaggcgaaaccctgatcgcgcgtctgattgaccgcccgattcgcccgctgttcccggaaggcttcgtcaacgaagttcaggttatcgccaccgtggtttctgttaacccgcaagttaacccggatatcgtcgcgatgattggtgcttccgcagcactgtctctgtctggtattccgttcaatggtccgattggtgctgcccgcgtaggttacatcaatgaccagtacgtactgaacccgactcaggacgagttgaaagagagcaaactggatctggttgttgcgggtactgaagccgctgtactgatggttgaatctgaagctgaactgctgagcgaagaccagatgctgggcgcagtagtcttcggtcatgaacaacagcaggttgttattcagaacatcaatgaactggtgaaagaagccggtaaaccgcgttgggattggcagccggagccggtaaacgaagcgctgaacgcgcgcgttgctgcgctggctgaagctcgtctgagcgatgcttaccgcatcaccgacaaacaagagcgttatgcgcaggttgatgtcatcaaatctgaaaccatcgcgacactgcttgctgaagacgaaaccctggacgaaaacgaactgggtgaaattctgcacgctatcgagaaaaatgttgttcgtagccgcgtactggcaggcgaaccgcgtatcgacggtcgtgaaaaagatatgatccgtggtctggatgtgcgtactggtgtgctgccgcgtactcacggttctgcgctgttcacccgtggtgaaacgcaggcgctggttaccgcaacgctgggtactgctcgtgacgcgcaggttcttgatgaactgatgggcgaacgtaccgataccttcctgttccactacaacttccctccgtactccgtaggcgaaaccggcatggtcggttctccgaagcgtcgtgaaattggtcacggtcgtctggcgaagcgcggcgtgctggcagtaatgccggatatggacaaattcccgtacaccgtacgtgttgtgtctgaaattaccgaatccaacggttcctcttctatggcttccgtgtgcggcgcgtctctggcgctgatggacgcaggtgtgccaatcaaagctgccgttgcgggtatcgcaatgggtctggtgaaagaaggcgacaactacgttgtactgtctgacattttgggcgacgaagatcacctgggcgatatggacttcaaagttgcgggttcccgtgacggtatctctgcattgcagatggatatcaaaattgaaggtatcaccaaagagatcatgcaggttgcactgaaccaggctaaaggtgcgcgtctgcatatcctgggggtaatggaacaggcgatcaacgcgccgcgtggcgatatctctgagttcgcaccgcgtatccataccatcaagatcaacccggacaagatcaaagatgttatcggtaaaggcggttctgtaatccgtgctctgaccgaagaaaccggcaccaccatcgaaattgaagatgacggtactgtgaagattgcagcgaccgacggcgagaaagcgaaacacgcgattcgtcgtatcgaagagatcactgcagaaatcgaagtgggccgcgtctacaatggtaaagtgacccgtatcgttgactttggcgcatttgttgccattggtggcggtaaagaaggtctggtccacatctctcaaatcgctgataaacgcgttgagaaagtgaccgattacctgcagatgggtcaggaagtaccggtgaaagtgctggaagttgatcgccagggccgtatccgtctgagcattaaagaagcgactgagcagtctcaacctgctgcagcaccggaagctccggctgctgaacagggcgagtaa

SEQ ID NO: 7444 - protein, 740 aa, Escherichia coli
MSLVARMRRRSGINTSTVRYCLRKRKDITLLNPIVRKFQYGQHTVTLETGMMARQATAAVMVSMDDTAVFVTVVGQKKAKPGQDFFPLTVNYQERTYAAGRIPGSFFRREGRPSEGETLIARLIDRPIRPLFPEGFVNEVQVIATVVSVNPQVNPDIVAMIGASAALSLSGIPFNGPIGAARVGYINDQYVLNPTQDELKESKLDLVVAGTEAAVLMVESEAELLSEDQMLGAVVFGHEQQQVVIQNINELVKEAGKPRWDWQPEPVNEALNARVAALAEARLSDAYRITDKQERYAQVDVIKSETIATLLAEDETLDENELGEILHAIEKNVVRSRVLAGEPRIDGREKDMIRGLDVRTGVLPRTHGSALFTRGETQALVTATLGTARDAQVLDELMGERTDTFLFHYNFPPYSVGETGMVGSPKRREIGHGRLAKRGVLAVMPDMDKFPYTVRVVSEITESNGSSSMASVCGASLALMDAGVPIKAAVAGIAMGLVKEGDNYVVLSDILGDEDHLGDMDFKVAGSRDGISALQMDIKIEGITKEIMQVALNQAKGARLHILGVMEQAINAPRGDISEFAPRIHTIKINPDKIKDVIGKGGSVIRALTEETGTTIEIEDDGTVKIAATDGEKAKHAIRRIEEITAEIEVGRVYNGKVTRIVDFGAFVAIGGGKEGLVHISQIADKRVEKVTDYLQMGQEVPVKVLEVDRQGRIRLSIKEATEQSQPAAAPEAPAAEQGE

SEQ ID NO: 7445 - DNA, 270 bp, Escherichia coli
atgtctctaagtactgaagcaacagctaaaatcgtttctgagtttggtcgtgacgcaaacgacaccggttctaccgaagttcaggtagcactgctgactgcacagatcaaccacctgcagggccactttgcagagcacaaaaaagatcaccacagccgtcgtggtctgctgcgcatggtttctcagcgtcgtaaactgctcgactacctgaaacgtaaagacgtagcacgttacacccagctcatcgagcgcctgggtctgcgtcgctaa

SEQ ID NO: 7446 - protein, 89 aa, Escherichia coli
MSLSTEATAKIVSEFGRDANDTGSTEVQVALLTAQINHLQGHFAEHKKDHHSRRGLLRMVSQRRKLLDYLKRKDVARYTQLIERLGLRR

SEQ ID NO: 7447 - DNA, 945 bp, Escherichia coli
atgagtcgtcctcgtcgtcgcggtcgcgacattaacggcgttttgttgctggataaaccgcaggggatgtccagcaacgatgcgctgcaaaaagtgaaacggatttataacgccaaccgtgccgggcataccggtgcgctggacccgctggcgaccggcatgttgccaatttgcctcggggaagcgacgaagttttcccagtatctgctggactccgacaaacgctatcgggtcattgcgcgtcttggacagcgtaccgatacttctgatgccgacggacaaatcgttgaagaacgtccggtaacctttagtgcagagcaactggcggcggcgctggataccttccgtggcgatatcgaacagatcccttcgatgtattcagcactgaaatatcagggcaaaaaactgtacgaatacgcgcgtcagggcattgaagttccgcgtgaagcgcgcccgattaccgtttatgaattgctgtttattcgccatgaaggcaatgagctggagctggaaattcactgctcaaaaggcacttatatccgcactatcattgacgatctcggcgaaaaactcggttgtggcgcgcatgttatttacttgcgtcgtctggcggtaagtaaatatccggttgaacggatggtgaccctggaacatctgcgtgaactggttgagcaagccgaacagcaggatattccggctgcggagttacttgatccattactgatgccaatggacagtccagcttcggactacccagtggtgaatcttccgttaacgtcttctgtttacttcaaaaatggtaacccagttcgtacatccggtgcgccgctggaaggactggttcgcgttacagagggtgagaacggcaagtttatcggtatgggcgaaattgacgatgaaggccgcgttgcgcctcgtcgcctggtggttgaatacccggcgtaa

SEQ ID NO: 7448 - protein, 314 aa, Escherichia coli
MSRPRRRGRDINGVLLLDKPQGMSSNDALQKVKRIYNANRAGHTGALDPLATGMLPICLGEATKFSQYLLDSDKRYRVIARLGQRTDTSDADGQIVEERPVTFSAEQLAAALDTFRGDIEQIPSMYSALKYQGKKLYEYARQGIEVPREARPITVYELLFIRHEGNELELEIHCSKGTYIRTIIDDLGEKLGCGAHVIYLRRLAVSKYPVERMVTLEHLRELVEQAEQQDIPAAELLDPLLMPMDSPASDYPVVNLPLTSSVYFKNGNPVRTSGAPLEGLVRVTEGENGKFIGMGEIDDEGRVAPRRLVVEYPA

SEQ ID NO: 7449 - DNA, 402 bp, Escherichia coli
atggcgaaagaatttggtcgcccgcagcgcgtagcgcaggaaatgcaaaaagagatcgctctcatcctgcagcgtgaaattaaagatcctcgtctgggcatgatgaccaccgtttccggtgtcgaaatgtctcgcgacctggcgtatgccaaagtatatgtgacgttcctcaacgacaaagatgaagacgcggttaaagcgggcatcaaagcgttgcaggaagcttctggtttcatccgcagcctgctggggaaagcgatgcgcctgcgtatcgtgccggaactgaccttcttctacgacaactctctggttgaagggatgcgcatgtcaaacctggtgaccagcgtggtcaaacatgacgaagaacgtcgtgttaacccggacgacagcaaggaggactaa

SEQ ID NO: 7450 - protein, 133 aa, Escherichia coli
MAKEFGRPQRVAQEMQKEIALILQREIKDPRLGMMTTVSGVEMSRDLAYAKVYVTFLNDKDEDAVKAGIKALQEASGFIRSLLGKAMRLRIVPELTFFYDNSLVEGMRMSNLVTSVVKHDEERRVNPDDSKED

SEQ ID NO: 7451 - DNA, 2673 bp, Escherichia coli
atgacagatgtaacgattaaaacgctggctgcagagcgacagacctccgtggaacgcctggtacagcaatttgctgatgcaggtatccggaagtctgctgacgactctgtgtctgcacaagagaaacagactttgattgaccacctgaatcagaaaaattcaggcccggacaaattgacgctgcaacgtaaaacacgcagcacccttaacattcctggtaccggtggaaaaagcaaatcggtacaaatcgaagtccgcaagaaacgcacctttgtgaaacgcgatccgcaagaggctgagcgccttgcagcggaagagcaagcgcagcgtgaagcggaagagcaagcccgtcgtgaggcagaagaatcggctaaacgcgaggcgcaacaaaaagctgaacgtgaggccgcagaacaagctaagcgtgaagctgctgaacaagcgaaacgtgaagctgcggaaaaagacaaagtgagcaatcaacaagacgatatgactaaaaacgcccaggctgaaaaagcccgccgtgagcaggaagctgcagagctcaagcgtaaagccgaagaagaagcgcgtcgtaaactcgaagaagaagcacgtcgcgttgctgaagaagcacgtcgtatggcggaagaaaacaaatggactgataacgcggaaccgactgaagattccagcgattatcacgtcactacttctcaacatgctcgccaggcagaagacgaaagcgatcgtgaagtcgaaggcggccgtggccgtggtcgtaacgcgaaagcagcgcgtccgaagaaaggcaacaaacacgctgaatcaaaagctgatcgtgaagaagctcgcgcagcagtacgtggcggtaagggcggaaaacgtaaaggttcttcgctgcagcaaggcttccagaagccagctcaggccgttaaccgtgacgttgtgatcggcgaaaccatcaccgttggcgaactggcgaacaagatggcggttaaaggctctcaggtcatcaaagcgatgatgaaactgggcgcaatggcaaccatcaaccaggttatcgatcaggaaaccgcacagctggttgctgaagagatgggccacaaagttatcctgcgtcgtgaaaacgagctggaagaggcggtaatgagcgaccgtgacacgggtgctgcggctgaaccgcgcgcgccggttgtgaccatcatgggtcacgttgaccacggtaaaacctctctgctggactacattcgttcaacgaaagtggcctctggcgaagcgggcggcattacccagcacattggtgcataccacgttgaaactgaaaacggcatgatcaccttcctggacaccccggggcacgccgcgtttacttcaatgcgtgcacgtggtgcgcaggcaacggacatcgtagtcctggttgttgctgcagacgacggtgtaatgccgcagaccatcgaagctatccagcacgcgaaagcggcgggtgttccggtggtggttgctgtgaacaaaatcgataaaccagaagccgatccggatcgcgttaagaacgaactctcccagtacggcatcctgccagaagagtggggcggcgaaagccagttcgtacacgtatctgcaaaagcgggtaccggtattgatgaactgctggatgctatcctgctgcaggcggaagttctggagctgaaagcggtacgtaaaggtatggcgagcggtgcggttatcgaatccttcctcgataaaggtcgtggtccggttgctaccgttctggtacgtgaaggtactctgcacaagggcgatatcgttctgtgtggcttcgaatacggtcgtgttcgtgcaatgcgtaacgaactgggtcaggaagtgctggaagcgggtccgtccattccggtggaaatccttggcctgtccggcgtaccggctgcgggtgatgaagttaccgttgtacgtgacgagaagaaagcgcgtgaagttgcactctatcgtcagggtaaattccgcgaagttaaactggcgcgtcagcagaaatctaaactcgagaacatgttcgccaacatgaccgaaggcgaagttcacgaagtgaatattgtcctgaaggcagacgtacagggttctgtggaagcaatttccgactccttgctgaaactgtctactgacgaagttaaagtgaagatcatcggttctggcgtaggtggtatcaccgaaaccgacgctaccctggctgcggcgtccaacgccatcctggttggcttcaacgtacgtgctgatgcctctgcacgtaaagtgattgaagcggaaagcctggatctgcgttactactccgtcatctataacctgatcgacgaagtgaaagcggcgatgagcggtatgctgtctccggaactgaaacagcagattatcggtctggcggaagttcgtgacgtgttcaaatcaccgaaatttggtgctatcgcaggttgtatggttaccgaaggtgtggttaaacgtcacaacccgatccgcgttctgcgcgacaacgtggttatctacgaaggcgagctggagtccctgcgacgcttcaaagatgacgttaacgaagtccgtaacggtatggaatgtggtatcggcgttaagaactacaacgatgtccgcactggcgatgtgatcgaagtattcgaaatcatcgagatccaacgtactatcgcttaa

SEQ ID NO: 7452 - protein, 890 aa, Escherichia coli
MTDVTIKTLAAERQTSVERLVQQFADAGIRKSADDSVSAQEKQTLIDHLNQKNSGPDKLTLQRKTRSTLNIPGTGGKSKSVQIEVRKKRTFVKRDPQEAERLAAEEQAQREAEEQARREAEESAKREAQQKAEREAAEQAKREAAEQAKREAAEKDKVSNQQDDMTKNAQAEKARREQEAAELKRKAEEEARRKLEEEARRVAEEARRMAEENKWTDNAEPTEDSSDYHVTTSQHARQAEDESDREVEGGRGRGRNAKAARPKKGNKHAESKADREEARAAVRGGKGGKRKGSSLQQGFQKPAQAVNRDVVIGETITVGELANKMAVKGSQVIKAMMKLGAMATINQVIDQETAQLVAEEMGHKVILRRENELEEAVMSDRDTGAAAEPRAPVVTIMGHVDHGKTSLLDYIRSTKVASGEAGGITQHIGAYHVETENGMITFLDTPGHAAFTSMRARGAQATDIVVLVVAADDGVMPQTIEAIQHAKAAGVPVVVAVNKIDKPEADPDRVKNELSQYGILPEEWGGESQFVHVSAKAGTGIDELLDAILLQAEVLELKAVRKGMASGAVIESFLDKGRGPVATVLVREGTLHKGDIVLCGFEYGRVRAMRNELGQEVLEAGPSIPVEILGLSGVPAAGDEVTVVRDEKKAREVALYRQGKFREVKLARQQKSKLENMFANMTEGEVHEVNIVLKADVQGSVEAISDSLLKLSTDEVKVKIIGSGVGGITETDATLAAASNAILVGFNVRADASARKVIEAESLDLRYYSVIYNLIDEVKAAMSGMLSPELKQQIIGLAEVRDVFKSPKFGAIAGCMVTEGVVKRHNPIRVLRDNVVIYEGELESLRRFKDDVNEVRNGMECGIGVKNYNDVRTGDVIEVFEIIEIQRTIA

SEQ ID NO: 7453 - DNA, 1488 bp, Escherichia coli
atgaacaaagaaattttggctgtagttgaagccgtatccaatgaaaaggcgctacctcgcgagaagattttcgaagcattggaaagcgcgctggcgacagcaacaaagaaaaaatatgaacaagaaatcgacgttcgcgtacagatcgatcgcaaaagcggtgattttgacaccttccgtcgctggttagttgttgatgaagtcacccagccgaccaaggaaatcacccttgaagccgcacgttatgaagatgaaagcctgaacctgggcgattacgttgaagatcagattgagtctgttacctttgaccgtatcactacccagacggcaaaacaggttatcgtgcagaaagtgcgtgaagccgaacgtgcgatggtggttgatcagttccgtgaacacgaaggtgaaatcatcaccggcgtggtgaaaaaagtaaaccgcgacaacatctctctggatttgggcaacaacgctgaagccgtgatcctgcgcgaagatatgctgccgcgtgaaaacttccgccctggcgaccgcgttcgtggcgtgctctattccgttcgcccggaagcgcgtggcgcgcagctgttcgtcacccgctccaagccggaaatgctgatcgaactgttccgtattgaagtgccggaaatcggcgaagaagtgattgaaattaaagcagcggctcgcgacccgggatctcgtgcgaaaattgcggtgaaaaccaacgataaacgtatcgatccggtaggtgcttgcgtaggtatgcgtggcgcgcgtgttcaggcggtttctactgaactgggcggcgagcgtatcgatattgtcctgtgggatgataacccggcgcagtttgtgattaacgcaatggcaccggcagacgttgcttctatcgtggtggatgaagataaacacaccatggatatcgccgttgaagccggtaacctggcgcaggcgattggccgtaacggtcagaacgtgcgtctggcttcgcagctgagcggttgggaactcaacgtgatgaccgttgacgacctgcaggctaagcatcaggcggaagcgcacgcagcgatcgacaccttcaccaaatatctcgatatcgatgaagacttcgcgactgttctggtagaagaaggcttctcgacgctggaagaactggcctatgtgccgatgaaagagctgttggaaatcgaaggccttgatgagccgaccgttgaagcactgcgcgagcgtgctaaaaatgcactggccaccattgcacaggcccaggaagaaagcctcggtgataacaaaccggctgacgatctgctgaaccttgaaggggtagatcgtgatttggcattcaaactggccgcccgtggcgtttgtacgctggaagatctcgccgaacagggcattgatgatctggctgatatcgaagggttgaccgacgaaaaagccggagcactgattatggctgcccgtaatatttgctggttcggtgacgaagcgtaa

SEQ ID NO: 7454 - protein, 495 aa, Escherichia coli [sequence omitted]

SEQ ID NO: 7455 - DNA, 453 bp, Escherichia coli
ttgtccacattagagcaaaaattaacagagatgattactgcgccagttgaggccctgggttttgaactggttggcatcgaatttattcgcggtcgcacatccacactgcgcatctatattgatagtgaagatggcatcaatgttgatgattgtgctgatgtgagccaccaggtaagtgctgtgctggatgttgaagaccccatcaccgttgcttataacctggaagtctcctcaccgggtctcgatcgcccactgttcacggctgaacactacgcccgttttgtcggagaagaggtgactctggttctccgtatggcggtacaaaaccgtcgtaaatggcagggcgttatcaaagcggtagacggtgaaatgatcacagttaccgtcgaaggtaaagatgaagtgttcgcgctgagtaatatccagaaggcgaacctggttccccacttttaa

SEQ ID NO: 7456 - protein, 150 aa, Escherichia coli
MSTLEQKLTEMITAPVEALGFELVGIEFIRGRTSTLRIYIDSEDGINVDDCADVSHQVSAVLDVEDPITVAYNLEVSSPGLDRPLFTAEHYARFVGEEVTLVLRMAVQNRRKWQGVIKAVDGEMITVTVEGKDEVFALSNIQKANLVPHF

SEQ ID NO: 7457 - DNA, 1344 bp, Escherichia coli
atgacgacgattctcaagcatctcccggtaggtcaacgtattggtatcgctttttccggcggtctggacaccagtgccgcactgctgtggatgcgacaaaagggagctgttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccactggtggactgacctatttcaacacgacgccgctgggccgcgccgtgaccggcaccatgctggttgctgctatgaaagaagatggcgtgaatatctggggtgacggcagcacctataaaggaaacgatatcgaacgtttctaccgttacggtctgctgaccaatgctgaactgcagatttacaaaccgtggcttgatactgactttattgatgaactgggcggccgtcatgagatgtctgaatttatgattgcctgcggtttcgactacaaaatgtctgtcgaaaaagcttactccacggactccaacatgcttggtgcaacgcatgaagcgaaggatctggaatacctcaactccagcgtcaaaatcgtcaacccaattatgggcgtgaagttttgggatgagagcgtgaaaatcccggcagaagaagtcacagtacgctttgagcaaggtcatccggtggcgctgaacggtaaaacctttagcgacgacgtagaaatgttgctggaagctaaccgcatcggcggtcgtcacggcctgggcatgagcgaccagattgaaaaccgtatcatcgaagcgaaaagccgtggtatttacgaggctccggggatggcgctgctgcatatcgcttatgaacgtctgctgaccggtattcacaacgaagacaccatcgagcagtatcatgcacatggtcgtcagttgggccgtctgctgtaccaggggcgttggtttgattcccaggcgctgatgctgcgggactctctgcaacgctgggttgccagccagatcactggtgaagttactctggagctgcgccgcgggaacgattattcaatcctgaataccgtctcagagaacctgacctacaagccagagcgtctgacgatggaaaaaggcgactcggtgttctcgccagatgatcgtattggtcaattgaccatgcgtaatctggatatcactgatacccgagagaaactttttggttatgccaaaactggcctgctctcctcctctgccacttcaggcgtgccgcaggtggagaatctggaaaataaaggccagtaa

SEQ ID NO: 7458 - protein, 447 aa, Escherichia coli
MTTILKHLPVGQRIGIAFSGGLDTSAALLWMRQKGAVPYAYTANLGQPDEEDYDAIPRRAMEYGAENARLIDCRKQLVAEGIAAIQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEYLNSSVKIVNPIMGVKFWDESVKIPAEEVTVRFEQGHPVALNGKTFSDDVEMLLEANRIGGRHGLGMSDQIENRIIEAKSRGIYEAPGMALLHIAYERLLTGIHNEDTIEQYHAHGRQLGRLLYQGRWFDSQALMLRDSLQRWVASQITGEVTLELRRGNDYSILNTVSENLTYKPERLTMEKGDSVFSPDDRIGQLTMRNLDITDTREKLFGYAKTGLLSSSATSGVPQVENLENKGQ

SEQ ID NO: 7459 - DNA, 1659 bp, Escherichia coli
ttgtttatattggttgtgaacttggatttctggatgacagtattcaacaaatttgttagaagttttaaatctcattggttgttgtatctttgtgttattgtttttggtattacgaacttagtcgcctcttccggagcacatatggttcagcgattgctgtttttcgttctgaccatcctggttgttaaacgtatatcatcccttccgcttcgcctgcttattgccgtaccatttgtgttactgactgcggcagatatgagtattagcctctattcatggtgtatctttggtacaactttcaatgatggatttgcgattagtgtgctgcagagtgatccggatgaagttgtcaaaatgctgggaatgtatatcccttatctatgtgcttttgcctttttatcccttcttttttttgcagtaataataaaatatgatgtttccttgccgacaaaaaaagtgacaggaatattattgctgattgtcatttcgggcagtttattttccgcttgtcaatttgcttataaagatgcaaaaaataaagaggcgttcagtccatatatactagcgtcgcgatttgctacctatacgccgtttttcaatctcaattattttgctttagcagcgaaagagcatcaaagattactctcaattgcaaacacggtgccgtattttcaactatcagtcagggatacaggtattgatacctacgtgttgattgtgggggagtctgtacgtgtcgacaatatgtctttgtatggatatacacgctctacgacaccgcaagtcgaagcacaaagaaagcagatcaaactgtttaatcaagcaataagcggtgcaccttacactgcgctgtcggttcccctttctttaactgctgattctgttttgagtcatgacattcataattacccggacaacattattaatatggctaatcaagcaggatttcagactttctggctaagctcgcaatccgatttccggcagaatggtacagcagttaccagtatcgccatgcgcgccatggaaacagtctatgtcagaggatttgatgaattgttgttgccgcatttatcgcaagcgttacagcaaaagacgcagcaaaaaaaactgattgttcttcatttaaatggaagccatgaaccggcttgtagcgcctatccgcaatccagcgccgtgtttcaaccgcaggacgatcaggatgcctgctatgacaactccattcattacacagatagtttgctaggtcaggtttttgaattattaaaagatcgccgcgcctcggtcatgtattttgccgaccacggcctggaacgcgaccctacgaagaagaacgtctattttcatggaggtagggaggctagccagcaggcatatcatgtccctatgtttatctggtatagccccgttcttggggatggcgtggatcgcacaacggaaaacgatatcttttccactgcgtacaataattaccttattaatgcgtggatgggggtaacaaagccggaacagccgcaaacgctggaggaagtgattgcacactataaaggagactcacgggttgtagatgcaaaccatgatgttttcgattttgtgatgctaagaaaggaatttactgaggataagcaaggtaaccccacccctgaagggcagggttga

SEQ ID NO: 7460 - protein, 552 aa, Escherichia coli
MFILVVNLDFWMTVFNKFVRSFKSHWLLYLCVIVFGITNLVASSGAHMVQRLLFFVLTILVVKRISSLPLRLLIAVPFVLLTAADMSISLYSWCIFGTTFNDGFAISVLQSDPDEVVKMLGMYIPYLCAFAFLSLLFFAVIIKYDVSLPTKKVTGILLLIVISGSLFSACQFAYKDAKNKEAFSPYILASRFATYTPFFNLNYFALAAKEHQRLLSIANTVPYFQLSVRDTGIDTYVLIVGESVRVDNMSLYGYTRSTTPQVEAQRKQIKLFNQAISGAPYTALSVPLSLTADSVLSHDIHNYPDNIINMANQAGFQTFWLSSQSDFRQNGTAVTSIAMRAMETVYVRGFDELLLPHLSQALQQKTQQKKLIVLHLNGSHEPACSAYPQSSAVFQPQDDQDACYDNSIHYTDSLLGQVFELLKDRRASVMYFADHGLERDPTKKNVYFHGGREASQQAYHVPMFIWYSPVLGDGVDRTTENDIFSTAYNNYLINAWMGVTKPEQPQTLEEVIAHYKGDSRVVDANHDVFDFVMLRKEFTEDKQGNPTPEGQG

SEQ ID NO: 7461 - DNA, 381 bp, Escherichia coli
ttggttgaagcattggtacgcggcaactccgcaaggaacaggttgattatgtacgaagctcttttagtagttttccttattgtggcaattggccttgttggtctgatcatgctgcagcaaggtaaaggcgctgatatgggagcctccttcggagcaggcgcttccgctacgctgtttggttcaagtggttctggtaacttcatgacccgcatgacagcgctgctggcaacgttattcttcatcatcagtctggtgctgggtaacatcaatagcaacaaaaccaataaaggtagcgaatgggaaaacctgagtgcgccggcgaaaaccgaacaaactcagccagctgctccggctaagccgaccagcgatatcccgaactaa

SEQ ID NO: 7462 - protein, 126 aa, Escherichia coli
MVEALVRGNSARNRLIMYEALLVVFLIVAIGLVGLIMLQQGKGADMGASFGAGASATLFGSSGSGNFMTRMTALLATLFFIISLVLGNINSNKTNKGSEWENLSAPAKTEQTQPAAPAKPTSDIPN

SEQ ID NO: 7463 - DNA, 1338 bp, Escherichia coli
atgagtaatcgtaaatatttcggtaccgatgggattcgtggtcgtgtaggggatgcgccgatcacacctgattttgtgcttaagctgggttgggccgcgggtaaagtgctggcgcgccacggctcccgtaagattattattggtaaagacacgcgtatttctggctatatgctggagtcagcactggaagcggggcttgcggcagccggtctttccgcgctattcactggcccgatgccaacaccggccgtggcttatctgacgcgtaccttccgcgcagaggctggaattgtaatttctgcatcgcataacccattctacgataacggcattaaattcttttctattgacggtactaagctgccggatgcagttgaagaagccatcgaagcggaaatggaaaaagagatcagttgtgttgattcggcagaactgggtaaagccagccgtatcgttgatgccgcgggtcgttatatcgagttttgcaaagccacgttcccgaacgaacttagcctcagtgaactgaagattgtggtggattgtgcaaacggtgcgacttaccacatcgcgccgaacgtactgcgtgaactgggggcgaacgttatcgctatcggttgtgagccgaacggtgtaaatatcaatgccgaagtgggggctaccgacgttcgcgcgctccaggctcgtgtgctggctgaaaaagcggatctcggtattgccttcgacggcgacggcgatcgcgtgattatggttgaccatgaaggcaataaagtcgatggcgatcagatcatgtatatcatcgcgcgtgagggtcttcgtcagggccagctgcgtggaggtgctgtgggtacattgatgagcaacatggggcttgaactggcgctgaaacagttaggtattccatttgcgcgcgcgaaagtgggtgaccggtacgtactggaaaaaatgcaggagaaaggctggcgtatcggtgcagagaactccggtcatgtgatcctgctggataaaaccactaccggtgacggcattgttgctggcttgcaggtgctggcggcgatggcgcgtaaccatatgagcctgcacgacctttgcagcggcatgaaaatgttcccgcagattctggttaacgtgcgttacacagcaggcagcggcgatccgctggagcatgagtcagtcaaagctgtgaccgcagaagttgaagctgcgctgggtagccgtggacgtgtgctgttgcgtaaatccggcaccgaaccgttaattcgcgtgatggtggaaggcgaagacgaagcgcaggtgactgaatttgcacaccgcatcgccgatgcagtaaaagccgtttaa

SEQ ID NO: 7464 - protein, 445 aa, Escherichia coli
MSNRKYFGTDGIRGRVGDAPITPDFVLKLGWAAGKVLARHGSRKIIIGKDTRISGYMLESALEAGLAAAGLSALFTGPMPTPAVAYLTRTFRAEAGIVISASHNPFYDNGIKFFSIDGTKLPDAVEEAIEAEMEKEISCVDSAELGKASRIVDAAGRYIEFCKATFPNELSLSELKIVVDCANGATYHIAPNVLRELGANVIAIGCEPNGVNINAEVGATDVRALQARVLAEKADLGIAFDGDGDRVIMVDHEGNKVDGDQIMYIIAREGLRQGQLRGGAVGTLMSNMGLELALKQLGIPFARAKVGDRYVLEKMQEKGWRIGAENSGHVILLDKTTTGDGIVAGLQVLAAMARNHMSLHDLCSGMKMFPQILVNVRYTAGSGDPLEHESVKAVTAEVEAALGSRGRVLLRKSGTEPLIRVMVEGEDEAQVTEFAHRIADAVKAV

SEQ ID NO: 7465 - DNA, 915 bp, Escherichia coli
ttgtaccgaaaaccccggggcgtgctccggggttttttcttatcaattcataccagggataacatcatgaaactctttgcccagggtacttcactggaccttagccatcctcacgtaatggggatcctcaacgtcacgcctgattccttttcggatggtggcacgcataactcgctgttagatgcggtgaaacatgcgaatctgatgatcaacgctggcgcgacgatcattgacgttggtggcgagtccacgcgcccaggggcggcggaagttagcgttgaagaagagttgcaacgtgttattcctgtggttgaggcaattgctcaacgcttcgaagtctggatctcggtagatacatccaaaccagaagtcatccgtgagtcagcgaaagttggcgctcacattattaacgatatccgctccctttccgaacctggtgctctggaggcggctgcagaaaccggtttaccggtttgtctgatgcatatgcagggaaatccaaaaaccatgcaggaagcgccgaagtatgacgatgtctttgcagaagtgaatcgctactttattgagcaaatagcacgttgcgagcaggcgggtatcgcaaaagagaaattgttgctcgaccccggattcggtttcggtaaaaatctctcccataactattcattactggcgcgcctggctgaatttcaccatttcaacctgccgctgttggtgggtatgtcacgaaaatcgatgattgggcaattgctgaacgtggggccgtccgagcgcctgagcggtagtctggcctgtgcggtcattgccgcaatgcaaggcgcgcacatcattcgtgttcatgacgtcaaagaaaccgtagaagcgatgcgggtggtggaagccactctgtctgcaaaggaaaacaaacgctatgagtaa

SEQ ID NO: 7466 - protein, 304 aa, Escherichia coli
MYRKPRGVLRGFFLSIHTRDNIMKLFAQGTSLDLSHPHVMGILNVTPDSFSDGGTHNSLLDAVKHANLMINAGATIIDVGGESTRPGAAEVSVEEELQRVIPVVEAIAQRFEVWISVDTSKPEVIRESAKVGAHIINDIRSLSEPGALEAAAETGLPVCLMHMQGNPKTMQEAPKYDDVFAEVNRYFIEQIARCEQAGIAKEKLLLDPGFGFGKNLSHNYSLLARLAEFHHFNLPLLVGMSRKSMIGQLLNVGPSERLSGSLACAVIAAMQGAHIIRVHDVKETVEAMRVVEATLSAKENKRYE

SEQ ID NO: 7467 - DNA, 1707 bp, Escherichia coli
  n 9, 10, 11, 12, 13: n is any nucleotide
atggaatgnnnnntgttgaccaagaacgtcaaggttgtcggtgaaccgcctgaagaaccaagcctgctggcttctatcttcatctcctggttcccgatgctgttgctgattggtgtctggatcttcttcatgcgtcaaatgcagggcggcggtggcaaaggtgccatgtcgtttggtaagagcaaagcgcgcatgctgacggaagatcagatcaaaacgacctttgctgacgttgcgggctgcgacgaagcaaaagaagaagttgctgaactggttgagtatctgcgcgagccgagccgcttccagaaactcggcggtaagatcccgaaaggcgtcctgatggtcggtcctccgggtaccggtaaaacgctgctggcgaaagcgattgcaggcgaagcaaaagttccgttctttactatctccggttctgacttcgtagaaatgttcgtcggtgtgggtgcatcccgtgttcgtgatatgttcgaacaggcgaagaaagcggcaccgtgcatcatctttatcgatgaaatcgacgccgtaggccgccagcgtggcgcaggtctgggcggtggtcacgatgaacgtgaacagactttgaaccagatgctggttgagatggatggcttcgaaggtaacgaaggtatcatcgttatcgccgcgactaaccgtccggacgttcttgacccggccctgctgcgtcctggccgtttcgaccgtcaggttgtggttggcttgccagatgttcgtggtcgtgagcagatcctgaaagttcacatgcgtcgcgtaccattggcacccgatatcgacgcggcaatcattgcccgtggtactcctggtttctccggtgctgacctggcgaacctggtgaacgaagcggcactgttcgcagctcgtggcaataaacgcgttgtgtcgatggttgagttcgagaaagcgaaagacaaaatcatgatgggagcggaacgtcgctccatggtgatgacggaagcgcagaaagaatcgacggcttaccacgaagcaggccatgcgattatcggtcgcctggtgccggaacacgatccggtgcacaaagtgacgattatcccacgcggtcgtgcgctgggtgtgactttcttcttgcctgagggcgacgcaatcagcgccagccgtcagaaactggaaagccagatttctacgctgtacggtggtcgtctggcagaagagatcatctacgggccggaacatgtttctaccggtgcgtccaacgatattaaagttgcgaccaacctggcacgtaacatggtgactcagtggggcttctctgagaaattgggtccactgctgtacgcggaagaagaaggtgaagtgttcctcggccgtagcgtagcgaaagcgaaacatatgtccgatgaaactgcacgtatcatcgaccaggaagtgaaagcactgattgagcgtaactataatcgtgcgcgtcagcttctgaccgacaatatggatattctgcatgcgatgaaagatgctctcatgaaatatgagactatcgacgcaccgcagattgatgacctgatggcacgtcgcgatgtacgtccgccagcgggctgggaagaaccaggcgcttctaacaattctggcgacaatggtagtccaaaggctcctcgtccggttgatgaaccgcgtacgccgaacccgggtaacaccatgtcagagcagttaggcgacaagtaa

SEQ ID NO: 7468 - protein, 568 aa, Escherichia coli
  Xaa 3, 4, 5: Xaa is any amino acid
MEXXXLTKNVKVVGEPPEEPSLLASIFISWFPMLLLIGVWIFFMRQMQGGGGKGAMSFGKSKARMLTEDQIKTTFADVAGCDEAKEEVAELVEYLREPSRFQKLGGKIPKGVLMVGPPGTGKTLLAKAIAGEAKVPFFTISGSDFVEMFVGVGASRVRDMFEQAKKAAPCIIFIDEIDAVGRQRGAGLGGGHDEREQTLNQMLVEMDGFEGNEGIIVIAATNRPDVLDPALLRPGRFDRQVVVGLPDVRGREQILKVHMRRVPLAPDIDAAIIARGTPGFSGADLANLVNEAALFAARGNKRVVSMVEFEKAKDKIMMGAERRSMVMTEAQKESTAYHEAGHAIIGRLVPEHDPVHKVTIIPRGRALGVTFFLPEGDAISASRQKLESQISTLYGGRLAEEIIYGPEHVSTGASNDIKVATNLARNMVTQWGFSEKLGPLLYAEEEGEVFLGRSVAKAKHMSDETARIIDQEVKALIERNYNRARQLLTDNMDILHAMKDALMKYETIDAPQIDDLMARRDVRPPAGWEEPGASNNSGDNGSPKAPRPVDEPRTPNPGNTMSEQLGDK

SEQ ID NO: 7469 - DNA, 630 bp, Escherichia coli
atgacaggtaagaagcgttctgccagctccagccgctggcttcaggaacactttagcgataaatatgttcaacaggcacagaaaaaggggttacgttcccgtgcctggtttaaacttgatgaaatacagcaaagtgacaaactctttaaaccgggaatgacggttgtcgaccttggtgctgctccgggtggttggtcacaatatgtggtcacccaaattggcggcaaaggccgcatcatcgcttgcgatcttttacctatggatcctatcgttggtgtggactttcttcagggcgattttcgtgatgaactggtgatgaaagcactgctggagcgcgttggcgacagcaaagtccaggttgtcatgtccgatatggcaccaaacatgagcggaacaccggcggtggatatcccccgtgccatgtatctggtggaactggcgctagaaatgtgtcgtgatgtattagcgccaggtggcagttttgtagtgaaggtgttccagggcgaaggtttcgatgagtatctaagggaaattcgctccctgtttacgaaggtcaaagttcgtaagccggactcttctcgtgcacgttcgcgggaagtgtatattgtagcgaccgggcgtaaaccctaa

SEQ ID NO: 7470 - protein, 209 aa, Escherichia coli
MTGKKRSASSSRWLQEHFSDKYVQQAQKKGLRSRAWFKLDEIQQSDKLFKPGMTVVDLGAAPGGWSQYVVTQIGGKGRIIACDLLPMDPIVGVDFLQGDFRDELVMKALLERVGDSKVQVVMSDMAPNMSGTPAVDIPRAMYLVELALEMCRDVLAPGGSFVVKVFQGEGFDEYLREIRSLFTKVKVRKPDSSRARSREVYIVATGRKP

SEQ ID NO: 7471 - DNA, 294 bp, Escherichia coli
atgaatctgagtactaaacaaaaacagcacctgaaaggtctggcacatccgctcaagccagttgttctgcttggcagtaatggtttgaccgaaggggtgctggccgagattgaacaagcgttagagcaccatgaactcatcaaggtgaaaatcgccaccgaagatcgcgaaactaaaaccttgatcgtggaagctatcgtgcgcgaaaccggcgcctgtaatgtacaggtcatcggtaaaacgctggtgctttatcgcccaactaaagaacgtaaaatctcgctgccacgctaa

SEQ ID NO: 7472 - protein, 97 aa, Escherichia coli
MNLSTKQKQHLKGLAHPLKPVVLLGSNGLTEGVLAEIEQALEHHELIKVKIATEDRETKTLIVEAIVRETGACNVQVIGKTLVLYRPTKERKISLPR

SEQ ID NO: 7473 - DNA, 477 bp, Escherichia coli
atgcaagctattccgatgaccttacgcggcgctgaaaaattacgcgaagagctggattttctgaaatctgtgcgccgtcctgaaatcattgctgctatcgcggaagcgcgtgagcatggcgacctgaaagaaaacgccgaataccacgcagctcgtgaacagcagggcttttgcgaaggccgtatcaaagacatcgaagccaagctgtcgaacgcgcaggtgattgatgtcaccaaaatgcccaacaatgggcgcgttatttttggtgctaccgtaacggtgctgaatctcgattctgacgaagaacagacttatcgcatcgttggcgatgacgaagctgactttaaacaaaacctgatttctgtaaactcgcctattgctcgtggcctgatcggcaaagaagaagatgatgttgtggtcatcaaaacgccgggcggcgaagtagaatttgaagtaattaaggtggaatacctgtaa

SEQ ID NO: 7474 - protein, 158 aa, Escherichia coli
MQAIPMTLRGAEKLREELDFLKSVRRPEIIAAIAEAREHGDLKENAEYHAAREQQGFCEGRIKDIEAKLSNAQVIDVTKMPNNGRVIFGATVTVLNLDSDEEQTYRIVGDDEADFKQNLISVNSPIARGLIGKEEDDVVVIKTPGGEVEFEVIKVEYL

SEQ ID NO: 7475 - DNA, 1434 bp, Escherichia coli
atgcgattttccagatttatcatcggattgaccagctgtatagcgttcagtgttcaggccgcaaatgttgatgagtacattactcaactccccgctggtgccaaccttgccctgatggtgcaaaaagtcggcgcgtcggcccccgctattgattaccacagtcagcagatggcgctgcccgccagtacgcagaaagtgattactgcactggcggcgttgattcaactcggccccgattttcgttttaccacgacgcttgaaaccaaaggcaatgtggaaaacggcgtacttaagggtgacttagtggcgcgatttggtgccgatccgacgttaagacgtcaggatattcgcaatatggtcgcgactttgaaaaaatctggcgtcaaccaaatcgatggcaatgtgttgatagatacctccattttcgccagccacgataaagcccccggctggccatggaatgacatgacacaatgctttagcgctccgcctgccgccgccatagttgaccgcaactgtttctccatctcgctctacagtgccccaaaacctggtgatatggcttttatacgcgtggcatcttattaccccgttacgatgttcagccaggtacgcaccctcccccgtggttctgccgaagcgcaatattgcgagctggatgtggtgccaggcgacctgaaccgctttacgctgaccggatgcctgccacaacgttctgagccgctcccgttggcttttgccgtgcaggatggagccagctatgccggtgcaattctgaaagatgagttaaaacaggcaggtatcacctggagcggaacactgctgcgtcagacgcaggttaacgaacccggaacggtagttgccagtaaacagtcggccccgctgcacgatctgcttaagattatgctgaaaaagtcggacaacatgattgccgatacggttttccgcatgatcggccatgcgcgcttcaatgtgcctggaacatggcgggcaggatcggacgccgtgcgtcagatcctgcgccagcaagccggtgtcgatatcggaaacaccattattgccgatggttcagggctttcgcggcataacctgattgcccccgccaccatgatgcaggtgctgcaatatattgcccaacacgacaatgaacttaactttatctccatgctgccgctggcgggctatgacggctctttgcagtaccgtgcaggtctgcatcaggcgggcgtggatggaaaagtctcagcgaaaaccggttcgttgcagggggtatataacctggcgggattcattaccacagtgagcgggcaacgaatggcgtttgtgcaatatctttctggctatgcagtagaaccggcggatcagcgtaatcgccgtattccgttagtgcgttttgaaagccgtttgtataaagatatttatcagaataattag

SEQ ID NO: 7476 - protein, 477 aa, Escherichia coli
MRFSRFIIGLTSCIAFSVQAANVDEYITQLPAGANLALMVQKVGASAPAIDYHSQQMALPASTQKVITALAALIQLGPDFRFTTTLETKGNVENGVLKGDLVARFGADPTLRRQDIRNMVATLKKSGVNQIDGNVLIDTSIFASHDKAPGWPWNDMTQCFSAPPAAAIVDRNCFSISLYSAPKPGDMAFIRVASYYPVTMFSQVRTLPRGSAEAQYCELDVVPGDLNRFTLTGCLPQRSEPLPLAFAVQDGASYAGAILKDELKQAGITWSGTLLRQTQVNEPGTVVASKQSAPLHDLLKIMLKKSDNMIADTVFRMIGHARFNVPGTWRAGSDAVRQILRQQAGVDIGNTIIADGSGLSRHNLIAPATMMQVLQYIAQHDNELNFISMLPLAGYDGSLQYRAGLHQAGVDGKVSAKTGSLQGVYNLAGFITTVSGQRMAFVQYLSGYAVEPADQRNRRIPLVRFESRLYKDIYQNN

SEQ ID NO: 7477 - DNA, 450 bp, Escherichia coli
ttgcacctcatcgatatcgatccgattgacggcaccgatccggttgaaaacgcgcgtattattatcagtgagctggaaaaatacagccaagatctggcggcgaaaccgcgttggttagtcttcaacaagatcgatctgctggataaggtagaagccgaagagaaagcgaaagcgatcgctgaagcgctgggctgggaagataaatattatctgatctctgcggcgagcggactgggcgtgaaagatctctgctgggatgtgatgacctttatcattgaaaacccggtcgtgcaggctgaagaagcgaaacagccagagaaagtcgaattcatgtgggatgattatcaccgtcagcagcttgaagagattgctgaagaggatgatgaggactgggatgacgactgggacgaagacgacgaagaaggcgttgagttcatttacaagcgttaa

SEQ ID NO: 7478 - protein, 149 aa, Escherichia coli
MHLIDIDPIDGTDPVENARIIISELEKYSQDLAAKPRWLVFNKIDLLDKVEAEEKAKAIAEALGWEDKYYLISAASGLGVKDLCWDVMTFIIENPVVQAEEAKQPEKVEFMWDDYHRQQLEEIAEEDDEDWDDDWDEDDEEGVEFIYKR

SEQ ID NO: 7479 - DNA, 696 bp, Escherichia coli
atgaagtttgttgatgaggcatcgattctggtcgttgcaggtgatggcggtaatggttgcgtgagcttccgccgcgaaaagtatattccgaaaggcggcccggatggcggcgacggcggtgatggtggtgacgtatggatggaagccgacgagaacctgaacacgcttatcgattatcgttttgaaaaatctttccgtgcagagcgcggtcagaacggtgcaagccgagactgtaccggtaagcgcggtaaagacgtcacgattaaagtaccggtaggtacgcgtgtaatcgaccagggtaccggtgaaaccatgggcgatatgaccaaacacggtcagcgtctgctggttgctaagggcggctggcacggtctgggcaatacccgtttcaagtcgtcagttaaccgtacaccacggcagaaaactaacggtacgccgggcgataagcgtgagctgctgctggagctgatgctgctggctgacgtcggtatgttggggatgccaaacgcgggtaaatcgacctttattcgtgcggtatcggcggctaaaccgaaagtggcggattatccgtttaccactctggtaccaagcctgggcgtggtgcgtatggacaacgaaaagagcttcgttgttgccgatattccaggactgattgargcgctgcagaaggcgcasgtctgggcattcgcttcctga

SEQ ID NO: 7480 - protein, 231 aa, Escherichia coli
  Xaa 225: Xaa is any amino acid
MKFVDEASILVVAGDGGNGCVSFRREKYIPKGGPDGGDGGDGGDVWMEADENLNTLIDYRFEKSFRAERGQNGASRDCTGKRGKDVTIKVPVGTRVIDQGTGETMGDMTKHGQRLLVAKGGWHGLGNTRFKSSVNRTPRQKTNGTPGDKRELLLELMLLADVGMLGMPNAGKSTFIRAVSAAKPKVADYPFTTLVPSLGVVRMDNEKSFVVADIPGLIEALQKAXVWAFAS

SEQ ID NO: 7481 - DNA, 546 bp, Escherichia coli
atgttttttaacaccagtctggtcgagatatttacaaagctcaccgattacacctggggagttatctttggggtcggtgcggcgacggtttgggtgagttatggcgtggcgcaaaaggttttattgcgtcggctggcctcaccgcagatcctgtttttactgtacactttatgtacaattgcgctcttccctctggcaaatcctggagtgatagcgcagcttagccactggcagctcgcatgtttaattttttgcggactgaatacattggtaggatatggcgccctggcggaagcgatggctcgctggcaggcagcgcaggtgagcgcgatcatcacgctcaccccactgtttacgctgtttttttcagatcttttatcactggcctggcccgatttcttcgccagaccgatgttaaaccttttaggttatctcggtgcgtttgtcgtggttgcgggcgcgatgtattccgccattggtcatcgtatttggggcggattacgtaagcatacaacggtggtatcgcaaccccgcgcaggcgaatga

SEQ ID NO: 7482 - protein, 181 aa, Escherichia coli
MFFNTSLVEIFTKLTDYTWGVIFGVGAATVWVSYGVAQKVLLRRLASPQILFLLYTLCTIALFPLANPGVIAQLSHWQLACLIFCGLNTLVGYGALAEAMARWQAAQVSAIITLTPLFTLFFSDLLSLAWPDFFARPMLNLLGYLGAFVVVAGAMYSAIGHRIWGGLRKHTTVVSQPRAGE

SEQ ID NO: 7483 - DNA, 309 bp, Escherichia coli
atgaagcagcaggcaggcattggcattcttttggcgctcaccacagcaatttgctggggggcgttgccaatcgcaatgaagcaggtgctggaggtgatggaacctccgacaatcgtgttttaccgtttcttgatggcgagtattggccttggtgccattcttgcggtgaagaagcggttgccgccattacgcgtgtttcgtaagccacgctggttgattttgttagcagtggcgaccgccgggctgtttgggaacttcatcctgttcagctcatccttgcaatacctgagtccgaccgcttcgcagtaa

SEQ ID NO: 7484 - protein, 102 aa, Escherichia coli
MKQQAGIGILLALTTAICWGALPIAMKQVLEVMEPPTIVFYRFLMASIGLGAILAVKKRLPPLRVFRKPRWLILLAVATAGLFGNFILFSSSLQYLSPTASQ

SEQ ID NO: 7485 - DNA, 258 bp, Escherichia coli
atggcacataaaaaggctggcggctccacacgtaacggtcgcgattcagaagctaaacgcttgggcgttaagcgtttcggtggcgaatccgttctggcgggtagcatcatcgttcgtcaacgtggtaccaaattccacgctggcgctaacgtaggttgcggtcgtgaccacactctgtttgctaaagcagacggtaaagtgaaattcgaagttaaaggcccgaaaaaccgtaaatttatcagcatcgaagctgaataa

SEQ ID NO: 7486 - protein, 85 aa, Escherichia coli
MAHKKAGGSTRNGRDSEAKRLGVKRFGGESVLAGSIIVRQRGTKFHAGANVGCGRDHTLFAKADGKVKFEVKGPKNRKFISIEAE

SEQ ID NO: 7487 - DNA, 111 bp, Escherichia coli
  n 9, 10, 11, 12, 13: n is any nucleotide
atggaatgnnnnnttaaaatcgttaagtttcgtcgtcgtaaacactatcgtaagcagcagggccatcgtcagtggttcactgatgtgaaaattactggcatcagcgcctaa

SEQ ID NO: 7488 - protein, 36 aa, Escherichia coli
  Xaa 3, 4, 5: Xaa is any amino acid
MEXXXKIVKFRRRKHYRKQQGHRQWFTDVKITGISA

SEQ ID NO: 7489 - DNA, 153 bp, Escherichia coli
  n 126, 127, 128, 129, 130: n is any nucleotide
gtgccatttgaaatctctcctcaggtcttaggcgctgatgccagtaattttcacatcagtgaaccactgacgatggccctgctgcttacgatagtgtttacgacgacgaaacttaacgattttaannnnncattccattcattaattaattaa

SEQ ID NO: 7490 - protein, 50 aa, Escherichia coli
  Xaa 42, 43, 44: Xaa is any amino acid
MPFEISPQVLGADASNFHISEPLTMALLLTIVFTTTKLNDFXXXFHSLIN

SEQ ID NO: 7491 - DNA, 309 bp, Escherichia coli; identical to SEQ ID NO: 7483

SEQ ID NO: 7492 - protein, 102 aa, Escherichia coli; identical to SEQ ID NO: 7484

SEQ ID NO: 7493 - DNA, 258 bp, Escherichia coli; identical to SEQ ID NO: 7485

SEQ ID NO: 7494 - protein, 85 aa, Escherichia coli; identical to SEQ ID NO: 7486

SEQ ID NO: 7495 - DNA, 111 bp, Escherichia coli; identical to SEQ ID NO: 7487
  n 9, 10, 11, 12, 13: n is any nucleotide

SEQ ID NO: 7496 - protein, 36 aa, Escherichia coli; identical to SEQ ID NO: 7488
  Xaa 3, 4, 5: Xaa is any amino acid

SEQ ID NO: 7497 - DNA, 177 bp, Escherichia coli
  n 155, 156, 157, 158, 159: n is any nucleotide
gtgtgcgcggaagcggagttttatatgtacgcggttttccaaagtggtggtaaacaacaccgagtaagcgaaggtcagaccgttcgcctggaaaagctggacatcgcaactggcgaaactgttgagttcgctgaagtgctgatgatcgcaaacgnnnnncattcattcattaattaa

SEQ ID NO: 7498 - protein, 58 aa, Escherichia coli
  Xaa 52, 53: Xaa is any amino acid
MCAEAEFYMYAVFQSGGKQHRVSEGQTVRLEKLDIATGETVEFAEVLMIANXXHSFIN

SEQ ID NO: 7499 - DNA, 153 bp, Escherichia coli; identical to SEQ ID NO: 7489
  n 126, 127, 128, 129, 130: n is any nucleotide

SEQ ID NO: 7500 - protein, 50 aa, Escherichia coli; identical to SEQ ID NO: 7490
  Xaa 42, 43, 44: Xaa is any amino acid

SEQ ID NO: 7501 - DNA, 972 bp, Escherichia coli
atgaatttagaaaaaatcaatgagttaaccgcgcaagatatggcgggtgttaatgcggcaatccttgagcagcttaattccgacgtccaactgatcaatcagttaggctattacatcgtcagcggcggcggtaaacgtattcgtccgatgattgctgtactggctgcacgagctgttggctatgagggaaatgcgcatgtcaccattgctgccctgatcgagtttatccacacggcgactctgctacacgacgacgttgtggatgaatcagatatgcgcaggggtaaagctaccgccaacgccgcatttggcaatgccgccagcgtgctggtaggcgattttatttatacccgcgcgttccagatgatgaccagcctcggttcactcaaagtgctggaagtcatgtcagaagccgtaaacgtcatcgcagaaggtgaagttctgcaactgatgaacgttaacgatccggacatcactgaagaaaactacatgcgcgttatctacagcaagactgcgcgtctgtttgaggctgccgcgcagtgttccgggattctagctggctgtacgccggaggaggagaaaggcctacaagattatgggcgctatctcggcactgctttccagttgatcgacgatttactcgattacaatgccgatggcgaacagttaggtaaaaacgtcggcgacgatctgaacgaaggtaaaccgacgctgccgctgctgcatgcgatgcatcatggcacaccagaacaggcacagatgattcgtaccgccatcgaacagggtaacggtcgccatcttctggaaccggttctggaagcaatgaacgcttgtggatctcttgaatggacgcgtcagcgtgccgaggaagaagcagacaaagccatcgcagcgttacaggtgctcccggacaccccgtggagagaagcactcgtcggcctcgcgcacatcgctgttcaacgcgatcgttaa

SEQ ID NO: 7502 - protein, 323 aa, Escherichia coli
MNLEKINELTAQDMAGVNAAILEQLNSDVQLINQLGYYIVSGGGKRIRPMIAVLAARAVGYEGNAHVTIAALIEFIHTATLLHDDVVDESDMRRGKATANAAFGNAASVLVGDFIYTRAFQMMTSLGSLKVLEVMSEAVNVIAEGEVLQLMNVNDPDITEENYMRVIYSKTARLFEAAAQCSGILAGCTPEEEKGLQDYGRYLGTAFQLIDDLLDYNADGEQLGKNVGDDLNEGKPTLPLLHAMHHGTPEQAQMIRTAIEQGNGRHLLEPVLEAMNACGSLEWTRQRAEEEADKAIAALQVLPDTPWREALVGLAHIAVQRDR

SEQ ID NO: 7503 - DNA, 279 bp, Escherichia coli
atggaaagtaatttcattgactggcatcccgctgacatcattgcaggtttgcgcaagaaggaaacgtcaatggcggcggagtctcgcagaaatggtttgagttcctcaacgctggcgaacgcattatcacgcccatggccgaaaggagagatgattattgcgaaagccctgggaactgacccctgggttatctggccatcacgctaccatgatccgcagacccatgagtttatcgacagaacgcaattgatgcgtagctacactaaaccgaaaaaatga

SEQ ID NO: 7504 - protein, 92 aa, Escherichia coli
MESNFIDWHPADIIAGLRKKETSMAAESRRNGLSSSTLANALSRPWPKGEMIIAKALGTDPWVIWPSRYHDPQTHEFIDRTQLMRSYTKPKK

SEQ ID NO: 7505 - DNA, 1260 bp, Escherichia coli
atggataaatttcgtgttcaggggccaacgaagctccagggcgaagtcacaatttccggcgctaaaaatgctgctctgcctatcctttttgccgcactactggcggaagaaccggtagagatccagaacgtcccgaaactaaaagacgtcgatacatcaatgaagctgctaagccagctgggtgcgaaagtagaacgtaatggttctgtgcatattgatgcccgcgacgttaatgtattctgcgcaccttacgatctggttaaaaccatgcgtgcttctatctgggcgctggggccgctggtagcgcgctttggtcaggggcaagtttcactgcctggcggttgtacgatcggcgcacgtccggttgatctacacatttctggcctcgaacaattaggcgcgaccatcaaactggaagaaggttacgttaaagcttccgtcgatggtcgtttgaaaggcgcacatatcgtgatggataaagtcagcgttggcgcaacggtgaccatcatgtgtgctgcaacccttgcggaaggcaccacgattattgaaaacgcagcgcgtgaaccggaaatcgtcgataccgcgaacttcctgattacgctgggtgcgaaaattagcggtcagggcaccgatcgtatcgtcatcgaaggtgtggaacgtttaggcggcggtgtctatcgcgtgctgccggatcgtatcgaaaccggtactttcctggtggcggcggcgatctctcgcggcaaaattatctgccgtaacgcgcagccagatactctggacgccgtgctggcgaaactgcgtgacgctggagcggacatcgaagtcggcgaagactggattagcctggatatgcatggcaaacgtccgaaggctgttaacgtacgtaccgcgccgcatccggcattccctaccgatatgcaggcccagttcacgctgttgaacctggtggcagaagggaccggattcatcaccgaaacggtctttgaaaaccgctttatgcatgtgccagagctgagccgtatgggcgcgcacgccgaaatcgaaagcaataccgttatttgtcacggtgttgaaaaactttctggcgcacaggttatggcaaccgatctgcgtgcatcagcaagcctggtgctggctggctgtattgcggaagggacgacggtggttgatcgtatttatcacatcgatcgtggctacgaacgcattgaagacaaactacgcgctttaggtgcaaatattgagcgtgtgaaaggcgagtaa

SEQ ID NO: 7506 - protein, 419 aa, Escherichia coli
MDKFRVQGPTKLQGEVTISGAKNAALPILFAALLAEEPVEIQNVPKLKDVDTSMKLLSQLGAKVERNGSVHIDARDVNVFCAPYDLVKTMRASIWALGPLVARFGQGQVSLPGGCTIGARPVDLHISGLEQLGATIKLEEGYVKASVDGRLKGAHIVMDKVSVGATVTIMCAATLAEGTTIIENAAREPEIVDTANFLITLGAKISGQGTDRIVIEGVERLGGGVYRVLPDRIETGTFLVAAAISRGKIICRNAQPDTLDAVLAKLRDAGADIEVGEDWISLDMHGKRPKAVNVRTAPHPAFPTDMQAQFTLLNLVAEGTGFITETVFENRFMHVPELSRMGAHAEIESNTVICHGVEKLSGAQVMATDLRASASLVLAGCIAEGTTVVDRIYHIDRGYERIEDKLRALGANIERVKGE

SEQ ID NO: 7507 - DNA, 270 bp, Escherichia coli
atgattgaagatcccatggaaaataatgaaattcagagcgtgttgatgaacgctctctccctccaggaagtccacgtttccggcgatggcagccactttcaggttattgccgtgggtgagttgtttgacggcatgagtcgggttaaaaaacagcagacggtctatggcccgctgatggaatatattgcggataaccgcattcatgctgtgtcgatcaaagcgtatacccctgcggagtgggcgcgcgatcgcaaactgaacggcttttga

SEQ ID NO: 7508 - protein, 89 aa, Escherichia coli
MIEDPMENNEIQSVLMNALSLQEVHVSGDGSHFQVIAVGELFDGMSRVKKQQTVYGPLMEYIADNRIHAVSIKAYTPAEWARDRKLNGF

SEQ ID NO: 7509 - DNA, 294 bp, Escherichia coli
atgagcgagtcactgagctggatgcagacgggtgacacgctggcgttatccggagagctggatcaggacgttctgctaccgctttgggaaatacgtgaggaagcggtgaaggggattaccagcatcgatcttagccgtgtgtctcgcgtggatacgggtggactggcactgctgctccatcttatcgatctggcgaaaaagcagggcaacaatgtgacgcttcagggggtaaacgacaaagtgtataccctggcgaaattgtataatttgcctgctgatgttctgcctcgttaa

SEQ ID NO: 7510 - protein, 97 aa, Escherichia coli
MSESLSWMQTGDTLALSGELDQDVLLPLWEIREEAVKGITSIDLSRVSRVDTGGLALLLHLIDLAKKQGNNVTLQGVNDKVYTLAKLYNLPADVLPR

SEQ ID NO: 7511 - DNA, 636 bp, Escherichia coli
atgtttaaacgtttaatgatggtcgctttgctggtgattgcaccgctgagtgcggcaaccgcggcagaccagaccaatccgtataagctgatggacgaggcggcgcagaaaacgttcgatcgcctgaagaatgagcaaccgcaaattcgggccaacccggattatctgcgtaccattgttgatcaggaactgttgccatacgtacaggtgaaatacgccggtgcgctggtgctgggccagtattacaagagtgcgaccccagctcaacgtgatgcttactttgccgctttccgtgagtacctgaagcaggcttacggtcaggcgctggcgatgtatcacggtcaaacctatcagattgcaccagaacagccgctgggtgataaaatcattgtgccgattcgcgttaccattattgacccgaatggccgcccgccggtgcgtctggacttccagtggcgtaaaaactcccagacgggcaactggcaggcttacgacatgattgctgaaggcgtcagtatgatcaccaccaaacaaaacgagtggggaacgctgctgcgtaccaaaggtatcgacggcctgactgcgcaactgaaatcgatttctcaacagaaaatcactctggaagagaaaaaataa

SEQ ID NO: 7512 - protein, 211 aa, Escherichia coli
MFKRLMMVALLVIAPLSAATAADQTNPYKLMDEAAQKTFDRLKNEQPQIRANPDYLRTIVDQELLPYVQVKYAGALVLGQYYKSATPAQRDAYFAAFREYLKQAYGQALAMYHGQTYQIAPEQPLGDKIIVPIRVTIIDPNGRPPVRLDFQWRKNSQTGNWQAYDMIAEGVSMITTKQNEWGTLLRTKGIDGLTAQLKSISQQKITLEEKK

SEQ ID NO: 7513 - DNA, 636 bp, Escherichia coli
gtgactcgctcattattttttctcttccagagtgattttctgttgagaaatcgatttcagttgcgcagtcaggccgtcgatacctttggtacgcagcagcgttccccactcgttttgtttggtggtgatcatactgacgccttcagcaatcatgtcgtaagcctgccagttgcccgtctgggagtttttacgccactggaagtccagacgcaccggcgggcggccattcgggtcaataatggtaacgcgaatcggcacaatgattttatcacccagcggctgttctggtgcaatctgataggtttgaccgtgatacatcgccagcgcctgaccgtaagcctgcttcaggtactcacggaaagcggcaaagtaagcatcacgttgagctggggtcgcactcttgtaatactggcccagcaccagcgcaccggcgtatttcacctgtacgtatggcaacagttcctgatcaacaatggtacgcagataatccgggttggcccgaatttgcggttgctcattcttcaggcgatcgaacgttttctgcgccgcctcgtccatcagcttatacggattggtctggtctgccgcggttgccgcactcagcggtgcaatcaccagcaaagcgaccatcattaa

SEQ ID NO: 7514 - protein, 211 aa, Escherichia coli
MTRSLFFLFQSDFLLRNRFQLRSQAVDTFGTQQRSPLVLFGGDHTDAFSNHVVSLPVARLGVFTPLEVQTHRRAAIRVNNGNANRHNDFITQRLFWCNLIGLTVIHRQRLTVSLLQVLTESGKVSITLSWGRTLVILAQHQRTGVFHLYVWQQFLINNGTQIIRVGPNLRLLILQAIERFLRRLVHQLIRIGLVCRGCRTQRCNHQQSDHH

SEQ ID NO: 7515 - DNA, 552 bp, Escherichia coli
atgcaaacgaaaaaaaatgaaatttgggtgggtatctttttattagcagcactgcttgcggcgctgtttgtttgcctgaaggcagcgaacgtgacgtctatacgtactgaaccgacctatacgctttatgcgacgttcgataacattggcggcctgaaagcccgctctccggtcagcattggtggcgttgttgtgggccgggtggcggatattacgctggacccgaaaacctatctgccgcgcgtaacgctggaaattgaacaacgttataaccacattcctgataccagttcgctgagcattcgtacttccggcttgctgggggaacaatatctggcattaaacgtcggttttgaagacccggaactgggaactgctatcctgaaggatggcgatacaattcaggacaccaagtctgcgatggtgctggaagatctcattggtcagttcctttacggtagtaaaggcgatgacaataagaatagtggcgatgcgccagctgctgcgccaggtaataatgaaaccactgaacctgtgggtacaacgaaataa

SEQ ID NO: 7516 - protein, 183 aa, Escherichia coli
MQTKKNEIWVGIFLLAALLAALFVCLKAANVTSIRTEPTYTLYATFDNIGGLKARSPVSIGGVVVGRVADITLDPKTYLPRVTLEIEQRYNHIPDTSSLSIRTSGLLGEQYLALNVGFEDPELGTAILKDGDTIQDTKSAMVLEDLIGQFLYGSKGDDNKNSGDAPAAAPGNNETTEPVGTTK

SEQ ID NO: 7517 - DNA, 783 bp, Escherichia coli
atgctgttaaatgcgctggcgtcgctcggacataaagggattaaaaccctgagaacgttcgggcgggccgggttaatgttattcaatgcgctggtcggcaaaccggaatttcgcaaacatgcaccgctgctggtgcgccagctctataatgtcggcgtcctgtcgatgctgattattgtggtttctggcgtgttcatcggaatggtgttggggctgcaaggttatctggttctgaccacttatagtgcggaaaccagtctgggtatgctggtggcgttatcgctactgcgtgaactggggccggtggttgccgcgttgttgtttgccgggcgtgctggttcggcgctaaccgcagaaatcggcctgatgcgcgctacagagcaactctccagtatggagatgatggcggtggatccgctgcgtcgggttatttctccccgtttctgggctggagttatttcattaccactgttgacggttatcttcgtcgccgtggggatctggggcggatcgctggtcggcgtcagttggaaaggcattgatagtgggttcttctggtcggcaatgcaaaatgccgtcgactggcgtatggatctcgtcaactgtctgattaagagcgtggtgttcgccatcacggtgacgtggatttcgttgtttaacggctacgacgccatcccgacgtctgccgggattagccgggcaaccactcgcaccgttgtccactcgtctctggctgttctggggctggattttgtgctgaccgcattgatgtttgggaattga

SEQ ID NO: 7518 - protein, 260 aa, Escherichia coli
MLLNALASLGHKGIKTLRTFGRAGLMLFNALVGKPEFRKHAPLLVRQLYNVGVLSMLIIVVSGVFIGMVLGLQGYLVLTTYSAETSLGMLVALSLLRELGPVVAALLFAGRAGSALTAEIGLMRATEQLSSMEMMAVDPLRRVISPRFWAGVISLPLLTVIFVAVGIWGGSLVGVSWKGIDSGFFWSAMQNAVDWRMDLVNCLIKSVVFAITVTWISLFNGYDAIPTSAGISRATTRTVVHSSLAVLGLDFVLTALMFGN

SEQ ID NO: 7519 - DNA, 810 bp, Escherichia coli
atggagcagtctgtggcgaatttagtcgatatgcgcgatgtcagttttacgcgtggcaatcgctgcatcttcgataatatttccctgaccgtgccgcgagggaagatcacggcgatcatggggccatcgggcatcggtaaaacgacgctactccgtctgattggcgggcaaatcgcaccagatcatggtgagattcttttcgatggtgagaatattccggcgatgtctcgttcgcgcctgtatacagtgcgcaaacggatgagcatgttatttcagtccggggcgttgttcactgatatgaacgtatttgacaacgtcgcctatccactgcgggaacatacccaacttcccgcgccattgttgcatagtacggtgatgatgaagctggaggccgtggggctgcgtggagcggctaaacttatgccttctgaactttccggtgggatggcgcggcgtgcagcgctggcacgtgcgattgcgctggagccggatctcatcatgtttgatgagccctttgttgggcaagatcccattaccatgggcgtgctggtgaagctgatttctgagctgaacagcgcgctgggcgtgacttgtgtggtggtttctcacgatgtgccggaagtgttaagtattgcggatcacgcctggatcctggcggacaaaaaaattgtcgctcatggcagtgcccaggcgttgcaggcgaatcctgatccgcgcgtacgtcagtttctggacgggatagctgacgggcctgttccgttccgctatcctgccggcgattatcacgctgatcttttaccagggagttaa

SEQ ID NO: 7520 - protein, 269 aa, Escherichia coli
MEQSVANLVDMRDVSFTRGNRCIFDNISLTVPRGKITAIMGPSGIGKTTLLRLIGGQIAPDHGEILFDGENIPAMSRSRLYTVRKRMSMLFQSGALFTDMNVFDNVAYPLREHTQLPAPLLHSTVMMKLEAVGLRGAAKLMPSELSGGMARRAALARAIALEPDLIMFDEPFVGQDPITMGVLVKLISELNSALGVTCVVVSHDVPEVLSIADHAWILADKKIVAHGSAQALQANPDPRVRQFLDGIADGPVPFRYPAGDYHADLLPGS

SEQ ID NO: 7521 - DNA, 708 bp, Escherichia coli
atgcttttagctacggcactgttaattgttggtttacttttggtcgtttacagtgccgaccgcctggtttttgccgcgtctattctttgccgaacctttggcatcccgccgttgatcatcggcatgacggtggtcagtattggtacatcgttaccagaaatcatcgtctcgcttgccgcgtctttgcacgaacaacgcgatttagccgttggtacagccctcggctcaaacattatcaatatattgctgatcctcggtctggctgcgctggttcgtccttttaccgtccattctgatgttctacgccgtgaattacccttaatgttgttggtcagcgtggtggccggttccgtactctatgacggacaacttagtcgcagcgatggtatctttctcctctttctggctgtgctatggctgctgttcattgttaaacttgcacgtcaggctgaacgtcaggggactgacagcctgaccagagagcagcttgcagagctgccgcgtgaaggtggattgcccgtcgcatttttatggctcggcatcgcactgatcattatgccagtggccacgcggatggtagttgataacgccacggtgctggcgaattactttgccattagcgagttgacgatgggttctgacggcaattgctatcggaaccagcctgccggaactggcaaccgcaatagcgggggttcgcaaaggtga

SEQ ID NO: 7522 - protein, 235 aa, Escherichia coli
MLLATALLIVGLLLVVYSADRLVFAASILCRTFGIPPLIIGMTVVSIGTSLPEIIVSLAASLHEQRDLAVGTALGSNIINILLILGLAALVRPFTVHSDVLRRELPLMLLVSVVAGSVLYDGQLSRSDGIFLLFLAVLWLLFIVKLARQAERQGTDSLTREQLAELPREGGLPVAFLWLGIALIIMPVATRMVVDNATVLANYFAISELTMGSDGNCYRNQPAGTGNRNSGGSQR

SEQ ID NO: 7523 - DNA, 108 bp, Escherichia coli
gtgctggcggcgctccccgcaaccgggccgtggtgtaggggtattattaactggcggatttatcgtatggctggcgatgttgtactggttatcgccaatactcgttga

SEQ ID NO: 7524 - protein, 35 aa, Escherichia coli
MLAALPATGPWCRGIINWRIYRMAGDVVLVIANTR

SEQ ID NO: 7525 - DNA, 216 bp, Escherichia coli
gtgttgggtttacccgcgctgataacgccaggagagattgatccactggcgtacagtcgtgactacagcgtgatgttgctggtgagcattatttttgcgttgctgtgctggcggcgctccccgcaaccgggccgtggtgtaggggtattattaactggcggatttatcgtatggctggcgatgttgtactggttatcgccaatactcgttgaataa

SEQ ID NO: 7526 - protein, 71 aa, Escherichia coli
MLGLPALITPGEIDPLAYSRDYSVMLLVSIIFALLCWRRSPQPGRGVGVLLTGGFIVWLAMLYWLSPILVE

SEQ ID NO: 7527 - DNA, 1008 bp, Escherichia coli
ttgaataactggaaacgcattatgtcgcacgtagagttacaaccgggttttgactttcagcaagcaggtaaagaagtcctggcgattgaacgtgaatgcctggcggagcttgatcaatacatcaatcagaatttcacgcttgcctgtgaaaagatgttctggtgtaaagggaaagttgtcgtcatggggatggggaaatcggggcacatcgggcgcaaaatggcagcaacatttgccagcaccggtacaccttcatttttcgtccatcctggcgaagccgcgcatggtgatttaggcatggtcaccccacaggatgtggtgattgctatctctaactcaggtgaatccagcgaaatcacggccttaattccagtgcttaagcgtcttcacgtaccgttaatctgcatcaccggtcgcccggagagcagcatggcgcgcgccgcagatgtgcatctgtgtgttaaagtagcgaaagaagcctgtccgttagggctggcaccgaccagcagcacaaccgccacgttggttatgggcgatgccctcgctgtcgcgctgttaaaagcacgcggctttactgctgaagattttgcgctctcacacccaggcggcgcactgggtcgtaaacttctgctgcgcgtaaacgatattatgcatacgggcgatgagatcccgcatgttaagaaaacggccagtctgcgtgacgcattgctggaagttacccgcaaaaatcttggtatgactgtcatttgcgatgacaatatgatgattgaaggcatctttaccgacggtgatttacgccgtgtcttcgatatgggcgtggatgttcgtcagttaagtattgccgatgtgatgacgccggggggaatacgcgtgcgcccaggcattctggccgttgaggcactgaacttaatgcagtcccgccatatcacctccgtgatggttgccgatggcgaccatttactcggtgtgttacatatgcatgatttactgcgtgcaggcgtagtgtaa

SEQ ID NO: 7528 - protein, 335 aa, Escherichia coli
MNNWKRIMSHVELQPGFDFQQAGKEVLAIERECLAELDQYINQNFTLACEKMFWCKGKVVVMGMGKSGHIGRKMAATFASTGTPSFFVHPGEAAHGDLGMVTPQDVVIAISNSGESSEITALIPVLKRLHVPLICITGRPESSMARAADVHLCVKVAKEACPLGLAPTSSTTATLVMGDALAVALLKARGFTAEDFALSHPGGALGRKLLLRVNDIMHTGDEIPHVKKTASLRDALLEVTRKNLGMTVICDDNMMIEGIFTDGDLRRVFDMGVDVRQLSIADVMTPGGIRVRPGILAVEALNLMQSRHITSVMVADGDHLLGVLHMHDLLRAGVV

SEQ ID NO: 7529 - DNA, 567 bp, Escherichia coli
atgagcaaagcaggtgcgtcgcttgcgacctgttacggccctgtcagcgccgacgttatggcaaaagcagagaacattcgtctgctgatcctcgacgttgatggcgtactgtcagatggcctgatttatatgggcaataacggcgaagagctgaaagcgttcaatgttcgtgacggttatggcattcgttgtgcgctcacctctgatattgaagtcgctatcattaccgggcgaaaggctaaactggtagaagatcgttgtgccacattggggatcactcacttgtatcaggggcagtcaaacaaactgatcgcctttagcgatctgctggaaaaactggcgattgccccggaaaatgtggcttatgtcggcgatgatctcatcgactggccggtaatggaaaaagtgggtttaagcgtcgccgtggccgatgcgcatccactgttgatcccgcgcgccgattacgtgacgcgcattgctggcggtcgtggcgcagtgcgagaagtttgcgacttattactcctggcgcagggcaaactggatgaagccaaagggcaatcgatatga

SEQ ID NO: 7530 - protein, 188 aa, Escherichia coli
MSKAGASLATCYGPVSADVMAKAENIRLLILDVDGVLSDGLIYMGNNGEELKAFNVRDGYGIRCALTSDIEVAIITGRKAKLVEDRCATLGITHLYQGQSNKLIAFSDLLEKLAIAPENVAYVGDDLIDWPVMEKVGLSVAVADAHPLLIPRADYVTRIAGGRGAVREVCDLLLLAQGKLDEAKGQSI

SEQ ID NO: 7531 - DNA, 576 bp, Escherichia coli
atgagtaaagccagacgttgggttatcattgtgctatcactggcggttctggtgatgatcggcattaatatggccgaaaaagacgataccgcccaggtggtcgtcaacaacaatgatcccacctataaaagcgagcatacggacacgctcgtctataacccagaaggggcactaagctatcgattgattgctcaacacgttgaatattattccgatcaggccgtttcgtggtttacgcagccggtacttaccacgtttgataaggataaaatcccgacatggtccgtaaaagcagataaagccaagctgaccaatgaccggatgctctatttatatgggcacgttgaagtcaatgcactcgtgccggactctcaacttcgcagaatcacgacggataacgcgcagatcaatctggtgacgcaggatgttacctctgaagacctcgtcacgttatacggaacaacatttaactccagcggtctgaaaatgcgcggcaacttacgcagcaagaacgccgagctgattgaaaaggttagaacatcctatgaaattcaaaacaaacaaactcagccttaa

SEQ ID NO: 7532 - protein, 191 aa, Escherichia coli
MSKARRWVIIVLSLAVLVMIGINMAEKDDTAQVVVNNNDPTYKSEHTDTLVYNPEGALSYRLIAQHVEYYSDQAVSWFTQPVLTTFDKDKIPTWSVKADKAKLTNDRMLYLYGHVEVNALVPDSQLRRITTDNAQINLVTQDVTSEDLVTLYGTTFNSSGLKMRGNLRSKNAELIEKVRTSYEIQNKQTQP

SEQ ID NO: 7533 - DNA, 579 bp, Escherichia coli
ttgaaaaggttagaacatcctatgaaattcaaaacaaacaaactcagccttaatcttgtgcttgccagctcacttctggccgccagcattccggcatttgccgtaaccggagacactgatcagccgatccacattgaatcggaccagcaatctcttgatatgcaaggcaacgtggttacctttaccggcaatgtcatcgtcacccagggcaccatcaaaattaatgccgacaaagtggtcgttacccgtccgggcggcgaacaaggtaaagaagtgattgacggctacggtaaaccggcaacgttctaccagatgcaggacaacggtaaacccgttgaaggtcacgcttcacagatgcactacgaactggcaaaagattttgtcgttctgacgggtaatgcttatctgcagcaggtcgatagcaacattaagggcgataagatcacttacctggtgaaagagcagaaaatgcaggctttcagcgacaaaggcaagcgcgtaaccaccgttctggtgccgtcgcagctgcaggacaaaaacaataaaggccagaccccggcacagaagaagggtaattaa

SEQ ID NO: 7534 - protein, 192 aa, Escherichia coli
MKRLEHPMKFKTNKLSLNLVLASSLLAASIPAFAVTGDTDQPIHIESDQQSLDMQGNVVTFTGNVIVTQGTIKINADKVVVTRPGGEQGKEVIDGYGKPATFYQMQDNGKPVEGHASQMHYELAKDFVVLTGNAYLQQVDSNIKGDKITYLVKEQKMQAFSDKGKRVTTVLVPSQLQDKNNKGQTPAQKKGN

SEQ ID NO: 7535 - DNA, 726 bp, Escherichia coli
atggcaacattaactgcaaagaaccttgcaaaagcctataaaggccgtcgcgtggtagaagacgtcagcctgaccgtcaactccggggaaattgtcggtctgctggggccaaacggtgccggtaagaccaccactttctacatggttgttggcattgtgccgcgcgatgcgggcaacatcattattgatgatgacgatatcagtctgctgcctctgcatgcacgcgcgcgccgcggtatcggctatctgccgcaggaagcctccattttccgtcgcctcagcgtttacgataacctgatggcggtactgcaaattcgtgacgacttgtctgctgaacaacgtgaagaccgcgcgaacgagctgatggaagagtttcacattgagcacctgcgtgacagcatggggcagtcactctccgggggtgaacgtcgccgtgtagaaattgcccgcgcactggctgcgaatccgaaatttattctgctcgacgaaccgtttgccggggttgacccgatctcggttatcgacattaaacgcatcattgagcacctgcgcgacagcggcctgggcgtgctgatcactgaccacaacgtgcgtgaaacactggcggtttgtgaacgcgcttatatcgtcagtcaggggcatttgatcgcccacggcacgcctacagaaatcttacaagacgaacacgttaagcgtgtataccttggggaagacttcagactctga

SEQ ID NO: 7536 - protein, 241 aa, Escherichia coli
MATLTAKNLAKAYKGRRVVEDVSLTVNSGEIVGLLGPNGAGKTTTFYMVVGIVPRDAGNIIIDDDDISLLPLHARARRGIGYLPQEASIFRRLSVYDNLMAVLQIRDDLSAEQREDRANELMEEFHIEHLRDSMGQSLSGGERRRVEIARALAANPKFILLDEPFAGVDPISVIDIKRIIEHLRDSGLGVLITDHNVRETLAVCERAYIVSQGHLIAHGTPTEILQDEHVKRVYLGEDFRL

SEQ ID NO: 7537 - DNA, 1434 bp, Escherichia coli
atgaagcaaggtttgcaactcaggcttagccaacaactggcgatgacgccacagctccaacaggcaattcgtctgttgcagttgtcgacgctggaacttcagcaggagctacagcaggcgctggagagcaatccgctgcttgagcaaatcgacactcatgaagaaatcgacacccgcgaaacgcaagacagtgaaacactggacaccgccgacgcgctcgaacaaaaagagatgccggaagagctgccgctcgatgccagttgggacaccatttacaccgctggtacaccatccggcaccagcggtgactacattgacgacgagctgccggtctatcagggcgaaacgacacagaccttacaggattacctgatgtggcaggtcgagttgacaccattttccgacactgaccgcgcgattgctacctctatcgtcgatgccgttgatgacaccggttatctgactgtcccgctggaagatattctcgaaagtatgggcgatgaagagattgacatcgacgaagttgaagccgtccttaagcggatccaacggtttgatccggtcggtgtggcggcaaaagatctgcgtgactgcctgctgatccaactctcccaattcgataagaccacgccatggctggaagaggccagactgatcattagcgatcatctcgatctattagccaatcacgacttccgcactttaatgcgcgtcacgcgtctgaaagaagatgtgctgaaagaagccgtcaatctgatccagtcgctcgatccgcgccccgggcagtcgatccagactggcgaacctgagtatgtcattccagatgtgctggtgcgtaagcataacggtcactggacggtagaactcaacagtgacagcattccgcgtttgcaaatcaaccagcactacgcctcgatgtgcaataacgcgcgcaacgatggtgatagccagtttatccgcagcaatctgcaggatgccaaatggttgatcaagagtctggaaagccgtaacgatacgctactgcgcgtgagtcgctgtatcgttgaacagcagcaagccttctttgagcaaggcgaagaatatatgaaaccgatggtactggctgatatcgcccaggccgtcgagatgcatgaatcgacgatatctcgcgtgaccacgcaaaaatacctgcatagtccacgaggcatttttgaactgaagtatttcttttccagtcacgtcaatactgaaggcgggggtgaagcctcttccacagcgattcgcgcactggtgaagaaattaatcgcggcggaaaacccagcgaaaccgttgagcgacagcaagttaacctctttgctgtcggaacaaggtatcatggtggcacgccgcactgttgcgaagtaccgagagtctttatccattccgccgtcaaaccagcgtaaacagctcgtttga

SEQ ID NO: 7538 - protein, 477 aa, Escherichia coli
MKQGLQLRLSQQLAMTPQLQQAIRLLQLSTLELQQELQQALESNPLLEQIDTHEEIDTRETQDSETLDTADALEQKEMPEELPLDASWDTIYTAGTPSGTSGDYIDDELPVYQGETTQTLQDYLMWQVELTPFSDTDRAIATSIVDAVDDTGYLTVPLEDILESMGDEEIDIDEVEAVLKRIQRFDPVGVAAKDLRDCLLIQLSQFDKTTPWLEEARLIISDHLDLLANHDFRTLMRVTRLKEDVLKEAVNLIQSLDPRPGQSIQTGEPEYVIPDVLVRKHNGHWTVELNSDSIPRLQINQHYASMCNNARNDGDSQFIRSNLQDAKWLIKSLESRNDTLLRVSRCIVEQQQAFFEQGEEYMKPMVLADIAQAVEMHESTISRVTTQKYLHSPRGIFELKYFFSSHVNTEGGGEASSTAIRALVKKLIAAENPAKPLSDSKLTSLLSEQGIMVARRTVAKYRESLSIPPSNQRKQLV

SEQ ID NO: 7539 - DNA, 288 bp, Escherichia coli
atgcagctcaacattaccggaaataacgtcgagatcaccgaggcactgcgcgaatttgttacagccaaatttgccaaacttgagcaatattttgaccgaatcaaccaggtctatgttgttctgaaagtggagaaggtcacccacacctcagatgcaacactgcatgtaaacggtggtgaaattcatgccagcgcggaaggtcaggacatgtacgctgccattgatggcttaattgataagctggcacgccagttgaccaaacataaagataaactgaaacaacactaa

SEQ ID NO: 7540 - protein, 95 aa, Escherichia coli
MQLNITGNNVEITEALREFVTAKFAKLEQYFDRINQVYVVLKVEKVTHTSDATLHVNGGEIHASAEGQDMYAAIDGLIDKLARQLTKHKDKLKQH

SEQ ID NO: 7541 - DNA, 492 bp, Escherichia coli
atgacaaataatgatacaactctacagcttagcagtgttcttaacagggaatgtacgcgaagccgcgtccactgtcagagcaaaaaacgcgccctggaaatcatcagcgagctggcggcgaaacaacttagcctggcgccccaggtggtttttgaagctatcctgacgcgggaaaaaatgggcagtaccggtatcggcaatggtattgccattccgcatggcaaactggaagaagatactctgcgtgccgttggcgttttcgttcagctcgaaacgcctatagctttcgatgccatcgacaaccaaccggtagacttactttttgccctgctggtgccggcagaccaaactaaaacgcacctgcatactctgtcgctggtagcgaaacgtctggcggacaaaaccatctgccgccgtttacgcgcagcccagagcgatgaagagctgtatcaaatcattacggataccgaaggtactccggatgaagcgtag

SEQ ID NO: 7542 - protein, 163 aa, Escherichia coli
MTNNDTTLQLSSVLNRECTRSRVHCQSKKRALEIISELAAKQLSLAPQVVFEAILTREKMGSTGIGNGIAIPHGKLEEDTLRAVGVFVQLETPIAFDAIDNQPVDLLFALLVPADQTKTHLHTLSLVAKRLADKTICRRLRAAQSDEELYQIITDTEGTPDEA

SEQ ID NO: 7543 - DNA, 855 bp, Escherichia coli
atggtactgatgatcgtcagcggacgttcaggttcaggtaaatctgtcgccctgcgtgcgctggaagatatgggtttttactgcgtggataaccttcccgtagtgttgttacccgatctggctcgaactctggccgatcgagagatttctgccgccgtcagcattgatgttcgtaatatgccggagtcaccagaaatattcgaacaggcgatgagtaacctgcctgacgctttctcaccgcaactactgttcctggatgccgaccgtaataccttaattcgtcgttacagtgacacgcgccgactgcatccgctttccagcaaaaacctgtcgctggaaagtgctatcgacaaagaaagcgatttgctggagcctctgcgttcgcgagcggatctgattgtcgatacctcagaaatgtccgttcacgagctggcagaaatgctgcgtacccgtctgctgggtaaacgtgaacgtgaactgaccatggtctttgagtctttcggcttcaaacacggtatccctatcgatgcagattacgtctttgacgtgcgcttcttgccgaacccgcactgggatccgaaactgcgcccaatgacaggtcttgataaacctgtcgccgcgttcctcgaccgccacacagaagtacacaattttatctaccagacgcgaagctatcttgagctatggttacctatgctggaaaccaacaaccgtagctacctgacggtcgccattggttgtaccggcgggaagcaccgttcggtgtatattgcagagcaactggcagactacttccgctcgcgcggtaaaaacgtccagtcacgccatcggacgctggaaaaacgtaaaccatga

SEQ ID NO: 7544 - protein, 284 aa, Escherichia coli
MVLMIVSGRSGSGKSVALRALEDMGFYCVDNLPVVLLPDLARTLADREISAAVSIDVRNMPESPEIFEQAMSNLPDAFSPQLLFLDADRNTLIRRYSDTRRLHPLSSKNLSLESAIDKESDLLEPLRSRADLIVDTSEMSVHELAEMLRTRLLGKRERELTMVFESFGFKHGIPIDADYVFDVRFLPNPHWDPKLRPMTGLDKPVAAFLDRHTEVHNFIYQTRSYLELWLPMLETNNRSYLTVAIGCTGGKHRSVYIAEQLADYFRSRGKNVQSRHRTLEKRKP

SEQ ID NO: 7545 - DNA, 273 bp, Escherichia coli
atgaccgtcaagcaaactgttgaaatcacaaacaagctgggcatgcatgcccggcctgcaatgaagctgtttgaattaatgcagggttttgacgctgaagtgctgttacgtaatgacgaaggcaccgaggctgaagccaacagcgttattgcgctgctgatgttggattctgccaaaggacggcagattgaagttgaagcgaccggtccacaggaagaggaagcactggccgccgttatcgccctctttaactctggttttgatgaagattaa

SEQ ID NO: 7546 - protein, 90 aa, Escherichia coli
MTVKQTVEITNKLGMHARPAMKLFELMQGFDAEVLLRNDEGTEAEANSVIALLMLDSAKGRQIEVEATGPQEEEALAAVIALFNSGFDED

SEQ ID NO: 7547 - DNA, 633 bp, Escherichia coli
atgattcgcttatctgaacaaagtcccctgggcaccggaagacatcggaaatgttatgcgcatccggaagatgcccaacgctgtatcaagattgtctaccatcgtggcgatggtggcgataaagagatccgccgtgagttaaagtactacgcgcatcttggtcgccggttaaaagactggagtggaataccgcgctatcacggtaccgttgagacggattgcggaaccggttatgtctacgatgtgattgccgatttcgacggcaagccttccattacgctgaccgaatttgcagaacaatgccgttacgaagaagacattgcacaactgcgccagttactgaaacagctgaagcgttatttgcaggataaccgtatcgtgacgatgtcgctgaagccgcagaatatcctctgtcaccgcatcagtgagtcagaggttacccccgtcgtctgcgacaacattggtgaaagcacattgattccactggcgacctggtcgaagtggtgttgtctgcgtaagcaagagcggttatggaaacgatttatcgcccaaccggcgctggctattgccctgcagaaagatctgcaacctcgtgagagcaaaacgctggccctcacttcgcgcgaagcttaa

SEQ ID NO: 7548 - protein, 210 aa, Escherichia coli
MIRLSEQSPLGTGRHRKCYAHPEDAQRCIKIVYHRGDGGDKEIRRELKYYAHLGRRLKDWSGIPRYHGTVETDCGTGYVYDVIADFDGKPSITLTEFAEQCRYEEDIAQLRQLLKQLKRYLQDNRIVTMSLKPQNILCHRISESEVTPVVCDNIGESTLIPLATWSKWCCLRKQERLWKRFIAQPALAIALQKDLQPRESKTLALTSREA

SEQ ID NO: 7549 - DNA, 633 bp, Escherichia coli
ttgtttagcgttgcgcctgttcctttctcagcggtaatggtcgagcggcaagtcagcgcctggctgcatggcaattttcgttacgtggcacattctgactgggtcagtatggatcaaatctcgccgtggatgggactggcggtgattgccgcagaagatcagaaatttcctgagcactggggctttgatgtcgcttccattgagcaagccctggcgcacaacgagcgcaatgaaaaccgtattcgcggtgcttcaacgatttctcagcagacagccaaaaatctctttttatgggatgggcgtagctgggttcgaaaagggctggaagccggattaacgctggggatagaaacagtctggagcaaaaagcgtatcctgacggtttacctgaatatcgccgaatttggcgacggtgtgtttggcgtcgaagctgcggcacaacgttatttccacaaacccgcgagcaaacttacccggtcggaagctgcattgctggcagctgtattacctaatccacttcgtttcaaagtctccgcgccatcgggctacgtgcgtagccgtcaggcgtggattttacggcagatgtatcagttaggcggtgagccgtttatgcaacaacaccagcttgattaa

SEQ ID NO: 7550 - protein, 210 aa, Escherichia coli
MFSVAPVPFSAVMVERQVSAWLHGNFRYVAHSDWVSMDQISPWMGLAVIAAEDQKFPEHWGFDVASIEQALAHNERNENRIRGASTISQQTAKNLFLWDGRSWVRKGLEAGLTLGIETVWSKKRILTVYLNIAEFGDGVFGVEAAAQRYFHKPASKLTRSEAALLAAVLPNPLRFKVSAPSGYVRSRQAWILRQMYQLGGEPFMQQHQLD

SEQ ID NO: 7551 - DNA, 654 bp, Escherichia coli
atgaagaaaattggcgtaattctgagcggatgcggcgtctatgacggttctgaaattcatgaagcggtgttgacgttgttagctatttcacgcagcggtgcgcaggcggtctgctttgcaccggataagcagcaggttgatgttatcaaccatttaactggtgaagcgatgacggaaacgcgcaatgtgctgattgaagcggcacgaataacgcgcggtgaaatccgtcctctggcccaggccgatgccgctgaactggatgcgttgattgtgccggggggttttggcgcggtgaagaatttaagcaattttgccagtcttggtagcgaatgcaccgttgaccgtgaattaaaggcgctggcacaagcgatgcatcaggccggaaaaccgcttggttttatgtgtatagcaccggcgatactgccgaaaattttcgatttcccgctgcgtttgaccatcggtactgatatcgataccgcagaagtgctggaagagatgggcgcggagcatgtgccgtgtcctgtcgatgatatcgtggttgatgaagacaataagattgtcaccaccccggcatatatgctggcgcagaacattgcagaagcggcgagcggcattgataagctggtttcccgcgtgctggttctggctgaatga

SEQ ID NO: 7552 - protein, 217 aa, Escherichia coli
MKKIGVILSGCGVYDGSEIHEAVLTLLAISRSGAQAVCFAPDKQQVDVINHLTGEAMTETRNVLIEAARITRGEIRPLAQADAAELDALIVPGGFGAVKNLSNFASLGSECTVDRELKALAQAMHQAGKPLGFMCIAPAILPKIFDFPLRLTIGTDIDTAEVLEEMGAEHVPCPVDDIVVDEDNKIVTTPAYMLAQNIAEAASGIDKLVSRVLVLAE

SEQ ID NO: 7553 - DNA, 2337 bp, Escherichia coli
atgaagcaaattcgtctgctggcgcagtattatgttgacctgatgatgaagttaggtctggtgcgcttctcaatgttgctggcgctggccctcgtcgttcttgccattgtggtacaaatggcggtaaccatggtgctgcatggtcaggtcgaaagcattgatgttattcgttctatcttctttggtttgctgattacgccgtgggcggtctactttctatcggtggtcgtcgagcaactggaggagtcacgacaacgtctgtcacgactggtgcaaaaactggaggagatgcgcgagcgcgatttgagcctcaacgttcagttaaaagataatattgcccagctaaatcaggaaatcgccgttcgtgaaaaagcggaagcagaactgcaggaaaccttcggccaactgaaaattgaaatcaaagagcgcgaagagacacaaattcagctcgagcagcaatcctcattcttacgttccttccttgacgcttcacccgacctggttttttatcgtaacgaagataaagagttttccggctgtaaccgcgcgatggagctgctgaccggaaaaagcgaaaaacaactggttcacctgaaacctgctgatgtttactcaccggaagccgctgcgaaagtcattgaaaccgatgaaaaagtgttccgtcataatgtgtcactgacctatgagcagtggctggattatcccgacggacgcaaagcctgctttgaaatccgtaaagtaccgtactacgaccgcgtgggtaaacgtcacggtttgatgggctttggtcgcgacattaccgagcgtaagcggtatcaggatgcgcttgagcgcgccagccgcgacaaaacgacgtttatctccaccatcagtcacgaattgcgtacaccgctgaacggtatcgtcggcctgagccgcattctgctggatactgaactcaccgccgagcaggaaaaatatctcaaaaccatccatgtttcggctgtcacgttggggaatatcttcaacgatattatcgacatggataagatggaacggcgcaaggtccagcttgataatcagccggttgatttcaccagcttccttgccgatctggaaaatctctccgcattgcaggcgcaacaaaaaggattgcgctttaatctggagccgacgctgccattaccgcatcaggtcattaccgacgggacgcgtttacggcagatcttgtggaacctcatcagtaacgccgtcaaattcactcagcaaggccaggttaccgtgcgcgtgcgctacgatgaaggcgatatgctgcattttgaagtggaagactctggtatcggcattccgcaggatgagctggataaaatcttcgccatgtattaccaggtgaaagacagtcatggcggtaaacctgccaccggcaccggtattggtctggccgtttctcgtcgtctggcgaaaaatatgggcggcgatattacggttaccagcgaacagggcaaaggttcaacctttacgttgacgatccacgcaccgtcggtagcagaagaggttgatgatgcgtttgatgaagacgatatgcctttaccggcgctgaatgtgctgctggtggaagacattgaactgaacgtgattgtcgcgcgctctgtgctggaaaagttaggtaacagcgttgatgtcgccatgaccggcaaggcggcgctggagatgtttaaaccgggcgaatacgacctggtgttgctggatattcagttgccagatatgaccgggctggatatctctcgtgaactgacgaagcgttatccgcgcgaggatttaccgccgctggtggccttaaccgctaacgtgctgaaagacaaacaagagtacctcaatgctggaatggatgatgtgctgagtaagccgctttctgttccggcgctaaccgcgatgatcaagaaattctgggatacccaggatgatgaggagagtacggtgacgacagaagagaacagtaaatcagaagcattgctcgatattcccatgctggaacagtatctcgaacttgtaggaccgaagctgatcaccgacgggttagcggtgtttgagaggatgatgccgggctatgtcagcgtgctggagtcgaatctgacggcgcaggataaaaaaggcattgttgaggaagggcataaaattaaaggtgcggcggggtcagtggggttacgccatctgcaacagctgggtcagcaaattcagtctcctgaccttcccgcctgggaagataacgtcggtgaatggattgaagagatgaaagaagagtggcgtcacgacgtagaagtactgaaagcgtgggtggcaaaagccactaaaaaatga

SEQ ID NO: 7554 - protein, 778 aa, Escherichia coli
MKQIRLLAQYYVDLMMKLGLVRFSMLLALALVVLAIVVQMAVTMVLHGQVESIDVIRSIFFGLLITPWAVYFLSVVVEQLEESRQRLSRLVQKLEEMRERDLSLNVQLKDNIAQLNQEIAVREKAEAELQETFGQLKIEIKEREETQIQLEQQSSFLRSFLDASPDLVFYRNEDKEFSGCNRAMELLTGKSEKQLVHLKPADVYSPEAAAKVIETDEKVFRHNVSLTYEQWLDYPDGRKACFEIRKVPYYDRVGKRHGLMGFGRDITERKRYQDALERASRDKTTFISTISHELRTPLNGIVGLSRILLDTELTAEQEKYLKTIHVSAVTLGNIFNDIIDMDKMERRKVQLDNQPVDFTSFLADLENLSALQAQQKGLRFNLEPTLPLPHQVITDGTRLRQILWNLISNAVKFTQQGQVTVRVRYDEGDMLHFEVEDSGIGIPQDELDKIFAMYYQVKDSHGGKPATGTGIGLAVSRRLAKNMGGDITVTSEQGKGSTFTLTIHAPSVAEEVDDAFDEDDMPLPALNVLLVEDIELNVIVARSVLEKLGNSVDVAMTGKAALEMFKPGEYDLVLLDIQLPDMTGLDISRELTKRYPREDLPPLVALTANVLKDKQEYLNAGMDDVLSKPLSVPALTAMIKKFWDTQDDEESTVTTEENSKSEALLDIPMLEQYLELVGPKLITDGLAVFERMMPGYVSVLESNLTAQDKKGIVEEGHKIKGAAGSVGLRHLQQLGQQIQSPDLPAWEDNVGEWIEEMKEEWRHDVEVLKAWVAKATKK

SEQ ID NO: 7555 - DNA, 963 bp, Escherichia coli
ttggcctcttttcaaggcgcggtctatcagattatgcagttacagaaattagtcaatatgtttggtggtgatctcacccgtcgttatgggcaaaaggtgcataagctgacgctgcatggcggttttagctgccctaaccgtgacggtaccatcgggcgtggcggctgcacattctgtaatgttgcctcgtttgccgatgaagcgcagcagcatcgttccattgccgagcaactggcgcaccaggcgaatttagttaaccgcgctaaacgctatctggcctactttcaggcgtataccagcacctttgcggaagttcaggtgctgcgttcgatgtatcagcaggcggtgagccaggccaatattgtcggtttgtgtgttggtacccgcccggactgcgtgccggatgcggtgctggatctgctttgcgaatataaggaccagggctacgaagtgtggctggagctggggctacaaaccgcccacgacaaaacactgcatcgcatcaatcgcggtcatgattttgcctgctatcagcgcacgacgcagctggcgcgtgagcgtgggctgaaggtgtgttctcacttaattgttggcctgcctggcgaagggcaggctgaatgtttgcaaacgctggagcgagtggttgaaaccggcgtggacggcataaagctgcatccgctgcatatagtgaaaggcagcattatggcgaaagcctgggaagcggggcgtttgaacggaattgaactggaggattacacgctcactgccggagaaatgattcgccatacgccaccggaagtgatctaccaccgcatttccgccagcgcccgtcgcccgacgctgcttgctccgttgtggtgcgaaaatcgatggacgggaatggtcgagctggatcgttatctgaatgaacatggcgtacagggatcggcgctgggacgtccgtggctacctccaacggcgtag

SEQ ID NO: 7556 - protein, 320 aa, Escherichia coli
MASFQGAVYQIMQLQKLVNMFGGDLTRRYGQKVHKLTLHGGFSCPNRDGTIGRGGCTFCNVASFADEAQQHRSIAEQLAHQANLVNRAKRYLAYFQAYTSTFAEVQVLRSMYQQAVSQANIVGLCVGTRPDCVPDAVLDLLCEYKDQGYEVWLELGLQTAHDKTLHRINRGHDFACYQRTTQLARERGLKVCSHLIVGLPGEGQAECLQTLERVVETGVDGIKLHPLHIVKGSIMAKAWEAGRLNGIELEDYTLTAGEMIRHTPPEVIYHRISASARRPTLLAPLWCENRWTGMVELDRYLNEHGVQGSALGRPWLPPTA

SEQ ID NO: 7557 - DNA, 96 bp, Escherichia coli
gtgattgtgcatgaaatttcggtaattttgattgattatgcagttgataaaagcaggccgggacgattgatccaggtcatcgccgaattgggctaa

SEQ ID NO: 7558 - protein, 31 aa, Escherichia coli
MIVHEISVILIDYAVDKSRPGRLIQVIAELG

SEQ ID NO: 7559 - DNA, 4461 bp, Escherichia coli
atgttgtacgataaatcccttgagagggataactgtggtttcggcctgatcgcccacatagaaggcgaacctagccacaaggtagtgcgtactgcaatacacgcactggcccgcatgcagcaccgtggcgcgattctcgccgatggtaaaaccggtgacggttgcggcttgctgttacaaaaaccggatcgtttttttcgcatcgttgcgcaggagcgcggctggcgtttagcaaaaaactacgccgtcgggatgctcttcctgaataaagatcctgaactcgccgctgccgcacgccgcatcgttgaagaagagctgcaacgcgaaacgttgtcgattgtgggctggcgtgatgtccccactaacgaaggcgtgctgggtgaaatcgccctctcctctctgccacgcattgagcaaatttttgtgaacgccccggcaggctggcgtccgcgcgatatggagcgccgtctgtttatcgcccgccgccgcattgaaaagcgtctcgaagccgacaaagacttctacgtctgtagcctgtcgaatctggtcaatatttataaaggtctgtgtatgccggcggatctgccgcgcttctacctggacctcgctgacctgcgtctggaatcggccatctgcctgtttcaccagcgcttttccactaacaccgtaccgcgctggccgctggcgcagccgttccgctacctcgcgcataacggtgaaatcaacaccatcactggtaaccgccaatgggcgcgtgcgcgtacctataaattccagacgccgctgatccctgacctgcacgacgccgcgccgttcgtcaacgaaaccggctctgactccagttcgatggataacatgctggaactcctgctggcaggcgggatggatatcatccgtgccatgcgtctgttagtaccacccgcctggcagaacaacccggatatggacccggaactgcgtgccttctttgactttaactccatgcatatggagccgtgggatggtccggcagggatcgtgatgtccgatggccgtttcgccgcctgtaacctcgaccgtaacggtctgcgtccggcacgctacgtcatcaccaaagataaactgatcacctgcgcctctgaagtcggtatctgggattatcagcctgacgaagtggtcgaaaaaggccgcgtagggccaggcgaactgatggtgatcgacactcgcagtgggcgcattctacactcggcagaaaccgatgatgacctgaaaagccgccatccctataaagagtggatggagaaaaacgtccgccgtctggtaccgtttgaagatctgcccgatgaagaagtgggtagccgcgaactggacgacgacacgcttgccagctaccagaaacaatttaactacagcgcggaagagctggattcggtgatccgcgtactgggtgaaaacggtcaggaagcggtcggttcgatgggcgacgacaccccattcgccgtgctctccagccagccgcgcattatttacgactacttccgccagcagtttgctcaggtaaccaacccgccaatcgacccgctgcgcgaagcgcatgttatgtcgctcgccaccagtatcggtcgtgaaatgaacgtcttctgtgaagcagaaggccaggcgcaccgtttaagctttaaatcgccgattctgctctattccgatttcaaacagctcacgacgatgaaagaggatcactaccgcgcagatacgctggatatcacctttgacgtcactaaaaccacgctcgaagcgacggtgaaagagctgtgcgacaaagccgaaaaaatggtacgtagtggcaccgtgctgctggtgctctccgaccggaatatcgctaaagatcgcctgccggttccggctccgatggcggttggcgcgatccagacccgtcttgtcgagcaaagcctgcgttgcgatgccaacatcatcgtagaaaccgccagcgcccgtgatccgcaccacttcgccgtgttgctgggcttcggtgcgacggctatttatccgtaccttgcctatgaaacgctgggccgcctggtagacacccacgcgattgccaaagattatcgtaccgtgatgctcaactaccgtaacggcatcaacaaaggcttgtacaaaatcatgtccaaaatgggcatctccaccatcgcctcttaccgctgctcgaaactgtttgaagcggtcggtctgcacgatgatgtcgtaggcctgtgcttccagggcgcggttagccgcattggcggggcgagctttgaagacttccagcaggatctgctgaatctgtcgaaacgtgcctggctggcgcgcaagcccatcagccagggcggcctgctgaaatacgtgcacggcggcgaataccacgcctacaacccggacgtggtgcgcacactgcagcaggcggtacaaagcggcgagtatagcgactatcaggaatacgcgaagctggttaatgagcgtccggcaaccacgctacgcgatctgctggcaattacgccgggtgaaaacgcggtcaacattgctgatgttgaaccggcaagcgaactgtttaaacgcttcgataccgccgcgatgtctatcggcgcgttaagcccggaagcccacgaggcgctggcggaagcgatgaacagcatcggcggtaactcaaactccggcgaaggcggtgaagacccggcgcgctatggcactaacaaagtgtcgcgcatcaagcaggtggcgtccggtcgcttcggcgttactccggcgtatctggtcaatgccgacgtcattcagattaaagtcgcccagggcgcgaagccgggagaaggcggtcagttgccgggtgataaagtcactccttacattgccaaactgcgctattcggtgccgggcgtgacgctgatctccccgccgccgcaccatgatatctactctatcgaggacttagcgcagctcattttcgacctcaagcaggttaacccgaaagcgatgatctccgtgaagctggtgtccgaaccgggcgtcggcaccatcgcgaccggcgtggcgaaagcttatgcggacttgatcaccatcgcaggctatgacggcggcaccggcgcaagtccgctttcatcggtgaaatacgcaggctgtccgtgggaactcggcctggtggaaacccaacaggcgctggttgccaacggtttacgtcataaaattcgtttgcaggttgatggcggcctgaaaacgggcgttgatatcatcaaagcggcgattctcggcgcagaaagcttcggcttcggcactggcccaatggtcgcgctcggttgtaaatatctgcgaatttgccacctgaacaactgcgctacgggtgtagcaactcaggatgacaaactgcgtaagaatcactatcacggcctgccgttcaaagtgacgaattactttgagtttatcgcccgtgaaacccgcgagctgatggcacagctgggcgtaacacgtctggtggatctgattggtcgcaccgacctgctgaaagagctggacggtttcaccgccaaacagcagaaactggcgctgtcgaagctgctggagactgccgagccgcatccaggtaaggcgctctactgcaccgaaaacaacccgccgtttgataacggcctgctgaacgcgcagttgctgcaacaggcgaaaccgtttgttgatgaacgccagagcaaaaccttctggttcgatatccgcaacaccgaccgttctgtcggcgcatcgctttcaggctatatcgcccagacgcacggcgatcaggggctggcagccgatccgatcaaggcgtacttcaacggcaccgcaggccagagcttcggtgtgtggaacgcaggcggcgtggaactgtatctgaccggcgatgctaacgactatgtcggtaaaggcatggcgggcggcttaattgccattcgtcctccggttggctcagccttccgcagccatgaagcaagcattatcggcaacacctgcctgtatggcgcgaccggaggtcgtctgtatgccgcaggccgcgcgggtgaacgtttcggcgtgcgtaactccggtgctatcaccgtggtagaaggcattggcgacaacggctgtgaatatatgacgggcggtattgtctgtattctgggtaaaaccggcgttaacttcggcgcgggcatgaccggtggcttcgcttacgttctcgatgaaagcggcgatttccgcaaacgcgttaacccggaactggtcgaggtcttaagcgttgacgatttggcgatccatgaagagcatctgcgtggtcttatcaccgagcatgtgcagcataccggttcccagcgtggtgaagagattctggcgaactggtcaaccttcgccacgaaattcgcgctggttaaaccgaagtccagtgatgtaaaagcactgctgggtcaccgtagtcgtagcgcagcagagttgcgcgtgcaggcgcagtaa

SEQ ID NO: 7560 - protein, 1486 aa, Escherichia coli
MLYDKSLERDNCGFGLIAHIEGEPSHKVVRTAIHALARMQHRGAILADGKTGDGCGLLLQKPDRFFRIVAQERGWRLAKNYAVGMLFLNKDPELAAAARRIVEEELQRETLSIVGWRDVPTNEGVLGEIALSSLPRIEQIFVNAPAGWRPRDMERRLFIARRRIEKRLEADKDFYVCSLSNLVNIYKGLCMPADLPRFYLDLADLRLESAICLFHQRFSTNTVPRWPLAQPFRYLAHNGEINTITGNRQWARARTYKFQTPLIPDLHDAAPFVNETGSDSSSMDNMLELLLAGGMDIIRAMRLLVPPAWQNNPDMDPELRAFFDFNSMHMEPWDGPAGIVMSDGRFAACNLDRNGLRPARYVITKDKLITCASEVGIWDYQPDEVVEKGRVGPGELMVIDTRSGRILHSAETDDDLKSRHPYKEWMEKNVRRLVPFEDLPDEEVGSRELDDDTLASYQKQFNYSAEELDSVIRVLGENGQEAVGSMGDDTPFAVLSSQPRIIYDYFRQQFAQVTNPPIDPLREAHVMSLATSIGREMNVFCEAEGQAHRLSFKSPILLYSDFKQLTTMKEDHYRADTLDITFDVTKTTLEATVKELCDKAEKMVRSGTVLLVLSDRNIAKDRLPVPAPMAVGAIQTRLVEQSLRCDANIIVETASARDPHHFAVLLGFGATAIYPYLAYETLGRLVDTHAIAKDYRTVMLNYRNGINKGLYKIMSKMGISTIASYRCSKLFEAVGLHDDVVGLCFQGAVSRIGGASFEDFQQDLLNLSKRAWLARKPISQGGLLKYVHGGEYHAYNPDVVRTLQQAVQSGEYSDYQEYAKLVNERPATTLRDLLAITPGENAVNIADVEPASELFKRFDTAAMSIGALSPEAHEALAEAMNSIGGNSNSGEGGEDPARYGTNKVSRIKQVASGRFGVTPAYLVNADVIQIKVAQGAKPGEGGQLPGDKVTPYIAKLRYSVPGVTLISPPPHHDIYSIEDLAQLIFDLKQVNPKAMISVKLVSEPGVGTIATGVAKAYADLITIAGYDGGTGASPLSSVKYAGCPWELGLVETQQALVANGLRHKIRLQVDGGLKTGVDIIKAAILGAESFGFGTGPMVALGCKYLRICHLNNCATGVATQDDKLRKNHYHGLPFKVTNYFEFIARETRELMAQLGVTRLVDLIGRTDLLKELDGFTAKQQKLALSKLLETAEPHPGKALYCTENNPPFDNGLLNAQLLQQAKPFVDERQSKTFWFDIRNTDRSVGASLSGYIAQTHGDQGLAADPIKAYFNGTAGQSFGVWNAGGVELYLTGDANDYVGKGMAGGLIAIRPPVGSAFRSHEASIIGNTCLYGATGGRLYAAGRAGERFGVRNSGAITVVEGIGDNGCEYMTGGIVCILGKTGVNFGAGMTGGFAYVLDESGDFRKRVNPELVEVLSVDDLAIHEEHLRGLITEHVQHTGSQRGEEILANWSTFATKFALVKPKSSDVKALLGHRSRSAAELRVQAQ

SEQ ID NO: 7561 - DNA, 1419 bp, Escherichia coli
atgagtcagaatgtttatcaatttatcgacctgcagcgcgttgatccgccaaagaaaccgctgaagatccgcaaaattgagtttgttgaaatttacgagccgttttccgaaggccaggccaaagcgcaggctgaccgctgcctgtcgtgcggcaacccatactgcgagtggaaatgcccggtacacaactacatcccgaactggctgaagctcgccaacgaggggcgtatttttgaagcggcggaactgtcgcatcagaccaataccctgccggaagtgtgcggacgtgtctgcccgcaagaccgtctgtgcgaaggttcctgcaccctgaacgatgagtttggcgcagtgaccatcggcaacattgagcgctatatcaacgataaagcgttcgagatgggctggcgtccggatatgtccggcgtgaaacaaaccggtaaaaaagtggcgattatcggcgctggcccggcgggtctggcgtgcgcggatgtcctgacgcgcaacggcgtaaaagcggtcgtcttcgaccgtcacccggaaattggcggattgctgaccttcggtattccggccttcaagttagaaaaagaggtaatgacgcgccgccgtgaaatcttcaccggtatgggtattgaattcaaactcaataccgaagtgggccgcgacgtacagctggacgacctgctgagtgattacgatgccgtgttccttggcgtcgggacttatcagtcaatgcgcggcgggctggaaaacgaagacgccgatggcgtgtacgcagcgctgccgttccttatcgccaacaccaaacagttaatgggctttggtgaaaccaacgacgaaccgttcgtcagcatggaaggtaaacgcgtggtagtacttggcggtggcgataccgcgatggactgtgtgcgcacgtctgtacgccagggtgcaaagcacgttacctgtgcctatcgtcgtgatgaagagaacatgccaggttcccgccgcgaagtgaaaaacgcgcgggaagaaggtgtagagttcaaattcaacatccagccactggggattgaagtgaacggtaacggcaaagtcagcggcgtgaaaatggtgcgcacagaaatgggcgaaccggatgccaaaggccgtcgccgcgcggagatcgtggcagggtcagaacatatcgttccggcagatgcggtgatcatggcgtttggtttccgtccacacaacatggaatggctggcaaaacacagcgtcgagctggattcacaaggccgcatcatcgccccggaaggcagcgacaacgccttccagaccagcaacccgaaaatctttgctggcggcgatatcgtccgtggttccgatctggtcgttaccgccattgccgaaggtcgcaaagcggcggacggcattatgaactggctggaagtttaa

SEQ ID NO: 7562 - protein, 472 aa, Escherichia coli
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVKAVVFDRHPEIGGLLTFGIPAFKLEKEVMTRRREIFTGMGIEFKLNTEVGRDVQLDDLLSDYDAVFLGVGTYQSMRGGLENEDADGVYAALPFLIANTKQLMGFGETNDEPFVSMEGKRVVVLGGGDTAMDCVRTSVRQGAKHVTCAYRRDEENMPGSRREVKNAREEGVEFKFNIQPLGIEVNGNGKVSGVKMVRTEMGEPDAKGRRRAEIVAGSEHIVPADAVIMAFGFRPHNMEWLAKHSVELDSQGRIIAPEGSDNAFQTSNPKIFAGGDIVRGSDLVVTAIAEGRKAADGIMNWLEV

SEQ ID NO: 7563 - DNA, 465 bp, Escherichia coli
atgatgatgggtgaagtacagtcattaccgtctgccggattacatcctgcgttacaggacgcgttaacgttggcattagctgccagaccgcaagaaaaagcgcctggccgttacgaattacagggcgacaatatctttatgaatgtcatgacatttaatactcaatcgcctgttgagaaaaaagccgaattgcacgaacaatacattgatatccagctgttattaaacggtgaggaacggattctgtttggcatggcaggcactgcgcgtcagtgtgaagagttccaccatgaagatgattatcagctttgcagcgccattgaaaacgagcaagccatcatcctgaaaccgggaatgttcgccgtgtttatgccaggagaaccgcataaaccgggatgcgttgttggcgaacctggtgagattaaaaaggtggtagtgaagattaaggctgatttaatggcttaa

SEQ ID NO: 7564 - protein, 154 aa, Escherichia coli
MMMGEVQSLPSAGLHPALQDALTLALAARPQEKAPGRYELQGDNIFMNVMTFNTQSPVEKKAELHEQYIDIQLLLNGEERILFGMAGTARQCEEFHHEDDYQLCSAIENEQAIILKPGMFAVFMPGEPHKPGCVVGEPGEIKKVVVKIKADLMA
